United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 7

SEQ ID NO: 24932 - DNA, 1962 bp, Glycine max
  Peptide Sequence Number=SeqID_141710
atgaatgggtataagttgctcttaaacgtgcctgtgccttgtagttgtgagcgtggcattagcatttgcatgtacccattattgaagcaagcgcaaggtccttattcttctctttcatattgctctcttctcctaaaccactgtttatctaaaaaatcgcttaactttgtcaaaatcgtgcatgcccacttcctcaaattgggtcttaacacctacacatacttgggcaatcgctgtctcgacctttactctgagttcggccaccttaacgatgcaccgaaggtgtttgatgatatttcccataagaattccacgtcttggaacatttgcttgaaatggttgctcaaaagtggccagtttggcaaggcctgccacttgtttgatgcaatgcctgttagagatgtcgttacttggaactccatgatttcgggttatgcttcttgtgggtattttagtcatgccttggagctttttgttgaaatgcaaggcactggtgtaaggccaagtgggttcactttctccattttgatgtcactcgtgtcaagtccctctcatgctaagcagattcactctaggatgatcagaagtggggtggatttggataatgtagtgcttgggaattcgttgataactatgtatgggaggcttggtcttgttgaatattcttttggtgtgattatgactatgaagcagtttgatgtcatatcttggaactctttgatctgggcttgtcatagagctggacaccatgagttggctttggagcagttctattggatgagaggtgctgagtttttacctgatcaatttacgtgttcagtgttgatgagtgtctgttctaacttgcgagacttggacaagggtaagcaggtttttgccttttgtttcaagatgggatttgtttataatagcattgtatccagtgctgctattgacctcttttccaaatgcaacagattggaggattctgtgcggctctttaaggaacaagatcaatgggattcagctctatgcaattccatgatttcaagctatgctagacattatttaggggaagataccttgcaactttttgtgctgaccttgagaaagaatatcaggccaacagaatacatggttagctctctcctgagttctgtttcgatattcttacctgttgaagtgggtaatcaaatccattctttggttcctaaattgggttttgagtcagatgcagttgttgctaattcccttgtccatatgtatgctaaatttggatttattaatgatgccttgaatatcttcaatgaaatgaaaataaaagatttggtatcatggaacactataatgatgggattgacttactatggcagagtgtctttgaccatggacctctttagggaattattgactagagaaggcatgctaccagatcgaataacacttactgcggttctactagcatgcaactatgggttattggttgatgaaggaattgaaatattttcctcaatggagatggaattcagagtaaaaccaggagaagaacattatgcatgtgttgtggagatgttgtgtaaagctggtaagctcaaagaagccattgatatcatagaaacgatgccatatagaactacctctgacatttggaggtcaattttttctgcatgtgcaatttatggagacttgcaaattatagaaggggtggcgaagaaaataatggatatggaatcactgatatccttaccgtacttggtgttggctcaagcatatcaaatgaggggtagatgggattccatggttcgaatgaggaaggctgcagaaaatagaggttctaaagagttcattggacacagttggattggaataaaaaataatgtgtacacttttgcgtcaaatcaattacagcattatggtggcaaggatctttatctggtgttgaatttactggtctgggagatggagactgaaggttatgtctaa

SEQ ID NO: 24933 - DNA, 798 bp, Glycine max
  Peptide Sequence Number=SeqID_141711
atgtcgggggcagggcgggaaaaacccgaccccgatcggggacgaggatggggtgtaaatatacacccccgtcggtttcgggggtgggggtggggagggaaatggagagtcgggggcgggggtgggctcagcaacgtttctttgaaggttttggaccttgaattgtttagttcggataagtttatattggaggcggatttgcttgagaagcttcatttgaaatattgtagctttgaggtttttgagctgattgaaaaggggacattgaaggtgttgaaaattgatgatgtgagtgttatccatcttgatattggggatagtacagagaaccttgagatcatagatgtcagtaacttcacaatcatgtggccaaaattttctcatatgatctcaaaagcatcaaagttatataagctttggatgtggggtgtcgtttttgatgatgaggatgaggttgttgatatagagacaatttctgtttgctttcctcagttgacacatttgtccttaagctatgatttaagagatggagttcttcattatggcttgcagggtttgtcttgtttgatgaatgtggtggtgttagaacttggatggactgtaattagtgatcttttctcagtatgggtagctgcacttctggaaggttgtcccaatttgaaaaaattgatcatttatggttttgtttcagaggtcaaaacacacgaagagtgccaaattcttgccagattctctgaattcattcttcaacttggaagaaaatatgggcatgtaaagtttgagtttgaatatgagtag

SEQ ID NO: 24934 - DNA, 840 bp, Glycine max
  Peptide Sequence Number=SeqID_141712
gataattttattatttgtgcaaattgtttcaaaagtgggaattatggggagaaaaggtccgcagaggattttgtatttagtgagtcaagtgaaaatagtgtcaaacatgacactgtctggactgaggctgaaactcttctccttttagaatctgttttgaagcatggggatgattgggagcttgttgctcaaagtgttcaaaccaagaccaaacttgattgtatctcgaaactcattgagctgccctttggggagctcatgttgggccctactcacaaaaatgttaacattaacggtgctaatggcatcatgaacaatgccaaacaagttcaatcatcttcatctgacaaccaagaaatttcaaagacaaaggaccagactcctgagcttacaaatgaaaatgagcagaacggagatgcagtgaaggaaagtccttcaaaaagacagcgtgttgctgccctttcagattccagcagtttgctaatgaatcaggctcatgcctgtgcacactgtgcagatgcttctttggctgttacatctctagtgggactgatctctaatgtggttgaccctcatatcacagctgctgcagctgatgcagctgtttcagctctttgtgatgaggatttgtgtccaagggagatatttgatgttgaagaggattattcagcaagagctcttgagggtgaagaaggtttagagatggagaggtcctctctatcaggaaaccatcttatggacggcaatgattactcagtggtgagttcatgttccttgttagatgaatgtttgacccagtaccttgtgatggtgcattttagggattttttatgggattga

SEQ ID NO: 24935 - DNA, 159 bp, Glycine max
  Peptide Sequence Number=SeqID_141713
atgtcaggcccacgaaatggtcaagtacatgagcctaccaatcagcctcctatgcagagaaggaacaaggattggatcaccattagtcaagaaggaaattcagaagatgagaatattggaaacttagcctaccagaactactccttgatgcaatgttaa

SEQ ID NO: 24936 - DNA, 474 bp, Glycine max
  Peptide Sequence Number=SeqID_141714
atgaagatagctcttcttgaccagaacaaatttggtttcattgatggttctattgttaaacctgctttgggtcatgcgaatcatattgtttggcatcgcaatgacaacattgttgcttcttcttggcttttgaagtctctttcaaaagaaatgcaagtagtaggttttatgagtgtatatgtttgggagtctctgttaaagttaaagtctgcacatacttgcacatgcactagaatcaaaccttggtgtgagtatgctcaacttgagtatgttatgtatttctcgttgggtcttaatgaagcctactcttggattcggggtcagatcctctatatggatccttttccttacattaccgagattttttctatggttgttcaagaagaaaaacataaggaaattggtactacttttgctactcctcatgcttttgttgtgaagcaaggttctgattcgaagaacaaacccaattag

SEQ ID NO: 24937 - DNA, 1587 bp, Glycine max
  Peptide Sequence Number=SeqID_141715
atgaaacctatgccctttcagaacatctgtaataatatggttggggtgttaaagcgcttgaaaccggtgcttgatgacattatggattaccaaatcccttcaaatgtaaatctatgtaaagagtgtgaggaattggatatgcaggttaatgaagctagggatttcattgaaaaatggagtccaaagatgagcaagattcacagtgttctacaaggtggtactttgttgatcaagttacagagcacctctctagatatctgtcacatgatagttaaatccttacagtcacctccatctgcatcagttttggctaatcttcagcactatatccaggaacttcagtgtttcaagaaggaaatggctatggtcttcatagaagaagcactaagaaaccaaagagataatgttgaactttgcacggagcatctcaaggaaattattgagttacttaaattgacatcaaatcaggagctcttaagagaaagtattgctgtggaaaaggaaaggttgaatgctgaagtcaataaaatgaagggggacttggaagaacttgatgatattgtgattcttgtctgtaatttgcgtgattatgtgatgaaaactgagtgtcctgtagtcaagagtggtctgttaatccctctatacttccgctgtcctttatcattggaactcatgttggatcctgtcattgtggcttcaggtcaaacatatgagaggcaatccatccaaaagtggcttgatcatgggctgactgtttgtcccaaaactcgtcagagacttactcctacaaatctcatacctaattatactgtcaaagctatgatagcaacttggtgtgaggaaaataatgtcaaactttctggtaactctgagcaaaataattctgcctgtatcacatccccctcggaccatttattgcctcaagatttaactcatgattgttgtgttgagtctttacctagtagcaattccatttcaagatcagctctgcaaactgaaaatgcatttgaaaagcaaaagggtgataactctttcagattatgcgaagaatacaatggatgccagagtggagcaattgaaaagtgtgagcaacagtccccatatactcacagcagaagtgaatcattttcaagttcaatttctagtactgattgtgcgcatgcagtttcaaaagaggtgtcagggatatccaataagcttcaaaatgtgaaggtactgtctggagaaatcacaaaggtgtgtcctccttctcctggtaacaaacaatcagggatctctccgtggttatctggaacgcaatttcaaagccctggatcaaatgtgggagtgttggagaatggaaataataataatagtcattcaagatttgattcccatcctgttttcaactccgggtcggatgaattaaccacctcatctcatgttattagattgattgaagaccttcacagccaatcaattgaaacgcaaactgctgctgcagaagaattgaggctccttacaaagcataacaaggaaaaccgtatcattgttgggcagtatggggctgttgcacctttgctttcactgttatattcagacttgcag

SEQ ID NO: 24938 - DNA, 348 bp, Glycine max
  Peptide Sequence Number=SeqID_141716
atggaccatgctgaaggaatggttgacaaggctgttgctcttctgtcaaacctgtcaacaattccagagggccgattagaaattgcaagggaaaggggcatccccttactagttgaaattgttgagtatggttcacagaggggaaaagaaaatgcagcctccattctcttgcaattatgccttcatagttctaagttctgtactctggttttgcaagaaggagctgtccctcccctggtggcattatcgatatccggtacaccaagagcaaaggaaaaggcacaacagcttctcagccattttcgtaatcaacgggaagcagctactactgggaaagggaaatcatga

SEQ ID NO: 24939 - DNA, 285 bp, Glycine max
  Peptide Sequence Number=SeqID_141717
atggatagccctccagcttctgcatcttacgtagtggttgcatgtgatgccactagggagcgcactgaacacgagatcaaactcgttgttgatcatgttcaggaaaggcatgtctttctcccttctgtggggtaccagacattaacatgtcccgagtcttttgctggaaccaactttcgtgcaagggaggatgaagtcaagaagaaagttgatgcatatgcaactaagcttttgccaagttatgaagattttgaaagtgaagggggtacattatttaagttctag

SEQ ID NO: 24940 - DNA, 378 bp, Glycine max
  Peptide Sequence Number=SeqID_141718
atgaccaaatgggccgccaccagtccaggatggggtgtgcaaatggaaaaactaggtcttttagattattatctaattttcttatacgtcgtcttcaacatgctagccggtcgaaccggtaacctcgatctccacacctgcaccagcgtcgtcggttactgcctcttgccggtcgtcattttctctgccctctcgctcttcttaccggtcgatggggtcattcgcctctcggtcgccgcggttttcgtcttgtgggccaccagggcctccgccggactcgtcgtttcgttcgccgacggcggtgacgaacaccgtggactcattgcatacgcatctttcttgatttacactctgttttcgttgcttgtcatattctag

SEQ ID NO: 24941 - DNA, 876 bp, Glycine max
  Peptide Sequence Number=SeqID_141719
atggagttgaaagagattcagagactcgaaggccacaccgataaggtttggagcttggcctggaacccgaccaccggtcacgccggtatcccactcgtcttcgcttcttgcagcggcgacaaaaccgtccgaatctgggagcagaacctctcctctggcctctgggcctgcacggcggttctggatgaaacgcacactcgaactgttcgatcttgtgcttggtcaccgtcgggtaagctattggccactgcaagcttcgatgccaccactgccatttgggaaaatgttggtggtgattttgagtgtgtttctactttggagggacacgaaaatgaagtcaagtgtgtgtcttggaacgcggctgggacgttgcttgcaacttgtagtagagataagtctgtttggatatgggaagtgctgcctgggaatgagtttgagtgtgtgtcagtgctgcaaggacactcgcaggatgtgaaaatggtgaagtggcatcccacagaggatatcttgttttcatgtagctacgataatagtgttaaggtttgggcggatgaaggtgatagtgatgattggcagtgtgttcaaacgcttggggaacccaataagtactacttctcgacctctcccatcacctccaattttgaagcttcttgcggtcatacttccactgtttgggccctctccttcaatgtgagtggtgacaaaatggttacgtgtagcattttgatgccaatcccttatggcagtgatgatcttacactgaaggtatgggaaacagaaagtgtagggacgcaatctggtggtggatttgcaccttgcatttttagagttagccgctacgggatgctcttgagatttgataactacgatctctaa

SEQ ID NO: 24942 - DNA, 750 bp, Glycine max
  Peptide Sequence Number=SeqID_141720
atgccatgcaagattgcattggttaaatatgacttgtctctggatatctggagatctcattatgtacatgagacaaagatcacagaaacaaaatgcgtatattctttgccaaagtttgtgtcgctagcagattgtcatagtgttgaagacattgaggattctattatctcttgcaaaagttatccccattctatattttcttctgatagctctagtacgattaggagctacacaaagcagtcatcatatggtaacaggtcacgggagaacagttccttatcagattttggatcttcttctaagcaagatagatcaggcataagcatcaaaggagaatgtaggctaattacttctcagattgaccaaaaacaaaatcaaagtggctttctgccaaaacattcagatgctccgcttctttgtactggctgtggtacaagattgtctatcaaggagtcaatgaggttcagctattctgacattcaaagtgcaacaaatgatttttcaaaggataaattattaggtgaaggtggatatggtcacgtatataacggtgttcttaaagatggacagcaaattgccgcaaagaaaataatgaagctgttcttgagtggcaccaaaggtatgccatcgccattgggactgcaaaggaattgcgttttctacatgaggaatgtcgtggtggtcctattattcatcgggacatgcgaccaagcaatagacttctcacccatgattttgttcccatggtaa

SEQ ID NO: 24943 - DNA, 882 bp, Glycine max
  Peptide Sequence Number=SeqID_141721
atggttaatcagatccagccagcggttgtgttgccacggaaaacgccgggtgagcggatcaaaccagcgctggctgatggcgatgtcgaggctttcgtggcgcgaccaccacagaaacgccagcgccagaattgccagcaaaataaggttgatagcgtagaagcgcaaaagcggccagatgatgacgatcagcgtccccgccagcgtcagcaagacgttggcaatggcgtaggtgccggcatagccgagcgccggaatgctgctgcgcgcggtatcgctgatgatctccatggcaggtgcgcaggtgcgcgcgcccatgatggcaccaaacagcagcgcgcggttcatgcgcagcacgtaagcgccgaacagatagcaaatcaccaccggcaacagactcaccagcaggccgctcagcagcatcagcgcgcccgcactgccgagaccgtgctgcagcccgctgccggcgctcagaccaaccccggccataaacaccatcaggccaaactctttcaccatggtcagtgcgccctgcgggatgtagccgaacgtcgggtggttggcgcgcaggaagccgagcatgatgccggcaaacagcagcccggcggcgttgcccaggccaaagctgaagttactgaactggaaggtgatcatgccgatcatcaggccgatgataaagaaggcgcagaacgccagcagatcggtcatctggctgtgaatagcaatgaagccgatgcgatcggccaggcttttcacccggcgcgcttcgccgctcacctgcagcacatcacctttgttgagcataatgctgtcgtcgatcggcatctcaatctggctgcgaatcacccggttcaggaagcagccgtgatcggtcagttttaa

SEQ ID NO: 24944 - DNA, 180 bp, Glycine max
  Peptide Sequence Number=SeqID_141722
gctgagcctatgatagagaagttggctttacatgaactgattgacactcgtctaggggaatcatatgacacgtatgaactctacctcatggctaaagacgcatacttctgtgtgcaaaggaaacctgagatgcgtccttcaatgggagagatgcacatgataaacactcgtgtgacgtaa

SEQ ID NO: 24945 - DNA, 303 bp, Glycine max
  Peptide Sequence Number=SeqID_141723
atggctaaacacacacaatctttccctctcctgcacctagaggcagccctttctcttttcatttcccttgtcgtgagagctcaaaattttcaagggccacagggaaccaaggagaaaggaacagaatgggatgttccactttgttttgttcgtgcagcaaatgctacagaagtattctgttaccacttaaaatcagacgggatgtctaattatgggcaattttgcactgttaatcccatttatgctagttgtcaaaaacgatatgaagacattcctgtgctagggcaaaggccgtcagaatag

SEQ ID NO: 24946 - DNA, 180 bp, Glycine max
  Peptide Sequence Number=SeqID_141724
atgaggaaaaaaggcataggcaaaaggatggacccgttctccaaggaaggcgccagcgatgacaaaggtaacatagacagagttgcgacgcataacgaccttgtagaggctttcgaaaatgcctccacctcttcttcgagaaacactttccatcgtttcgaattcgattcaccactctag

SEQ ID NO: 24947 - DNA, 546 bp, Glycine max
  Peptide Sequence Number=SeqID_141725
atggagaatgctgaagaagaaataaatgggcacaatttaatagatgaagatagcgacaaagatgatgcaagtggtgatgatggctgtggtgaagaaaatgatgttgctactatgggtatggaggaaataagtggtttgattagtgcatttgaagaagaaattaatcagcatataattataaattgtgagatgaatatgctgaaaatcgaaagcatgaagaatgaggctaggtgtgtctgtagggcatattttcgtgttcacattcaacaaactattgagctatggtatgtgtctgtttggaaagatgatcatagtcaggaactgttggaagaaagatattgtgcaatgatgccatctcataggaagttgactgatattgagactcttcaaatagataattttagacgagttggaattagacctcctcatattcttgatttatttgcaagcactttgggggatatggcaagatacattacaggaagaatgatattcataatcaaaatgatcgggaaagacggcaacaaatttctaatgcaagtgtag

SEQ ID NO: 24948 - DNA, 189 bp, Glycine max
  Peptide Sequence Number=SeqID_141726
atgttgctcttgttggatgcaggaaatccctgtctaggcagggtgcaatggtttggggaaatggtcgaagatggcttggacgctggggtgccagaatttttaactgatgaaaaagctttacatagatacacgaatcgaagatactatagcacacacacaaacaacttgcatcgagaaccaggggaatag

SEQ ID NO: 24949 - DNA, 679 bp, Glycine max
  Peptide Sequence Number=SeqID_141727
agggctgcacgtcctcacctttagagggctacacgtcctcgccataagagggctgcacaccctcgccttcagagggctacacgcccttgccttcagagggttgcacgccctcaccttcagagggctacatgtcctcaccttcagggggctgcacgtcctcgccttcagaggactacacgtcctcgccttcagagggttgcaccctctcgcctttagagggatacatgtccgcacctttagaggtctgcacgccctcgccttcagtggtctagacgccctcgcctttagaggtctgcacgccctccccttcagaggtctgcatgtcctcaccttcaaaggactacacatcctcgccttcagaggactacacattcttgtcttcagagggctgcacgccctcgccattagagggctgcacgcccttgccatcagagggctacacaccctcaccattagaggaccacacgtccttgccttcataaggctacacgccctcaccttcagaggactacacgtcctcgccttcagagggctacacgtcctcaccttcagagggctatacgccctccccttcagagaactacacgtcctgcctttagagggctacacgtcctcgctttcagagggctgtacatctgtgcctttagataactcaaggtcccctgcccttaatgcttaa

SEQ ID NO: 24950 - DNA, 1362 bp, Glycine max
  Peptide Sequence Number=SeqID_141728
atggctaaagtttgttggccatattttgatcctgagtatgagaacttcagcaatagaatgaaccctccaagggtctctatggacaatgctagttgccatgattgtacactgatcaaggttgatagtgttaacaaacctggaattctgctggaagttgtgcaaatcttgacagaccttgacttcataattaccaaagcttacatatcttctgatgggggttggtttatggatgtatttcatgtaacggatcagcaaggaaaaaagataacagatagcaaaaccatcgacttcattgaaaaggctctaggaccaaagagccagagcacagaaggggtgaaaaattggccaagcaaacgcgttggagtgcattctgttggtgatcatacagccattgagctaattggcagagaccgcccaggtctcttgtctgagatttcagctgttcttgccaacctccattttaatgtttttgcagcagaagtttggactcataacaggcgaatcgcttgtgttctttatgtcaatgatgctacaaaccaagctgtagatgaagcaaacagattatctcttatggaggagcagctcaacaacatcttacgtggatgtgatggtgagaaagttgctaggaccagtttctccatgggttccacccatatggatcggcggcttcaccaaatgttgttcgctgatcgggattatgaaagttatgcagtagcaagagaggttgatagtcctccctctttaaggccaaaaatcacaatagaacgttgtgaggaaaaagggtactcagtggtcagtgtgaagtgcaaagatagggcaaaactcatgtttgacattgtttgcactcttactgatatgcaatatgttgttttccatgccacagtctcatcagatggcccttatgcattgcaggagtattttattcgacatatggatggatgcacgcttgatacacaaggagagaaagaaagggtcatccaatgtattgaagctgctattcgaagaagagtaagcgagctatctacttgtattgctgcaatgggagtgagccttgagctgtgtgcgaaggatagagtggggttgctgtcagaagtaacaaggattctacgagagaatgggttgacagtgtgtagggcaggtgtatcaacaagaggggagcaagcactgaatgtgttctacgtgagggatgcatcagggaaccctgtggacatgaaaactatggaagcacttcgtaaagaaataggtaagacaatgatggtggatgtgaagagagtgccaagcaatgccaaagcaccagagacccgaggatgggctaaaactagtttcttctttggtaacttgttggaaaggttcttgacctga

SEQ ID NO: 24951 - DNA, 387 bp, Glycine max
  Peptide Sequence Number=SeqID_141729
atgcctcatcaaagcccaaaagacaatgttgccttgcatccaattccttatgattgcagtaggtactttacaagagatgttgctataaagactattacattaaagccaggcattgagtttgatctaaatgatgtcatgctcttttactttaaagagatgtatgaaaactctcgccatgcgcccacctcggactatgaaatggaagataactccaatcatatatgcatggtgaaaaagaggctaagtcatgaaatgtcaaaagtgacagttaggcttagctcattacgctatgctcaaatccacttatgcgcactaagcgcgatggtggcgctaagtgcaacgtcgcgaattcagagcctatttaaagcttgtcttgtgcagaattag

SEQ ID NO: 24952 - DNA, 225 bp, Glycine max
  Peptide Sequence Number=SeqID_141730
atgtcgctgctgacggtggtaacaaaggaagaggggcgaagcaaagatgtcttcgttgatgttgaactcgtggaagttgaattgccagattcaggggctctttgtgccacaagtagggaggttcccgtagttatactcgtccacagtttcacggatcaatacgaactcctccttgaggttatcgttccaaacttccctgatttgaaccgaattgcctttcgataa

SEQ ID NO: 24953 - DNA, 186 bp, Glycine max
  Peptide Sequence Number=SeqID_141731
atgacagattcagaagtgaataagtcaaaggagtacgtcagtaaggttagggctgagtcattaaaggtcatctcgacccgacttaattttgatagactggtggtaagaaaggccataataggttgggttggacactttgtcacccttaatcttatggatatcttagttgctaactcttatccctag

SEQ ID NO: 24954 - DNA, 1419 bp, Glycine max
  Peptide Sequence Number=SeqID_141732
atgaacaacaccaatgaatgttgttgcaacgatgaaaatgggaaaatcgttgttggggtgcccttagttttcaatttcttcgataagaacaccaacaatattgagaagagtctcaaggtccaattagagaagaagaaccaattagaagatcatgattgtgaccaagaagatgatgatgatgatcttgaggccacatctttgggagacgcagccccgagtcctgctgagatcaagctcaaggcggagaagtcattgctcgagtttcgttgcaaggttgaggatgccattcttgggaactatctgttaggagaacaagatcatgagaaacttgcgccacaagaaatagtagtggcaagggaacagattagagagattactctctggggcgttcctttgttgccaagcaaggctcataagggaactgatgttgttttgaggaaattcttgaaggccaaggatttcaaggtgagtgaggcatttgacatgctgcagaagacacttgtgtggcggcgcgagaacaacgttgataggatcattgatgaggatttgggggctgagtttggaaataataatgcaggattcttgtgcagtaaagatagggaaggtcgtcctgtgtgttaccatgtttgtgggattttcaaagacaggcgcatctataagaagacctttggatcagataacaaatgtgacaagtatttgaggtggagaattcaattgattgaaaaggctgtgaagaagctttgctttagggaaggaggagtgaactctgtacttcaggtttttgatttgaggaacacaccaatgcaaggaaccaaggagctcaactcactcagcaaaagggctctaattttgtttcagaattactaccctgagatcattcacaaaaatattatagtatatgctccattttggttctacacttctcaagtgctattctcaaggttcatgaatcagagaaataaaaagaagttcatcttagctaggccacagaaggtcacacagacacttcttaagtttatagccccagagcaccttccaactgaatatggtggtgtaaggaggaacaatgatgaagatttttcaccttctgataaggtttcagagcataaaatcaaaggaagtacggtttcgaaagttgaatttccggtcaaagagcttggagtgacaataatgtgggatgtaactgtggtgggatggaatgtgtcctacaaggaagagttcattccagatgatgaaggctcatacagtgtattattgcaaaaccaaagtgtagatggtagcagcactagaaactccttttacatcagtgaacctgggaagatagtgataacagttgaaaatggaacctataagaagaaaaaaatgttctatagatttacagctagaaccactgttccaatgttcttcttgttacagtag

SEQ ID NO: 24955 - DNA, 550 bp, Glycine max
  Peptide Sequence Number=SeqID_141733
atgtatattgtgttaggtgtgtgtgacgcttgtgtgtatgagtgtgtattggccaggtacaacaatggaggattgaagggagcaattggacttgcaattccgggatgtcctgaaacgtttgaggagccagaagacaatctagatggcggagaagaggctcaaggagacatactcttgattcctcctggtgttcctttctggatctataacactggcgatgaagctcttgttgccgttagtgatcaaaaccgcaggtgtcgtgtcggacaccggacacaccaagcgactcggatgtccctgcttcataggcaacaacaccaccagaagcagcaggagggggaagatgaagatggaagcgtgctaagtggcttcagtaagcactttttggcacaatccttcggcatcaacgaagacatagcagagaaacttcagtctccagatgacggcaagaacaacaacaacaagaggaagacaaagacgaagaagatgagccaagacccagagaatattgctcgcccttcgcgtgctcacttctacaaccctaacgctg

SEQ ID NO: 24956 - DNA, 2238 bp, Glycine max
  Peptide Sequence Number=SeqID_141734
atgaagggagaacatttcttgtggaagttgtttaatatacacaacgattatgctgaaacaattaaggatcttgaagatgaggaaaaaagccgtgaaggtgttgttaaagagctagaatactttgaaagtgaagctagtaaaaagaaaaaagagcaggctaaatatctgaaagagattgcactacgtgaaaagagaattgctgagaaaggcaacaagcttgacaagagtcaacctgagcttctgaagttaaaggaggaaatgactcgtataacttcaaaaattaaaaaagggaagaaagagcttgataaaaaaaaggttgaacggaagaagcatgatgctgatatagcattactacagaatgacatccaggatcttacagcaaaaatggcagaccttcaggaaaagggacgagatgttgatgacgagcttgatttgcaaggcaatgacttggaagaatattttcgcatcaaagaggaagctggaatgaaaactgcaaagcttagagaggaaaaggagcttctagataggaaacttaacgctgatagtgaagctcaaaagaacttggaagaaaatcttcaacagttaagaaacagggagtctgaactgaattcgcaggaagaacagatgcgagcaaggcttgaaaaaattcttgataattctgcaaaaaataaagttggccttgaaaacttgaaaaaagaactacgcgtgatgcaggacaaacatcgtgattccaagaaaaaatatgaaaatttgaagttaaaaattggtgaattagaaaatcaactacgtgaattgaaggctgatagatatgaaaatgagagagatgttaggttgtctcaggctgttgagactctaaaacgcctgtttcaaggagttcatggtcgcatgactgatctttgtagaccaacacagaagaagtataacctagctgttactgttgctatgggtaaatttatggatgcagtcgtagttgataatgaaaagactgggaaggaatgcatcaagtgcaagtttgatccctccttggagaaggcaattctctttgctgttgggaatactctagtttgtgatgatcttgaggaggccaaaattttaagctggagcggtgagaggtttaaagttgtaactgtggacggaattctgttgacaaaatctggcacaatgactgggggcactagtggtggaatggaagcaaggtcaaaacagtgggatgacaagaaaattgaaggacttaataaaaagaaagagcagtatgaatcagaattggaagagctaggatcaataagagatatgcaccttaaagagtctgaagcatctggaaaaattagtggacttgagaagaaaattcaatatgctgagattgaaaagttaaatgatgctgttaacaagagcaatgcagatgtacgtaagcttgagaagaggataaatgaaattactgacaggatatacagagacttcagcaagtcagttggggttgcaaacatccgtgagtatgaagaaaatcgactcaaggctgctcaaagtatagcagaggagaggctgaacctgagtagccaactctcaaaattaaaatatcagttggagtatgagcaaaatcgggatatgaattcacgaattcaagatttggaatcttctcttggtgctttagagaaagatttaaaacgtgtacatgacagagaggctgcagcgaagttagcagctgagaatgctacggaagagattaatcaacttaaggaagaagctaaagagtggaaatcaaagtcagaagattgtgaaaaggaaatccaagagtggaagaagaaagcttctgcagccacaacaaacatatccaaacttaatcgtctgatacactctaaggaggcacagattgatcagttgaatgtgcaaaagcaggaaatattagaaaaatgtgaactagaacagattagcctcccgatcatactggatcctatggatactgatagctcagtaccaggtccatcttttgactttgatcaactaaatagggcactgaaagataggagacactcagacagggataaaattgaggtagagtttaagcaaaaaattgatgccttgatatctgagattgaaagaacagcaccaaatttgaaggcattggaccaatatgaagctctgctagaaaaagaaagagctgtaactgaagagtttgaagctgtcaggaaagaggagagggaaaaaacacagagattcaatgaggttaagcagagaaggtaa

SEQ ID NO: 24957 - DNA, 114 bp, Glycine max
  Peptide Sequence Number=SeqID_141735
atgacgtatacggcaaacatgataggggaagtaggtagggactttttcgtgcaactttatgagagtgatatacagctcaatatatataagcaaatggatagagcagtacaatga

SEQ ID NO: 24958 - DNA, 348 bp, Glycine max
  Peptide Sequence Number=SeqID_141736
atgtgcactggtgctgaatctcgaggaattgtagatggtaataaccccgtgactaattcaaaggttggaggagtgtaccatgagatcaacggaatgagaagcacagaaggtggtgatggtgaaggaaaaagaaacagtggttgttctggcagattcattcaaggccttcatcaacacttgcatcaactcctcaaggcacttttccctaccctttctctctctgaggttcgtaactatatctctagcttcctctgtgtggtttttgttctgaaagttctttttgggtcaaaaagtgaaaataaatcaaatagactgatcctgtcaatgttgtacggaaagaagctataa

SEQ ID NO: 24959 - DNA, 1236 bp, Glycine max
  Peptide Sequence Number=SeqID_141737
atgatgaccaacgtgcttttgtattctcgatccgctatttccatgctttacttgggtcgccaagggaaagtggagctagcaggaggatcacttgcaatagggtttgccaacatcactgccaattcatttctcaagggtctcaccatgggaatggacccaatttgttgccaagcatatggtgcaaaaagatggtcagttttaagccaaactttttgcaaaaccttgtgcctcctcctccttgtagccatccccatttcactcctttggctcaacatggcacctctccttcattggctagggcaagaccctgaagtcacaaaagttgcacaagtttacatggtcttctctatcccagaattgcttgctcaagttcatctcaaccctttaaggtcttttttaagaacacaagggttaacaacaccattaactattgcagcttcttttgctgccatcttacaccttccaataaactatttcttggctacatatttggaattaggagtaaaaggcattgcattagccacaggtttgaactccataaacatgatactagggttggtgctttatcttgttgtgtcagagaaacccttaaagccttgggaaggtgttactattctctcttcctttcatgattggagaccattgctaaccctagcattgcctagttgcatctcagtgtgcttggagtggtggtgctatgagataatgctcttcctatgtggcttgttgagtaatccacaaaccacaattgctaccatgggtgtactaattcaaacaactgggttcttatatgtgttcccattttcactaagtgcagcattgacgacacaaattggtcactccttaggtgcaggtcaaccttcacgtgcacaaaacacagccaaaataggactcttcattgcatttgcattaggtgtctcagcctttgttttcttattgtttgtgaggaatgtgtgggggaaactcttcacaaacgagacacaaattgttgacatggtcacagccatacttccaattttagggttgtgtgagattggaaactggcctcaaactgctgcgtgtgggatcttatcagggactgcacggccttatgtgggtgcaagaataaacttgtgtgctttttacttgattggattgccggttgcgatttttgctgctttcatgcacagacggattgggggcaccaaagtagaagagctgagcaattggctcaaacaacagatgaggaaaatgtaa

SEQ ID NO: 24960 - DNA, 981 bp, Glycine max
  Peptide Sequence Number=SeqID_141738
atgcaatttctcgggttcttgggcatctacaaagaatcctacaagctcatattttcatggaggaagatcttcacccagatcaccttcaccctaatcctccctctctccttcatcttcctcatccacatccaagtatccgatctcctcttcgggaaaatcacacacgacgccaaggacttaaccgaaaccctacccggcacaccccaacaccaaaagctccttgacacattctcttccgattgggccactttctttctcttcaaactcctttacttcatttccctactcatcttctccctcctctccacctccgcaattgtttacaccgtcgcttccttctacaccggcaaagaagtaaccttcaagaaggtcctaagcgttgtccctaaggtatggaagaggctcatggtaacatttttgtgcaccgttgttgctttcttcgtttacaatgttatggcagtgttggttctaggcatatgggcactcacaattggtgtgagaaatggtggtggtgcaattttgtcggtcttagcgatattatatctagtggggtcggtgtaccttaccgtggtgtggctattagcgagtgttgtgacagtgttagaagactcttatgggtatgaagccatgatgaagagcaaggagttgataaaggggaagatgggtctgtccgtgatgattgttttgaagctcaacttcttgttctttctaacacagtttttgttctcgatggtggtggtgaacggatggaaggtgttcggtttggggtcggtggacagaacagtgtttgggattgtgtgtttcttgctgctgtctcatttgttcttgctgatgcttgttatccaaactgtgatgtattttgtttgcaagtcctaccaccgcgagattgttgacaagtctgctttgtcatatcacttggaagtgtatgagtgctatgagcctttgaaggctaaagatgttcaactggattaccatgtctaa

SEQ ID NO: 24961 - DNA, 321 bp, Glycine max
  Peptide Sequence Number=SeqID_141739
atggttgtatttcgtggggtttgtgtacttaaccgtgatttgggaagtgggagtgtggtgaccgtgttggaagaagacacgtacggggtaagagcaatgatgaagaccaacgttgaagctcatgatttcttccgggttgatacagtttctgttcaagaaaacggtggtgcaagggtggagtttgggtgctctatttcgtttgcaagtcctaccaccatcagaatattgaaaaatctgccttgttggatcaccttgaagtgtatcatggtgagtgagcctttgaaggctaaagatgttcagatggaagagtgtcatgtctga

SEQ ID NO: 24962 - DNA, 1377 bp, Glycine max
  Peptide Sequence Number=SeqID_141740
atgggggaacacgtggcagcattccacactgctaccaacgctgtgcaagcattaaatagaggctttgatgtgaactgcgatacgaggttgctgtattgcaaacgagtggcagggtctagggtgattcatgttgatgaagaacacgtgagggacttgtggttgttcccaatgtttcaattgacattgttcagaactctcaggagcatgtggggcgtcgcagttctggagtctgtagttatcaggaggttgacatctatgattgtggagaaggagaagagattgctcaggaatctgatggtggaatattttaatcagaaggcaaatatatcacaaagctttcctcttgggacatttaattctgcgtttagcttcactggttcaaaacacattgatgctactgagacaaaatctctttcttcagatgggttttattttcccctcgcaaaggttcagcttataaactcccacttaatgttgcaagaaaatgtcgaaagggacatcccagtgaattgggatccaccatccttggcaagctttattgaaaactttgggacacatgtcattacatccataactattggtggtaaggatgttattttttctaaacaacaccatagttcacctttgtcaacattggagataaagaactatattcaagaaattggaagccagaggttctctgacatcagtaaccatacaagttcacttcaaacaaaatccaaggataaggctagtttcactttgattccgactctttatactgatttgattctggttgttgattccttttcattcaataatcaagtgatacaccctcaacctgcatctggaacttatctaagtgggaaagatgtcagagtcattttcagaaggagaggaggagatgatttggaacaagaccacagtatgtggctcagaacagtctgttcttccccagatgtcattcagatgactttttgtcctataacagatctcattgatgaagttcctggcaaggagcatttggctcacattattggtctctatcttgaatataaacctcccattgaagaacttagatatttcttagagtttcaaattgctcacgtttgggctcctcttcatgacaggactcctggacaccgaaggaaggaacctttgtgtccatctttgcaattcagcataatgggccagaaactttatatcactgttgggcgtttgcaagtaaccggcctacgtctgtttctagaaggaagcaagcacaatcggttgattgttcatcttcaaaacttatcatcccttccaaagatcctttggccatattgggacacatacgtagccattggtgctcctgaaaattgctattcaagaatactaaatgcattaaaaatggattaa

SEQ ID NO: 24963 - DNA, 360 bp, Glycine max
  Peptide Sequence Number=SeqID_141741
atgacaacaaatttaaaggcaaaggagttatggcaggttgctggtctttggcatcatctcgaaagaaagctggataatagcaaattttatttggagttgggatgttcctatgtaatgaacatgggcaatttgttaaagcaaagacatcccattcatcaagtcatattaatcaagtgtaagggagtggagagttctcacactcatgcgcctctcattcaagctatcaaagctcttgttgctcaggcttggatcgtctcgattcaacacactcttcgcgaaggaaacttctatgttgactggctcgccaataagggatcctttgaatttattcccttgtctgtgttagagacatgtccttag

SEQ ID NO: 24964 - DNA, 198 bp, Glycine max
  Peptide Sequence Number=SeqID_141742
atggctaatcatctactggtgaaggattcttccttggttgtgatgtgcatgcttagcattttttcctgcgagtgtgagaatgaaaatgaagaacacaacagaccaagcgtggacaggatcgtgatccttagggagaaagttgttgagaaacctcagccgcttcgaaaccttggaacaaaggtccaccgaagttcctaa

SEQ ID NO: 24965 - DNA, 345 bp, Glycine max
  Peptide Sequence Number=SeqID_141743
atggaatgctgcatggcggttagaaacctaagggacattgtcaggagatctatgcatactcagtatctagcttgtctttgccttcaagatgttgttaagcaacaccatcatactattaacactactgcgtatgaaaaccttccttacagctgcggcgttgccttgccctaccatttcactcacgacatggattgcaacatcataagcatgatgcctgatttacatgttgcaatcaatggaggggctagccttgaagggcaagttgactccacacttggcaggaagacctgcaaggctagcaagattgagtctagggatgctctgagcaatggttttcactactaa

SEQ ID NO: 24966 - DNA, 1496 bp, Glycine max
  Peptide Sequence Number=SeqID_141744
gacgtacaagggttgatagacaacagagaactaatcatcatgaggaaggacaaagaagtgtgcgtcattacccctgagtttcagcggttggaaataagctataacagtggggaatcaactactactccactggtgattagcttgccaggacctatgccgtatgcttctctaaaagcggtcccttacaagtatagtgccacgatgttggaaggtgggcaggaggtgcctttgccctctctaactcctgcgatttctgtggacaacattgctagtgacagtaaggttctgaggaatggacgtgttatccccacattgtttgcaaagaaaatgaatgatccggcagttaaacaggtgacagtgaacggccccggtacaaggaaggaagtgggccaatccaatgggactagcaagaattctgatcatgacgaaattctgaaactgatccagaagagtgagtataaagtagtagaccaactgctgcaaactccctctaagatatccattttgtctctgctattgaactcagaagcacaccgtgaggctctaatgaaggtgttagaccaagcttttgtggagagggacgtgactgttaatcaattggacagtatagtaggaaacattactgcctgcaataatttaagttttagtgatgaagaacttcctgaggaggggaggaaccacaatctggcgttacatatatcggtgaactgcaagtctgatgctctgtcgaatgtacttgtggacactggttcctcattgaatgtaatggccaaatccacattagatcaactttcctaccaggggccccccatgagaagaagcggggtggttgtcaaagcgtttgatggatcaagaaagtctgttatcggggaggttgatttgcccattacaattgggccgtttgttttccaaattacattccaggtgatggatatccaagccgcatacagttgccttttgggtaggccgtggatccatgaagcaggggccgtgacatccactttgcatcaaaagctaaagtttgtcagaaatgggagattgatcactgtgagtggagaggaagccttgttggttagccatttgtcagctttttcctttattggtgctgatgaaacagaaggaacctctttccaaggcctgactgtagagggtaaaaagccagagaaaaatgaagtatcttttgctacttggaagagcgcacagaaagtggtgcaggaaggaacaggtgtaggatggggaaaagttgtgcagttgctagagagtaaaaaccgtgaaggactgggatttgcttcttctgcaggatccgcaacgaacagtgttggatcaagctccattactagcaccttttgtagcgccgggttcatcaacaactcgccagaagccaatgctgtcttggaagatgttcctgaagagatagtacttgcatttgtcacacctggaaaaattgttcgcaactgggacgcggttgacatcccttcagtagttcatgcatcaaa

SEQ ID NO: 24967 - DNA, 333 bp, Glycine max
  Peptide Sequence Number=SeqID_141745
atggcgggttttgtgggtggccgacaatttcaatctcgtttgccaagctctaggattggtgtgaggccttattattcaaagaaggtgctaagacaacttggccatgtacagaggattccacgccagccacctccccgtcctatgtatcagctttgtgatcaggcatgggtgaactggttttccacccttatgtcattccaccagaggagggacaaccatcacgtggtcttgtacatttacagcccatcccagtacatcgacatactatgtactaggtggagactacttttgctagatggtgttaggagttatgcaaaggttgttggaccttaa

SEQ ID NO: 24968 - DNA, 288 bp, Glycine max
  Peptide Sequence Number=SeqID_141746
atggctcatctttgcattctaagagagataacagttctagtagcgggaatcgcagtcctcgactcacgtctacgtcacctacctccagtcctcgacaacctaaatgcttgcctccaatacacacggggagtagctatactggcatacctctatgacaatctctcctatgtgagccagtatgccaaaaagaagtgcggaggttatattggttactcatggcaatcatggacgtttgagcatcttcctagtgttggctacttagagattatgatgttgatgacttactag

SEQ ID NO: 24969 - DNA, 267 bp, Glycine max
  Peptide Sequence Number=SeqID_141747
atgccaagaaaggccatgccaaatgggagggaaaagcttgaaaattttcaaacaaaagttaatggtggcaataatttcaattgcaatggtggcggcaatgacaatggtagcggtattggtggtggcgatagtgacactaatgatggtggtgataacgatgatagcaatgttggtgacgatggtagtagtgatagtaatattgatgatgatggtgatgtcaatggtcgtggtgatagcagtgtcggtgattgtagtggcgacaactag

SEQ ID NO: 24970 - DNA, 198 bp, Glycine max
  Peptide Sequence Number=SeqID_141748
atgactcaccgagagttgaaaattgtgaaattgaacagtaacagaatctgggaactgatcaaggaactgagaaggaacgaaaaggctcggactttccacttgggtgcagaagcagcatcgtctttaatctcagtgaaacaacgtactgttgctgttgctgctgctgctgctgctgctgcttcatgccgtgcgttttag

SEQ ID NO: 24971 - DNA, 1383 bp, Glycine max
  Peptide Sequence Number=SeqID_141749
atggatgagtttgggattggagatgcacttagtaaaatgtttgttgcatcagcccgtcagttggctaaagccttagaagtaccattggttaatgatttaggatatacaaagagatacgtgcgctgcctacagatatcagaagtggtaaatagtatgaaagacttgatagattacagcagagaaactgggactggacctatggtcatagttggtatgacaataatgataaaaaaaagagatgttaaagggaatcaagagcagatcattagagttcataatgtctcccctaaagatttattttttggagcttacctattaggctattacaacttgagagttgacgccgatatttgggaggaaagacttcttttgttagttgtcttactttctactcaaatcctgtttctggagcctgagagcttagcaaaattccctcggagaacaagtggttcatctggacctcgtggtcaagcacaacagcatgaagaacaattacaacagcagcaacaacaacagatggtggcccataactcaaatggtgatcaaaactcagtacaagctgctgccatgcaaattgcttctagcaatggtatggttagtgtaaataacactgtcaacccagcatccacattaacctccacaagcactattgttggtcttcttcaccagaactctatgaattctagacaaccaaattcaatgaacaatgcaagcagtccatatggaggtagttctgttcagattccatccccaggttcctccagtacagtgccacaagcccagccaaactcatccccttttcaatcaccaacaccatcctcttctaacaaccccccacaaacatctcaccctgctttaacatctgccaatcacatgagtacaacaaactctccagctaatatttccatgcaacaacagcagccatctatttctggtgaacctgaccctagtgatgctcaaagctcagtccagaaaatcatacacgagatgatgatgtcctcccagattaatggcaatggtggaatggttggtgtcggatctcttggaaatgatgtgaagaatgtaaatggtattctgccagtgagtgccaatacagggctcaatggtggcaatggcttggtgggtaatggcacaatgaacagtaattcaggcgttggggttggtaattatggcacaatgggtctcggtcaatctgctatgcctaatggaatcagatctgctatggtaaataattcaatcatgaatggaaggggaggaatggcgtctcttgcccgggatcaagctatgaatcatcaacaggatatgtcaaaccaactacttagtggactaggggccgttggtggttttagtaatcttcaatttgattggaaaccttctccttga

SEQ ID NO: 24972 - DNA, 570 bp, Glycine max
  Peptide Sequence Number=SeqID_141750
atggggttaagcagacgacctgcaaggtttaaaaaacccgatttcatgccgaccgaaccaaacggtgaagaaaagctcgaagtgttaagggttgttggtgctggtgtttttattaacgagcaaaatcctgaaggagaatcctcggaagtgaatactattgttggatatgaaaataataatgtgagggacgaagcaggtaacaatgacaatggaattaaccttctggcaacagttgcaactagacttattaggaagaaggtggagaagaagctgaggaagctgccactgccactggacttaagatggcggaatcaaaaaaggagggaagagaagcccaccgaatctgaaacgtcgaacccggagatagcatgtcctaatgatagcaaagctaggaagcggaaagcaaagcaatcaataagcaggcaagatgaaaagatggaaatgttaacggttgcagctgctagtgtttctattaacgagcaaaaccctgaaggagaatcctcggaagcagatgatgacaatggaatgcagctgctcgcagcagttgccactggggataaaacaccctga

SEQ ID NO: 24973 - DNA, 225 bp, Glycine max
  Peptide Sequence Number=SeqID_141751
atggaattttcactggaggtaaaggccaaaagcaaatttggtaggggccaaagtaaataccatacttggatagagaaagtgtatccaagggagatgaggggagtggttgtggcggtggttttgggtcgatggtggtattgggtggaggcgaggcttcagagagatgggtatttatgtccattcaggaatgaaaaagcgaggtgcataaataaaaagcccaaataa

SEQ ID NO: 24974 - DNA, 588 bp, Glycine max
  Peptide Sequence Number=SeqID_141752
atgtctctatttttaaatttcttagaattgggcttagcgagcctgctcgctaagcctgtgctgtctagtttagtagttgcactaagcgcgccttgccgctctaaatcaagatttgtatcccaagatgcctgggaccgctatgcaaacgatgtcattggccagaaaatccttccggaaaggaatgtgaagttgtatatcacagaatttgatgaatttaggagagaaattgagaggaggaattggcataaggagctcactaacttctcattgggaagcattgatgttgctattgttaaagaattttatgctaacctctatggccctaaagacaaatcgcataagcaggtgagggtgcgagggcacctaattaaattttttattgacaccctcaacaccttcttgaagacaccagtggtcataaaggaaggggagagcttgctcacctactctaggtttgctaatctgaggtctgttcctcaagagcttacaacctgtctatgtatccctaggaggggatttgagctgaatgcagacgggctgcctctgaagatcttaaggaagaatctgactactctgcccagacctgga

SEQ ID NO: 24975 - DNA, 579 bp, Glycine max
  Peptide Sequence Number=SeqID_141753
atgggtgggggagagaaaatgagtagagagagaaacattgggtgtgggagagatagacttagaggtaagacaatagagagagctagagtgacctttggggaggcattccgatgggaatatgctggaaacaaagaaagagtcaagcaaaactacattgtgtctaactggagagatcacgaggatatcacatccttttacttcacctgttttgctgatgacatcacggagaaggagttgtggcaccatttcaaaaaatggggggacattagggaaattttcattccaaatcgaagaaactacacaggcagaaggtatagatttgttagatttaaaggggtacgagatatcccatacacggcaaagcagttggataggattgtaattggtgggatgaaattatatgtcaacctcccaaagtatggaagggagttgccaaggaaggtagatgcaggaatcaaaacacagtttactgggacaacgagtgacccccaacagtcgtgtatcttcaacatcctcggttcacatcaacattggccagaagacgtggggagggcacctataaaacccagccatgtttga

SEQ ID NO: 24976 - DNA, 2265 bp, Glycine max
  Peptide Sequence Number=SeqID_141754
atggcggtgctgacaagaaatatcagacctccgggacaaaggttggcttacaacaaccattcccaaagacatgacacttcaatatcctcggttcacctcgacataggaccagaagataacaattggttgaaggatgcgtgggtagggcatctaaaaaatcctgccatgtttgatagattggacgatgagctactgtgggagataggaatgaacatatcacccaagtacataggggaagatctagtcctactacttggtctcactaacgccggagtagaacaagtcatgaatggccgacaacatggaggcgcatcgatgttttactcaatggagaagtggagcccaagcttatgcataggcttcaggctaacatgggttcaatgttggggtatcccgcttcaggcttgggatatgaaatatatccagaagatattggttcctatgggggaaatggtggacatggatgatgacgtcgaggacaaacggaggctggaccaagaaagggtgctcgttaagaccccatggaggccgacaatcaagcacaccatcgatgtccacataggcgatgagtgttttaaagtcttcagtggatcgtcggagaagattgactctgacgaaagctacctcgggaacctgattctgagattgacaaacactttggagaaggaaggcgacatgcacgatctattggcatcggcaacgcaagctgagccatgcaggaccaccaactctcccagtgccggcagcaacgaccatggaacaaacccattatccagtggtcatcgagagcgcaactacccactaggtaatgccctcagcccacggacgctatgcagtatacgccaggtcacattggatgaacagacaaggactttaggcgcaacctatgcagaaagggaaaacccaagtcatgaaaatggaaaacaagaaaagggggagagcagtggtgcggcagaggcaaggatggcattaggaatagcaacatcgatagaaacaggaatggttagcttgcatactcagcacctagaggacatggcgcaatatgggactgctttcaataccaataatgactctactacagaatcagtagagaggaaatgcatcaggtacccagttgaaagatttggcatatgccaaagggactcaaggaataacaacatcaaagagttcaatggttggatagatgatttggaggttgttgaggcaccatggttgggaagaaaattcacttggtttagaccaaacagggcgtccaggagtaagcttgacagattcctactatctcctgagtggcttggaaaatggcctgcaagcactaaaattactttacctaggaacttctcagaccattgtcaaatcctgcttaggtctatatctgtagactggggtcctaaaccttttaggattctagattgctggaataactctctaaagggagtcatgattggtggaatatgcattgttgagccatataaggtgaaggaggaagctatatgggattgtgggagtgagaaaagcccaggccctgatggaatgaattttaaattcatcaagcagttctggaagctaattaaacctaatgttctccgttttctagatgaatttcatgtcaatggtgccttgccaaggggttgtaatgcatccttcattgctttaattcccaaggtggatgattcacaattcttgaatgactacagacctatctcactaataggttgtatgtacaagatagtctccaagttattggcaaaaagaatgaagaaggtgatggcatatatcgtagatgagacccaatatgcattcattgagggaagacatctattacattgtgctctcattgcaaatgaggtgattgaagaggccaaaaagagcagcaaatcattccttgtattcaaagtagattatgagaaggcactcggtctcctgttctcccccaaagggggacttaggcaaggggatctattatcacccttcctatttaatgtggtagctgaagctttgaatgggctaatgaggatagctgatgcaagctccattggagcttgtaggcctaggatcttcttcatcaatggattcctttgcttcttggaagatgaatggcagcggaatggagaaagggagagagagaggagacgccacttcaaggagaagatgagtctagaagaagctcaccaccataggaggccatggataagagattggaggaagaaggagatgaatgaagggagagggagagaagagcacgaaattttgtgctccaaatga

SEQ ID NO: 24977 - DNA, 366 bp, Glycine max
  Peptide Sequence Number=SeqID_141755
atggattcatcgattggtgtgaagtcgataatgaagttcgacagtcggtactctgtggaaatcgtgtttgatggaagcaagcttggaattgagccttatgtcgtcctcgctttctttaagctgagggtgcaacaatgtctggcatttcaccttgagttgctaaatgaagcagaagtggcagctgttgcagaagagaaagaaacccattcatttgaaattgatccttctcatgcactttacatgatgaatcctaataagttcagagcattaaagcatcgagcttatgggttggctgacattcaaattaatgaattaaatgccagggaaagcttgaggataggatggctggggcaaggaggagtataa

SEQ ID NO: 24978 - DNA, 276 bp, Glycine max
  Peptide Sequence Number=SeqID_141756
atgtcgttttgcgcttgtgacggactaactcctctcgaaggagaccacagtgatggggtcgctagaacctcggagtttccgtttggcgccgtaaatggttattatgctcttgccagaacctcgctggaaccaccagtcctcgagaacctcgaattccttctccagaggaactttcagaagttatgcgctcgagtgaaggagggtgtgagcgcgagaagaaagagagagagaccagtcatagaagtcgaggcaacgaagtacgctgcccaacaatag

SEQ ID NO: 24979 - DNA, 729 bp, Glycine max
  Peptide Sequence Number=SeqID_141757
atggcaaatgtaagagcaatcaaggtgatgttaaggagctttaagttggtatcgggattaaagataaacttttccaaaagcagtttttgggcaattgggatgactgagcaatggatgaacaatgcagctccaaagattgtggtggataggttggtgaggctgcagcggtggttcttgtggggaggacactcggatcagaaaaagattacgtgggtgaattgggggttcagtctgtctacaaaaggaaaaaggtggcttaggcatcaaggatttgatgaaattcaactatgcactgcttggaaaatggtgttggaatttgtttcatcaccaaggagaattatggccacaagttttggaatccaaatatggagggtggaggaatttggatgtgacaagaaggacatacagagagtccctctggtgttgttctgggaagacgggtggaaggatgatggggttttgttaattgaaaagtacccaagattgtaccacatttctcaacagcaacatcaatatatccaccagctacgggcgacatcaggtgcaggtctgatcatacaactgcagcgacaagacacctggaattgggagggagattcaagcaggggatatacagtgggaaatgcttacatgttgcttgatagggattcgacaaatgaaaatcaggttggagtgtttactgcactatggaagttaaaaatcccaagtaaagcctcattctttgcttga

SEQ ID NO: 24980 - DNA, 1914 bp, Glycine max
  Peptide Sequence Number=SeqID_141758
atgtcgctgaatctcacggcaaacgcgatcccggcgataatcggtggcgacgtgaacgcgaaaccgctggttcaggttctggacgtggcgctagtctccaatagcaacaactcgcagcagcagcagcagaggtaccgtcttctgctatccgacgccgttttctctcaccacgcgatgctcgcaactcagctcaacgaccgagtccgaaccggtcgagttcagaagggttcggttgttcagcttctcgattatatatgcactcctctcaagaaccgcaagattattgtgattctaaacatggaaactataatggatgagtttgagatcattgggaatccaaagccatatatggattctgatataccaacagtgagagcttcagattcagcttcagctgatagcactgttgagaatttgcccaggagttataatagtaataatagttctgctggtcaaaatgcaagtcacaataacacgcagaatttcaggccaactattcaacctccataccaaccacctccactttacaaaggccgtgggccagttgtgaaaaatgaggcaccagcacgcatcattcctatagctgctttaaatccgtatcagggtcggtgggctatcaaggcaagggtaactgctaaaggggatctgcgccgctataataatgctcgtggtgatgggaaagtcttctcatttgatctccttgattctgatggaggtgaaatacgagtaacatgctttaatgctgttgttgaccgcttctataatgtaattgaggttggtaaagtttacatgatatccaaaggtagcttgaaacctgctcagaagaatttcaaccatttgaagaatgaatgggaaattttgttggaatcatcttcaatggttgagctctgcccagacgaggatggttctatacctagacagcagttctccttcaggcctattagtgacattgagaatgttgacaataactccatccttgatgttattggggtagtgacatctgtgaatccttcagttcccatcttgaggaagaatggaatggaaacccagagaagaattttgagtctgaaggacagttctggcagtagtgttgaacttacactgtggggcgaattctgcaacagggaaggacaacagcttcaagacatggtggatgctggatttttcccaattttagcagtcaaaactgggaaggtgaatgattttagtggaaagtcgataggttctatttctaccacgcagcttttcataaatcctgattttcctgaggctcatagcttaagagaatggtttgaactggtaggaaaagattctgcctccttatcgatttctaaggacattattcccggagcattgaagaatgaggtccgcaaaactgtgtctcaaatcaaggatgaaggtctagggcggtcagacaagccagactggataacagtaagggctgctatattattcatcaagacagatacattttgttacacagcttgccctctgatgattggagatcgacagtgcaataagaaagtgactaggctaggaaacacaaggtggcaatgtgatagatgcaaccaagaatttgaggagtgtgattaccgataccttctccaagttcaaattcttgatggcacaggattagcttgggtaactgctttccaagaagcaggggaagagattatggattactcagcaaaggatctgtactttttgaaacatgaagagcaggatgatgagaagtttggagaaataatcaagagccgactcttcaaccagttcatgtttaggctgaaaatcaaagaggaattatatggcgatgaacagaaggtgaagattactgtggtcaaggctgataaggtgaactactcttcagagagtagatacatgcttgatacgatttccaagttttgtaggcagtaa

SEQ ID NO: 24981 - DNA, 141 bp, Glycine max
  Peptide Sequence Number=SeqID_141759
atggctcttggttcgaagattcatacaaaaggtggaatgccaaaggtagtgaaaggaaatcttgtagtgatgaaagctgggaaaatcacagctaatcgatacatgcttttgggagatacgttgcaagaagcagatgcataa

SEQ ID NO: 24982 - DNA, 210 bp, Glycine max
  Peptide Sequence Number=SeqID_141760
atggcggaaccagtgcaaatcgccaatggtaatggcattttcctccacgtgttgatccaaggcaaagtcataggatcgagggcggggcagtttggggaaacccaatcctcaagcaggggcggggatgagtctaattttggacctcaacgagaaatgagggtgggggcgggaaggacttggggagtcaggagcggggggtggggagactaa

SEQ ID NO: 24983 - DNA, 999 bp, Glycine max
  Peptide Sequence Number=SeqID_141761
atgggaggaacaaagtattttgtaccattcattgatgattactctaatagattatgggtgtactcaatcaagatgaactcagacttgtttctagtattcaaggaattcaaagcgcatgtggagcttgaaattggcaaaagaattaagtgcttgaggacaaataatggaagagaatatgtagatgaacagatgaacaagactctattggatagaacaagagccatgctgggaataacaggagtggccaaatctttcttggcagaagcaattaacttgataaatcgttcaccttcaacaacaattggattgaagacatcgatggagacgtggaaaggaaaaccaattgattattccttacatgtgtttggatgtcttgtgtacatgatggggtattgcttgtgggatcctattgtccacaaggttgttgttagcatggatgtagtttttggagaaaatgaattggaaagtgagcagaaaaatgtcagcactaccaaagacaccactatagtgcaaataaagaagaaattaggagaagataactcttctgaagcagaacatgagcacgaagaacaagaaccaaataaggccaatggtggacaagccgtgagtggtttaggtgcttctctattggtgacaaaaatgcatgaagaaatggaagccttgcatacaaacaaaacttgtgaacttgttgaacttctagaaggttggttattggaagcaaattgggtttataagatcaaacgagatggcaatgatcaagtggagcgatatcgtgcaggattggtagtcaaggggtatgctcataaagaaggtgttgatttcaatgaaatattttcttcagttgttagattgaccactatcagagttgttctggttatatgtgttgcatttgatttacatcttgaacaacttgatgtaaagattgtttttctccacggagaacttgaagaggaaatatatatgctccaactagaaggctttaaggaacaaggaaaataa

SEQ ID NO: 24984 - DNA, 174 bp, Glycine max
  Peptide Sequence Number=SeqID_141762
atgggtaggattagtgggacgatccagatttatgttctgtttcttaccaccttgagaatggtgttagttaagctaacaccttgggaatggtctcctagttggtggtctgggggagttcactccaaggagttccatactaaaataagtggaaagtcagagctatttgttggttaa

SEQ ID NO: 24985 - DNA, 291 bp, Glycine max
  Peptide Sequence Number=SeqID_141763
atgccgccacaaaatgtgtttctcaattatacccttccacctcttcttctcaatgatgttcaaaggggtcacgccctccacggttcgaacgtggcgttcatgtggtggtcctacaacatcatcaccatcttcggtgaaaccattaccgggatgaagtgcaaaggcattttcccggcaggggcagtggggaagtcgatgaatgctaaggtcgtcgacgacgtcttattgggaatcttctcgacgttgtcaatgagcgaccacgaagtccttcgcagatctgtcacagcgtag

SEQ ID NO: 24986 - DNA, 1122 bp, Glycine max
  Peptide Sequence Number=SeqID_141764
atgttgtcattcctgatcagcgcacttatccttctcttttttcccacatttctaaatgataacgaggagtattttgagttagatcttgtagaggactacatgacccttaatgctcatgtacaagaagatgaagacgaaggtggtgagcagcataatgaccaagtggctgaggacatcaatgtgaagcagcataaagttaattggtttgaacaagaaatttattcagaagtcaaatggtgcctggctttagacagtgtggagtttcgaggggcaagtgagttccaaaatctgaccgttctttctacaaaacggtttggaaaggcactcgtcattgatggacatttgcaaaacacagaattggacgaatacatttaccatgaaaacttggtccatcccgctctgttaacacataataaccccaaaaccgtgtttattatgggaggaggtggaggttctgctgcaagagaggtactgaagcacagacacattgaaaaagtgataatatgtgacattgataggaacattgccggtttgatccgcgagcatatgacggcaaatcatgcggcctttaaagatgagaggcttcaaattgtatacaatgatgcaaagtatgaactagagatgtctgaagagaagtttgatgtgatcctaggagatcttcctgaactagatgaatcaaattcatcaggttctagccatctctacacaaaatccttttatgagaatgttgtcatacctaagctcaagggcaatggtctccttgttactcaagctggtcccgcgggaatttttacacacaaggctatgttctcaccattatacaacacattaaaacaagttttctcttatgtggttgcatatacagcggtgatgccatcctatggcgactcgaatggatggattatggcttcgaacgaaccaatcaatcttgacggtgagcaactcaacaacaggattggtgaaagaatcaaggacgagttaagatatctcgatgggcctgtcattatagcgtccacagttctaaacaagactttgaaaaactcgcttatggaagagactcggatcttaacggatgaaaatgtgaacgtgggatttgttcgcaaacgtggagtttgcaactaa

SEQ ID NO: 24987 - DNA, 471 bp, Glycine max
  Peptide Sequence Number=SeqID_141765
atgttatcattcttgatcagtgcactcattattctcttttttccaacattcctaaatgttaacaaggaggattacgagttagatcttttactgaacctttatgctcctattccattactagaagatgcagatgaagatgaagatgaagatgaaggtggtgagcagcataatgaccaagtggctgaggtcaccaatgtggagcagcataaagataattggtttgaacaagaaatttattataaagtcatatggtgcctggctttagacagtgtggcaagtgagttccaaaatctaaccattctttcaacaaaacggtttggaaagcctcctcacctttcgccctcatcttctgctccaccacactcgtgtccctcaccttctgcctccaccgctgtcacgtggcggaactcatgtagtcagagtctggttggtccgaccgtagtgcatggggttcctctcactcttcgatga

SEQ ID NO: 24988 - DNA, 1017 bp, Glycine max
  Peptide Sequence Number=SeqID_141766
atggagatatggaatagttggtgggttttgcaaattatgcaatttctgggtttttttagtttttggatttcatttgcaaagtttaggactttattctcaagagcttttggttatggccacaaggttgtgaagggtgactgcagtacttggatctttgtttccttcaatgggttggtcacagttggttctttcatattcttcctcttggtcctttcctgggcttatttatacgcatttcccagttctcaatcactgattcagagtcatgagattcccatcaacagttctgactcacttgttcagagttatgagattcccagcaacagttctgactcacttgttcagagttatgatgtgattctaaaacccaatgtttcaatggacacatgcaatgtgtttgaaggaagttgggtgagggatgatagctaccctttgtatgatgcttctcactgcccttttgttgaaaggggtttcaattgccttgctaatgggagaaaagatagagattacacaaaatggaggtggaaacctaagaactgtgagattccaaggtttgatgcccgtggaatacttgaacaacttcgtgggaaaagggtggtattcgttggcgattcgttgagtaggacacaatgggagtccatgatatgcttgctgatgacaggagttgaggataagaagagtatctatgaaatcaagggcaacaaaatcacaaaacagataaggtttttaggtgtgaggtttagtacttttgatgttagaatcgatttttatcgatcggtgttcctggtgaggcctggttctgtgcctagacatgcaccccaaagagtgaagacaacattgagattggacaagattgatgatattagccatgagtggattgattctgatgttcttatattcaattcaggtcactggtggacacggactaagctttttgacgttttctctaaagagaagcaaagaatcaggtttggtaagggtcatggtcctgttaacataactaaggaaagggaatga

SEQ ID NO: 24989 - DNA, 3249 bp, Glycine max
  Peptide Sequence Number=SeqID_141767
atgagtcgccgtggcatggacgacgacgacgaggaggaatacgaggagcaggacgagcaggtcgccgacttcgacgaggaggaggacgagcaggtcgccgacttcgtcgaggaggaggaggagggcagccaccgaggacgcggcggcggtggcggcaggaagaggggaagatctggctttatcgatgacgacgccgaggaggtcgacgaggacgaggaggaggaggacgacgatgacgaggatttcgatggccggggtggcggtggcggtcggaggcgccagtacaagaaggtttccgcctctaatttcttcgatgaagaggccgtggtggatagtgatgaggaagaggaggaagaagagggagaagacggaccattgttgatgcttgataaggatggcaagacaattgcagtggcaattgtgggtgttgtcgtgattattgccgtggaggtggcaacaactgtaatggtagaaggtagagacttcattgttgagggtggatctgatctgccggaagaagatgatgggagaaggatgcgtagtagccgtatgctgccacatcaccaagaggatcatgaagatcttgaagctatggccagaagcatccaggaacgttatggaaggcgcctaacagattacgatgaagaaacgacagatgtggagcaacaagctcttttgccatctgtgagagatccaaagctgtggatggtcaaatgtgcaattggtcgtgagagagaaacagctgtttgcctcatgcaaaagtacatagataaggggtctgagttgcaaataagatcagctattgctctcgatcatctcaaaaactatatatacgtggaagcagataaagaagcccatgtcagagaggcttgcaaaggtctgcgcaatatatttggccaaaaaataacacttgttccaatcagagaaatgactgatgttttgtctgttgaaagtaaagctattgatcttgctagagatacttgggtcagattgaagatcgggacatataaaggggaccttgccaaagtagtggatgttgataacgtgcggcagagggttactgtcaaattaattccaaggatagacttacaggctcttgcaaacaaattggaaggtagagaagttgtgaaaaagaaggcttttgttcctcctcctcgttttatgaatgttgatgaagcaagggaactgcatatccgtgtggagcatagacgcgatgcctatggggaacgatttgatgcaattggaggcatgatgttcaaagatggattcttatacaaaactgtatcgataaaatccattagtgctcagaacatcaaacctacttttgatgagcttgaaaaatttcgtaaaccaggcgaaagtggagatggtgacgtagctagtctgtcaactttgtttgcaaacaggaagaaaggccattttatgaaaggagatgctgttattgttgttaagggtgatttaaagaacttgaaggggaaggtggagaaagttgatgaagataatgttcatataagaccagaaatggaggatcttccaaaaactattgctgtaaatgaaaaggaactttgtaaatattttgaacctggaaaccacgttaaggtagtttctggtgctcaagagggggctacaggcatggttgtgaaggtcgagcagcatgtgttgatcttaatatctgatacaacaaaagagcatatccgtgtctttgcagatgatgttgtagaaagttcagaagtaaccactggagttacaagaattggggactatgaacttcgtgatcttgtattgctagataataatagctttggtgtgataatacgtgttgaaagtgaggcatttcaggggattcctgacagacctgaagttgtgcttgttaaattaagagagaacaaatgtaagatagataagaaaataagtgtgcaggataggtttaagaatacggtatcgtcaaaggatgttgtgcggatcattgatggtccctgcaaaggaaagcaaggtcctgtggagcacatatatagaggaatcttgttcatctttgatcgccatcatcttgaacatgcaggctttatatgtgctaaggcccaatcatgtgtagttgtgggaggttcacgctccagtggtgacagaaatggggatgcctactcaagatttgccagtcttagaagtccaagtcgtattccaccgtccccgaggaggttttctcgaggagggccaatggattggagacataggggtggaaggggccatgatagtttggctgggacaaccgttaaagtacgccaaggtccctataaaggttaccgtgggcgtgttatagatgttaaaggcacaacagttcgtgttgagttggaatcccaaatgaaggttgtgacagttgaccggaaccatatatctgacaatgtggctgtaaccccatatcgtgatacatctcgctatggaatgggaagtgaaacaccaatgcatccttctcgaactcccttacatccatatatgactccaatgagagatcctggagcaacacctattcatgatggaatgagaacacctatgcgtgacccagcatggaatccttatactccaatgagtcctccaagggataactgggaagatggaaatccaggctcttgggcagccagtccacagtatcagcctggaagccctccttcacggccatatgaagccccaactcctggtgctggttgggctagcactcctggtggaaattatagtgaagctggaacaccgcgggacagttctgcctatgccaatgctccaagcccatatttaccatcaacacctggtggacagcctatgacaccgagttcagcatcttatcttcctggcacccctggaggacagcctatgactccaggcacaggtggtatggacatgatgtctccagttttaggtggggaaaacgaagggccttggtttatcccagatatattggtcaacgtacacagggctggagaggaatctgttggagttataagagaggttctcccggatggctcttacagggtagctcttggatctagtggcaatggtgaagcgattacagcccttcctaatgaaatggaggctgtggtaccaagaaaatcagacaaaataaagattatgggtggggcattgcgtggtgccaccggcaaattgattggtgtagatggtactgatggaattgtaaaggtagatgacacattggatgtgaagattttagacttagttattttggcaaaattagctcaaccatga

SEQ ID NO: 24990 - DNA, 927 bp, Glycine max
  Peptide Sequence Number=SeqID_141768
atggctgatgggtatgccagaataggggagatggaagcagccagggaggtctttgagatgatacctgaaaggaattgctttgtgtggtcatctacgattaatgggtacttcaagaagggcaatgtcactgaggctgaggctaatggattcggtgagaaagcactgcaagcttttgagggaatgggagctgaagggtttgagcctgatgagtttactgcagttagtgttttatctgcgtgtgctcagctggggaacctggatgttggtaagcaaatccatcacatgatagaacataaagggatagttgtgaacccgtttgtattgagtggattggttgacatgtatgccaaatgtggtgacttggtcaatgcaatgttggtattcgaagggttccctgagaagaacatattctgctggaatgctatgatttcgggctttgccatcaatggaaaatgcaaagaggctcttgagttttttggcaggatggaagaatcaaatataaggcctgatggtatcacctttcttaccatgctttccgcttgtgctcatggggggagattaaaagaggcttatgacttgatagtgagaatggcaatgaaacctaacgacacagtttttgggggaatgcttggagcatgccggattcattctgatatgaagatggcagaacaagtaatgaagttgatctgtgaagaccctgttactggtgctagttctcacaatgtgcttttgtcaaatatctatgcagcttctgaaaaatgggagaaagctgaaaggatgaagagcatagatggagggtctcagaggatacccggattaactgtgagccccacgccaagaccaatgcatggctgcagcctccattatgggggcaaggaagtgtggtttgaagccacatgcaaagtattgaaagctagtgaaggttga

SEQ ID NO: 24991 - DNA, 792 bp, Glycine max
  Peptide Sequence Number=SeqID_141769
atgtggccactaaaaataggtgtggagtctactggaactattaccttggcagtcttcagttctagtatatttgtgcttgtagctcttgttctctcaacttatctaatttttgagcatttagctgcctataatcagcccgaggagcagaagtttttgattggtctcatcttaatggttcctgtttatgccttggaatcgtttttgtcactattggattccagtgcagcatttaactgtgaagttattcgggactgctatgaggcttttgcattatattgctttgaaagatacttgatagcttgcttaggtggtgaggacaaaaccattcaatttatggaaagtatgagcctaacagaatccagcactcctcttctaaaagaagcatatgcttatggagttgtagagcatccatttcctgtaaattgcttcttaagagactggtatcttggccctgacttctatcaatctgtgaaaattggcattgtacaatatattgttgatgacatgaaatttacagtttcacatgtggtagaacctgtcgaaaggggtattgcaaagattaacaaaaccttccatcagatatcagaaaatgtgaaacgtcacgaagacgagcggaggaaaagcaccaaggtcaaggatgacagttaccttgttgccctgcgttcatggagatcagaattttctgatgttcatgacagacttggggaaggaagtgtcagtgatagtggtttgccaagcagaaagagacaacatctgcaatccaaagcgtcagcatccaggatgcgaaggtag

SEQ ID NO: 24992 - DNA, 1587 bp, Glycine max
  Peptide Sequence Number=SeqID_141770
tcggagcttcttcagaaagaagtgtttttggtagagttggtagattctatttccaagtcaaacgaatcaatgtcgcatctcaaggctgtttacttccttcgacctacatcggagaatatccagcttttgcgccgccaactggctagtcctagatttggagagtatcatctatttttctccaacatattgaaggacactcagattcacttacttgctgattcagatgaacaggaagttgtccagcaagttcaggagttctatgcagattttgttgccattgatccgtatcatttcactttgcacgtgccttcacattacatatatatgctcccagctatggtagatccttcaacagtgcagcgcttctctgatagggttgttgatggtcttgcagctctttttttggcattaaaacgaaggccagtaattaggtatcaaaggacatctgacattgcaaaaaggatagcacaggaagcagctaaattgatgtaccaagaggaaagtggtctttttgattttaggcgaatggaagtttctccactgctgttagtgattgacaggagggatgatcctgtaaccccactgctaaatcaatggacctatcaggctatggttcatgaattaataggaatccaagacaacaaagtggacttaaaatccattggtaaatttccaaaggatcaggaggaggttgtgttatcatcagaacaagattcatttttcaaagctaacatgtatgagaattttggagatataggtatgaatatcaagcggatggttgatgaatttcagcaagtgtcaaaaagtaaccagaacatccaaacaatagaggacatggccaaatttgttgataattatcctgagtacagaaaaatgcatggaaatgtgaccaaacatgttactttagtaactgaaatgagcaagatagttgaagagcgaaaacttatgtcagtttcgcaaacagaacaggagttggcttgcaatggaggacaaggagctgcttttgaggcagtgacaaatctactaaacaatgaaagcatatcagatgtggaccgactacgtctggtcatgctgtatgctttacgatatgagaaagatagccctgttcaattaatgcagctcttcaacaaattggcttccagatctgccaagtacaaacctgggcttgtccagtttcttctgaagcaagcaggtgttgacaagagaactggtgatctttttggaaatcgagatctaatgaatattgcccgtaacatggctcgtggtttgaagggtgttgagaatgtttacacccagcaccagccacttctgtttcaaatcatggaaagcattgtcaaagggaggttgagagatgtggactacccattcattggaaatcactttcaacagggaaggccacaggatgtgatcatcttcattgttggtgggacaacttatgaggagtcacggtctgttgctttacaaaatgccagcaataccggcattcgttttattcttggcggctcttctgttcttaattctaaaaggtttttgagggacttggaagaagctcaaagggtagctcgttctagcaccactgtcatttga

SEQ ID NO: 24993 - DNA, 315 bp, Glycine max
  Peptide Sequence Number=SeqID_141771
atgcgtctaccggggaaggagagtctgccgatgaaatctcccataaccataaatgagattttggatgttagcatttcgtttctaaatgaccatttagaggaaacactgggtttgacaaaaatagaagaaatccactcaaagtgtatcaatctcgcacagtgcggggcgaaaaaaaagtcgctagcgcacgggattttggttgatattgtccggtccaaagacctctctgcacatttcttctgttttccttcaatccctgatcaggagctttctttccttcttcttcttccttttttactttctcccattctttga

SEQ ID NO: 24994 - DNA, 618 bp, Glycine max
  Peptide Sequence Number=SeqID_141772
atgtaccatttgaggggtacacttgatgatgagtggaagtttgatttttctgtgtctaatgcccgccagatggtttacaccaaccaagcagatatgaccgaaaggcttcatgccggttcattggcatttgaatgccgcatcatgcactacttgattgtgtgcatcctactccctagatcttccaaccttgcacaggtttctgaggaagatttgagaatcatgtgggttttcttaaccggtcatcaaatcgattgggcccatcttccctttgtcaaagtcaagagatccttctctatcggtgcaaatgtagtctcttccttcggataccacaaagagagggatggctcttgggtgaagaaggatgctctggtacaggctgatgaagaccattctccatcaccacattctcagagagatgactcttcatctcttatgcacaacattcttgacagactggatggactccacacctttgtcggagagcgctttgacttgctggatagccgtattgttgccatggatgcacaatttgcagggatggatacacatatcaccaagcttgaggaggatgttagttttgtttgtcagtgctttgatattccaccaccatcctcatag

SEQ ID NO: 24995 - DNA, 255 bp, Glycine max
  Peptide Sequence Number=SeqID_141773
atgttggaagagaagtttgttactattattgatgttagtagcaatgaagagaaagttcattataaagcttgggaaagatctaacagactcagcctaatgttgatgagaatgactgttgcagacagtattaagacaactctccctaaaatcgaaagtgctaaaaagtttatgggattagtggaagagtattctcaaacagctgataagtctgttgttgggacattaatgagtacattgaaccaccatgaagtttga

SEQ ID NO: 24996 - DNA, 432 bp, Glycine max
  Peptide Sequence Number=SeqID_141774
atgactcaagagctggtagcccacggagacaccttacggttatccgcacctcgtcattcagtgaccccaagtgtgattgatgagcagagaccaatatggtcatctgcgccctttccggagatgtcagcattttccgatggagacttttcaagtctcacaaaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccacacccttttgtcatccagaggcggcgggcccgatgacaagcaaagaccaagtttggtcattctgcacccttgtatcatccagaggcggcgggcccgatga

SEQ ID NO: 24997 - DNA, 797 bp, Glycine max
  Peptide Sequence Number=SeqID_141775
gttcatacatggtctgtggatgctaaccagctcattgctgatgaagaagatgccacttatagttgccgcatctctagtgtgcttttactggaagaggttgtgaattcttttgatggtgaaggaattttggccataacagatggtgcaaaacaatggttcaccgagtctcaaattagaaaagtagctgtcacctgtgagacaaagttaaccaccattagacgtttcaataacctcatgacactattaatcacttctgaaacatatttaaccattagtgctacaagtactgatcaacataatgggtatggtcaacataatgcgatgacagtggcggcacaacgagtggagggaaggagtaaaaattttagggatgcatcaaatgtttactctttctacttcataagttttttggaagatacgggggaaaaagatttgtcgtttgagttcaagaaatgggtcggcgtcagggaggtattcatcgtaaagaatagaaattggagcgtccgaagatacagttttgtacgattcaaaggggccgatgacgttaggaaacttgagagacaattggataacttgattcttggcagactgaaactacatgcaaatcttccgaaacatggaagggagtggaagctgatggagaaaaccaacaagatcagcacaaagggctggcagcaaaactacggtgaagaggtggttaccgagatatgtgcaagcaacgagaatgacatcccacttgtgaatttagttaagtataccaatggaaaagaggacacggttcagcaacgcttgggtag

SEQ ID NO: 24998 - DNA, 327 bp, Glycine max
  Peptide Sequence Number=SeqID_141776
atggcaggggcaaggaggagtataatgcatttttttattcccttgtttcaattgatacccagttatttttccttgaggatcaattggcacttcttggaaaggtttgcatcctcattccctgttgactatatagtgatatttataaacaaaaatcaatgttactacatcggtgcctacatcacaaccgatgtagaaatatcatatttcaacgtcgctgcttactttaaaaatgacttagaaagtgcatcttactacatcagtgcctacttcaccaccgatgtagaaacaaatgcaattctacaacggtcacttatggaccgttgttaa

SEQ ID NO: 24999 - DNA, 474 bp, Glycine max
  Peptide Sequence Number=SeqID_141777
atggaggtaaagaacattaaaccaaagtaccttggtggcgacatagtgttactcatggacctcattgataccagagcagaagaaatattggtggatattgatgacgatgttgaagaccttcaacaattggatagggcacgagtgctcataaaaacatcatggcaccttataatcaatcactccgtaactacgcccattaacggggacgattatgtgatcaacatcatagaggagacgtgctacaacccctgtatgtgtaaatgcaacagcgggagcctgatagggtcctcaaaggaaatattttctaacgagaatgaagtggggctggccttatcgttggaggttgcgtcgtcccacgatgagtctccaacgataaccatgctagctgatgcagatggaggtgagcagaacaaaagtggtggggagcagcagttgtccgctggtctatatatcatgtcagcacctatgacatag

SEQ ID NO: 25000 - DNA, 822 bp, Glycine max
  Peptide Sequence Number=SeqID_141778
atgctgtacaacgtggttatagccaatgaagtggtcaaagaagcaaaaagatgtaataaaaactgcctagtgttcaaagttgattacgaaaaggcgtatgacttagtatgttgggactttctattgtatatgatgagtcagatgggtttttgtaccaaatggattagatggattcaaggttgcctaaaatcagcttctattttcatattggttaatgggagcccaagagcagagttcactcctcaaagaggacttaggcaaggtgacccactagtctcattctcgtttaatattgtagcgaagggcttaactggtctgatgagagaagcccaagagaagaatttgtttgaagaatgttggtcagtaccctttccttatttgggtatccctattggggcacacccaagacatagtgagatttgggatccaatagtcaagaaatgtgagagaaaattgtttaaaccgaagaaggtggtggataggttggtgaggctgcagcggtggttcttgtggggaggacactcggatcagaaaaagattgcacgggtgaactggggttcaatctgtctatcaaaggaaaaaggtggcttgagcatcgaggatttggtgaaattcaactatgcacttcttggaaaagggtgctggaatttgtttcatcaccaaggagaattgtggccacaagttttggaatccaactatggagcatggaggaatttggatgtgacaagaaggaacaacagagagtccctctggtgggaggacctaagcttcatctgtaattcgaccgagaagggaagctggtttaaaagcgagacaaaatga

SEQ ID NO: 25001 - DNA, 165 bp, Glycine max
  Peptide Sequence Number=SeqID_141779
atgaggaagcaaccaaatttcagctgggaaaggaagagaaagggtcaaattcgaatcctacccctaagcagcttcctgaagatgaaaggcttgtgtttcactcgcgatgaaagcttcatatccagcaacacaacatttgtagttaaaggtagaggagtcatctga

SEQ ID NO: 25002 - DNA, 300 bp, Glycine max
  Peptide Sequence Number=SeqID_141780
atggattgcaatttcttagaccactgcccaattctattgagatccacaattgttgatagaggcctgaagctgtttcaggttctagattgttggtttgaggataaatctttcaggaaggagactgaattggagaggcctagactagctggggtcagatttcagtccattggccagcaagataatgttctcctggtggcgtgctttgaagagaaagaaatgaaggttgcagtgtgggactgtggcagtgtgaaaagctctggatcggatggactaaatttcaagtttatcaaggaattctag

SEQ ID NO: 25003 - DNA, 318 bp, Glycine max
  Peptide Sequence Number=SeqID_141781
atggacgcagagaaacacgaggaactggaaccagagaaacggaacgcaaaccgaggcaggattttagcgtttcaaagcaaaacagaaaaatttagaagctctccctctctctcacgcagccttctcttcttttcttcctccaccattgttgcccaacaaagcttcaacctttggtgccaatttccgctccaaatcgcaaaaggagggcatttccggagtcgtgaagcgcgtctctacgtgtgggacttcgaaatttcaggtttgggtggacttctttctcctttgattttcgtgggtatggggttttgggagatatga

SEQ ID NO: 25004 - DNA, 639 bp, Glycine max
  Peptide Sequence Number=SeqID_141782
atgaaacaacttcaccatccatcagcattagacatgtttgacaaaattattgacgcgtcaaagggaaaacaatttgtcatgtttctggactatgatggcacgctgtctcctatagtcgacgaccctgaccgtgctttcatgtgtgattcgatgagaaaaacaatgaggaaacttgctaggtgtttccctactgctatagtgaccggcagatgcaaaggcaagatgcatgacttattttggaacttggaagcaacaggtatgattgggatagttgattataccaattatgatgatatgaaatatgctatcaggaaacttgatgactcagaattccgcaatgccttttctcgtgctttcatacgggttattctagaagtcctagtcgtgattcaaggaggagctattctagaagcctcagccgtagtccatatatctcacgaagccgcagccatagccgcaacagaagtcatagctatagtgacaggagcagaagttggtctccgaaaccaaaacactctcgacattcaatatctctttcaagtgaatgagtatccctgcgttattgtaactagggtgtttctcttggagtctatgtttctatcatcgttcccaataggtagtatcatgtggctcatttaa

SEQ ID NO: 25005 - DNA, 357 bp, Glycine max
  Peptide Sequence Number=SeqID_141783
atggaaactgcagaaaaccagggtggtatatcaactgtaacaagagaaaacatcaagatacaaggggattcagtgcatgaaaaagttagacataaatgcaacattataagaagtgccaatggtgtaaatcaatcacaacacataggaaacaatgtgcatatgaataatcaagcactgtcagggaaagaaagagacatacaaaatgtttgtgacctcgaggttcagcgtgcgcaagctttagggaaagaggttcagggtacgtttgacagtgcaggaggtgcgagggttcagcgaaaaaggtttaggggaagaggttcaggaggcgcgagggttcagcaaaacgcagtgaatgcctga

SEQ ID NO: 25006 - DNA, 3579 bp, Glycine max
  Peptide Sequence Number=SeqID_141784
atgagcaacgcatatgttagctcaacaatatatgctgttaggtgtaaagaaccattctcattatctttcaatggctactcaaacttctgttacgaaagatttgacagaaccgcatcatactgtttgtcatgctgtggttgttgtgatttctgttcagtctccacttacagagtacccataaaaccttgtcttataaatgggttgaggcaatctgctcttcttcaattgtcggcatctagaaggttgatattgggtggtggagaccattaccttccccggctaccagcttatggtgtcctcagaggttgtcaggagcttaattcttctgtcaatgagagaactgtttacaataatagtagatggagaataaagggaagatgtatttgtgctacttccccgaaagggagagaattttcccattcatttggttctgatgatgctgaagcagttctcagcttgttgagtgaggaggcagataaggatgctattggtagcaaatgtaagaatgcatcttcatcaaaaagagtggaagttgagaagaaaagaaaaaatctgagcagagagagacattttagttcaagtgagaaagtagaaacagagaaaaatggaaatttgaagcgacatgaatcatccaccatagacttgagaagagaatatggaaaagccaacaaagaaagggaagcctttgcaaaaagtgaaaaccataggaaacgaagagatgcatctagttgttcatcttattactctctctcatcaggagattttgggagtgagctggaagttcaggatgagattggtttggaagagtcgtcactggaatatgagaaggatgaagcgaatcatctggaggaacaagtaaaggaagaattcaacaggcaaggggatgactcaaagaagctgcaggctgtttcaaataagcgaagaattgcatttggtgtggatattgattggaacctaaggaacaagtctgaaaagaagctgactgagggaactctgcaaaacactgaatccacaagagaacaacaggacatgcattcaagagaatttagaacacttgaatctggtcataaaaaatcatctatttcacaaaagcgagtcaatattgaggatgataaatcatcttgtgttgtcaatttggataagaaaactaacaaagcatatattcaaactgagtctggttgtgatgaagttgagacaattttgttatcacaaaaggaattcagtggcagggaagggaagcttgagatatcagaaacaattttgaacgaaacaactgataaacataaaaagtttgttagttcaacttctaccacaggaaagcaaactttgacatcaaagaaggtattcagtggcagggaagggaaccttgcaatatcagaaacacttttacaagaaacaaatgataaacataaaaaaattgttggttctacttctaccactggaaagaatgtgatagatagaagttcccagaaatatactggaaatttaaaaattgaagacactgaaaggacctcaaatactaggatgaaggacatggaagtgaaaaaagattcagttttgagttctgttcagggagtggaggagcagcaataccaaaaaggagagaagatcattaaggtgaaggataaagagagaagaaaaaaatctgaacaattttctgaagtatcagaagctcacaagatcaatgttgaagatacatctagcataaagtctagaactagattaatgaacatggaagaaaaatcgaacataagctcagatgcaagggttacgtggctccaaacagataaaaggacaactcagagtttccaacacaggaaaggatctgaacttgtcagcactttatcagaaggctatgccagtgatgaaaagcaagtttcaagttctcaaaaagcttatgagaaggtgagattaattccaaaaagtaaatcaacatcagttgttagaactagagaaagttctagccaaactgatgaaaggattgcaaattttgaattggccagagacgaccaaagatctagcaacctttcaatttctgatgaaactacctcaagagaggaatccagctcccagggatcattgaatttgatttctggggctggaaaacatattatattagcatcaggtgaaaaaaggaggcctgcaacaatgttgatcccttcctcttctgaaattggtggagactcagcacatgttgaactcactgcaggaattgcaagccctgagatcttccttggaacttcagaaagtggctcttctgctttgtatgacaattcaggaagaaggtctgctttgcatccagatgctattgattcagctgatcgtttagagaagtcatctagacagtttgttgatgagtttgctgagaggatcaggcatgaagtaacgacttcagaagcacaagagatggaagttacaggaacaaaattgaatcttgaagttgggggtgatcagatctacagctcaaggcaacaaggcactcaaaatggtgctcagtcaaaggagcatgattctagtcgttcctctgggtttcctgggaccaaaggaccttctgatgagatgtgggatgtcacagaaccatctgctgagcaagttctagtagccaaagaaacagagatcagcaaggaaactgggaaagcagttgttactagaactgggaggtccttatggggtatgattgctgatattgttcgattacgttggggttcacgtgctggttcctccacttctgctgagagaaattcaccaaacaagtctgacagtgacacatggttttctgggcaggagcatgaggaaaccactaaaactaatgtcataaaagaaacaagtgtaccaccacaagccatgacttttgataagttaaaaccgggtaaacattatacccaaagtgagggagaggtgtccgacaatacaaaactgaaggacaaaggaaaaaatgttgaagttggattgtcatccccaaatacattggaaagtggatcaatgttagtaggcgtatcttacacttctggagaggaaaatgctagttggactgaagataaaaaaaatttgaaagtcaatacttctggcactcaaaacatggaattaccaatttcagtacctgccagagggccttctattgttggagaaattataagcattggtggatctgacatgtctggagctgaatcagtggttccaatcaaggaatctgttgctcctgggcagtctgaattgtccggctcagagagaaaggatggagagttgaagcaaaggaagtttcaacggaacaggcaagtcttaagagataggtttgatgactgggaagaagcctatcaacgtgaacttgagcagcgaagagtagatgaaatgttcatgaaggaagcacttttggaagccaagaaggctgctgatacatgggaggtacctgttggagctgttcttgtgcagcatgggaaaattattgctcgaggctgcaacttagtagaagagttacgggactccactgcccatgcagagatgatttgtatacgagaagcttcaaaccttctccgatcatggagactatcagctagtaccagtggtactgaaagtacatag

SEQ ID NO: 25007 - DNA, 333 bp, Glycine max
  Peptide Sequence Number=SeqID_141785
atgaatattgattatgctatcaggaaagaaaaaccaccagatattactgagactaacactccaaatgcaattgatctttatgaaaaatgggagcatgataatgtcaaggattcattgaaagctatcgatgagcaatttactacatttgataaatcccttaccaacacccttataatgcaattctcatccatgaggctcactgggatacaaggagtacattatcacatcatgcgcattagggaaatattggctcaaatgaaagccttggagattaccatgtctgattctttcttgggtatgaaaaacctaaggatgccagtgggaagtgactag

SEQ ID NO: 25008 - DNA, 230 bp, Glycine max
  Peptide Sequence Number=SeqID_141786
agagatcaatacagtctgagcattctcctcatctatcagatggaaaaactggggaatcagagagagcaacaacttctccagatgaggaatcagaaagatcagcagctcctccacctgggggaattaggctagcatccgctaagcgcaacactcctgggctaagcgcgaggaagaatccagaagaatatgagttgtacagattcgctaagtgcaccacttcatctctctaa

SEQ ID NO: 25009 - DNA, 108 bp, Glycine max
  Peptide Sequence Number=SeqID_141787
atgaaattgaagaacagtgtgctgagtaagtatggttgccgtactgtttccctatgcatggtgtgcctggggtcccattataaggatgtatgtaattctgaactgtaa

SEQ ID NO: 25010 - DNA, 912 bp, Glycine max
  Peptide Sequence Number=SeqID_141788
atggattttcttggcatcgatctcaatctgttagtggcttttgacgcgctgatgaacgagcgcaacgtcacgcgggcggcaatccaggtgggcgtcagccagccggcgatgagtgccgctttgtcgcggttacgcaccctgttcggtgacccgctgttcatgcgcagcgcggagggtttactgccgaccgcgcgtgcacgcgatctgtccggccccatcgccggggcgttgcgccagctcgaagcgacgctggtggcaaagcccgcgtttgcagcggaaaaagcgcaaataaacttcaaattgggcgtgtcggagtatccggctttcgtgttgctgccttcgttaatgcaggcgctacaggacgtcgcccccggcgtgtcattgaatgtgcaggcgtttaccaaccgcgatcacgcggtcgatttgttagatgccggcgcgattgatgtcgccatcggcgtcatgcctacccacagcgatagccgcatcatctcccggccggtattgcgcgacgaattcgtcaccatcgtcgccagcaaccatccggcggccagacgcggcatggacatggagagttacctggcgctgccgcatattctggtctcgccggaaggtgaactgtacggcctggttgatcaggtgctggcgcagcagggtaaaaagcgccggctgggactaacggtccagcagatgtttacggtgccgtctatcgtggcgcaaacccacatgacggcgaccgtgatgaagcgcgtggcgctgcatgcgcaggccagtcgccagctggtactgttccctccaccgctgtcgttgcccgaaatggtgttcaacctgatctggcaccggcgcagcgacgcgcatcccgcccagcagtggttcagagaatttattgaactacaggcggcgcggttgtag

SEQ ID NO: 25011 - DNA, 447 bp, Glycine max
  Peptide Sequence Number=SeqID_141789
atggataatgcgcggcgtcaggtcgatgccattcgtcaggggaagatgttcggaccgatcgatcctaacaagaaactgccgcacaccgccgcatgtgatagcgccgctgccgccgctgcgctgctgatcgatcgttcctggtcgggacagcaggatgtgccggttctcgggcccgaagagcattcttacgccgaactcgccgccatcatctctgacgttatcggatcggaagtccgctatgtgcaccagtcgtacgaagcctacaaacaagccgcgattgaaagagggttgacgccggctttcgcgcaaggctatgtcgacatgctacgcgcgaaagaggaaggcatggacaacgtggcaccccgctcgacggccatcatcggtcagaccagcttccgccaatgggtcgaaaacgagttgaaacccgcagttgtaaggggaaactga

SEQ ID NO: 25012 - DNA, 444 bp, Glycine max
  Peptide Sequence Number=SeqID_141790
atgaatccagcagcagaatacgtacaacgtctgaaaattgaacgacaggcggtagagacgctctatcaggccttcagcgacaacaaccccgatctggtcgatagcgtgctggctccgtcatgggaagacattccgctggcgccgggacaggcgcccgggccggaaggcatcaagccgatcattcgcatgctggcgcaggcttttccggacgtgcagatcgtggtgcatgacatgattcaggaacctggccgcatcgcggcgcgggcggaaatcagcggcacccatctcggcgaaattttcggtatcgcgccgactggtaagaaagtgagcttccgtctgcatgagttccatgcgctggaggacggccgtctgatcaccacctggcacatggaggattggtttggcctgttcctccagcttggccagtttccgccacaagcctga

SEQ ID NO: 25013 - DNA, 585 bp, Glycine max
  Peptide Sequence Number=SeqID_141791
atgcaagaaaagactagctctaaaaagtgctttaaatttcttggaaaaggacacatcacttctcaatgcctcaccaagaaaaccatgattatgaggggccaagacatttgtagttgccaagatgaggctactagttcaccttcctctagtgaaagtgaagaagcaaaaagggaagaatctagtgaagaaatctacccccaagaagaaggacaacctttaatggttaaggaggagtgtaaggaggtaagtgtctcctccaagagattagctatgaaggaaagtcattttgcaataaagacaaaaattaaagaaacttcccctcttagacaacctccacgttttttcctttgtaaaaagacacttgttagcactaccacatctcttgggcttgaggttattcctcaagtaaagaagttgttggatgagggtttagttcgtaagagcttaaatccttgtactttgttggtgtccaaaataggtgttgagggaaggagcccagagtatcaagaatctcagaatttgaggtcaaatcatttccaagagggagggaatgatgcaatcctaccccccaagggtattggatag

SEQ ID NO: 25014 - DNA, 141 bp, Glycine max
  Peptide Sequence Number=SeqID_141792
atggttgttaagtacatcgaggcggtcaagcgaaggttgcatgccagcaaacaatggtccccagacgaaattaggatagtttacatacctattcataaccacaatcatcttttcataccagacatctatttaccgaaatag

SEQ ID NO: 25015 - DNA, 117 bp, Glycine max
  Peptide Sequence Number=SeqID_141793
atgggggacctcccggggagtcctcgtgttgcacctctttttaggtgcgatcataccagcaataatgcaccggatcccatcagaactccgcagttaagcgtgcttgggcgagagtag

SEQ ID NO: 25016 - DNA, 348 bp, Glycine max
  Peptide Sequence Number=SeqID_141794
atgagtcaatcagacatccaagtaaaaagttattgtcgtttgaatttgtttggagattccattttcagtttcgagcatctcgatatattaagggactcaatcggacatccgagtaaaaagttattgccatttgaatgtggaagcaatgccttccatggttattttgatgatgccaaagaatcaagagttaagcaaattccaaagattcaagaatctagattcaagattcaagaatcaagtttcaagaatcaagattcaagaataatcaagatcaagattcaagaatcaagagaagactcaatcaagataaattacacaatacttgtaatcgattaccagagcttctaa

SEQ ID NO: 25017 - DNA, 213 bp, Glycine max
  Peptide Sequence Number=SeqID_141795
atgtcacatcctatcagagcattgtgtcccgacgtccttcagcacaagggagaccagttagggtcacagtgttttgcgagaatgctccaaccatgtgggatcggcataggcttaaaggagcactcaaaccgggtgacccccaaggtctacactccaaagagtccgtcagggcctctcccttctgattcaggtccaacccagaaaacattttag

SEQ ID NO: 25018 - DNA, 261 bp, Glycine max
  Peptide Sequence Number=SeqID_141796
atgacagatcttgtaagtgcggaagatgatgtaaatctccgcgtgtcaacgggcttgccggccgcgattgacgaggggtgcagaatgaccataatttgtctctgcgtgccatcggacacgactgtgtctgaatggcaaaaggggtgcggaatgaccataatttgtctccgcatgtcatcgggcccgccgcttctggatgacaaaagggtgcagattgaccataatttgtctctgcgtgccatcggacacgactgtgtctga

SEQ ID NO: 25019 - DNA, 592 bp, Glycine max
  Peptide Sequence Number=SeqID_141797
ggactacacgtcctcgccttggagagggactacacgtcctccccatcaagaggggctgcaccgccctcacctccagaggactacatgtcctccgccttgagaagggctgcacgccctccccttggggctgcacgcccctcactttgggtactagttaccctcaacgtcagaggactacacgtcctcaccatcagagggctgccacgcccttacctccagaggactacatgtcctcgcccttgagagggctacacgccctcgccatgagaggacaacttgtcctcaccttgagaggactacacgtcctcgccttgagaggactgcatttaccctcaccgttgagaggactacacgtcctcgccttgagaggactacacgtcctcaccatcagagggctgcatgccctcacctccagaggactacatgtcctcgccttgagagggctgcacgccctcaccgtgggtactagttaccctcaacgtcagaggactacacgtcctcgccttgagaggactacgagtccttaccatcagagggctgcacgccctcacctccagaggactacatgtcctcgccttgagaagggctacac

SEQ ID NO: 25020 - DNA, 294 bp, Glycine max
  Peptide Sequence Number=SeqID_141798
atgaagatcaagaaaagaacaaaagaaaggaaagaaggattcccgatcaaagatcgaaaggaagtgaaaaggggaaaagaagcaactctcgatcaacgaaaggaagagaatagaaagtctccaaatccagattgccactcagaatcattcttgactggcaatattccaccccacatgaacaaagaggaaaaaaccgaaacaaccagcttcctctccaaaaacgctgacctcgagaaaatcctattgattagccccatgtttcccctgcgtgtttgtttgaaggctagaagttga

SEQ ID NO: 25021 - DNA, 477 bp, Glycine max
  Peptide Sequence Number=SeqID_141799
atgaagggaatcacaggagcaccttacagggcacgttgtgatgctttgaccatcacaaatgtgtcatggttgtcgtacactgagcatcggggggttagggcctttgagctgatttcatcattccagggtcagttgagatggggtcctaagatggtcacagctcgactggagagggtggtatctgcggattacatggagtggtttttccggatatctcacccattcatgataccgacccaggcaggtgaccagcccagagatgcaccagccgtagaccctgaggagtacatacagccgcctagccccccggttccagtggcatttgacccccctccacatgcagatgattacgactgctatgaggcgattgcacagaggttggagcgtgtgctcaaccttaggatggtcactgcagacacagagttatatgatattagacggggagccagtgctgatggaagtgtcagggctcgatag

SEQ ID NO: 25022 - DNA, 290 bp, Glycine max
  Peptide Sequence Number=SeqID_141800
atggttatcggttcaaggacgcaaggtgcccctgctttttcagggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcgg

SEQ ID NO: 25023 - DNA, 423 bp, Glycine max
  Peptide Sequence Number=SeqID_141801
atgtctatttcaccgagtctctctccgagacagtgcccagatcgttacgcctttcgtgcgggtcggaacttacccgacaaggaatttcgctaccttaggaccgttatagttacggccgccgttcaccggggcttcggtcgtcggctcccctgtcatcaggtcaccaacttccttgaccttccggcactgggcaggcgtcagcccccatacatggtcttacgactttgcggagacctgtgtttttggtacccatttgttgaaggtcgttcgagcttttcctgggagtatggcatggattacttcagcgctgtagcgcctggtactcgaactttggctcgaggcattttctctaccccttattaccctgaaaaagcaggggcaccttgcgtccttgaaccgataaccatctttcggctaacctag

SEQ ID NO: 25024 - DNA, 531 bp, Glycine max
  Peptide Sequence Number=SeqID_141802
atggggtggttggagtaccaaggaaatgtttggaagcaaaggcgaggaccttggcaagcaacgattgatgcttttcacgccttttacgaccgcaaggaaagcccgattgtcgctatcttagccgatctatatgacacattcggccgaagatgtgaaaagaacagtgcaaggatcgtttgttgtacaccggcactctatgtatggttggtttcacacctttttcgccaagaggtgagacacatttgcctgctagaaggccaccactcatgcaccaagaaaaaggaggcaaactgggacaaactcttagcaagcaaagaaggagtgtctgtcaattggttcccccgatggaaagaaggaagaaccgggattcttatttcgtgcggggaatttccaaatgttcccttgatggggacgagtggttgcattaattacaatcctgtttgtcataccctaatttcgtccggggaccatctgcttggtgggatgcaacctttgcttgaccacttcgaggtacttgacacccatcgttag

SEQ ID NO: 25025 - DNA, 380 bp, Glycine max
  Peptide Sequence Number=SeqID_141803
atgtcaggatttacacgcaattctcctcaaatttcagccagcccgtatcaattagacttcacactttatgcttcggggtcatacaatgctcaatggaatgccccagggctcctccacgataagcacacattgcgttcgagtcgtatcctcagaaaagtggaggtggtgttcgtcattggaagtgcggtagacagactttgtggtagatttagggatggcctttgtggatacctgggtggtggcatgggtttctccctctttctcaccctcttcatttgccccagttttctcagtcgtcctagtaggatgatcaaatttgcctcttttcggacccacatcgatcctttcactggcgaagaccaaatccgcaaagctttgag

SEQ ID NO: 25026 - DNA, 603 bp, Glycine max
  Peptide Sequence Number=SeqID_141804
ttgccggtgggtaccacactggcactgcgggtgttcaacgccggcggcaacgatgtcgaacgtgtggaaacgaccttggccagcggccagacgtctgcctcgcagtggcccttggcgctggcgcgcaaggtcaatggcagtgcacaacatgcgcgcgtgggcgtgcttgccaatggcgtgatcacgccgtcggcgtcggccaccgacaatcgcgtgtacctgaaggacggcaaccgcttccagctcgataccagggtgccggacccgggtacgccgtcgccgggcggcgatttcgaccacgtgtacccggcgggcatcggcagctatgtaccgggccagaccgtggtgaagagcagcgacggcaagctgtatgcctgccgcccgttcccggaaggtgcgtggtgcaacgtcaatgccgaggcgtaccggccgggcgtgggtgcggcctggcgcgatgcgtggatcgcggaatgccggccagcggccggcacgccccgcctacttgctgctgacgtacttctcgcggcggatctgcgggttgcccaggccggcggccttcagcagctcggcgcaggcatcgaccatgtccgggttgccgcacag

SEQ ID NO: 25027 - DNA, 1205 bp, Glycine max
  Peptide Sequence Number=SeqID_141805
gcaaggcgagggatatggcgaatcaagaggagtgggtcccattatagacgtattagcattgctaatctttggggttgtcctcttcccaaacgtggatggtttggtggacctagccgcaattgacgctttccttgcatatcaccatagcaaagagagcccgatggtagctatattggcagacttatttgacacatttgacgaagatgtgaaaagagtagtgcatggatcatctgttgtttacccgctctttatagtagattgggaccaacacttggctgggataggaggcagaacagtcaactggtttccacgatggaaagaaggaaaggagggagttctcttctcatgtggaagctacccaaacatcccgttgatagggatgaggggttgcattaactacaatcctgcactttccataagacagttagggtaccccatgaggggagcaccgacgaaagaaagcctgtctcctttccttgtgagagattttggcgtgcaaaatttcaaggttatacaaagtgtccataaggcgtgggaaagcccgttaaggaaagataaagaacttaggggcattcgtaatggcatcattggtggttatcatgaatggctgaaagttcgtacacggaggcttacattggctcgccaagatgaagaagtccgagctctgaaagccgaactaggaaaagcgagacttgccaaagaaaagttcaagttggtcgctacagacgtccaaaaagagtgtgccgggttacaagaagaaaatgcagctaccgcaaaagcccttgaacaagaaaccaagagggctcgcaaggaagaacatggccatgacaaattccgtggagcgttgtggggcagtaacagtgagttcaagcttcgaagggaggagagagaccgatcacgagcacatagcatggttttaaaagaagagttagccgtttgctcaaggtccaaaagaaacttgtctcagcgtttatgcgagacagagaccaagttagctatcatcaccaagtaccaagaagaactaagtctagccacggcccacgagcatagggtggcggacgaatatgcccaagtgtacgcggaaaaggaggctagaggaagggtgatcgactcgagtcaagaacttccccgattgctagccaaggccaaagcaatggcggacacctactccgcccccgaggagatccacggacttctcgactatt

SEQ ID NO: 25028 - DNA, 924 bp, Glycine max
  Peptide Sequence Number=SeqID_141806
atgagtgccttcatacgccagtggttgaggacaaatcctcaggagattgaagctaggctctgtattccccgcaaggggtttgttttgaatgctgagggtcagccatggaagcttcttagaaaagatctgaagacactggccaagacatggagtgtcttcccttactccaacctagctcccacatcccacacctcagatctagatatggatagaggtaggttggtctatggcttagtgactaacagggacatgaacattagagcccttatcttaggtcagatttattctattgctcagagtaactcctctaggctcagatttccagccttgatgactgccctatgcagagctagaggagttacctctcacagtctgacctatgagagcctgagcctggccattaacttggcctacattaagaaaaactgttggaatgtggatgatctaacagttaacttcagaggggtgaggaaggcaaggggcttgcaggtggtagctcctccagggtccattctatcggtagagcagttcattgaaaaggtatcctggcctggaaccttgccttctgtagtgaggaaaggtgagggtcccagtgctcaggtacctcaacaggtacaggatgcatcatctgaggccaccacccatgagccattcatttttgaggcaggcagggcacatgtaaggcaggaggctgctactccagagagatcaccacagatttcaccagatccaccctctccagtggttgatcaatcttctcttcagcagccggcagattctcctacactagtgcttgatcttccagcagacccgtgtacaccattacttgagattccagaggaccctaccacaccagtcctgggactgactaccactcctccaaccactcctgtgctacatttgacagatgaggaaggcacttag

SEQ ID NO: 25029 - DNA, 366 bp, Glycine max
  Peptide Sequence Number=SeqID_141807
atggtaacaagaaatacctccacattaattaacgttattaatgaagatagtgaccaaagctcagataacacaactgaggtaggatcagtgtcagaaaagaatataaatccaattaattccaaacactggaaaacaccctccaaattatattatcaacgtccgactgcccctgatcttctactagaagaaagaggtgaaaacaattttaaaagttttagtgcaaacaacatctatgaatggaacatagatgcaaaatcggagtataacatcatgaatacactccaacacatgaccgtggtagccacgacttaccaaacctcccacgaatgttcagaagagaccattatagatatcttagtggcatga

SEQ ID NO: 25030 - DNA, 444 bp, Glycine max
  Peptide Sequence Number=SeqID_141808
atggttcacttaattgttcatttggtcagagaaatcaaatgttgtggtcctgtttatttgtggtggatgtactcggttaagccatacatgaagatcttaaaagtgtataccaagaatctacattgtccggaagcatctattgttgaaaggtacattgcagaagaagccattgaattttgtttagagtacattgaaaaggataaaccttttgggcttccccagtcttggcatgacgaaagagtgggtggtaagggttcaagaggactttatgttatcactccaactgtagaagatttgcaacaagctcacttaaagctagcagatgggcctaaaagaaatattataacttggcaagtatacgacataaacaagtattccttttacacaaaagcacaagacgaccaaatgtacaatgcaaaacagcgaggtcaccctaagggctaa

SEQ ID NO: 25031 - DNA, 675 bp, Glycine max
  Peptide Sequence Number=SeqID_141809
atgactccgagaaagctttccgtaaagagatctaggaaggacgccgcggctgaagggactagtgccgctcccgagttcgacagccatcgtttcaagagcgctgagcaccaacagcgtttcgaggccatcaagggatggtcattccaccgagagaggtgcgtccagcttagggacgatgagtacacagatttccacgaagagatagctcgccggcgttggacgtcgctggtcactcccatggccaagtttgacccagatgtagtcctagagttttataccaatgcttggcccacggaggagggcgtgcgggacatgcggtcatgggtaaggggccagtggattccttttgatgtaaacgccctcagccagttcctgggagacccgctagtgttagaagagggccaggagtgcgagtatagccagagaaggaaccgggccgatggatttgacgaggaggtcattgcccagctgttatgcataccgggtcaagatttttcccagaccgctgccgggagacgggtgtggatcatgcgcaccagcatgactaccttgacccaaacgtggatgatgttgctgctcagcaacatcctgcccagcgatcataactccgaccttccgctgccaaagtgtcagctagtgtatgccacccaccaggcaccctctagacccggataa

SEQ ID NO: 25032 - DNA, 330 bp, Glycine max
  Peptide Sequence Number=SeqID_141810
atggttggatcacttcaccctagacctattgcaaccttccattttctgtccccacattctgctgttgtagcattttgtgaggagattttgaagcatggtactgcctgggaggcactaagaggggatcttgcagctcagaaggctgaaatgactcttgaggaagagagagcggctacggaatacaagtacatagattttggaagtaccatcacatacgggtcatacagtgtacatagcttaagggatggcagcgactatcagcaaaagattaaagggagggaatcaaaagtgggtgtgccggttaaatctatttgcatcgtcaaccgctga

SEQ ID NO: 25033 - DNA, 231 bp, Glycine max
  Peptide Sequence Number=SeqID_141811
atgggctttgtgacgtttcagaagaaaatgtgcaaaatattcaaaagaaggggaaaagggtcacttttggggtatttttcagcccctgggcccactaggaagcttagggctgaagtaaccagctcgcctgggcgagctaagcttgcttgggtgagcaaggttacttctaaaggaagcaagcagctcgcttgggcgagctactgtgcaacctccacccctcatttcctataa

SEQ ID NO: 25034 - DNA, 237 bp, Glycine max
  Peptide Sequence Number=SeqID_141812
atgtggacacatggccgaaaggtatttggtcaagctccaccattgtgtgaaaggtacatgacccttgaagttgtgcgtgccttgtgcatgaagtggtttgagattgacgacgatcgtggcattatattctctgaagggtacatagcccttaattccataagtgccttgtgcataagtgccttgagcttgaggttgattgatgcattgtctcaagggtacactattcttgtggactaa

SEQ ID NO: 25035 - DNA, 182 bp, Glycine max
  Peptide Sequence Number=SeqID_141813
gactatggtggtggtgcatgtgggtgacattagcgtcgctaggtttagatctaggacagagatggtgcagtgcttataggttgggggctggcacaacgggtccaaaatttggtcagagtggtggtgacctacgatgttggatcttgatggaggtggaggcacacgatagtgttggaagataa

SEQ ID NO: 25036 - DNA, 669 bp, Glycine max
  Peptide Sequence Number=SeqID_141814
atgtcgaacctgtacggcgaatacaaccagaagatcgactacgtgttcaaggtggtgctgatcggagactctgcggtggggaagacgcagctcctcgctcgcttcgccaagaaccaattcagcgtcgattccaaagccaccatcggcgttgagtttcagaccaaaacgctcatcatcgacaacaagaccgtcaaggcccaaatatgggacaccgccggccaagaaagggcagttactagtgcatattatcgcggtgctgttggagcaatgttagtttatgacatgactaaacgccaatcatttgataacatggcaaaatggttagaggaactgagaggccatgctgacaaaaacattgttgtgatgctaattggcaacaagtgtgatcttggaactcttagagcggtgccaactgaagacgcggaggagtttgcgcaaagagagaacctattctttatggagacatcagcacttgagtccactaatgtagaaactgcctttctgaccattctaactgagatatacagacttataagcaagaaaacacttactgccaatgatgatgcagatccaagtggtatttcagggcttctgaagggaaccaagataattgttcctagtcaagaaatcaatgctggtgaaaagaagggtaagggtggctgttgttga

SEQ ID NO: 25037 - DNA, 186 bp, Glycine max
  Peptide Sequence Number=SeqID_141815
atgacgatgatagtgacgaaccatgaccacaatggcagtggtaccagtggcagtggcaatgtcgatggtggtaccagtgatgacaatgacattggtgatgacgacgacaatgatggtgttggtggtgtcaatatcaataatggtgatgggcacgagagtgctgatggtgctggtcgcaatagcgag

SEQ ID NO: 25038 - DNA, 693 bp, Glycine max
  Peptide Sequence Number=SeqID_141816
atgttcggccatgctggcgactacagcgccgtcagagccagtgacaacatagaagaaacaactgtcatagggtcaacgacaacgagtgtcaaaggagtcgcggaagaacccacgcgccaaagacaaacctggtgcgcgtacgcgtgtttcgtgcggaaagtgaacggatttcgggatctgaacgccctgagggatgatttaatggagttaaagccaacactgtttgctggtgtcccacggtcaaaggttacatttgatggacttgtgacatgcacaatgttcattcagacaagatttcatgctaaggacgagggtgacaataaaagcaagcaggtttttgaagaaatttacaaggctacatgtacctggacatgtggatctgttgtcgtcatacaagatgaaacactcaagctggcctgtaaggcgatgtgcaagatgctaataagcatcgagagtggccatgaattagtgacgatgcataacgaggctcgaaaaagaatagtgaacatattggagaagaatataagtgaaagaagaagtggaattgcaactcaccatgaagattttcttcaacaacttttagataataaattaaatgaggatggagtcccagcagacaaagagatcaaagataatatcttacctatgataattgcagacattttaagatggttatttgaaaaatcgtcttag

SEQ ID NO: 25039 - DNA, 900 bp, Glycine max
  Peptide Sequence Number=SeqID_141817
atgggttctgaaggaaaacctatgcttcctgttctagatttcaccatagaagatttgaagccagggaccaattcctggttatcaacatgcacaagtgtgcgccaagcatttgaggagaatggttactttgttgctgtgtatgataaagcttctattgagctacaaaatggtgtatttggctccatgaaggagctgttcgatctcccaacagaaaccaaacgaagaaacatatttgagggcatgcccttgaaaggctacgttggacagcaccccaagattcccctccacgaaagcatgggcatagatccgggaacaacactagagggaattcaaagtttcgcagaaaaaatgtggcctcatggaaatgatcaattttggtatgctgaagtattgaatcggatggtggtgagaatgatatttgaaagttatggtcttttggagcactatgacacattcatagggtctacaaattatctccttaggcttttggcacacaaagcactcgaacagaatgagcctcaactgggttttgtggctcacactgacaaaagcttcacaactattcttcatcaaaatcatgtcaatgcactcatggtggagacaacgaacggtaactggattgatgttgatttctcttcacctacttcttttgttgtaatggctggtgatgcactcatgggtacatcctttgtggcacaagtagagggtaaatctacttgggttgttatactgagaacaagagagggtacatctcttgtggatcagttcaagtggagagtacatccacttggttgttcaaagagaacaagggagggtacatcccttgtggatctttggcttgtaaaggattttacaaggttgaagaaatctcaagaaccgttggttgcttggggactggat

SEQ ID NO: 25040 - DNA, 162 bp, Glycine max
  Peptide Sequence Number=SeqID_141818
atggtaaggaggattgttgatgctaagggtaatagcagtgacattttgtgttaccttagcaacatcattggttgcaagactaggttcaattcccatggctgcatttcaaacatgcctacaggaaatgttggtgtaaccacagaattactggtgtcactatag

SEQ ID NO: 25041 - DNA, 2298 bp, Glycine max
  Peptide Sequence Number=SeqID_141819
atggctgaaactgacatccaagactatctccaactcttcttcctctggttactctccatcatcgccgttagagccatactcaccaaactccgccacaagcctcgccgtccaccgggcccacggtccctccccatcatcggccacctccatctcatctccgccctgcctcaccagtctttccacgcgctctccacgcgctacggccccgccgtgcaagtcttcctcggctccgtccccgccgtggtcgtttcgtgcccggaactcgcgaaggagttcctgaaaacgcacgagcccagcttctcgaaccggttcgtgagtgcagcggttcaccacctgtcctatgggtccaaggggttcctcttcgcgccctacggaagctactggaggttcttgaagaagatttgcatgtcggagcttctcggtggccgcaccctcgaccagttccggcacttgagggagcaagaaactttgagggcgaaaggggaggcgcatgaggccgtggatgttagtggggagttgatgactttgaccaacagtgtaatatcgaggatggttttgagtcgaacatgttgcgagagcgatggtgacgtggagcacgtgaggaagatggtggcggacactgctgagctggcggggaagttcaacgtggcggattttgtgtggttgtgtaaggggttggatttgcatgggataaagaagaggcttgtgggtattttggagaggtttgatggcatgatggagagggtgataagggagcatgaggaggagagggagagaaggaaggaaagaggggaaggggaggagattagggatttgctagatattttgttggaaattcatcaagatgagagcagggagatcaagttatctagagagaatgtcaaggctttcatcttggacatatatatggcaggaaccgacacatcagctataaccatggagtgggccctagcagagttaatcaacaaccatcatgtgatggagaaagcaagacaagagatagattcagtgacagggaaccaaaggctaatacaagaatcagatcttcccaaccttccatacctacaagccatagtcaaagaaacactaaggattcaccctacagcgccactgctagggagagaatcatcagaaagctgcaatgtatgtggttatgacattccagcaaagtccttagtgtttgttaatctgtggtctatgggaagggaccccaaaatttgggaggaccctcttgagttcaggccagagaggtttatgaacaataatgaagaaaaacaaattgatgtgaggggacagaatttccaactattgccatttgggactgggagaaggttgtgccctggtgcatcacttgcacttcagactgtgcctactaacgttgctgctatgattcaatgctttgaatttagggttgatgggactgttagcatggaagagaaaccagccatgacacttcctagggcacatcctttgatttgtgtcccttctggcgacgatgagttcacgacaaagtcggggtacctgttcaagctgagcgcgacgaaggcagattcgctgggggaataccggatactgaaaatcgcggctgtatactcgaggaagcctctgctcgtggctcaccgcttgggaaatgcttcggtttccgctacatcgatactctcttggaccgctccgagtcaatgtttcagatatcgagcgtttgatgagttagaagggattgaagtggcttggaatcaggttaaggtggcgaacctattgcataacttcgatgatctggagcgactttattcagaggttcatttgctcaagactttgaagcataaaaatataattaagttttacaattcatgggttgacaccaagaatgagaacatcaacttcattactgaaattttcacctcaggaacattgcgtcaataccggaagaaacataagcatgttgatttgagagctgtgaagaaatggtccaggcagattttggaaggatttttatatcttcacagtcacaatccgctggttattcatcgagaccttaagtgtgataacatttttgttaatggtaatcaaggggaggtgaaaattggtgatttaggattggaagctatccttcaacaggccaattcagctcacagtgtcataggtacccctgagttcatggccccagaactttatgaagaggaatacaatgagcttgttgacatctatgcttttggcatgtgcttgctagagttggtaaccgttgagtacccatatattgaatgcaccaatgctgctcaaatatacaagaaagtgacatat

SEQ ID NO: 25042 - DNA, 610 bp, Glycine max
  Peptide Sequence Number=SeqID_141820
atgaattcttcctccatttatattcttgtctttgtccagctttggttgttgagcttaccatgcagagagagtgtgtgcatcccaagtgagcgtgagacacttatgaagtttaagaataatctgaatgatccttcaaataggctttggtcttggaatcataataataccaactgttgccactggtatggagtcctctgccacaaccttactttccatgttcttcagcttcacctccacacctcagattctgttttctatcattactatgatagctactctcacttcgatgaggaagcttataggagatggagctttggtggagagataagtccttgtttggctgatttaaagcatttgaattacttggacttgagcgccaatgaattccttggagaaggtatgtcaattccttctttccttgggacaatgacttccttgactcacctcaacctctctcatactggattcaatgggaagattcctcctcagattgggaatctctctaagcttcgatatcttgacttgagcggcaattatttacttggaggaggtatgtcaattccttctttcctcgggacaatgacttccttgactcacctcgacctctctg

SEQ ID NO: 25043 - DNA, 99 bp, Glycine max
  Peptide Sequence Number=SeqID_141821
atgggcactcatctccatgtgattggtgatcccatgaatggagttcaacggagctgttccgtttctcattcctatgacgaggtgtattataaattgtga

SEQ ID NO: 25044 - DNA, 291 bp, Glycine max
  Peptide Sequence Number=SeqID_141822
atggccaagttcgatccggaaatagtccttgagttctatgccaatgcttggccaacagaggagggcgtgcgtgacatgagatcctgggtaaggggtcagtggatcccgtttgatgccgacgctatcggccagctcctgggatatccgttggtgttggaagagggccaggaatgcgagtatggccagaggaggaaccgggaggcgagtgtgaatcatgcgcaccaacatgaccaccctgacccagatatggatgacgttgctcctcagcaacatcctgcccagcgaccataa

SEQ ID NO: 25045 - DNA, 489 bp, Glycine max
  Peptide Sequence Number=SeqID_141823
atgtgcatcaaatttgtgaattacaatgttatgataaatggtgatggtgttggtcgtcctattacaccaaaaagtggtcttagacagggggaccttttatcaccctcctcgttcattctttgcatggaagctttctcatctttattaaggaaagcaaaaggttgtggtgacattcatgttgtaaaagtgtgtagaggaaccccacttctcttacacttggctatgaataaggaagttgagaccttacagggtattttatccacctttgaaaaatcacctagacttgcaaccaacttccaaaaggatctaaaagtaattcagttaaaggaattaactagctcaacggtgcagagctccttggtgttgaggtttttgcgggttggaaaggggcatcaccatctctctccaacagatatgagcttcatccacatatgcgcttcaacagttccaccattgccctaccattctagatctgagcttcctcgataa

SEQ ID NO: 25046 - DNA, 936 bp, Glycine max
  Peptide Sequence Number=SeqID_141824
gccgtcaccttcatagggccacatgccctcacctttagagaactacaggtccacgcctttagaggactagacgtcttcgccttgaggagtaaaggcgctcaccttaagaggccgacacgccctcaccttcagaggactacacgtcctcaccttgggtactcatacccttaccttcagaggactacacgtcctcaccttcatagggctacacgccctcgccatcagagggcaacacgtcctcaccttgggtactcgtaccctcaccttcagaggactacacgggtacacgccctcgcctttagaggactacacgtcctcgccttcagagggttacacgccctcgccttcatggggctgcacatccttgccttcgtagggatacccgtcctcgcctttagaggaccacacgtcctccccttcatagggctacatgccctcactttcagtggactgtgcgtcctcaccttcagagggcttcaccccctcaccttcagaggactgcatcccctcgcctttgtaaggctacacgccctcacctttagaggactacacatcttcggcttcatatggctgcacgccctctgcttcctagggttgcacgccctcgccttcagaggacttcacgtcctccccttcagaggactacacgtcctcggcttcggaggactacatgtcctcaccttcagaggacaacacgtcctcggcttcagagaactacacgttctcaccattagaggactacacgacctcatcttcagaggactacacgtcctcgtcttaagagggtcacacgccttcgccttcgtagggctacacaccatcaccttaagaggactacacgtcctcgaattcatagggctgcacgccctctccttcagaggactactcgtcctccaattaagaaggctacatcttctcaccttcagaggactacag

SEQ ID NO: 25047 - DNA, 2018 bp, Glycine max
  Peptide Sequence Number=SeqID_141825
ccttttccttcattggtgctgatgaaactaaaggaacttctttccaaggcctgactgtggagaataaggagccagagaagaatgaagtgtcttttgccacttggaagagtgcacataaagtggtgcaggaaggaacaggcgtgggactgggaaaagttgtgcagttgctagagagtaaaaaccgtgaaggactggggtttgcttcttttgcaagatcctcaaagaacagtgttgggtcgagctccattagtagcaccttttgtagtgccgggttcatcaacgacttgccagaagccaatgtcgtcttggaagctgttcctaaagagatagtgccagcatttgttacacctggaagacttgttcgcaactgggacgcggttaacatcccttcagtagttcatgcgtcaaagctgaagaggaggaggatgaagaaattccaaatgaaattggttgacaaggctagtccgaaggatgatttccctttacctcacatcgatgtattggttgacaacactgctaagtccaaagtcttctccttcatggacggtttctctggatacaatcagatcaagatggcagttgaagacagagaaaagacatctttcatcacgccttggggcaccttttgttacagggtgatgcctttcgggttgataaatgcagaagtgtacgtggatgatatgatcgttaagtcgggtaatgaagaagaacatgtcgaatatttgcttaagatgtttcaacggctaaggaaatatcaactacggctgaatcccaacaaatgtactttcggtgttagatttggaaaactcttgggtttcattgttagccagaaaggtattgaggtagaccccgacaaggtcagagctatcagggaaatgcctgttccacaaacagagaaacatgtgagaggttttcttggacggttgaattacatctcccgtttcatttcgcacatgacaaccacgtgcagacccgtattcaagctgcttcgaaaagatcagggtgttgtttggactgaagattgtcaaaaggcttttgatcgcatcaagaattatctgctagaacctccaattcttatccctccagttgagggaaagcctctgattatgtacttgattgtgttagaagattctatgggttatgtgcttggacaacaagacgagaccggaaggaaagagcatgccatttactacttgagcaagaagtttacagattgtgagtccaggtactccctacttgagaagacttgttgtgcactagcatgggctgccaagcgtcttcgccactacatgattaaccacaccacctggttatatccaagatggacccgatcaagaagaattgctcgttggcagatgttgttatccgagtatgatatcgaataccgcacccagaaggcaattaagggaagtgttcttgctgatcatttggctcaccaaccaattgaggactatctacccatcaagtttgactttcctgatgaagagattatgcacttgaagatgaaggattgtgatgaaccattgcttggagaagatccagatcccgagtctaaatggggtttgatttttgatggagccgtgaatgtctttggcaatggaattggggcagttattatcactcctgaaggtaatcatctccctttcgccgcaaggttacagtttgattgcaccaacaatgtggcagagtatgaagcatgtatcctgggcattgaaaaagccattgacttgaaaatcaagaaccttgacatttacggggattcagctctcgtaatcaaccaaatcaaaggagaatgggaaactcgccaccccggcttgattccatacaaagattatgcaaggcatttgctaaccttcttcaacaaagtggagcttcaccacatccctcgtgatgagaaccagatggcagatgcgttagcaactttatcctccatgtacgaagtgaatcaccggaataatttgccaacaatcagaattcagcgcctcgagaggcccgctcacgtgtttgcagtcgaagag

SEQ ID NO: 25048 - DNA, 219 bp, Glycine max
  Peptide Sequence Number=SeqID_141826
atggcacaacctccaccccgtgaaaggactctaagggaaatggctgcacctgatttcacctacgaaagcttgtgcatccaataccctgatgaggatgtcccatatgctcttaaaactagactggtccatttgcttccaaaggttcatggccttgcagagggagtggcaaaggactggctttattaccttgctccacgggtccatcacgagctgggatga

SEQ ID NO: 25049 - DNA, 276 bp, Glycine max
  Peptide Sequence Number=SeqID_141827
atgttgttcacatggtttaatgaaacaggttgggacaaggaagggacaaaggagaacacacatcttttagaagaaattgaaaagatcttatgctatgtatgtgacgaagtctgcatatgcttgctgcattcgtatggcttgctgcattcgtatcaccatagagtggtggcaatgaagtgccttaagaatgtcacaagtggagatgctgagttttgggcagaagtcataatcatcgccagaatgcaccacctcaatatggaactgaatttgagttag

SEQ ID NO: 25050 - DNA, 246 bp, Glycine max
  Peptide Sequence Number=SeqID_141828
atgacattgtcagggcaaaattcaaaaacttcgacatccttacctttaggaacactcaaaaggtggcaacgccactcaaaaaggcacgacttcggctacgtggcggtggtgggagcagcaggtccacttcggcttcaagtacttcacgacgggaaacaaaacatcagggtggtagcgggacggagttcacgtcgggatgaagtagttaaggcaatagcgggggcgctaggtttttggagggtatga

SEQ ID NO: 25051 - DNA, 369 bp, Glycine max
  Peptide Sequence Number=SeqID_141829
atgaggcatgcatccccttccctctctcatgcctttcttttatataagatacacaggtttgtgctgatgatgaaagtgaaaggtgaagcatgtgaggttgtgaatgttggagatgagcttttgaagctaataaacaacatagtgatgagaatggcaataggagaaagttgtttcaacaatgatgatgaggctcacaagttgacagaaaggatcaaggagtcttccaaggaaattgggaagaacactattagaaaatacactttcaacatcggttatttatggcattctacattggttttaaaaccaatgttgaaagtaccgatgttgaatgttttacaattaacatcagttttacaaaaccaatgttaa

SEQ ID NO: 25052 - DNA, 492 bp, Glycine max
  Peptide Sequence Number=SeqID_141830
atgttttgtgtggggtgcttcttggtccttgctgattattgggccattacgaggagtgtggctcgtaacaataccatcaggctgggtaagagccttgtcctcaaggctcgaattgagagtggtgagcggggccccaaaatcattaacgatgataggcgatgcttggaggtggtggtggttgggttatgttggttgaggaggaaaaactttgtcaaaggattgttggtggataataggtgggtggaggagccaatggtggtaaaaagaaatattaaggaattctttgagaagatgtttaaggaagaggagcgatgtaggccaaagcttgacggagcaaattttaagagaatacaaagacagaacaacttgatgctcattttggtctttaaagaagaggaagtaaaggaagctatttgggcttatgggaatgataaaagtcttgatcccgatggtttcctttcctctttatcaaagaattttgggaggttttaa

SEQ ID NO: 25053 - DNA, 423 bp, Glycine max
  Peptide Sequence Number=SeqID_141831
atggagctaaagcatagggcctattgggccctcaaattcctcaacttcaatggctcactatctggagagaagcggagattgcagctgatggagttggaggaaatgaggctcaacacctatgaatcctccaggcattataagcaaaagatgaagatgtatcatgataagaagctactgagaaagaccgtttatcccagacaacaagtgtcattgtataattcacggctgaggcttttccctggaaagctcaaatccaagtggtccgggccattcatggtcaaagaagtgaagccctccagagcaatagagttaataaaacctgccacacctaatcctgagaaaaattggatagtcaacagtcagaggttgaagatatacaatggtggcagtgtcgagagactgaccaccatcatccatctctag

SEQ ID NO: 25054 - DNA, 1536 bp, Glycine max
  Peptide Sequence Number=SeqID_141832
atggctgattttggtgactattttgggttgcttttcatttggctagcctccatcttcattttacgtgtaatattattcacaaagtctcgcatcaagtcacgtctacccccaagtcctagagccctccctgtgttaggacacctctacctcctcaccaagctcccccaccaagcattccacaacatctcaatacgttatggtcctttggtctacctcttgttcggttccaagccttgtgttcttgtttcatcacccgaaatggcaagacaatgcctcaaaacccacgaaacatgtttcctaaaccgacccaaaagaaccaatttggactacatcacatacggttcttcagattttgtgttggcaccctatggaccctattggagcttcatgaagaggctttgcatgactgaactcctcggtggccgcatgcttcaccagcaccttcccattagagaagaagaaacaaagttgttttttaagagtatgatgaaaaaggcttgttttggagaggaggtgaacatagggaaggagctagccatgttggcaaataacataatcacaaggatggctttgggaagaaggtgttgtgatgatgttgaaggggagggggaccaattgattgagttggtgaaagagatgactgagctaggtgggaagttcaacttgggagacatgttgtggtttgttaagaggttggatttgcaagggtttggtaaaaggcttgagagtgttaggagtaggtatgatgccataatggagaagatcatgaaggagcatgaagatgcaagaaagaaggaaatgggtggagatgaagcagtgagggatttacttgatattctacttgatatctataatgatgaaagttcagagattggattaacgagagaaaatatcaaggccttcattatgaggaaagaggagactataacatcagccactacaatagaatgggctttggctgagctaataaaccatccagatatcatgttaaaagcaaggcaagagattgattccgtggttggtaagaatagattggttgaggaatcagatattctcaaccttccctatgttcagtccatagtgaaggaaacaatgaggcttcaccccacagggcccttaatagtgaggcaatccactgaagactgtaatgttaatgggtatgacattccagcaatgaccactttgtttgtaaatgtgtgggccattggtagggaccctaactattgggaaaatccacttgagtttaagccagagaggttccttaacgaagagggacagagccctttggatctgaaggggcagcattttgaacttttgtcatttggagctgggagaagaagctgccctggtgcttcactagctttgcagattattcccaacaccctagctggaatgattcagtgttttgaatggaaggttggtgaagaagggaagggaatggttgacatggaagagggaccaggaatggcccttcctagggcacatcccttgcaatgtttccctgcggctagactccatccttttgctgaagtctaa

SEQ ID NO: 25055 - DNA, 198 bp, Glycine max
  Peptide Sequence Number=SeqID_141833
atgcagggttaccttatggttacccgcacatttcgtcaaccaggggcaaacgagcttgttgacgcgcggggactaacatcgtcttctgcaccttttgtcgtcctgccccgtgaactttggtcaactaggggcaaacgagcccgttggcgcgcggagattaacatcgtcctcggcacctttatccgtcttgacccatga

SEQ ID NO: 25056 - DNA, 578 bp, Glycine max
  Peptide Sequence Number=SeqID_141834
atgacaacgttagtcactgcatgctactggacccttgagtctgacggtagaaacaagactttttcacggtctcagccggaagacgctgacatctccgggaaaggtgcaaatgacgattctcggctagaagacgctggcatctccaggaaaggtgcagataaagatatgctgacatctgggaaaggtgcagatgacgacattgacactgacatctccgggaaaggtgaagatgaccacattggtctttgcatgtcaacgggctcacttgcctctaatgctaacatctctgggaagggtgcagatgatcacattggtctctacgtgtgtccgcgtgctaccggacccttgggtcacgatagcaaaattgagacttatttgcggtctcggccggaagatgctgacatctccgagaagggtgtcttcgcgtgccatcggactctcgggtcacaggatagcaaaaagtatgcgcggataaccatcaggtgtctccgcgtgccaccagactcacagggcgagaaagtcgccagcgcacaggattttggttggcaatcaaaaggagaggactacttgaagtcgtg

SEQ ID NO: 25057 - DNA, 216 bp, Glycine max
  Peptide Sequence Number=SeqID_141835
atggcgaactcttttaaccgaatggtggaaagaatggatggtaaagttgatgatgaagatattcaagaagtattacgtgaggcagctttgataccagatcttagtagacaacaatgggctaaagctattaaatggttcgaccttttacacttgatgatgaatgaagattatggaatgaagaacgttgtttttttttttaaaatttggaccttgtaa

SEQ ID NO: 25058 - DNA, 408 bp, Glycine max
  Peptide Sequence Number=SeqID_141836
atgtataatactataataacctatattggtctccactgcagtgcacattggcaaatggtcgtcattttgtctaaagaaaatgttgtcatctggttttgttcgttgcataataggccaaacaactacctcaaaggaataattaatagtgctttgaaaggacttgaagatactccacaaactaaatccaaggctggtgcttggtgggttgttgttaaatgtaatgaacaaaaaggaagcactgggtgtagctattacgtgatgcactggatgtcaactataatcttaggaagtttcaagaataattggaaaaagtatttcaattatgctagaccattagagccagagagattgaaggtgcttcgcattcagtgggcaaagtattatttgaaagctagaaatgaaacttag

SEQ ID NO: 25059 - DNA, 1107 bp, Glycine max
  Peptide Sequence Number=SeqID_141837
atggatggcagcttatggaaactcagcccatcagcaaactgcaattgtatctcgcaaaatatgtgtaatatcttttcatttctggattattatattcacccaagtacaacaaaattgttaagcttcgatacaatctggatgcttaagatgttcataagattatgcatcggagtattgggtgtggcagctgttcagctctgcatatcagtagcttttccaggttatttctggtacagaggaaaaggatttaaatctgcatttctacgtcataaaaagcaaatagtactttcatctgtttttattgtagtttcagcaggaatatttttcattatacagcaacctaaagattacaaaagtaaaggtgcaggggttgttatcaaaggtaccttatatactgatctgaagattgattctgtaaaaatattctctaaggattttcataagcaggtaggaagtgccattgtaaaaaacggatcattcctgtgggaaacccgtcaacagattccatttgatcaatatagtcttgaatttggaaccaaaagaatcgatttcatgatgggaagcggagaccattttgattttgacatccgttgtaatcctttaaaaattcaatattttctaatctccaacaggtctgccgaacagcagtataatacagaagaagatggattcggatatgaattctcatatgctgtggagcaacagaaatacaatgataatccttcagagttttatcagctagcgcaatccgattggaataaaaatattaagagattggaacattatacagatgctgaaaataatgccttatctgatgaatataaatcttacaggaagcagcttcttgccattcagtatttgaacgagattaataactatcggaaaatgacttcctgggatgaccctaaatttgctgctccgaaagaatttttaaacgaactgaattctaaaattaaaaatccgacggttctgttaagtaaaaatgatgattacttacaatacagattggataaaatgctcaccgacagggaccggttgtccaatcctgacagtattctttttgtgaaattaaacgcgttacccgataatatcgacaaagaccgtttg

SEQ ID NO: 25060 - DNA, 165 bp, Glycine max
  Peptide Sequence Number=SeqID_141838
atggctacagccaggtgggcactcaagcatcccgtttatggcattgtgatactacggttgggaatttacacaaacagacccaacgtttccaagacaacattcctaaatgaaaaactctacacggctccgaaatttcaacaaacactattgacaacaacgaagtaa

SEQ ID NO: 25061 - DNA, 570 bp, Glycine max
  Peptide Sequence Number=SeqID_141839
atgaaacttttgcccttgctggcagcattacccctgctctgcgcctctgtcgtttccgcgcaatctttcatgtcggtcggctacttcaacggcggcggcgacgtcaccgcaggccccggcggcgatatagacaagctggacgtcacgcaaatcacccacctcaactattcgttcggactgatctacaacggcgagaaagacgaaaccaatgcggtgttgaaagaccccgctcgccgccaccagatctacctgtcgccgaaggtgatggccgatctgcaacggctaccgacgctgcgcaagcagaaccccgagctgaaagtgctgctgtcggtcggcggctggggcgcacggggtttctccgccgccgcggcaactgcggaaaaccgggcgatattcatccgtttcgcgctgcaggtgatcgcccagtatcagctggatggtatcgatctggactgggaatatccggtgaacggcgcctgggggctggtggaaagccaaccggcggatcgcgacaacttcaccctgctgctgaaagagcttcatcaggcgttggtaaaggcaagctgttaa

SEQ ID NO: 25062 - DNA, 318 bp, Glycine max
  Peptide Sequence Number=SeqID_141840
gctgacccagctgggtcatttgacacggagcggtatttacggcatttggttcgccagcaggcggccaaccacagggcgcacgtgcagacccatgactctctatatcagcatagcctcagcctgcagagccagggttttgcttcttttccatgccctactccggatcagttcagggcagaggtcgcatggcccggagattggcctgaggcccaggcaggggaggcacccgcggaggctcccggcgaggcaaatgaggcccgcgaggacaaggagatgaccgatttgcttgatttcttgggagggagcggagccacatga

SEQ ID NO: 25063 - DNA, 455 bp, Glycine max
  Peptide Sequence Number=SeqID_141841
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggccgaagggcgtagtcgatggacaacaggtgaatattcctgtactaccctttgttggtcccgagggacggaggaggctaggggtagagaaaatgcctcgagccaaagttcgagtaccaggcgctacagcgctgaagtatccatgccatactcccaggaaagctcgaacgaccttcaacaaatg

SEQ ID NO: 25064 - DNA, 810 bp, Glycine max
  Peptide Sequence Number=SeqID_141842
atgggaacaaatcaaaccggcaagaggttctaccaagtcaaggtcaaaagcctagataccaccagcatcaaggaattagggcggttgatggaacccctccaaatgcaaaccttccgcaagacttacggatatatcttagagttgaccatagcagaggtgtccatagaagccattgtatcacttacccaatactacgaccagcctttgaggtgcttcacattcggagacttccaattagtaccaaccattgaagaatttgaggaaattctaggatgtcctctccgggggaagaaaaccatatctttcctccgggtgtctcccctctttgagcagaattgcaactgtggtcaaggattcagcaagagaagtaccctagaagacaaggcgaggggtatggccaatcaaggagactggatcccgtttatggatgtgttagctttgctaattttcggggttgtcctctttccaaacgtggatggtttggtagacctagcagcaatcgatgctttccttgcctaccaccatagcaaggaaagtccggtggtagctgtcttggcagatctattggacacatttgaccgaagaatagattgggaccagctcttggccgggataggaggtagaacaatcagttggttcccccgatggaaggaaggaaaagaaggagtccttttctcatgtggaggatacccaaacattccgctggtaggaacgaggggttgtattaactacaatcccgcgctcgctataagacagctagggtaccccatgaggggagcaccgacggaagaaagcatgtctcctttcctt

SEQ ID NO: 25065 - DNA, 366 bp, Glycine max
  Peptide Sequence Number=SeqID_141843
atggagaggaaaatgcacaatcctacttcttccacagtgttgacaatattgctacttggagtgctttctcaaaaccttgtcgtccctgtaacatgcactcccacctcctcaccaactcccttcactggaacaagctactattggagcagtaacccaggaaggataaaggaggtgctagggtgggtgggaaccataggcagtgcatttggtgtgggtagtagtaataataagattccaagcaatgtgagcttggtacatgcactttccaacactacaagtgatgggctaggagcactgtgcagagaagggacagcttcctttctcaactccttggtcaacaacaagttcccttatacaaccccacaa

SEQ ID NO: 25066 - DNA, 159 bp, Glycine max
  Peptide Sequence Number=SeqID_141844
atggtccatgacatctttgtcaaggtgaagctggaagtaacaaggatatcaacaatcttaaacgtgtttggcagtagacgaagcaatgataaatgggtttatgatcccaacatggttggctcatggtacctaacacatgcaactaagagtgcatcatga

SEQ ID NO: 25067 - DNA, 879 bp, Glycine max
  Peptide Sequence Number=SeqID_141845
atgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccgcgggtagccccgcctgacctgaggtctcgttgggagcgtgcgtgcacgcaaagggtcgtcgatgggtccagaactgaccggctcgcacgtgattggtctcgagcgtggctcatcccaccatttttatcacggcgaaagtcggccatgaaccccagaatttcaaccaaaccacgagggcgggtgctcgcgggaggtcagccatacacccccgcgcagcaacattgttacatgtttgcgttggggaaacgatgtgtgacaccccaggcaggcgtgcccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 25068 - DNA, 538 bp, Glycine max
  Peptide Sequence Number=SeqID_141846
atgtcctgtcttttggaatttgggatgaccggtcctctcaatgagtcaatctcttgctttctaaaaagggtggacccttgggtactagtaccctcaccttcccaggactacacgtcctcaccttcagagggctgcacgccctcaccttcagaaggctacacgccctcgccttcagaggactacacgtcctcgccttcagaggactacacgtcctcgccatcagaggacaacacgtcctcgccttcagaggactacacgtcctcgccatcagagaactacacgtcctcgccatcagagggctgcatgccatcgccttcagagggctacgcgtcctcaccttcagagggctacatgcatgccctcaaaggactacgtgtcctcaccttcaaagggctacatgccctcacctttagagggctacacgccctcaccatcagaggaatacacgtcctcgccatcagaggactacacgtcctcgccttcagagggctacacgccctcaccttcagaggactaacatgtcctcaccctttagagg

SEQ ID NO: 25069 - DNA, 224 bp, Glycine max
  Peptide Sequence Number=SeqID_141847
tcggtgaaagagcagtctatgcaatgatgctggtgtttccacctgaattttctcctttgaaaactattttatttggaaatccttctcaagacaccgttgaacaactgatggaggctttggaggaagattctaaatatggaaatgagataaatgaatcaaggaagtttattggaggagtattggatcttgaaaagagaatcaatagactagatacattgacttag

SEQ ID NO: 25070 - DNA, 489 bp, Glycine max
  Peptide Sequence Number=SeqID_141848
atggatgacgctgctgctcagcaatgtatggtgcctactatgcaccctctggacccggagaagtccattatggccctggggtttctggctctgatcacaggcctctgccagtcctacggagttcctgtcacccccagtaaggccgcgagcgcaccgccaccacctcggcaagccaatccggctggatcactgggtgtggagcggtatctacagcatttggttcgccagcaggcggccaaccaccgtggacaggtacaaatacatgagagtctctaccggttcaacctcagtcagcaggggcagggttttatcccttttgtatgccttaccccggagcagtttgaggctaaggtcgcatggcctggagattggctcgatgctcagacagaggaggagcctgcaggatcccccgatggggcggatgaaccccagatggatgaggatatgaatgacctgctcggtttcttgggagggagtggggccacatga

SEQ ID NO: 25071 - DNA, 537 bp, Glycine max
  Peptide Sequence Number=SeqID_141849
atggcctctaggaagagaagaacgtccacctccagaccccaagagccttacaataccactcgatttatatctgaggtcacatgggagagatacgaacagaacatccacgccaggaacatcctccctgagaggaatacccccgtggttttggagccaggggagcgatactcggcatactctaggttctgcagcacataccctgatcctcaggagcttgctgccagactatctattccggggcggggttttgtacttaatgctgagggagctccttggaagcttctaagaaaggatctcactaccttcgctcaaacctggagcgtcttctcttattctaacctcgcccccacttctcatacgttcgatcttaatatggacagggcgaggttagtctacggactagtgatgaagatggatatagatgtgggctccattaccttagaccagatttctcaggacgtggacaccacacctatgccagctcaggatgcccctagatcacctcaggatgacccagcaccagctcaagaggagtga

SEQ ID NO: 25072 - DNA, 198 bp, Glycine max
  Peptide Sequence Number=SeqID_141850
atgtatgttccaagatggagaagattaagaatgagacaactctggtggccagagctaaggttttacaagacccttagagcgcaccaacccccattcattggctattggggtctcgctaagcgagatagtcgtgctaagcccaaaaacctctcgagttgtgcaattaatggaatagggctaagcgagtcaactcgttga

SEQ ID NO: 25073 - DNA, 447 bp, Glycine max
  Peptide Sequence Number=SeqID_141851
atgttgcattttcaattgcttggtagaattagaatattagagaatgtagtgattagtgaaaaaaaagtggggtggaaggttttgattttaagttggtggaacttgttaggtggagtggacaagaccttcctagtttctatctactcatttgctttgcgactaaatcaaccacatcctgattaccacattcccttttgttttgtcaaatgtagatggcatgctgttgcttcatggacttgggatgcccaggatgaaacctgtgggatttgtaggatggcctttgatggatgttgtcctgactgcaaacttcctggagatgactgcccactgatttggggtgtatgcaatcacgcatttcatctgcactgtatcctgaaatgggtgaattctcagacatcacaagcgcattgccccatgtgccgtagggagtggcagtttaaaggatga

SEQ ID NO: 25074 - DNA, 228 bp, Glycine max
  Peptide Sequence Number=SeqID_141852
atgtctgctaattcaagcacaagggggaatgtcacgtcaaaccgtctttgctattgtcgtagaagagctaccattcgaacagcaaggacgacaaggaataatgagagactattttatgcttgcccattaccacaagtaaacattgatgttggtgcaactgaaataggtagaatagaaccaataccagactttggtctaaggttgagactgaagattatgcaaagatga

SEQ ID NO: 25075 - DNA, 2205 bp, Glycine max
  Peptide Sequence Number=SeqID_141853
atgcctttgtatgagttataccggctggccagagagaagcttggtaaagaaactaccagcacacgtgcacctgatctatgttcctcgcctgagaatgatttttttgagctagtttgggagaacggtcagatttcaagccagggtcagtccagtagagttagaaggagcccctcttgcaagagtttgccatctcactgcttaccatctcactgtcccaaggtcagggataaagatgtaggatatggtaccaacacaaggatgggaaaatttggggatttagactctggattgaatgaaattccaatgtcggtgccatcccgtgaagtggatttctgtcatgatgaagatgtgttaccttggttggattatacatcaatggatggttccttgcaacatgaatatggttctgatttcctacatgcctcaaacagttttactctattggataaaaaaagtaatggcaatatggcgtttagggattctcataaaacttcggaagaacaagggaatgttttcaagggttcttcagctgaacaggttgagactgccagacctaaagctagcaccagtcagttattccccccatcattgcatcagtgtcaaacatcttttgtttcttctagatcaagagcatcggatataactgaaaataacaatacgagtaatgcaaaccaggatgtgtcttatggtgaaattactcatattctatcttcctcaagtgatttgtctagtgcaaaggtgcagaagtgtgatccacctattactagcaatggttccagttccaccataatgaatttctcccattttgcaaggcctgctgctatggtaagagctaatcttcagaacattggcctgaagtctggtttgtcttcagcaagatcagatagtatggaaattaagaataaaggtgctgctgcaactagcagcaatcctcctgaatcaattcttgttgattcaagtggtgaatgttcgaaggaaccgaccatgcaatgccagcaggttgtggagcaatccaagcctgatgtgaactctttgcagccaaaatctgttgaacagaatgctgtgccttctaagcagtcagagcctgctagtaaagagagtgccacaaagattgatcaaactcccaaccaagttcttggcgacagtggcactaaaggacagacagctgctgaaaaaagtatggagccagcagtagcctcttcctctgtttgctctggcactggtgcagaccaaggttcagacgagccaaatcaaaatttgaagcgaaaaacaaaagacaccgacgactctgagtgccatagtgaatttccctccataaccaagaaaacattttatgtgaaggatgttgaggaagaatcagctggtgctaaaaagacagctggtgggcaaggaggtgcaggttccaagagaagccgtgcagctgaagtgcataatctatctgaaaggaggcgaagagacaggatcaatgagaagatgcgtgcattacaagaactcataccaaattgcaataaggtggataaagcttcaatgctggatgaggcaattgagtatcttaaaacacttcagctccaagttcaaattatgtcaatgggagctggtttatatatgcctccaatgatgttacctgcaggaatgcagcacatgcatgcaccacatatggctccattttcacctatgggtgttggcatgcatatgggatatggtatgggttatgggatgggaatgcctgacatgaatggtggatcttcaagattccctatgattcaggtgccccaaatgcaaggaactcatatccctgttgcgcacatgtctggacctactgctttacatgggatggccagatcaaatcctccaggatatgggcttcctggacaaggctatcccatgcatatgccgccagcttccgtgtttcctttttcaggaggacctctcatgaattcaccagctcagggactacatgcccgtggatcatcaggacttgttgaaaccgtggattcagcttctgcgtctggcttaaaggatcaaatgcaaaatgttgacccacaagttaagcaaagcactggtggctgtgactcgacaagtcagatgcctacccagtgtgaagcagcagctgtaggatttgagcaatctgctttggctcatagtagaggtcatgcatccaaggctaatgacaatggagctgttaatcctgatcctggcagataa

SEQ ID NO: 25076 - DNA, 2301 bp, Glycine max
  Peptide Sequence Number=SeqID_141854
atgaagagtatcaaacataaatcaaataaaactgtgtgcaataaaagaattttgcaacgtgccttccctctttttccgtcattgccagtacaatatgtgaagaatgaaaaggacgaaggcattgcacaaaagatggcttctttagcaaatgaagatgaagtcaaacatgacaagcctgaggatgaggatactccttcatcaaagacagaagaagatgaggttgctgcagttgagatcgaaaaatctgaagattctccggcattagaggcttctgctgaagatagtgtgaaacatgacaaggttgaggatgcacaaagtgcaacatcacccccaacagatcacaaggttgaacctgctattactatagaaaagactgaagattctgtgccatctgttgcagttgaagacaatgtaaaggaggagaaggaagtggttcctgactcacacagtatcagtgacattgaaccagttcataaggcaccatccacagaacccgctgcggaggaaacaccaccactggaactagaaaaggaaccaagcaacacagatgagactagtcctctgacagaatcagaaggaggggtgctgaaagaagctcaagttttggaaacatgtgcccaagtggaagagaagcctgagcctgtgtctacacctgtggctgctgaagttgatgaaagccagaaagaaccagaaaagcaatcattggaacaaagggtagaagaggagaaaccagacacatctgtagttcctcaacactcagaagaaagcggtgatgccacagaggtcaaaacaagagaactagaatttgaggcagaggtattggaaaagactaacaactctgaaacagagaaaccagagcctgtggaagctgaagttgctgaaagccagagagaagcagagaaagcagagcctgtggctgctaaagttgatgaaaaacagagtgaaacagtgaaagcagagcctgtggccgctaaagttgatgaaaaccaaagtgagccagaaaaacaagagaaagaagagaagcctaagaaagttgctcctttaacagaagctgaaagtgcagagcaagaaggaaatatagttgaggctcaccctcccaaagactcaggtattgaggatgtgaaagacactggcaactcggagccagaagcagttcctgaaaaaacagagaaaccagaacctctgccaactgaagtggaggaaaagccaagagaacaactacaagtagatgaggaagttgcagaagctagtaaggaaatggaaactaagaaagaaattgtgattgagactgccaagagtgaaggaacatctgacgacacgatcaaggaagagaaaactgagaaagaggaggaaactagcctcactgtaaatgccacacaagtttcatcaaatgcggaacctcaagaaaatcctgtggaaacttcttctgaagttgtgcttgagacttccaagagtgaaggagctctggatgacacggccaaggaagagaaaactgacaaagaggaggaaactagtctcactgtaaatgctgcacaagtttcttcacaagtttctcctgaagcagcagaaaagattgttgaagaggttgatgacaagaaagaatcaagcatttccaatgtgatcgaagcggaatcaaacgaagccgctgacatcataaaaagtccagagcaagcctccattgatgaggaagctaaaactgacctaaacgaagaaagagagatttatgttcctgctgctgtggaggaaaaggttgctgttgatgttgctgcaaatgatgatgttgacaagaaggaacctgaagcacctaataatgctgtccctgaatcctctcaagaggaagtggttgaaagcaaaaaggttgaggaacagaacgaggcaaaggcagctacaactgaagcagcagagagtgtaaaagttgataaagtagttgatgacaagaaggaagagaaaactgagacaaaggtggaagaaatctctagagctattaatgaacctgttagagaaacattggcatctaaatttgaagaggaaagtgttgaacctggagcggataaggtagagaaagaacaaactgtggagcctgagaaaactgaggttcaagccaccaaggaaaatgatgcaacaaaaacatccaaggaccttccaaaagaaactccagccaaaccagctcaaaagcaatcaaataacatcatttcaaaggttaagcagtcactagtgaaagcaaagaaagctatcactggaaaatctccatcctccaaaaacctttcctccgagcccaagggcgatattaaagtcaaataa

SEQ ID NO: 25077 - DNA, 318 bp, Glycine max
  Peptide Sequence Number=SeqID_141855
atgggcacccaaaaagatacgaaatttttggaaacccttggctcctcgagaatcgtgaccgacgaggttttcctaatccaaatgcagcaacactgctatttgagtgggggtgatcatttcccagttcacataagcactgggaagttatcaaaaagcaatcttttcaggcctaagaggtgtctcagctcggagaaagagaagacccaaatggatgcagaaagtggcgaaagatttgcagagaagcaatgcggaagaaggcaaagcaaagcagtgtctggcagtgacacaaatgaaacagacaggaacagaaaagagtga

SEQ ID NO: 25078 - DNA, 342 bp, Glycine max
  Peptide Sequence Number=SeqID_141856
atgaatgatattgatgcggtatgggaagtcacaaggaaaccgggacacgacgatgtacaacaccataccgaccataccattcagtcaatgacgcaagacatgactcaaaccctccgcaccgacgagcaccaccacgtgataggcagcaacgactggtcccctgacagatgcagttttatgtgtcccctacgcccgatcgacgctctgcaagctcaaacgttgtttcttgaagaagaggatcatcgacatgagaaaaaagtcatgagttcgagaataagatttcaggaactttcaagtagaagagatgatgaaagttataaaggaaatacacaaacattttag

SEQ ID NO: 25079 - DNA, 291 bp, Glycine max
  Peptide Sequence Number=SeqID_141857
atgatgatgatgaagattgaaaagatatatagggatgtggaagagcatgtgtttttggggaaaatacagcaaatattttttcagctttgcgagctgcaagaaaggttgcactcgcagtctccaaagcacaaggcagagtggggggtgtgtttggtttggatttggggtttggggtttgggaagggatgggaggtggtagtgcctggtttgggggggtatttgatggctttggaaactttggtgagtggatgtgaggctctccctccctaccttctattctatgggtcctaa

SEQ ID NO: 25080 - DNA, 909 bp, Glycine max
  Peptide Sequence Number=SeqID_141858
atgccttcactctcagaagcctaccgagcccaccccgtgcacgttcaacacaagcaccctgacttaaactccctacaagaactccccgagtcttacacttggacacaccatagccatgatgatcatactcctgcagcttccaacgagagtgtccccgttattgatctcaacgacccaaatgcttcaaagttgatacaccatgcatgcataacttggggagcgtaccaagtggtgaaccatgccatacccatgagcctcctccaagacattcaatgggttggggagacactcttctctctcccttgtcaccaaaaacaaaaagcagctcgttcccctgacggtgctgatggctatggccttgctcgcatctcttccttcttccccaaactcatgtggtctgagggattcacaattgttggatcccctcttgagcattttcgtcaactctggccccaagattaccacaaatactgtgatatcgtcaagcgatatgatgaagccatgaaaaagctagtgggaaagctgatgtggctgatgttggattctctgggtattacaaaggaagacctgaaatgggccgggtccaaaggccaattcaaaaagacatgcgcagccttgcaattgaactcttacccgacttgtccggatccggatcgggccatgggtctggccgcccacaccgactccacccttctcacaatcctttaccaaaacaacataagcgggttgcaggttcaccgaaaaggcggcgggcgacctcctccacatattgtcgaacgggttgtacccgagtgtgctccaccgggtcttagtgaaccggatccagcaaaggctttcagttgcgtatttatgtgggccccctccgaatgtggagatatgtccacatgcgaagctagtgggcccaaataa

SEQ ID NO: 25081 - DNA, 651 bp, Glycine max
  Peptide Sequence Number=SeqID_141859
atgtacaatgccattatcttccttgggatccagaatgccttttttgtgcaaccagtggtcgccattgaacgaacagtcttttatagagaaagagcagctggaatgtattcagccatcccctacgcccttgctcaggttgtaatagagctaccatatatttttgtccaagctgtaacatatggcatcatagtttatgcaatgatcggattcgaattgactgcttcgaaattcttttggtatctgttcttcatgtacttcacatttttatacttcaccttttatggcatgatgactgtggctgtaacaccaaaccaacacattgcttccattgtggctactgcattctatggagtttcgaacctgttttcgggatttgttgtctcacgacctttttatattcctgtgtggtggagatggtactattgggcatgtcctgtggcttggagcttatacggtttggttgcatctcagtttggggatgtaacaagtgcagttgagttaaatgagacagtgaaagagttttttagaagatactttggttatagagatgattttgtaggagttgctgcaggtgtagttgttgggtttgcattgctatttgctactatctttgctttttctgtaaaggtcttcaattttgaaaggcgatag

SEQ ID NO: 25082 - DNA, 537 bp, Glycine max
  Peptide Sequence Number=SeqID_141860
atgaagaaccagggtgtaattgaggacaggttggtccttctgaagggtgctagtggtgcatttaggccaggtgttctcacagctctgatgggtgtgagtggagcaggaaaactggagggtacactgaggggagtatcacaatttcagggtaccctaaaaatcaagaaacatatgctcgaatctctggctactatgttcattgaggaggttatggagctggtagagttgaacttactgagggaagctttggttggtttacctggtgtgagtggtctctccactgaacagcacaagagactaactatagcagttgagctaatggctaatccctccataatattcatgggtgagccaacatgtggcttagatgcaagaggtgctgcaatagttacgaggacagttagaaacatagtggacacaggaagaacaattctttgtaccatccatcaaccaagcatagacatatttgaagcttttgatgaggtaagttctgctcttgatcatataatactgagttttctcacttttcttatttga

SEQ ID NO: 25083 - DNA, 2211 bp, Glycine max
  Peptide Sequence Number=SeqID_141861
atggcagaagctgaagattatggattcctcccagaggagatggctgtcaatgaaaaccttggctaccctaaagccttcgctaaactctgtcgcgaccgcggtttcagtccctacagccatggccctccctttaccttcatcccttatgttttgccagaagatgaggctgagagagctagggatttggatgagatgtttccgattattgatcccaaagctaaggcgaccagcaagcccaaaatctttgtcagtgtcttgtggaagcagctccgccatcttgggaatgctggctttgaccctgcggtgattcgggtggatggttatggcaatgtgctctattatcatgcggactcagcttctcctctggcttgggatgttgatcactggtttccttgttcaaggggaggtttgactgttcttagcaatctaaggatattacagcggcaagcctgtaagaggaagaaaaacaagctggaattcttggtgccatggtgggatttccaattggggatctctgtgaaccagttcctacacagggccttttcatttttgttctatgaaggagaaaatcaagaattgaatgcttcacaaatagtggattctcattcttttccacaacactttttcccattgaaagaagaggttggcctagctcctgctgcaattgttgaatctcgaagggaaccttgcgatgcattagttttgagacaacttgattacaataggaagccaaggcccatgtctcctgcaatagctgcaaggaaaagaaatggcaatttcctgaaagaaaatgaagatccagactttgtgaaaaacccctaccaagcaattgtcatggctagagattccctgaagcaaagagaggaaactacaaaaatgcaggctgaaatacagaagatagatgatgaagtgaatgaaatgaagctcaaaaatgaggaagaaaaactcgctattcaagacctggaaatggcacttataaaacgtagaaggaaggcagaaaagtgcagacggttggctgaggctcaatcttcttacaggactatgctagagaagatgattagagattctatgcaccagagtgtcatttataaggaacaggtaagattgaaccaggctgcaagtaatgcactaatggctagacttgaagcccagagggaaatttgtgatgctgcagagaaagatcttcacaagaaatacaaacaaagagatgacatagagaaacagattagacctgaatgggagcaaggaaggaagaggtcgagaatagatgatgccacctatgaagagagagacagtaaacctgctctttatttgcctgggcctataccaagaacacctttgcacaaggagctcggagtgtttttagaggaggaacaaaggtcatccgaagttgacttatctgcaaacgaagaagagcaaaagcaggaagaaaaagaagagaagatgaaaatgccagataataatgacctagaagagaagcttgaagagcataccaaatcaagtgttgcattggatgaagaaaactcaattgagcaaagacttcagaagctcaaaatcagcgaaggcaagaggagttatggcatttcattctcaggtcttcataagacagcaactgaggaagatgaagaaaccagaaagcaacgtggaagagggaatgtggagaagtggcttcaaatgcttttagagaatggtcaacaacaagaaagaactgatccactagaaacaagtgaaaatgcttcttgtggaactgaagaaaaaataatccaacaactgaatcagaagttcccacaaaaggagttgaagatctcaaaagtttcagattctgattataaagagaaccagctgcaacttcttcaaaacaggaacggatggacagagaaagaggatagaatagaaaacgaagctagaagtgttatgccgacaggatacaaaaattactctggagaagcttgcataggtgctaattgcactcttaatgttgaagggatggaaagaaaggaacaacataaaaaggaaaaaaaacttcctagatcagagagtgctaggaccttgaggcgaattccatcatctccatctttgcttcttgggatcaaaaaaggtgtggactacattcgaaagaagccaatggcaagtgatgatgctgatcttgcagcatcaaacagtttcttgaagtcatccatcaagacaatcaagaaagctgtaaaattatga

SEQ ID NO: 25084 - DNA, 1423 bp, Glycine max
  Peptide Sequence Number=SeqID_141862
atgcacattgcccatttgaagaaatcagtccctgcccctgacaatggaaattactccatatgtctctcatacttcaccattgcatttatcaggatgatattgcttttgggtcctccaagttctggaaaaaccacactccttttggctctggcaggaaagcttgatccagatcttaaggtttctgggcacgttacttataacgggcatggaatgaatgaatttgtaccccagagaactgatgcctatattagccggcatgattttcatattggagaaatgactgtgagggaaaaccttggctttctctgcaaggtgccaaaggacttgctatctgaactgtcaagaagagagatagcaacgaatattaagcctgaccctaatattgatatctacatgaaggcggtagcatctgttggccaggaagcaaaccagatggtgacagaatatgtacttaagatcttggggctggaaatgtgtgctgatattgtggtaggggatgaaatgttgcgtggtatatctggtggacaaacgaagtgtgttaccacaggggagatgttggttggtccaacaaatgcactattcatggatgtaatatcttctggcttggacagctccacaactgttcaaattatcaagtgtctcagacaaattgttcacattctagatggaatagcggttatctcattattgcaaccagagccagagacatatgaactctttgatgacattagcctcctctctgatggtcaaatagtataccaaggacctcgtgaattcgtccttgaattttttgaatctaagggtttcagatgtcctgagaggaaagccatcttccttcaagaagaaggatcagcagttccgtttgataagagaaagaaccacccagcagcattaactactatgaagtacggggtaaacaagaaggagcttttgaaagctaacttctctagggagtatttactaatgaagaggaatgcattggtttacatcttcaagctatctcaagattcctgcgaactgaaatgcacaaggattctgtggataaagggggagtttacaccggatgttaagaaatggtggatatggggttactggatttcacctataatgtatgagcagaatgctatgatggtcaatgagttcctcggaggcagagttcttcctaattcaaccgaatcactagaagttgaggctcttgagtcccgtgggttcttcacacatgcatcctggtattggataggggctggggcattgctcggatttgttgttctattgaacatcacattcactcttgctctcacttatctaaacccacttgagaagccacgggctgtcatcttcaatgaatctcatggcaataggcataaagacagaactctagacgatattggattatcactcagattcacagggaatgccccaa

SEQ ID NO: 25085 - DNA, 463 bp, Glycine max
  Peptide Sequence Number=SeqID_141863
atggcatccttcagccacatgcagtcccagcttcagtcgcagatgcaatctcagggaattgtagtgcctcctgaccctctggttggtccctccggtcctcgagtgagcacaaaggggagttgtgttgatccctcaggaaacgatcctgagacggatgcagatgctccagttcctgtacccactgatgaggtttccttagtggggcaggcacttcacaccttccttgcttggccgacacatttggtcaagtctttatcacaacaggtagctgtgtctccgacaaaaccacctccaaagcccgatccggaggtcgatgatccactttatctgatgacattgaccatcccagagcttttattgaggccttatcaagttagatgggatgccaccgtgttcggggtctttaatccagatttccccctctacataaagcacgcagacctctccgaaattgcacacggtg

SEQ ID NO: 25086 - DNA, 372 bp, Glycine max
  Peptide Sequence Number=SeqID_141864
atggtggtgagcttgttcttgactcatcttctctttgaagtggcatctccaatcatgtttcttccttcttcattccgctgccatgatcttcaagcagcaaaggactccattgatgaagaagatccaaggcctacaagctctacaaggaactatatcaccaaccccatgctctcatgcatgcatactcataccgtgtcatcactcatgcatcgcatttgtctcgtcatcattgtcacggggagctacaaggtccacctcaccttcttaagtgcatgcattgggcaccatggtaatgtctgcgaacgaaccatgatacccaatgcattatgggtaagaaggggtggtcttccaaactcttgtgttcgtagataa

SEQ ID NO: 25087 - DNA, 226 bp, Glycine max
  Peptide Sequence Number=SeqID_141865
gagagcatcacccaggacaattgcctatttttattctataaataactttgatcggaggcaggaaccggccatgtacaactattatgagaaagggagagcacctgatcttgaaagtgtattggcagacttcatgacataccaagatacctctaaaggcgattgttattccatgcaacagcaaggaactcagtttgaaagggactattcttctacagattatcaatag

SEQ ID NO: 25088 - DNA, 279 bp, Glycine max
  Peptide Sequence Number=SeqID_141866
atgaacaacgaagctggaagagactcttgctcagttcatgcaagtttccatgtcaaaccaaaagagcacagagtccgccataaagaatctggaagttcagaaaaacaacagctggtgtctggcccagcacttgatcctgtggtagagtctttgactgagtctgaagaagaattgaaggtaaaagatgagaagaagaaggagacaacaataaatttgagtgaacaagaaaaagaggagaaaaataaagaaaaagaaaaagaaaaggaagaagaaaaataa

SEQ ID NO: 25089 - DNA, 360 bp, Glycine max
  Peptide Sequence Number=SeqID_141867
gacagagagcttaacgaaacccgtcaacaaatcatcggcggctatcataagtggctgagagtccgaacacaaggactggattggctcccaaatctaaagactgtgagagacgatgaggttaaagcttcggaagaaagtgatgaggtacaagccctaaaggcagagcttgaaagagcctgggtagtcgaagagaagttcaagtccatagccatcaaagcccgaaaggaagaacacgaccaaagcaaagttttgagggggctttatagggcagcaatagtgagctcaagttccgaagaggtgaaaggaatcatcacgggtcaaaggcatgatcttgaaggacgagctaaaggcttgccttag

SEQ ID NO: 25090 - DNA, 357 bp, Glycine max
  Peptide Sequence Number=SeqID_141868
atggcgattcgagacattttgcttaacaaagtgaggtctgccataactcgcctatgctttttcttcaatgccatttatagcaaagtcattgaccctgttaagttagatgacttggaaaacaaggttgctattaaattgtgtggtcccgtttatttatggtggatgtatccggttcagcgatacatgaatatcttaaaagggtatacaaagaatctatattgtcctaaagcatccattgctgaaaggtacatttcaaaagaagctattgaattttgttcacattacattgaaagggcaaaacttgttggtcttctcgagtctcaacatgacaagagagtaggaggtaagggttcatga

SEQ ID NO: 25091 - DNA, 714 bp, Glycine max
  Peptide Sequence Number=SeqID_141869
atgcatcctcctaccctcgagtctggagtcccgcgagttgattgcctagcgctgttcgccaattctccattctccacttttattcggagccccatgaattcattgcctagcgctgctcatgtgtcctccaccttcgagtctggagccccgcgaatttattgcctagcgctgttcgccaattctccattctccacttttattcggagccccatcaattcattgtctagcactgttcatgcatcctccaccatcgagtctggagtcccgcgaattgattgcctagcgctgttcgccaattctccattctccacttttattaggagccccatgaattcattgcctagcgctgttcatgtgtcctccaccttcgagtctggagccccgcgaattcattgcctagcgaagttcgccaattctccattctccacttttattcggagccccatgaattcattgcctagcgctgttcatgtgtcctccaccttcgagtctggagccccgcgaattgattgcctagcgctgttcgccaattctccattctccacttttattcggagccccatgaattcattgcctagcgctgttcatgtgtcctccaccatcgagtctggagccctgcgaattgattgcctagcgctattcgccaattctccattctccacttttatgcggagccccatgaattcattgcctcatgtgtcctccagcttctag

SEQ ID NO: 25092 - DNA, 636 bp, Glycine max
  Peptide Sequence Number=SeqID_141870
atggtggaaaatgaaaaatttgatcatatagaagaaaggctgagggccattgaagggggcagagactatccttttgctgacatggtagaattgtgcctagtgcccgatgtcattatccctctgaagttcaaggtgtcagactttgataagtacaaggggactacttgccccaagaatcacctgaagatgtatagtaggaaaatgggggcatactcgaaaaatgaaaaattattgatgcatttcttccaagaaagtcttactggggcagctgtcaactggtggagggatctagcagctcaagtagcgcccccaatgatggagagggagatgataacaatgatagtggacacgttactggaattctactatgagaagatggtgggttacatgccttcgagctttgcagatttagtgtttgcgggtgagaggatcaaagtaggcctaaaaagaggcaaatttgattacgttgcttcgatgaattctggtgataggaggcctagggcaaatggagggaataagaaggagggagacacccatgatgtggttgtcgttcctgcatggccaaatttctcgttagcccaacaatatcaatactcagccagtatcagtccttctcattacctaccaccttactag

SEQ ID NO: 25093 - DNA, 411 bp, Glycine max
  Peptide Sequence Number=SeqID_141871
atgaaaaaaacaacccctctgctgttcctggccgccatggcctttgcccctgccgcctttagcgcccctgccggcacgctgagcgtccacattctcgaccagcaaaccgggatgccgccatcagacgtgaccgttacgctggagaagcagcagcaggacaaatggaccccggttgccagcggcaaaaccgaccacgacggacgtatcaaatcgctctatccgcaggaccaggacatgcagcctggcgtgtataaagtgacctttaaaaccgcagagtacttccacggcaaaaagctggacaccttcttcccggagatcccggtgctgtttaccgtgacccgcaccaacgaaaagctgcacatcccgcttctgctgagtcagtacggttactcgacctacaagggcagttaa

SEQ ID NO: 25094 - DNA, 423 bp, Glycine max
  Peptide Sequence Number=SeqID_141872
atgatgtacgacgccggacgcgagtacccaagaccagagctggtcgcgaacgtgctgcgtccgctgcgcagccaggtctcggctaacgttgcagccgccatgaccctgcgcgcgatcctcgacggcatcatcatcgcctacacctcgtttcgtctcgaaggtgataagaaagcgccgggcgacaatattctgctcagcggctggcatctcaacgacccgtgcgagatctggctcgaagccctaacgcgcaccggtcagggtcaccggatcgacatcatgccggttccccctgccacgctggctccggagattttcccggaacggaaatggattctggtcaccagcggcaaacttaccgccggacggaaaaagcagctggagcagtggcagcagcaggtatcgcttgaagtgattatcctctga

SEQ ID NO: 25095 - DNA, 522 bp, Glycine max
  Peptide Sequence Number=SeqID_141873
accaatatctttgatctcacctttgctcatgataagtacactttaatctgcaaaccaaaagtggaaaggaaagatattgacctgatagaggaggaagaagcacagattggtggtgatcgttctagtgcaacctcgaataaagctaagatttattacgaggaggcacggaagaaaacacagaagcataaaccaaagagggtggagagtgtcaatgctgatgcagaagcctttgctgaagcactagaacatacgaagaaaagagatacaggccatcaaagtgtggcattggacaatgagacaggagtttcaactatgctgaagatgggagattcagctaaagttgtgataaaacaagacatgaagggaagagagcataaatatgggtttaacaacaatgaacgtgagaagccagagaagaaaagggtggtggatgatgaaactggcgacaaacatcagctggatgaagtcctaaggaggcaaattgaaacaaaaaaccgatgcctcaataagagaaaaatgtag

SEQ ID NO: 25096 - DNA, 1596 bp, Glycine max
  Peptide Sequence Number=SeqID_141874
atggaggtaagaacgaacgaagttgcaaagcaaagaatagaagacgaagggtatagagctcataacaatccatttggtcttaatttgtttctgttttcttcattctgtcagccatatatggcttccttggcgacggtgcaagatgaacgttgcgttcagagaagctactggattgaacataccacagatttgtccgtagagtcaatgatgctcgattccaacgcctctgatctcgacaaggaagaaagacccgaagttttgtccctactaccagcatatgaaggaaaatcagttgtagaacttggagcaggtattggaagattcacaggtgaattggccaagaaagctggccagttgcttgctgtggatttcattgagagtgctataaagaagaatgaaagcattaatggacaccacaagaatgtcaagttcatgtgtgctgatgtcacttctccaaacttgcatatttctgaaggatcagttgatctgatgttctccaattggttactcatgtatctttcagataaagaggttgagaatttagctgcaaggatgatcaaatggttaaaagttggtggatatgtattcttcagagaatcatgtttccaccaatctggagattccaagagaaaatacaacccgactcactatagggagcctagattttacactaaggtatttaaagagtgccatacgagtgatgatacccggaattcctttgaactttcccttgttggatgtaaatgtattggagcttatgtccgaaataagaagaatcaaaatcagatttgctggatatggaaaaaagttagatcacaggatgatagggggttccagaggttcttagatagtgttgagtataatcataaggatattttactttatgagagtgtttttggtcaaggttttgtgagcacaggaggacttgaaacaaccaaggaattcgtggcaaagttgggactaaaacctggccagaaagtactggatgttggttgtggtactgggggaggtgacatttacatggcagaaaattttgatgttgaggttgttggcattgacctctccataaacataatttctcttgccattgaacgtgctattggactcaaatgctgtgtagaatttgagtgtgccgattgcactaaaaaaacatttcctgtgaatacatttgatgtaatctattcccgtgacacattgttacacatcaaagataagccatcactattcagatcattttacaaatggttgaagcgtggaggtacacttctgattactgattactgcaaaagtgaaggaagtctatcattaggatatgctgagtatataaagaaagggggatattatattcatgacatgaaaacatattgtcggatgctcgagaatgctggatttgatgatgttgttgccgaggatcgaactaatttgttcatgaaaacactacaacaggagttaaatgcccttcacagcaagaaggatgatttcattgatgacttctcggaggaagactacaatgaaattactgaaagatggaaggccaagcagatgcggggggcagatggtgaacaaatatggagcttgttcattgccaagaaataa

SEQ ID NO: 25097 - DNA, 468 bp, Glycine max
  Peptide Sequence Number=SeqID_141875
atggcaatcttttacattacccaagacactcaaaggcatcctctacttcctgaattaaaatctggtggatttcgggtgacaggaaaaatctctactcaatgttctttgtctggtcctattagtggtgagttaactgtagaaacatctgcagttccaattcattctattgacattcagttgtttcgagttgagtccgttcttcttggggagaaaattgtgaccgaaacctctctgatagcagatggagatgtgtgccataatttgacgctgcctatttatgtaatactaccacgccttttgacctgtccaacaaccttagctggtcccttctcagttgagttcaaagttgccatcgttataagctttcagtcagagctaagtaaactgcacaaaaaatctgacgccaaaactccgagactatggctggcaatggaaacattactgcttgagttggttcggacaaagtaa

SEQ ID NO: 25098 - DNA, 186 bp, Glycine max
  Peptide Sequence Number=SeqID_141876
atggacactgagcttataccagggacttacccagttccaattccattattgagcacagtgtcagtacagtactcttatagcctattgagaaagaaagtaaagaggaggagaacacggagtcgcagcaccgcacccaaccacaaacaaattggattacatactttcaaagcgaatcatctattttaa

SEQ ID NO: 25099 - DNA, 198 bp, Glycine max
  Peptide Sequence Number=SeqID_141877
atgagcattgagctcaagacgtgcatacatcttggtgttagaaagttcaatgtcaacaccgaggtaagaaaagcatacatggactcccttgttacccccaagaacgatctagttcatgttatggcctctgcaaaggaagccatgaaagttgtggttgcagaaaagatgcatctctttggttcagcaggaagggcataa

SEQ ID NO: 25100 - DNA, 492 bp, Glycine max
  Peptide Sequence Number=SeqID_141878
atgaaattattttccacccagggatacaactctacagggatcaatcagattatttcagaagcgagtgtagccaaagcgagtttttatcagtattttaagtccaaagaagatttgtgtgttgagtttttgaataccaggcatacttactggttcaatgaacttgaaacctttacggcggggaaaagaggggctaaatcgaaagtaatggctgcttttgacttcctgattgacatgaatcgaaaagagaatttcaggggctgcagctttctcaatatcttatctgaaattccaactgataataccaagatactgaatgtaattcaacatcataaaacagatctccgtaattactttatgaaaatagtggatgatgctgagatcagtgatcatatttacatgctttttgagagcagtattatagaaagccagttgtttagatccaatgaacttatagaaaaatcaaaaaagataatcaccaatttaatatcataa

SEQ ID NO: 25101 - DNA, 1797 bp, Glycine max
  Peptide Sequence Number=SeqID_141879
atgcatgttaacacaaaacttctcttgattcacagcattaatgggaatgctgtcaagaatatgttaaaatgtgataccacaaatataaatgatcccgtcattgaagaactcgtaaagcttggaggagttaaatgtccaagcccttcggaagcagggagagatgtatcagctttagttgtcctgatatctcacgttgatcaaactaatcatcttatttttggggagaagggtgctttgaaagatctaaaatcagacacagttcttattctccgttcgaacatattaccatcatttctccaaaaactggaaaaggatctggcagaaattcacaaaatagcttatgttgttgatgcatatgtctcttatgggagatccgatgatttgaatgaaaaagtcactattgcatcatcaggaagactagatgccattgcaagagcacggcctattctttccgcaatgtgtgaaaagctcttcacttttgagggtgaaattggtggtggcagtaaggttaaaatggttactgtgatgctggaaggcattcattttattaatgcagtggaggctctctctcttggtgccaaaattggaattcatccatggataatctatgatataatttccaatgctgctggaaattcatgggcgttcaagaattatgttcctcttttgttgaagggagaagttaatcatcaaattctgaacacttttgttgaggagttggaaatcattttgaatatggccaagtcacttacttttccacttccaattttggctgctactcatctacaacttattcatggtacagaacttggagtttcacttgttggtagcgaagatgatcttacagcaataatcaaggtttgggaaaaggtttatggggttaaaatttcagatgctgcaaatgctgatgtgtataaccctgagcaattggcatctgaatttactactgattccaagagtgggagaagggttggttttattggccttggagctatgggatttggcatggcaactcatttactgagttcaaaattctgcgttgttggttttgatgtgtataaaccaactctaacgcgattttcaaatgctggtggcttgattggaaattctccagctgaagtgagtaaagatgctgatgttctcataattatggtcacgaatgaagctcaagcagaaagtgtgctatatggagaatatggtgcagtttcagctcttccaccaggagcaactattattctctcttctactgtttctcctgcatatgtgagtcagctggagcacagattgcacaatgagggtaagaatttgaagttggtggatgccccggtttctggtggtgttgtgagggcctcaatgggaacgcttacgataatggcttcaggaactgatgatgctcttaagagtgctggtttagtcttagcagccttgagtgagaaactttatattatcaaaggtggttgtggtgctggaagtggtgtaaagatgattaaccaattgcttgctggagttcagattgcctcagctgctgaggcaattgcatttgcagcacgtttgggtctgaatacaagactgctgtttgattttattgcaactagtgggggaacttcctggatgtttgaaaatcgtggccaacacatgatagacaatgattacacaccttgttcagcactagatatctttgtgaaggacttgggaattgttactcgtgaatcatcttcgtggaaagttccacttcagctatcaactattgctcaccaactatatctggcaggtgctgtatattactttgaatcttaa

SEQ ID NO: 25102 - DNA, 249 bp, Glycine max
  Peptide Sequence Number=SeqID_141880
atgccatcaatatacaacccacgtctatctgagatattagcatcagggtcctaccctgagggatcaacacagcttccctttgtgctcacatgggcactggaaggagctacatttggcttaactagatgtgatgtgtgggagctttgtgatggtgctccgaagtattgtctgatggtgacaccaattctagcagcacagacatggccaaagtgctttggtcacccaatggtagtagtcagtatatcttga

SEQ ID NO: 25103 - DNA, 120 bp, Glycine max
  Peptide Sequence Number=SeqID_141881
atggcgtctcggaaagcgatcggtttcgtcggtttggatgagttgagcttggagatggcggcgaaggctattcgccatggctacgatgtgcaagctttcgagatgaaaaaagaaaattaa

SEQ ID NO: 25104 - DNA, 648 bp, Glycine max
  Peptide Sequence Number=SeqID_141882
atggatagatttcctgcttttctccagagtcttgaagatatgaataatgttgatatgatgtataaggttgatatgtccgcatcaacatcagtgattactaaagcactggttttaaaagccgttaagccttttgttggcgataatgattatgtatttagactagtaagttctttacttgagctacctatctatacaaaggatggggataaagttttagtagggtctgatgatattcctcctcctcttggagaggtctccagattgctattcaactttgtattaatggacttatttgatcgggagtttgtcaaatgttttccagaaataagatttagacgattttcccatgaggtcttcgtagcaactgctgatatttatgatgtctttttctctgaaaagagttgttatgctttattggggaagataggtttgagaggcgaaatctattctatttcgcgagggggagggtaccttacctccgggggagtgaacgagattctgcttcaagttactagagtcaattatcataaaccagctcttacaaagcttatgactgcaagaaaatcaattgagaccttcacaaagatgttgggaaattccctaacaaaagaccttattgaattgatgcatccaaacgctaaagaatga

SEQ ID NO: 25105 - DNA, 209 bp, Glycine max
  Peptide Sequence Number=SeqID_141883
aggtgtcatcctctaaagaggatcttgaagaggacccaggggagttatctcctgaacctgctatggatgcccctgacttaccagaggatgatgaggacccgctccctgatgttgattctccagaggatattatgcctgcatctgaggcaaactctacagaggagagtggccctagagggacagcgaatagtgatgactcttcatcatag

SEQ ID NO: 25106 - DNA, 827 bp, Glycine max
  Peptide Sequence Number=SeqID_141884
agggctacacgttgtaaccatcagagaactacaagttcacgccttcagagggttgcacgccctcaccttcagaggactgcacgtccacacctttagaggtctacgcgccctcaccttcagagggctacacgctcttagcttaagaggactacaagtcctcgcctttagagggttacacaccctcaccttcagaggactgcaggtcctcacctttagagggctacgcaccctcaccttcagaggactacacgtccacaccttcagaggtctacgcgccctcaccttcagagggctacacgcactcacctttagaggacgacacgtcctcaccttgagttggctacacgctctttccttcagaggactacacgtcctcgccttcagagggctgcacgccctcaccttcagaggactgcacgtccacaccttcagaggtctacgcgccctcaccttcagagggctacacgctcttaccttaagaggactacaagtcctcgcctttagagggttacacaccctcaccttcagaggactgcacgtcctcacctttagagggctacacaccctcaccttcagaggactacatgtcctcgccttcagagggttgcaccccctcacctttagaggactgcacgtcctcaccttcaaggggctacgcgcactcacctttagaggacgacacgtcctcaccttgagagggttacacgctctttcctttagagggactacacgtcctcgccttcagagggttggacgcccacaccttctaagtactgcgcgtcctcgccttctgagggctacgcgccctcaccttcaaaggactacac

SEQ ID NO: 25107 - DNA, 428 bp, Glycine max
  Peptide Sequence Number=SeqID_141885
atgaatttattgcctagcgctgttcatgcgtcctccaccaacgagtctggagccctgcgaattgattgcctagcgctgttcgccaattctccattctccacttttattcggagtcccatgaattcatttcctagcgctgttcatgcatcctccaccaacgagtctggagccccgcgaattgattgcctagcgctgttcgccaattctccattctccacttttattcggagccccatgaatttattgcctagcgctgttcatgtgtcctccaccttcgagactagagccctgcgaattgattgcctagcgctgttcgccaattctccattctccacttttattcggagtcctaagaattcatttcctagcgctgttcatgcatcctccaccaacgagtctggagtcccgcgaattgattgcctagcact

SEQ ID NO: 25108 - DNA, 264 bp, Glycine max
  Peptide Sequence Number=SeqID_141886
atgtacatcaagtatggcccaaaatacatcatgaagcatagccaacaaaacatgcttgtagtgagcttcaaaacaaggaaagggaaacaaggctcaaaagggctatcaaaggaattaattcaaggtaagtccatttggctagaagcttatgagaacaaaattgccttaatcatttccaaatatgcatgtgaattaggaagcatcaacaagaatcaagccaaggctattgtgcaagcaatcaatggggcaaaacacaccaaatga

SEQ ID NO: 25109 - DNA, 2004 bp, Glycine max
  Peptide Sequence Number=SeqID_141887
atggaagagacggcacaacaagtaaaacgtccttttgatgttcctgaagaaccagaattcattgttgggttggatgcaccattgagtgagttgaaaatggaacttcttaaagaaggcgtgtccatcattgtgctgactggtttaggtggatcgggaaaaaccactttggttacaaagctttgttgggatgaactagtcataggtaaattcaagggaaatattttatttgtcaccatctcaaaaacgcctaagctgaagattatcatcgaaagactatttgaatattatgggtgtcaagtgcctgcgtttcaaagcgatgaagatgcagttaatcatttgggaattttgctgaggaaaattgatgtaagtccaatgttgttggtcttggatgatgtttggcctggctcagaaggcttcattgagaaagtcaaagttcagatatcagattataaaattttggtgacttcaagggtagcatttcctagatttggcactccatttatcttaaaaaatcttgttcatgaagatgcaatgaccctttttcgtcaccatgcactcttagaaaaaaacagctcaaatattcctgaagaagttgtccaaaagattgttagacattgtaagggtttaaatttaccgcttgtcataaaagtgattggtagatcactaagtaatcgaccatacgagttgtggcaaaagatggtggagcaattgtcacaaggtcattctatacttgattctaacactgaattacttacttccttccaaaagatcttagatgtcttggaagataatcccaccatcaaagagtgcttcatggacttagctttatttcctgaagaccaaagaattcctgttgctgctcttgttgatatgtgggttgagttgtatggactagataatgacggcatagaaacagtggccattgtcaacaaattagcttccatgaatctggttaatgtcttagtaacaaggaaaaataccagtgacacagacagttactactacaataaccatttcatcatccttcatgatatcctaagagacttcggaattcatcaaagcaaccaggaacaagttgaacagagaaaaagactgatgattgacataacagaaaataaacctgaatggtggcctagagaaaaacagatccctgcacagacattgtctatatcaactgatgaaacttgcacatcatattcgtcccacctgcaacctgctcaagctgaggttctgattttaaaccttcaaactaatcagtgcacctttccaaagttactgaaagaaatgaggaaactaaaagttctgatagtcatgcattatggtttccatccttctaaaatgaacaatttagagttgtttggctcattatcccaccttaaaagaatcagattcgagcggatttgggttcctccctttgtcacattgaagaatcttaaaaagttatccctctacttgtgtaatacaagacaggcttttggaaacagaaacatgctaatttcatatgcttttccaaatctagtagatttgaatgttgactattgcaaagatttggtagaattgcctaaggggctatgtgatatcaccaccttgaagatgctcagtattaccaattgccataagctctctgcattacctcaagaaattggaaacttggacaatttgaaacttcgaaggctaagttcttgtactgatttggaagagataccaaattctattggaaaactttcaaatctaagacatatggacatctcaaactgcattaaccttccaaatttaccagagaactttggtaatctttgcaatctaagaaatctgtacatgacaagttgtgcaaggtgtgaattgccaccctcgattgtcaatctaaagaatttaaaggaggtggtatgtgatgaagagacgactgtttcgtgggaagctttcaaagatatgcttcctaatctgaagatatatgttcctcaaattgatgtcaacttgaattggcttcatgaaattcactcctaa

SEQ ID NO: 25110 - DNA, 1376 bp, Glycine max
  Peptide Sequence Number=SeqID_141888
cacaagctttcgcggtaggtgtcaccagtattgtgtttgtgttaatcattggttttggttatgtagcatttttcgttctccgcagaagaaagacacaagaagaagttgaagattgggaactggagtattggcctcacaggataggtttccatgagatcgatgcagcaacaagggggttttctgaagagaatgtggttgctgtaggagggaccgggaaggtatataaaggggttttgcatggggtagaagttgcagtcaagagaattcctcaagaaagggaagaagggatgagagagtttttggacgaggtttcaagccttggcagaatgaagcacagaaatttagtaggattaagaggctggtgcaaaaaagaaaagggaaatttgattctagtttatgacttcatgagcaatggaagtttagacaaatggatatttgagtgtgaagagggaatgatgctaacatgggaagagaggattcaagttttgaaaaatgtagccacagggattctatacctgcatgagggttgggaagttaaggtcttgcatagggacattaaagcaaacaatgttcttcttgataaggacatgaatgcaaggctgggagatttcggattggctcgtatgcatgatcatcagggacaagtggtcagcacaacaagagtaatagggacactaggatacattgctcctgaagtgattcaaagaggaacagcacctattgaagaacataagccggggctaattgaatggctgatgtccttaatggtgcaaggccaattgcacagtgcagttgatgaaaggttgaaggctaaagggggatacaccatagaggaagaccctagtattagaccaacaatgaggcaggttgtgaaaattttggaggtggaaattgacagcattgagtctgatgaagataacatggaaatgagtttgcttggaaaaataagatcagctactacgtggtctagagttgaatgtgctttaccatacagtggttacccttcttttgatgaagttaagatgttcagttttaattctaggacttctagaagtggctcaaacacaactaaacatgaagacagtaaatctgaagctcaaattaaacatcatgggtttcatcaagttcagtgtactaacttagaccaaacgctcaacgaaactgataatgtggcacaggatgacacaccactgatgaaggatggcagcaggctgttcccgaaagtcgttcactcactgcccgcaaggatacacaaagaagagctaaatgcacccatacctttgtcggcgacggcttcaaacggaacgagacgcaacggatacgagatggtggttgtcggagacgatggtctttgtcggagaagatgctctgtgtag

SEQ ID NO: 25111 - DNA, 210 bp, Glycine max
  Peptide Sequence Number=SeqID_141889
atgactctattgatgaagaagatccaagccctacaagcttgtaggccttggatcttcttcatcaatggagtcctttgcttcttgaagatcaatgacagtggaatgcagaaggaggaaagcgtgaagaaggattctagaagagaagctgaattgaagcagcacgcaaagcgcgagatcaacccgctaagtgagtcatccgtctcttgctag

SEQ ID NO: 25112 - DNA, 378 bp, Glycine max
  Peptide Sequence Number=SeqID_141890
atggacgtcgacgctgacataattgattttgccaagcttggcgatgacgagagctttggagccgaagataactcgagaagcttctgcttcaacaaaattagggtttgcgcgggattggcaagaggtcatgctcaaagggctcgtgccttgggtgaaccacagtggttgggtccctcagggatgaagatgacatggatggctctattggttcgaacaagtagatggagaaaaaagagatgcgggtgtgttttggtggagtttattgagagaacaatgagcgaggcgagggccagtgaaactaagtatgcgatggcgacatgcacaatggtggtgatgacgagatttgaggacttgacaaagctttggacacaaagagag

SEQ ID NO: 25113 - DNA, 516 bp, Glycine max
  Peptide Sequence Number=SeqID_141891
atggcagtattcgtgcaaccttttcgctttctcattcgtacacgctccttcactactcacaatttcaaaatccctaaaacactcaccctaatcaatcatttacgctccattcttcttaaatctataccaacaataaaaaaaatcgtcaacaacaaccaatccgccccctacgacaccacgtcgcacgccctatgccgcaacctcgcctctgagatgctccacccctcacgcgtcagctcggagtttgggttgaacgcactttacgactccgtgaacggcggaggtgatgtttggatcaacgagaactgcttccgcatccctttcaagaggtatgttaagatcgggagggttgcccaaatcaactacggcaaggaatatggcaggctcatcgtcattgtcgacgtcattgaccagaacaaaatgttaagaccaagtgagagaagagtttatggggcaggaaactcattgtcagaaagagaagggcatccctcaatgattttgataggttcaagataa

SEQ ID NO: 25114 - DNA, 297 bp, Glycine max
  Peptide Sequence Number=SeqID_141892
atgaatcctctcttgttctcagttacaacaacccaagtagatataccctctacttgtaccacaaaggatgtaccctccaatgtgttaagacaaagttctcaggcgggaaagggaagaatcaaaagaattctcagactgtgtccttttgaattctttgaaaagggagaagagaggcataaaagaattcaggcggtaatcgattaccaaaaccatgcaattgattacacaaagcattttatgaaaagatgtgactcttcacaattgaatttgaatttcaacgttcagatacactggtaa

SEQ ID NO: 25115 - DNA, 477 bp, Glycine max
  Peptide Sequence Number=SeqID_141893
atgcaagaaaataacacgcaatgtctttgcaatttcgttaacagcactactctatttcagtcccttggtggttccaaggatgagatcttgaagctcccccaagcttgtggcatcaattttgacccttctaagtgcaacaacacaggaggaggaggatcccaagtggcttcgacgccttccctcgccagaatgctaacacatctccgccgcgcggctgccgcatgcggtggtgctacctccgaccacttcctcgctctcaggcagttcagctccgccgtcgtcgccgtttcctccgtgtctgattccgatccaacacttccctcttcttccgattcacagagaaaagcatctagatggttgctatttctacctggggcaatcacatttggccttgggacttggcagattggtagaagagaagaaaagggggagggaataggagggaggaaaggaatgatgttgattgatactatgtga

SEQ ID NO: 25116 - DNA, 267 bp, Glycine max
  Peptide Sequence Number=SeqID_141894
atgggtaagaaaccaaatgcaagaatgcataactattcaccaatgttagtgaaaaagtattaccttgactcctggaaagagataaagcatgatacaaagcaccaaaccgaagaagtaaaagatagacgggacgtagcgcagtgcacgggcacaacgacaatgatcggaaaacgttgggcagcaagacacgtcggagaagcaacatggggaaatggaggggcaaaaagccccaaaaaccaggaaatgtgtcacatgtcaaaattttag

SEQ ID NO: 25117 - DNA, 2376 bp, Glycine max
  Peptide Sequence Number=SeqID_141895
atggtcttcaagggaagattcttctcttccaagaaatccgattcttctagccccgatgcatcctccaatagtcctcgatctttctcctccaattctccttccagatccgacaagaaaaaatctaaatccgccgctagtcaaaccctagtcgccgctgccgccggcggcagcggcggcggcggtctcgcttcgtgccggcagacgcaggtcaaggatggaaccaagaagaaggatacggtcaaggggaaggaaagtcaaacgccgccgccggagtctcggaaggattctccggcgaagaagctgacggcggcggagggacgggaatcgccgtcgtcgtcatcggtgtctccgattctggcgtcgtcgctggggcttaacaggatcaagacgagatcggggccgctgccgcaggagagcttcttcggattcaggggcgagaaagggacggcggcgctcggcggcagcaacctctcgcggccgggtgttagtgcccgcgccggcgatgggaagaagaaggaggtggctagccagagcagggtgggatttcacgagggttccgtcggcagtgccgccgccggaggttggggcgataacgggggcaattccgataatgtgtcaacgtcggggagcttgccatcgagggagcagagtccggtggtgttgccgcggtcgcggttgcagaatggagagtcatcatcggaagctgcaggcaaacaggtatcatcacgggctcagtctggaggcttaaaaagtgcagatgtttgtactccagagacagcatatgattttgaaaaccctaaggagtctgaatctcctcgttttcaagctatattacgtgtcactagtgcacccagaaagaggtttccttcggacatcaaaagtttttcccacgaattgaattcgaaaggtgtctggccttttccattttcgaagcctcgacggttaaataaccttgaggagattttggttgttattagggcaaaatttgataaagcaaaggaagatgtgaactctgatctggctatttttgcggcagacctggttggaattcttgaaaaaaatgcagatactcatcctgaatggcaagaaaccattgaggacttgctagttttggccaggagctgtgctatgacttcatctggtgagttttggcttcagtgtgaaagtatagttcaggagttggatgacaggcgtcaagaacatcctccagggatgttaaagcagcttcacactcgaatgcttttcattctcacaaggtgtacccgattattgcaattccataaggaaagtggtttggctgaggatgaacctgttttcaatctccgtcaatccagagtcttgcattctgctggaaaatgtattcctcctagtgtgggaagggatactaaaagttcaagtgctacaaaggtcttaaagccttcatcgaaaaaagcttttagtcaagagcagagtatgatgggttggaagaaagatgttatgcaaccagaaaatctatctattcctgctgatgatgacaatgcaaaacactttaactcttcttcaggcaggaatcgaatggcttcttggaagaaattcccttctccaacaggaagaagccctaaagaagctgttcagttgaaggaccaaaattatgggaggattgagtcttcaaaggcatcaaataataagagattcagttctgatgtggatactgctaagccatctgagcttcatcctgtcaaagattccttggatcatgcttccaaacaccagcacaaagtttcctggggacactggggagatcagcagaataataatagtgaggagaattcaataatttgtcgtatatgtgaagaggatgttcctacttcacatgttgaagatcattcaaggatttgtgcacttgctgatagatgtgatcagaagggactgagtgtcaatgagcgtcttggcagaattgctgaaacactagaaaagatgatggaatcatgtacacaaaaggatacccaacaaatggtgggaagtcccgatgttgcaaaagtgtcaaattctagtatgactgaagaatctgatgttccttcacctaaacttagtgattggtctcgcagaggctcggaggacatgctagactgtttccctgaagccgacaattctgtttttatggatgacctaaaaggattaccacttatgtcatgtaaaactcgttttggtccaaagtctgaccaaggtatgacaacatcatctgcagggagcatgactcccaggtctccgttgatgacaccacggacaagtcagattgacttgctcttggcagggaagggtgcttattctgaacatgatgatctgccgcaggcatgccactttttaattctctttctaagatgcttttatttctaa

SEQ ID NO: 25118 - DNA, 354 bp, Glycine max
  Peptide Sequence Number=SeqID_141896
atgtccaaaaatacattagttgtggctttggagtttaaggatgattttgatagatatgtttctgatctcatggtgttgttgctcagtcgggctaaaatcaaagaagtaagagacacttatcctatagcaatccagaattcaatgtatggttctcaaatttttgtgaatactgacatgaaagaaattttggaattcaagggcagtcaaattttgggatcttcagtgtattctcttgcagatcgctttctgcataatgcccaagtgaaatgctttgatgaacctaaccaattgaaaaaggactgtatgcgtgtcattgtagctactataagcaagttgttggtagccaataggtag

SEQ ID NO: 25119 - DNA, 288 bp, Glycine max
  Peptide Sequence Number=SeqID_141897
atggcaataggtggtgaaaaaagtctcagtgatccactttccttcacaaatgtgcaacacttttgggttcgattagagaccatgagaatgtctaaactcatactaggaaatacaccaagttctgatcatggtgctctaagaaacttcctagacccccattttgttgaagggagttgcagtcactcatactttgtttcctctagagaaaatgaaagaccaagtgaaggaactgtaatgtgtcaagagtgcaaacgacccatgaagaattttgtggtgtaccaaccatga

SEQ ID NO: 25120 - DNA, 288 bp, Glycine max
  Peptide Sequence Number=SeqID_141898
atggatgtgatgcggagcggtgtggtgcgaacccctcacgatggtttttcaaatcatgcaggcggcgaagtcggtgctccagttcgaaagaatgcaccaacttgtggatttgattttggagtgtcaaacgtggatctcttgcggtggttcctattcgatttgaaggtgggaatcccttgtggatctctccattgctatgtcaaaggcatcgtgaaggtcgccaggaatggagagtacataaaagagaaaggagaagaaagttatgatgcgatagggtgcatcatataa

SEQ ID NO: 25121 - DNA, 2055 bp, Glycine max
  Peptide Sequence Number=SeqID_141899
atgcaacaacattctcagaccctcttcgccaccttcaccataatcttctttgccttcttcttcccttcaacattctccgacatctcatcggagcgcgcggcgctgctcgccctgcgctccgccgtgcgcggccgcaccctcctctggaacgccaccgccccctcgccgtgcgcctggcccggcgtccaatgcgacgtcgctaacgccagcgtcgtcgagctccacctccccgccgtcgcactctccggcgagctccccgccggcgtgttcccggcgctcaagaacctccacacgctcagcctccgcgtgaactccctctccggcaccctccccgccgacctctccgcctgcaccgccctccgcaacctcttcctccagcagaaccacttctccggcgaggttccggcgttcctttccggcatgaccggcctcgtccgcctcaatttggcctccaacaacttttccggtccaattccggcccggttcgggaacctcacgcggttgaggaccctcttccttgagaacaaccggttcaacggttcgcttccaagttttgaagaactcaatgaattagctcagttcaatgtctcttacaacatgttaaacggtactgtgcccaaaaagttgcaaacttttgatgaagattcgtttttggggaataccctttgtgggaaacctctagcaatttgtccctgggatgatgggggtggtgagagtggtgtaaatgggagttcaaattcaagtggggttggagggggtgaagggagtgtgattggaggggagaagaagaagaagggaaagctttctgggggtgcaattgctgggattgttgttgggagtgtggtgattcttttgttggttgtctttgctttgattctcttgtgtagaagtggggacaagactaggagtgttgataatgttaataacattgtggggttgaaggaggagcagcaactgcatggagaggtaggaattgagagaggcaatgtggagaatggtggtggagggggaggtgggaattcggtggtggcggcagcaacagcggtggcagcagtgagtggcagcaggggtggtggtggtggtggtggaggaagaggagataagaagttggtgttttatggtaataaagtgaaggtgtttgatttggaggatttgctgagggcttctgctgaggtgttggggaaaggaacttttgggactacctataaggcggttatggaggatgggcccgtggtggctgtgaagaggttgaaggatgtgactgtttcggagaaggagtttaaggagaagattgatgtggtgggagtgatggatcatgagaatttggtgcctctcagggcttactactatagcagggatgagaagcttcttgttcatgattacatgccaatgggaagcctatctgcaattttgcatggaaacaaaggagctggtaggacaccattgaattgggaaatgagatcaagcattgcactaggagctgctcgcggcatcgagtacctacattcacaagggcctagtgtttctcatggaaacataaagtcctccaacatcctcctaaccaagtcctatgatgctagggtatctgattttggcctcacacaccttgttggctcttcatccacgcccaacagggttgccggttaccgtgctcccgaagtaaccgatccgcgcaaagtttctcagaaggctgatgtatacagctttggggtgttgctcttggaacttctcacaggaaaggctcctacacatgccctcttgaatgaggaaggagtggaccttccaagatgggtgcaatcagttgttagagaagagtggagttctgaggtgtttgatattgaactccttaggtatcagaattcagaagaggagatggttcagttgttgcaacttgcagtggattgtgtagttccataccctgataaccgcccttcaatgtctcaagtgagacaacgcatagaagagttacgtaggcctagcatgaaagagggtactcaagaccaaatccaacaacctgatttgatcaatgatatagatgatgtgtcttctagatga

SEQ ID NO: 25122 - DNA, 256 bp, Glycine max
  Peptide Sequence Number=SeqID_141900
ggcactcaatgcgattacggttcgcgatcgttttcctatacctactgtggatgaattactggatgaacttggaggcgcagtctggttttctaagttggacttgatgcaagggtatcatcagattctgatgaatgaatccaatacgagcaaaactgccttccacactcaccatggacactatgagtttcgggtgatgccttttcggctttgtaataccccttcatcctttcaagcgacgatgaaccgcttgttttag

SEQ ID NO: 25123 - DNA, 231 bp, Glycine max
  Peptide Sequence Number=SeqID_141901
atgttttggaatagacaaaatattgaaaaggtttctgatcctgcagtaaagtcatctaacttcactgctcgatccaatgtctccccatatgctccaccaatgattacaatggacaatgatgatggcatctcttatatagcaattggaggtcccaccggtgacctattagagcaaaatgcacaggccttgaatcaaatctccacaaatctttccgctttccaagtgaattga

SEQ ID NO: 25124 - DNA, 450 bp, Glycine max
  Peptide Sequence Number=SeqID_141902
atgttgctgcggaagaaggttcttccgcaagaaagatttccttcatgcggaagaaccttcttccgtagcaacatatggaagaaccttctttcgagactatgtgcggaagaaccttcttccacaacttcacatggaagaaccttctttcactcatacgcaagaagttcttctgtaaactcatacggaagaacttcttccgtaagcagttatacttacggaagaacttcttctgccattaacggatgggaaggtgaaactaacctcaacggcagagaagaagcagaaaaatgcagctccaaacggccacgaacggagaagatgaagactcgcggaggagagcagaggagcgcggcagaaacggagaagatgaagactcatagaggagagcagaggagcgcggcagaaagaaaaggaagaaggagaacgcgtgaaaaaatgttgggtgcgtag

SEQ ID NO: 25125 - DNA, 486 bp, Glycine max
  Peptide Sequence Number=SeqID_141903
atggcgtcgttcagctttgcaggcggctttgatgccgtagcgttcaccgatgaggaggtcccagcgaaaaatctgggtgaggctgttcatcatgttgtcgagctcctcgtccttcaccaacgtgctcaccgtgaacccgagctcggtgatcttcgccgccatgtagtagcagatgccataagcctaaaagagctcctccagttctccgagcttgcgcggcgccgccgccctcgcgggatggaacaccggggttggaaattgaggagtgcaaaggtgtgtgtgtggtactgtttgggtggagataaaggcataaaggcggtgaagggaattcgaagaacgaaaagggaaacaatcgcaacacaacttagactcagcgatggtagtgagtttcgacaccgtgttcatgcatgtgaacaagggcacgatggtgtggcgcttggagagcttgcaaaaaagaggaagaaggaggtggagagaaagagctag

SEQ ID NO: 25126 - DNA, 1392 bp, Glycine max
  Peptide Sequence Number=SeqID_141904
atggccgaagctacgcgatccaaaaccagtgtcgattgttgggaagatgccttcgcgaagctttctgcatctatgactttgaagttcgatgagcttcttaattgtatgaatcaattggagaccttgcataccaatcctcatgttccaccagcgtttgcaagtccttcgtccgccacaaccgcaaattctgcttatcggctgaaactggaggttcctcgcttcgatggatcagtcctgacagatggatattcaagattacacaattcttcgaatatcatgcaacaacagaccatgatcgacttacgatttcttcgttctacatggaaggatcctactggagtactgtgtaaattgacacaatgttcaattgtttctgcgtatctctcagagttcgaagctctcgctaaccgagttatcggcctcccagcgtcatttgtgctcagttgttttgtatcaggattaagtcccgctattcgacggaaggtgcaagtcatgcagcctcactccttggcccaagcagtttcgttcacaaggctccatgaggagaagttgctagatagtcatcggccgagaccacgctcctccaccattcctttcaaacagttgactccaacggaattagcccttcgccgagaacaaggtctatattttaactgtgatgagaaatactctcgcggacataaatgcgcttcttctttgttcttgtttgttacggaggaggatgagtatgctcaggaaatcgatcctaggcctttgtcgccaactctccctccttcttcgcaagactcgtcaccggcgcagattagcctgcatgtgctctcaggccaaggagctccggaaactttacgtgtcactagcttaattgagaatcaccacgtccagattctcattgatggtgggagtactcataacttcctgcaacaagagctggagctacagttcaaccaggtatgcatggatgtatcagtgcagattcagaagcatgatttaaaggttgatttccatgtgctacccattcgaggggctgacgtagtcctaggagtgcaatggctcaaatcattagggcctgtcctaacgaactacacaactcttactatgaaattcatttatgatggcaagttgattgaacttacgggggatcattatacaactattgatcagatttcgccatcccagttgcgtcgtctggtagacacaagtaacactagcacttattttcacattcaaatggagcctcacaccacgacatcattacccttggtttaccctataccaacaatccagaagctcatcaccaaatattcttccctgtttcaaccattgttgaccttacctccatctcgacccacagaccacaccatcacacttctcccgaattcagccaatgttaac

SEQ ID NO: 25127 - DNA, 372 bp, Glycine max
  Peptide Sequence Number=SeqID_141905
atggcggcgaagatcaccgagctcgggttcacggtgagcacgttggtgaaggacgaggagctcgacaacatgatgaacagcctcacccagatttttcgctgggacctcctcatcggtgaacgctacggcatcaaagccgcctgcaaagctgaacgacgccatgttgaagatgacaacatcaagcgcctagatattgaagattgtagggtacagaagaaagaaaatagcaagagaaggaaggatgatcataatttaactcgaaaaagtaaagataaaaagattgcgtatatgcctgtggaaaatccaccaaatgttggattagctcctgcttcggctttaagaattcatctggaaacgtgcttctgcttttag

SEQ ID NO: 25128 - DNA, 935 bp, Glycine max
  Peptide Sequence Number=SeqID_141906
atgccactgattcacactactccaccgcttcactatgccatttccacacttatcaatgcaccatcatcatcttcttccaccctctctgctgccacattcggttccaattttctgcgcaaaatccataacccaatttttaggttttccaccgccagaaatcgctcgcgcgctgcagtggtcagagccaaagcagggaccgattactattccaccttgaacgttggccccaatgccacgctgcaagaaatcaaggcctcctatcgtaaactggcgcgaaagtaccatccagatatgaacaaaagccctggggctgaggataagttcaaggaaataagtgctgcatatgaggtcctatcagatgatgagaaaagatctttatatgatcgctttggtgagtcaggtctacaaggagataatggagggtcgactggtgctccaggggttgatccttttgatttattcgatacattctttggtcgttctgatggagtatttggagttggtgatgaagggagcttcaacttcaattttagaaacaagagaaaccatgttcatgatattcgatatgaccttcatttgagctttgaagaatcaatatttggaggacagagggagatcgaagtttcctgttttcagacatgtaatatgtgtgatggtacaggagctaaatcaaagaattgcattaaacaatgcacaaattgtggtggcagagggggagaaatgaaaactcagagaacaccctttggaatgatgtctcaggtttctacctgctctaagtgtggtggccttggcaaaataatcaccgatcaatgtcgaaggtgtgatggcagtggtcaggtgcaatctaaacaaacaatggaagtagaaattcctcctggagtcaatgatggagacacaatgcaaattcaaggacaaggaaattttgataaaaagag

SEQ ID NO: 25129 - DNA, 261 bp, Glycine max
  Peptide Sequence Number=SeqID_141907
atgcctcacccacacaattcaacaattatcactagcaacaacaccttgtattacaacttcaaggccaacatcacaacgaaccccaacaacaaagtcatagtgcactatgcgaagattgaagctatagcttcgtgcaaaggtagtgattttggtttagtgagcttggcaccctttgatcagcaaggccacaataagaacacaaccttccctcaagtagtgtttgaatggcacagtgttaggaattttataattcctaattaa

SEQ ID NO: 25130 - DNA, 300 bp, Glycine max
  Peptide Sequence Number=SeqID_141908
atgacaaatgcgagaatgatatgtccattgcgatgccatgaagagatgcatgacgcaatcaaggaaaatgccagaagttatgcacaagaacataagagaaataaagggaaaccgacaaaagggaaagtcatgatattgcacaagattaggaggcctaactctcttaaaatagtccccagtggagtctccaactgttgtgacctgccctctggcgggggcgcgaaaaggcctctcaagcgggctaagggagcgtcttctgtcgaaggaaaacgcgtggagtcgccaccaacatttatttga

SEQ ID NO: 25131 - DNA, 186 bp, Glycine max
  Peptide Sequence Number=SeqID_141909
atgggtaaagtagacaatgtgcaagagcggataaaggccaacttggaggccatgaaagagcaaatagccacaatgatgcagacgctctcttggcccgctcgagaggccttttcgcgcccccgtcggagggcaggtcgcaatagtgatgattggatgctattgattaagatggttgagagatgttga

SEQ ID NO: 25132 - DNA, 393 bp, Glycine max
  Peptide Sequence Number=SeqID_141910
atgaggaaaaggattccttccaagaagattgttaagaaggaaaatcattttgcaacaaaaggtgatattaaaagggcactccttcttaaacaatctttctaccatctcctatcaagggaaacatctcttagcaccgccatacctcttgagcttgaggttattcctcaagtaaaggatttattggatgaggatttggttcgcaagagcttaattccttgtgctttggcgaggctcacgggtgcgctttccaaaggaggaaagatgcgcggagtcgccaccaacgaaggtattagcacctctcacgtcgacaaaagtggggcttttgctcctacgtaccctcctttggagaggaaatcagacctacgtagttctttcttatgcgtgaatcaagtg

SEQ ID NO: 25133 - DNA, 228 bp, Glycine max
  Peptide Sequence Number=SeqID_141911
atgagtgtctctaccagctcagcctcagtcagcagagccagggtttcactccttttgcgtgccctactccagatcagttcagggctgaggttgcatggcccggagattggcctaaggcccaggcaggggaggcgccccgcagaggctcccggcgatgcagaggaggcccgcatggatgaggagatgacagatttactcggtttcttaggagggagtggagccacatga

SEQ ID NO: 25134 - DNA, 243 bp, Glycine max
  Peptide Sequence Number=SeqID_141912
ggtgctcaacccattgatgaagaaggaaatttacatggtggagaagattcctctcttcttcaaaagattttggacaggttcgatggtcttcaaacctttgttggtgaaaggtttgatactttggagttacaagtggacatgcgattcgatgagatggagtcaaggatcaccaaggtcaaagaagatgtttcttacattcgtacaagctttgatctaccaccaccaccgccaccatcatcttag

SEQ ID NO: 25135 - DNA, 334 bp, Glycine max
  Peptide Sequence Number=SeqID_141913
aatattctataaaaaggttgaatatgtgcttgaagattgtaatgaggttctcgtcaaaatcaacaaatttgtcgtcaacaaagaaggcttagtatgtgtggaaacgttgtgtatgcctgttactaaaccagaaagatttgagttggatgcttttgagttagatgaacctgaagatgctggcaggtatatagttagaaagagcataaagagtgcaaaagacatagttcgttttcctttccaacagaatgccaccatactttacttattgcacactgtgtacagaggcagagagaatctcccattacttactgtgcactatgtaagtttgatttga

SEQ ID NO: 25136 - DNA, 129 bp, Glycine max
  Peptide Sequence Number=SeqID_141914
gaaaaatgggcaagattggtgaagtacaaaatttatgaactcgttgagccacgccatgtgctgggcgagccatccactaagcgcactatccttcggctaagcacgcagaagaatctggaagaaggatga

SEQ ID NO: 25137 - DNA, 192 bp, Glycine max
  Peptide Sequence Number=SeqID_141915
atggtgacaccacgcaacaaagacaaagatgatgagtgcaatccaagaggagtgacaacgagggcacaagaacaaaagccactagggttcaaagtaggaaaagtgcatgtcgcatatcctaccgcagagtttgagaggaactgtcgttttttcaacattcaacattcaacattggttttgaacaaatgttga

SEQ ID NO: 25138 - DNA, 444 bp, Glycine max
  Peptide Sequence Number=SeqID_141916
atgcagagactgcaggttgtggctccaccaggaaccatcttgacagttgagcagttcatggaaaaggtagcctggccaagaactcagccttctcttattgagggaaggtggaggtcccaatgctcagaggccaccatccctgagccatttgtttttaaggcaggagggacacaggtaaggcaggaggttgcaactccagagaggtcaccacaaatttcaccagatccaccctcaccagtggtggatcaatcttctcctcaacagctagcagaccctcctacacaagtgcatgagatgtcaacagacccttctactccattgctggagattccagaggaccctgccacaccagtcctgggactgactaccactcctccaaccactcctgtgctacattttatagatgagaccactcaggatcaggatacccagcagaatgattag

SEQ ID NO: 25139 - DNA, 2349 bp, Glycine max
  Peptide Sequence Number=SeqID_141917
atggcttcgaatggtccttttcccttaaatcttccaattctaaccggcaagaacttcaacagatggagtgtgcaaatgaaagtcttgcttggatttcaagacttgaccggtgtgattgagaatggaatagaaattcctaaagagggagcctcagatttgcagaagactgaattcaaggatctgaagaagaaagactgcaaagccttggtgatcttgcatcaatgtgtcgatgattctcactttgagaaaatcgaaaatgctaaatccgcaaaggaagcatgggacattctgaacaaggcttatgcaggagctgataagatcaagaaggtgagacttcagactcttcgaaggcaatttgaattgctgcagatggaagagaccgagagcattggagattactttggaagattgcaggttcttgcaaattcaatcactagttgtggtgatacaattactaatctgacgttagttgagaaagttctgaggaccctgaatccaagattcaatcacattgtggttgcaattgaggaatcaaaggacttggaatcattatctgttgatgaattacaaagatcacttgaggcacatgaacaaagattgcaagaaagagcaaatgataaggctacagaacaagcactgcaagcacaccatcaatcaagaaatggtggttctgataatcgcagaggcaagaaaggaagagggagattccagaacacgagaggtagaggaggttactccaaagataaaggtaaacctcaacctgatcaaagaagtggagataactgcagtaaaagaagtggtggttctggtactcgtggaagaggaggcaaaaagaaatgggataaaagaaatgttgaatgcttcaattgtggaaaaagaggtcattatgcagaagaatgctggtataaggagaaaaatgctgatgatgaagcacaattagccacaggagctgtttctgacactgaaccagtgttgttgatggtcataacaaagactggagctgatgcaaaagatcaatggtacttggacacaggatgttcaacacatatgactggtcacaaggactggtttgttagccttgatgagtcagtaaatcacaaggtcagatttgcagatgacagcactattagagttgaaggtcatggcaaggttgtgattaaaagaagggatggtacagtgtcatacattgaggatgtgctctatgttccaaacatgagatgcaatcttctaagtcttggccaactacttgataagaaatacagaatggtgatggaggacaaagaaatgaagatctatgacaaggacaaaaggttgatcatcaaagctccattcaacaggaatagaacttttaaggttggtattcaagtcatgaaacacaattgcttgcaggctgagacatgtagagaggaatggttgtggcaatacagatttggacccttgaatttcaaggatttgagtcaactgcacagaatggctcaaggaatacctcacttgagacagatgacagataactgcagagaatgcctagagtgcaagcaaccaaggaatgcatttcagaaatttgtaccagtaaagtcaacacataaattggaggtgatctattcaaatgtttgtggtcctcttcaggttgaatccctaggaggaaacaagtactttgtaacattcatagatgacttgactagaatgacttggatttatataatcaagaagaaaaatgaggttcctataattttcaaaaaatataaagcctcagtagaaaaatgtagtggccactgtataaaaacattaagaactaacggaggtggtgaatacacctccaaggaatttgctgagttttgtgatgaggcaggtatcactcatgagttcactccaccttatacaccacaacacaatggtgctgttgaaagaagaaacaggactatcctgaatatggtgaggagcatgttgaagactaagaagctacctcatttcctatggagtgaagcagctgcaacaacagtctatatactcaacaaatgccctaccaagagactgaaaggagtgacacctgaagaagcctggactggtactaaaccaaaagtgaatcaactcagaatttttggttcattttgttataagcatgtccctgagcagctgaggcagaaacttgatgataaaggtgaacaaatgatccttataggctatcatgcaactagaggttacaagctacttgatccaaggacaaagcaggtctctgtgagcagagatgtgatatttgatgaactaaaggaatatgagtggaaggaggaccctataaacaatacaaccaagattctggtagattcattcattcctagaagaattgagtga

SEQ ID NO: 25140 - DNA, 2603 bp, Glycine max
  Peptide Sequence Number=SeqID_141918
gagaatatgagtcagacttagtaatattgtgcctctatgtagatgatttactcatcacaggaaacaacaaggtagagattgacaagattaagcaactgctgaagaatcaatttgaaatgactgacttaggatctctctcatacttccttggaattgagttcaaggaaactgaagctggaattgtgatgcatcaaagcaaatatgctacagacctgttgaagaagtttcgaatgactaactgtaatgcagcagccaccccagctgaaacaggattggcattgagtttgagagatgaaggagaacctgttgatgaaactcagtacagacagattgtgggttcattaaggtacttgtgcaatacaagacctgatttggcattcagtgttggactgatcagtaggcttatgcaaactccaaaaactcctcacatgatggcaacaaagagaattttgaggtatattagaggcacaattaactatggtattctactgccaaataccatcacgagttcaaacatggaactgcttggctatactgactcaaactggataagagataatgatgatagaaagagcactgctggatatattttcctacttggagatgcactggtgtcatggagttcaaaaaagcaagatcttattgccttatcaacttgtgaagttgaatacatagcagcatcaatgtgcttgtgtcaaggcttatggctaagaaaactgttgaaagaaatgaagatccagaagaatgaagctataaacatactggtgaacaacaaatctgcaatcagccttgcaaaaaatccaattgatcatggtcgaagcaaacacatagaaacaaggtaccattttattcgggacaagattggctttagcaagtgcatatctgaacatggagtatatgtaaaaggagaatatgagtcagacttagtaatattgtgcctctatgttgatgatttactcatcacaggaaacaacaaggtagagattgacaagattaagcaactgctgaagaatcaatttgaaatgactgacttaggatctctctcatacttccttggaattgagttcaaggaaactgaagctgcaattgtgatgcatcaaagcaaatatgctacagacttgttgaagaagtttcgaatgactaactgtaatgcagcagccaccccagctgaaacaggattggcattgagtttgagagatgaaggagaacctgttgatgaaactcagtatagacagattgtgggttcattaaggtacttgtgcaatacaagacctgatttggcattcagtgttggactgatcagtaggtttatgcaaactccaaaaactcctcacatgatggcaacaaagagaattttgaggtatattagaggcacaattaactatggtattctactgccaaataccatcacgagttcaaacatggaactgcttggctatactgactcaaactggataagagataatgatgatagaaagagcactgctggatatattttcctacttggagatgcactggtgtcatggagttcaaaaaagcaagatcttattgccttatcaacttgtgaagttgaatacatagcagcatcaatgtgctcgtgtcaaggcttatggctaagaaaactgttgaaagaaatgaagatccagaagactgaagctataaacatactggtgaacaataaatctgcaatcagccttgcaaaaaatccaattgatcatggtcgaagcaaacacatagaaacaaggtaccattttattcgggacaagattggctttagcaagtgcatatctgaacatggagtatatgtaaaaggagaatatgagtcagacttagtaatattgtgcctctatgttgatgatttactcatcacaggaaacaacaaggtagagattgacaagattaagcaactgctgaagaatcaatttgaaatgactgacttaggatctctctcatacttccttggaattgagttcaaggaaactgaagctgcaattgtgatgcatcaaagcaaatatgctacagacctgttgaagaagtttcgaatgactaactgtaatgcagcagccaccccagctgaaacaggattagcattgagtttgagagatgaaggagaacctgttgatgaaactcagtacagacagattgtgggttcattaaggtacttgtgcaatacaagacctgatttagcattcagtgttggactgatcagtaggaggatcaaagcaatagcttggtacaaagataatgattttggttgggtgagcttaacaccctttgaccaaggccacaagaataccactttccttcaagcagtgtttgaagggcaaagagtgattaagctcaaacctaaacaacttggtgagtacaaagatgagacaagtgttgggatttacgaggacttggctgtggattttgatcttagaatcaaagcaaactttggaaggttcaagagtagtcgtttcgatccacccgttgttcagtgtcgccgtttgaaggttcctttgatttctaatggtaaaactgcacctccttttagtgtcaccaaatgtaaaattgatggttctttctttgcagatcgtgattctcaagcagaagctagatag

SEQ ID NO: 25141 - DNA, 330 bp, Glycine max
  Peptide Sequence Number=SeqID_141919
atggggcatgaagttgttatttgcataaattggaatcaaccacataatgaagctgcaaaggctgctgaagcggaggaggagtactcgtttgttgctacatgtttctctagtattaaatcaagtcaaaattggcttattgacaatagttgtactaaccacatgactaacaacaaggatttattcaaggaactgagcaatataagcacattgatggttctagttggagatgacaagttcatcgctgtgaatgcaaatgtaactatagcaatctcaaccaatataggtacaaaactcatttctgatgtgttgtatgttcttgaaattgattaa

SEQ ID NO: 25142 - DNA, 751 bp, Glycine max
  Peptide Sequence Number=SeqID_141920
cgagcaagtgaggctctgcagccacttttccggcttcggagcatcgtgttcaagcaagaagacggctagcgcggcggcaacaagcgcctcatctccggctgcaccgaccagatcagaaaactcgtcaaccacctcggccgctccttcttcatctcccgtctcttccacctccaagtctgcacccacttcgattccgaggacgacttcgtcggctccctcgaacgctctgttgaaggttgacgttcctcttgtgttcagaggagaagatgcccttggttatggacgtgcactttctgaacatatactattagatgctggcctaatccccagtacaaaagtttcaaaagatagaacgtgggatgatgctactgttcaggcgttggtccaagctgttgtgaggcttgaagattggatgcaagatgttattttaggtgaattagtccctgaaggatacattttgatgcagaacaaaaatctggggaaggattcttccatatctcaaccaagaagtgttagccagatgtatgatgagttctgccccatcttactcaaccaatttaagtcaaaggattatacaaagtttgagacatttgatgctgccttggatgagttctatggcaaaattgagagccaaagatctgaacaacaacagaaagccaaagaaaacttagcttctcagaaacttaataagattcgccaggatcaagctgcaaagtttttggatgacgccactttcagtgaaggaagataa

SEQ ID NO: 25143 - DNA, 840 bp, Glycine max
  Peptide Sequence Number=SeqID_141921
ttccatgtaactgatgcctccctcacacaattcaacctcagaagcaacaacaccttggactacaacttgaaggtcagcatcacagtgagaaaccccaacaacaacatcatagtgtactatggtaggatcacatcaatagcttggtacaaagataatgatttcagttgggtgagcttaacaccctttggccaatgccgcaagaataccaccttccttcaagcagtgtttgaagggaaaagtgtgattaagcacaaatcaaaagaacttgccaactatggaaagtatgggagcagtagtttcaattcacccattgttcagtgttgcggtttgcgtgttccttttatttttaatggtaaatcaacacctccttttggtgtcaccaaatgcaacactgggtctttttttggtttagggacctatgaaattgatgttgaatctagtttctcacaaattgctcatcgtgtctttgatgaggagagatatgacctttggaaggtaaacatgaagtcctacatgaagtcttttgatttgtgggatgctgtgaaagagaattataaaatgccttcgttgcctaaacattccaccatggcccaaataaagtaccacaatgagaaaaaaaccaagaaggaagagtatgaaggggataagcacgtttgtggcatgcaagtgccaaacttgatgaaagaatttgagatgcaaaagatgaaggaatccaagacaattaaatggtactcagatagattgcttgacattgctaacaaagttacattgccaagcactacatttgcaaattctagaattgttgaaaaagattctagttacattgacggagagatatga

SEQ ID NO: 25144 - DNA, 426 bp, Glycine max
  Peptide Sequence Number=SeqID_141922
atgaggcctgccaatgttcctttcataaacctaagcaatgtagatcttcagctttcagcagagaattctgctcggcggtgtgatagcaaggacagaggtagtgtctacaatccaattttggggatatgctgccatttttgcaggttcacggtttggtggtatatgctttatattagaattgggtttgacaatgatttccaacaggaaagactgattgttctgtctgtcactctagcactggtgttttttgtagagcctgtctcaagattcgatatggtgaagttcaatatgcctgaggaacgaaagatgcctccaactggaatagcagtatacagagtggcagatctactaatggaagaacttaaaaacttggaagatgtaagatctagactagatgtaatcaacagttattttctaacttggtag

SEQ ID NO: 25145 - DNA, 396 bp, Glycine max
  Peptide Sequence Number=SeqID_141923
atgggaaaaacaactactcttgatgcatattataaaagacaacgtgatgaagctccccaagtagcaagtaatccatcaactcttccatcatcttcacaagaacaacaatttaaaggtcctagaatagaagaagtagatatctcctcacttaagaaagattcaggaaagcgtctttctatttggaaatatcagaccatatctgatgtaagctccattggagcttgtaggcctaggatcttcttcatcaatgaattcctttgcttcttggagaatgacaatggaatggagaaggaagagagaaaggagatgccacttcaaggagaagatgattctagaagaagctcaccactatatgaggccatggataagagcttggaggaagaaggagatgaatga

SEQ ID NO: 25146 - DNA, 795 bp, Glycine max
  Peptide Sequence Number=SeqID_141924
atgaatatcatagatttctccaaactcattcttagcctcggtgcatgtttggataagttatatggggttattgagtgtctgacgacttggattccaggaagtccaggtcctgattattcttttccatctctcactacatgtgatgaacttgagacaaaggcttcaactactttagttaaatgcaaatttggatcagttgaggctgcaacaaaggtgcgtactttggaagagcaggggagtttggcagacaaaattaaaaacttcgaatataattgtttgagagaaattagaattcttggtgctttaaaacacccttgcatagtggaaatgtacggacaccaaatttcatgtcaatggtttgtctcagctgatggtaatcctaaacaccgtgtattaagatctgcaatttttatggagtatgtggaagggggctccttaaaaaattatctggagaagttgttagaagctggtgaaaagcatgttcctgtggagttggctttgcatatcgccaaagatgtctcatttgctttgtcagagctgcactcaaagcacataattcatcgtgacataaaaagtgaaaacatattgtttgatttgggtaggaagagagatgatggaactcccactgtgaagctctatgattttgatagtgcagtgccactaagatcaactttacatgtgtgttgtattgctcatgcgggaacacgtcctccttgtatatgtgttggaacacctcggtggatggctccaaaggttatgcggactatgtataaaaaaaatcctatggattggtaa

SEQ ID NO: 25147 - DNA, 477 bp, Glycine max
  Peptide Sequence Number=SeqID_141925
caagatctcattttgtggcattgaagaccatctatcagatgacttttatgatgcaggacaagatcggctgtttatgcctgttgagtgttatgagcaaaatcattgtcttgcttctcgtgaagtcatccttttggacagaaaaattgatgaagagttggatgctgttatgctagctgctcaggcattgatggcatcactgcttgcactctttgtatctgatcattttggtggcagtgatagaagtggtattgtagaaaggacacggaaatctgtgtccggttcaaactataataagccttttgtctgtacatgctcagctggaagcagcaccagtataagttctcccactgaaccagttgcaaacaccatagaagatatcactctttcgaagatgcgagcgaaggcgaggctcacgggtgcgctttccaaaggaggaaagatgcgcggagtcgccaccaacgtttatttgtggaaaac

SEQ ID NO: 25148 - DNA, 372 bp, Glycine max
  Peptide Sequence Number=SeqID_141926
atggctcgaagtcctctttcttgtctaagctttgtacttcgtaaatacttctttgaacctgggaattccttctcaaagactctcccctcttttcgattcgagcagatacttgttattcctttcatcatcaacctcaccgcatttccgaacttcgccactgttcttcgtgaacccaagctctcactcactgatcctatcagttaccaaacccttcgtaagaatcatcctctctcagatttacaatgtcgcaaggacaagcagttccgtttgctgggaaatggcaccgttttacagtcaggaacgacggagagaaggtggttccagaaccacaaggtgacgccgaacacacagaaacctgggaatcggaggtga

SEQ ID NO: 25149 - DNA, 246 bp, Glycine max
  Peptide Sequence Number=SeqID_141927
atgactagcaataacccaaatgttcctactttgttgagatatgttgttggtgttgtggtcgaagtcattgagcgtaaaacagttaatcctacatatagagttacaatcaagttgagggataacagattagatgtaggtatgtcattctacgctggcggactatcaaatcaaggaagtgtttctcaatcacaatatagccaatattcccaacgaagctctatggacaagttcttgcataatgcttaa

SEQ ID NO: 25150 - DNA, 531 bp, Glycine max
  Peptide Sequence Number=SeqID_141928
atgggctcctcactatccaccgaagtgctattcgcatataatggaagcagctatattgtaaaagttagaaaagctgacaacaaatacttctttgctgatggtttgaaggaattcaggaaagtgttgaacattcaagaaggtattgtcatcacttatgctgctccagagagatattggatattcaatcttcacttcatgctaccactagataatcagacatgtggaagtcatccaacaacacgaagaacacatgtctggatggtaaaacttactgaagctatgatctcaactccacgtccattggtactaccaatgcatgctctaagctatcttggtgtctcaaggaaaaatatgacggttctggtaaatgatggtcatactctgctatggaaattgaccttgcatgatgctgaaaataggctacaatgtgttgctgagtcgtggtaccaatatttgagacacaatgactttagtgttggagatgagatatgcctctacttcagggagattgtttcaacaatggatagttga

SEQ ID NO: 25151 - DNA, 312 bp, Glycine max
  Peptide Sequence Number=SeqID_141929
atggaatgtgtattggctgatgtacttagagatcaaaggaatttgagcaacaagggtgacggaggttggaaaaggtcagcattgaatgttgtagccgcagtgttgtctacaagcttcaatgttaatgtcacatcagataatgtcaaaaaccatatcaaattatggagatcgtggtatggtatttcgcataaatcggctaaaccatttcgattcaaggtgcttcaaaattgggaagatatagtggatttgtgtgctaaagatagagtcaccggtcatggagctgaaattgctatgatgctgatgaagcgatga

SEQ ID NO: 25152 - DNA, 261 bp, Glycine max
  Peptide Sequence Number=SeqID_141930
atggccaaagaacgaacaacgaacggtgtaggaattgatcacggatgcgatttggaagcgtttcggccttgttttctcttctttcttcttctttctggacctctggactttagggaacttcaggaacctcttacttcagccttcttaggcttatttatagcaaaacaagccacttggaatgaaggtagctcgcccaggcgagctgataacttcattctgaagcaaattgctcgcctaggcgagctggttacttcatcatga

SEQ ID NO: 25153 - DNA, 516 bp, Glycine max
  Peptide Sequence Number=SeqID_141931
atggtgacaccacgaaggtcccctccacagtcagatgataatacgaagccacaacctaagaagacaagacagagcacacgtcttagaaggctgactttaagaactcgagaaaagatcccgattgtccacagcaattggaaaaatgtgccgaaaactctaaaggacatggtatggggggaaattttggcaaaatttgatatccctgaagccgaaaaggcccaagaaaaaggcaaacagatagaaaatgcttcagtcaaatatggtatggataagcaaacttgggataaatttgttgcaagtcgcaagaccccagattggcaggactcgttagaagagcagacgacacagggtagttttgttccctatggtcgggatgacatcttgaatacggccattgtcaaaccggaacatccaagtcgagttcgtgcagcgggatctggtatgacccttactcaattttatggtagggcaacacgtacctcaagtagttcctcagcaacactaatgcagcaatag

SEQ ID NO: 25154 - DNA, 732 bp, Glycine max
  Peptide Sequence Number=SeqID_141932
atgcagagactaaaaaccaaggacactccaagcttcaattcctatgcattgtatgcatatgaaactgtttggttagtagcccgggctcttgatgcttttgtcaaaaaaggtggtgttgtgtctttctcctttgaccctacgttgctcgaaacaaatggaagcatgttgcatttacatttgcttcgtgtttttgatgatggccctttgtttcttgagacaattttgagcaccaatttctctggtctaactggaacagctcactttgatattgaaaggaatagaaatcatccagcatatgatatgttgaatattggaagatctggaatgcgcaaaattggttattggtctaattactcaggtctctcagttgtgactccagaaattttgtataagaaaccagttaacacttcaacaagcagccagcaactgtatggtgttatatggcctggagaaactgcagctaaaccaagaggttgggtgttccccaacaatggaaagccactgataatagcagttcctaaccgagtaagctacaaggagtttgtttctaatgacaataaccctcctggagtaacaggctattgcattttcttggaagctgccataaacttggtgccttatcctgtcccacgagaatatatattatttcgacctggtaatagaaatcctagctatgatgaccttgcaagtcaggttgcactaaatggttggttgaggtctcttcagacataa

SEQ ID NO: 25155 - DNA, 354 bp, Glycine max
  Peptide Sequence Number=SeqID_141933
atgactaaagcacgtcaaaagggggtacggaaagaaaataggggagaagcttgccacccagctcgcccaggcgagctaggttgcttcctccagaagcaaccgccttctggaggaatattctggaaggcccaagtgggcctgaacttcatgaattgcctaacgatgggtgccaagtacctcgaagtggccaaacgagggttgcatcccaacaacggatggtccccggacgaaattaggggaactaaagataagacactaatttcgttcgagcgaaacaccattcagccagtgaacctccctgccagcggaacctgcaaaaatttgaaaatgatcagtaccgacacatcatcctga

SEQ ID NO: 25156 - DNA, 609 bp, Glycine max
  Peptide Sequence Number=SeqID_141934
atgagtggtcgtgctggtcgacgaggcattgatgaacgtggaatatgtatcctcatggttgatgagaagatggagccttctactgctaaaaatatggttaaaggggtagctgatagtctaaacaggttctgccagataatggtttactcgtccattttgttagagatcttaatgattctgaaacttcggaaacagattgaatttgagccagaatatttggtggagtttgataatccagatattgatgagaaggaaccaattccactacgggatgcacttgagaaggcgaaaccattcttgatgtcatatgaggggattcaaagtcaggaagtgtgggagaaaacaatggaagagacaatggcgcgagttccattgttgaaaaagattgttgatcactacagtggacctgatagggtaactacaaagaagcgacaagaagaattagacagagttgctaaaactcttcctgaaagtgcaccatcttcagtagaacaatttactaatcgttctgttatttctcttcagttgtttccctcttgtgttgataatctttttataagtatctctgccaatgatgttctattgcttgctcatgcagttcagtgttaa

SEQ ID NO: 25157 - DNA, 968 bp, Glycine max
  Peptide Sequence Number=SeqID_141935
gagctagggtttatcgaggctttcgattcgttccttcctcgctgctacaacaatggcgaaacctgggcgaggtcgtcgctctccctccggttccgtttccggcccctcttccccctccgactcccgttcctcctctcgctcgcgctccctttctcggtcccgttctccctcgcgctccatatcgtcttccccctcctcctcctcttcctcccgcagccgcagccctcccccgcagaggcgccgaagagtatagagattgcgccgaaggtatcgctattttagagattgcgccgaagctcccgcagctgcagccctcccccgcagagatctcattttatggagtttcacccggggaaggtatgggagcaacaacgtctgatgacgaagatgagcaagtagatagtgatgccaatctgtttgatggtgctttggatggtcctgatagcatgggattcggtcctcttattcccacagagaatgagaggtccctcatggaacgtgtaagacatgaagtaaagcacgaattgaaacagccagctttaacagttatacgggataaagaatcaaaatgcttgcttgtgttcatccgtggaactcaaagcttaaaatacacactgacagatgcaatcggtgctcccgtgtccttcaatcatttcatttgcaacgatgatggtgagctgaagaggaacaacaaggttgcaggacatggacaccgtggtatggttgctgcagctcgttggattaagaagcactgcaccactatactacttgaagatcttcgtcgacaccccccgatttccaaatcaaggtattgtggagttccaaatctggccatggttgagagtgtggacaatcagaaggtagcaaatcatcttgaccgtatggtatcaacccttggaagaaatcctctgaaggttttggtgcaagtttcctcactccctttgggtgtgaggaaaattcttgcttga

SEQ ID NO: 25158 - DNA, 626 bp, Glycine max
  Peptide Sequence Number=SeqID_141936
gtggatatggggtggctcagatcctcgttacatgtccaatgtagccactgattgggatgacatattgaaaattatagagaagctgataggggaagatgaagttgaaggagttgggcttgtaaatttcaacaagactgaactagcacaatgggagcatcttattcctgaggcaacacatgttgttctgcctctggagtatgctgcaagaaatgtgacatgggagtccttgtacccgcaatggatcgatgaggaagaagaaacccaagttcccgtttgtccttctctgccaagtctaaggaatggagggaattggtctatagatgttgctcggttgcaccttcagcttgcagctgctgcccttgcaacctttttcaaaggcaactaccccgtccatcttcctatagggtcttgtgaacttgcacttcctatgagaggaaaagagttggtttacaacgggaatgctcccagagaagcatatgcaacaattctgcattcagctcatgtttacgtttgtggggctatagctgtggcacaaagcatccgcaagtctggatcaactcgagaccttgtaatacttgttgatgagacaatcagcagctatcacagaagtggtctggaagcagcag

SEQ ID NO: 25159 - DNA, 309 bp, Glycine max
  Peptide Sequence Number=SeqID_141937
atgactgataagatttttcaagagtgggatgatttgttaaattggattcgatgtgtgagaaaggagcacatgtttgtaattgtcgttcataagtcaaaaaggttttcacaactagatgtgtctggtaaaatcaccttgaagactaaagtccgtgaacttgtgttttcagataccacttcgatgtgtccccctgcaacaaagataaaaacaaagggtgcaccaaagtatttgaaatctatcaagtgtgaaccttcaatgtgggagtgtgtcgatgaaatgaacacgatggttggtagtttgagaatgtga

SEQ ID NO: 25160 - DNA, 339 bp, Glycine max
  Peptide Sequence Number=SeqID_141938
atggagaacatgaagatgaacaaagatgaaaggtttgcacaaaagggtgtcccaatacatagccaggttatgaagatcaggcaagagtcagagaaaattgttgattggtccccgggcaagccagagataagacccgttctccgtgaaataagccggcagatttcccggtcgccgttggggatctccggcagaccgatttccgttgcttttattttctggtttgatatgttctatcaagttgatatcggtagggtttggggaattggttttgaaggttcctcaattttgaatggtttagtcatatacttagaaagaggtttaaaagaagaagaaaagtaa

SEQ ID NO: 25161 - DNA, 540 bp, Glycine max
  Peptide Sequence Number=SeqID_141939
atggcgatgaccatgggggccaagtcgaagcctcacatgaccattggggctagattggaggcacacatgagacaacgggaaaagaaagtaggagcttggttggaggaaggggagagggaagacaaagggagaaaagagcttaagcagaggaggagaggttgcgcggaggaggagggggggttcgtggaaaggggaaaaagagaaagaaagaaagaagaaaaagtagataagaaagaacgaaggataggggcatcaattaaggtttcagaaactgacacaccatcacgaatcccccacccaatgggacaaaaaggcagccaagaggaagatcagagggaaatgagcattttattctacactggtattggacttagttgctatgaaagagataatgaaggaaataaatgttgtccaaaaaaaataacagagacagtggagatggatgacatcaccaagttgcacgatattcttatgaagctgacaagtaacatgactaaagaagaatgcagcaaacaaaaaatcacttgtaattatatttaa

SEQ ID NO: 25162 - DNA, 306 bp, Glycine max
  Peptide Sequence Number=SeqID_141940
atgtctaggatggttggagtcaggctagtgtgttcgtggaatgggatttcagtcaatgagggctttggaatggtgacaatggtgtttttaaaggttctgatttctgattttggatgggacaacataagatggtcttctatctgtggagcttgcttgcgatgctgtttgtgttcagtcagaggtttaattgctggtgcaatatgtagatggagtttcgtgaggtctcaaaatcaggggattgtagtgtatgttgagaagctctcatctcagcagggggagtgcaagttttgggtgagaatggaataa

SEQ ID NO: 25163 - DNA, 542 bp, Glycine max
  Peptide Sequence Number=SeqID_141941
ccattagaagagaaagaacatgtgattagtagtatgactgaaaatgttagtcagtttgtcagattgattgtgaaggaatgcattaactgtatcccggccatgtttgattgtgatagcctcgtagccaaaaagctgatggcgagagcatcatccacagaaaagcttggttcaagacaaatttgtcccaaatttgggggagacactggtgggctaagcgtgcatccactgctaagcgtagcttcagcgcgacagaagaatcaggcagagcatcgatattggccacatgctaaacgcgagatcagtgtgctaagcgcaacagttgtcttcagccaggctcagcgcacgactggtgctaagctcaaatccacttactcgtgctacgcgcgaagaattccagagcacaccatagtgccttttttcgagaaaagagttttggaggcagcaagaggagcaacttttgcagaaatacctaggggtgtgcaaatagcaatcaagcccacttgggccttccaggatgttctaacagaaggcggtgccttctg

SEQ ID NO: 25164 - DNA, 273 bp, Glycine max
  Peptide Sequence Number=SeqID_141942
atggcaagcccacctcagaactcagacctaacattcccagcagcagatattgctggagaactgaatcctgggagaaacacacacgttcatgttgattctaaatcttctgaggtggctgcctccaaggaacaagccgaggccaaacagaagaaaaatgaaaggcaaaagaaggatgcattgcaaacaataaaatcagccattttaatttcaggcatagttgttgctgtgtcaggagctgcatttgccataaccaagaaattaagagagaaatga

SEQ ID NO: 25165 - DNA, 258 bp, Glycine max
  Peptide Sequence Number=SeqID_141943
atggcattgaacgagaaattaggggcaagtggtaacgagaaagaacaactcaccagtgacgacgacgttggggtgatactccggcgaaaggcggcgagagagctgaggctacggttccacggcggcggcgggggagtcactttgcggcggaaagaaagtgttgacagggcaagaggtgctgacagcttagaagctagaggtaagcaacatgtgctgacagctagaggttcgaaagagtttgaagcgagactagggtga

SEQ ID NO: 25166 - DNA, 405 bp, Glycine max
  Peptide Sequence Number=SeqID_141944
atggacagggtgaagcatgcagctcaaactgctcatgcagacgagtttattaaaaaacttccagaaggatacaaaaccaatattggaccaaggggatcaactttaagtggaggccagaggcaaaggctggctattgcaagggctttctatcaaaattcttctatattaattctggatgaggcaacttcgtccttggatagtaaatctgagttattagtgagacaagctgtagagcgtttgatgcaaaatcgcacagtgcttgtgatttcccatcgcttggaaacagttatgatggctaaacgagtattccttttagacaacgggaagctaaaagagctgcctcaatcaactttgttggatggtcatcacaaggattcattgctatcatctgggcttgttatttga

SEQ ID NO: 25167 - DNA, 267 bp, Glycine max
  Peptide Sequence Number=SeqID_141945
atgacctttcatttggtcttgccaaaagttaggtatgcactgcagtgggagtctaagaatctgattgctgtgagcactgcaattcaagattggcttacttcaagacttgcgatggagctgatgaaacgaggggcaatgatgactgttttgagctcactcttaactgctttggcttggcaagctgcgttacttgcagcaactgactttataaacagtaaatggacaatagctattaacaggtgtattatatctccttattctgtctag

SEQ ID NO: 25168 - DNA, 477 bp, Glycine max
  Peptide Sequence Number=SeqID_141946
atgaagacccccgacgaagcaatggacttaattgaaagcatggctgctagtgacattgccattttgagagaccgagcccacattcctaccaagaagagcttattggagctaacctcacaggacgctctgttggcacaaaacaagttgctatccaagcaactagaggcattaacagaaacactcagtaagttgccaactcagattcattttgcacaaccttcacattcttctattttgcagggaatcaacccagaggcaatttcaatacaagtggatttccaggatttcagaacaactagcagtatcaacaacatagacagtggcaaaatcaccctggtgggccagctcgcaaagcagttagctgaaagaccatccaacagctttacagcaaacacagagaaaaatcgtaaggaaaagtgcaaagttgtgacgactagaatcagaatggctattcaagctgaggaaagtagagcttga

SEQ ID NO: 25169 - DNA, 531 bp, Glycine max
  Peptide Sequence Number=SeqID_141947
atggaactactccttttgagagctgggcttagggaggaggaaagaacaagtattgctaggttccctggtggacttaatatggaagtgagggtcaaggttaagctccttccatatagggacctagatgacctagtccaactttgcataagggaagagcaacaacttaaaaggaagcctacttcaaaatcttatggctctcactcttatccaaagaaagaccaaggtcaaggcatcttaggggctccaccttctaagcccaaagatgataaggggaagacaatagaaaagcaaccccctaaggctagtatgcaagagaagactagctctataaaatgcaaaactagtcatgcatgcacccatgtggacactcaagcatcaagtttttatggtcatgtgacactagggctcaggattcatttttcctatttaagtcaacccaatgtttccaaaatatgctcctttatcaatttatgcattcatccgagtccattttgggtgtttgggaaaattttcatagcattcacccttcag

SEQ ID NO: 25170 - DNA, 240 bp, Glycine max
  Peptide Sequence Number=SeqID_141948
atggcttggtgcaaacttagcacaccagtggatgaaggaggtttgggattaaggtctctaaaaagcattaaccaggtagctttacttaaacaagcttgggcggtcaatgaaattaaggaagtgataattccttgtatcccttgcattgatcatccaatttggtgccctgcagcattgggagaatcattttttaaagtagcaaatgactttgttagggaatcatcctctaaagtctcttag

SEQ ID NO: 25171 - DNA, 405 bp, Glycine max
  Peptide Sequence Number=SeqID_141949
atgtgggttttcttaaccggtcgtcaaatcgactgggcccatcttgtgagatatcacatgcataaggcattgcaatcaaatgctccactcccatatccccatctgattactttgtttctacaacattttaatgtccctcttaactctaagccctttgtcaaagtcaagagatccttttctatcagtgcaaatgtagtctcttccttcggataccgcaaagagagggatgactcttgggtaaagaaggatgctccagtactggctgttgaagaccgctctccctcactacattctcagagagatgactcttcatctcttatgcacaacattcttgacaggtttgatggacttcaaacttatgttggtgagaggtttgactccttggaacgtcaagtggactcatga

SEQ ID NO: 25172 - DNA, 568 bp, Glycine max
  misc_feature (255)..(255): n is a, c, g, or t
  Peptide Sequence Number=SeqID_141950
gctggtaatcaattaccagaggcctccacaatgttccagtcccctttctaagcctggtaatcgattacacccattggtaatcgattaccagaagccctcatggcttcctgacctcattttcaagcctggtaatcgattacaccccgtggagctcgcctgtttaggtacatcacaggttctcactgaccgactatgcccgggttgggtcgggattggtcaagcttggttttgggcaatagcaccccacctgacggncccaaggtctcctgacccccgcgacatatctccaggtggcggtccgggccgatggtgcacaacaagttttccacatccacaatgcgcgcataaacccacccatcccccctattgcccacctccaactgagctcacgtactccccacgtagcccccatatcctccgtttctctcaacaccgggtccccatcaatccctcccaagcttccacaacatccaagcaaaacaacattcaaacagcacaagctatcatagcccaagcaaaacagagcaaaggcagaaaactctgctcaacacatcaacaaaaatcatag

SEQ ID NO: 25173 - DNA, 792 bp, Glycine max
  Peptide Sequence Number=SeqID_141951
atgtggaagcaacaactatcaacttcaatcaagccatggactagtcaaaggactaatgcacaatcagtctgcatggatgctggggatgcgaagcgtggtgggatgttaggatccacttgcaatgtatgggatttgaatcccacattggaagtgtgggatgggattttactgaaggagttgaatcgccttcttcgctttaatgggtactttgtttattcagccccccctgcttatagaaaagataaagattatcctgtcatttgggataagttgatgaatttgactacagcaatgtgctggagacttattgctcgacaagttcagacggcaatatggattaaagaaaataaccagtcatgccttttgcacaatgtagaacaaaaacacataaacctctgtgatgctgctgatgattttaaaccttcatggaatatccaactaaagaattgtgttctagttagaaattctaaaacagattcttacaagcttcctcctagtcacgaacgccattcagtgttttctgagaaccttaacacgataggtataaatcggaatgaatttacttcagatactgtcttctggcaagaacaaattggtcattactggagactgatgaatattggggagacagaaatacgcaatgtgatggatatgaatgcctattgtggtggatttgctgttgcgctcaataagtttcctgtttggatattgaatgtagttcctgcaagcatgaagaacaccttatctggaatttatgcccggggattgattggaatttatcatgattggtaa

SEQ ID NO: 25174 - DNA, 231 bp, Glycine max
  Peptide Sequence Number=SeqID_141952
atggaaaaatccgacaagatgaatttcaaagagaagaaagaaaagaaaggatatatcacttgggaagataatgccataaattattcaagtgattcagagaagaaaatcataagtctggatatcatgatgaaagactatgaaaatggagaagagcaaagtcgatacattgatagcaatttctccaaacacatggcatgcatcaaagtttattcatttttctctccaagataa

SEQ ID NO: 25175 - DNA, 231 bp, Glycine max
  Peptide Sequence Number=SeqID_141953
atggtgttggggattggtcacaaagtcgggggcgggggtgggaaatgcaatacccgtccccgtttcaccccgttgccatgcctaccggcccatactcttttggtcttacgattgtggaagaaaagcttccaagcttattttgataatgccaaagactcaagtcaagaatcaagatacaagcaagtttcaagaatcaaagagtcattcaatcaagaatcaaaattcaagtga

SEQ ID NO: 25176 - DNA, 225 bp, Glycine max
  Peptide Sequence Number=SeqID_141954
atgcggaaattgattaaggtaaggatggaaaataaggtggttaatttcgtgggtcttaatcaggtggttcttggcataaaatggatgaatgggatggtggattttctggaattgtggtttgaaagaacaagggtgaagatgaaaggaaggaaagaatcactctttccagcgagggcaacatacaaaggttgtgaaagtcctttgatacagccagggtgttcttga

SEQ ID NO: 25177 - DNA, 507 bp, Glycine max
  Peptide Sequence Number=SeqID_141955
atggaagaatcatcgaagaagcgaaagggatcatcctccaccatcactgttgctggtcatcgccgccacaaaccatctgaagcacccacaacacctatccatccttccttatcatctccaagatcatccaccttgttttcttcagatgatcaatatctacggtacctttctcaattttcttttaggatcattttagaccctaagtacctagacatagatttcttcaatgatgaaacatttgactgttatcaagtgtttcaaaactctggcttggttgatttcatgtctttaaaattgccttactatcctgaacttgttaaagtcttttacagcaatttaaaaattcaggaggacattatttcttctaaggtgcatgttatttccatgatcattgatcaatctttgttcttttctttgacaaaattacccagtcatggtgcaccttttgagggcaccattgttgatgactggaaatttgattattctagtcatgatgctcgtcgtatg

SEQ ID NO: 25178 - DNA, 815 bp, Glycine max
  Peptide Sequence Number=SeqID_141956
atgaagaggtacgaaacaaatgaggcaaaattgggtgagaatgcggaagagaaatcgtcgtttctggaatgcgtgaatcgcatctcaaagctgatgaaacatttctcggagtacgctcaatctcatcaagaggaagatcaagaagaaaacaaggacaaggtcaagggaaaaacagacttgataatcaacggcctcggcgcgcttcagcagcgtgcgatgtcgtttttggaggacgagtttcggtctctaatggaagaatctagaaaccaagccaaacccgcagagcaaaaccagaaccagaaggggaaacaacaacaagtggcggaatcttctgagcccgagtcacctgcagaaatggttacggatttcccgggtttaccggaggaaacggttacgaaactgagcaaaatagctaaagaaatgatcacaggcggttacggaaaagagtgctgccatgtctacgcgctttcgcgaaggcacgcgttcgaagacggaatgcacaagctactaggttacgagaagctcagcatcgatgaagttcagaaaatgcagtgggagccactggagcgcgagatcccactgtggatcaacacgtggaaggaatgcacctccgtgtggttccctggcgagtggaggctcgcggagtcagtgttcggcgaagagaaggagcaagattcttccctatcgacgaacaatatcgcggcgagcctctttgctaacctctcccgcggaatcatgatccagcttctcaatttcgcggagagtgtcgccatgacgaagcgcgccagcgagaagctcttcaagttcctcgacat

SEQ ID NO: 25179 - DNA, 228 bp, Glycine max
  Peptide Sequence Number=SeqID_141957
aaagtaaccaaagaagagggcacccagccatcacggcctgcggctcccttgcgttgctcgacaaagtgggcgcccatcgaaactcgccctagccgcttgcacaaaacgcaagccgccgcggaactcgaacagccgatggccgactactcccgctctgcctccgctactcagcgtgatggaatgggattattctcaccaaactcacattggcgaagtttggacagttaa

SEQ ID NO: 25180 - DNA, 991 bp, Glycine max
  Peptide Sequence Number=SeqID_141958
atgtcgaaaatcaccggactgcacgaggcgatgtcgcgcctcgacgaggcgtggtccggtgccgacgagtcgagaaatctctcgcgagagcaactcatcgccgtgaacgatgcgatcggcctgttgcagcggcggctggatgcactgcacaccgatgtggccgcggacatcgcgcgcgaatcgcgcccggaactcggacctgacagcctcgccaagcagcaggggttccgcactccggcaaagctcattgctgcgacgacaggcgtttcgaccggagaggcgatgcggttggtcgctgtcggagaggcaacggcgccgcgcaccgacctcatcggtgcacagctccctgcccgatacccggtggtgcgggaggcgcttgcgtcgggtgctctcggcgctcagtccgccgcactcatcatcgggttgctcgatcggtgccgcatcgcggccggagctgatcggatcaacgagggcgaacggatgttgacggccgcggccgagggtcttgcgctcgacgatgtgcgcaagctgatcatccgtgcggaagcgtggctcgatccggatggggtcgagccgcgtggggatgaacaacgtgcgaggcgttccctgacgatcttcgagcggaacggcatggtgcacgtgaacgcgcagctcgatgcggagacagcggctccggtcgtcaccgccatccggggatacgtgtcggcggccttcgctgcgcgtgtggacgctcccgacaaagacgcgccagacgcggaccgccgtaccgtgccgatgctccaggcggatgcgcttgcagtgttctgcgcacacgtcctcgggtgtgaccgccgcgtaccgctggcgggggcgaccgtggtcgtgcggattaacctctccgatctggagaccggcaccggctcggcgaccgtcgacggaatcgaccagccagtgagcgcgggagtggcgaggcggatggccgcagacggcggagttatcccttgcgtgctgg

SEQ ID NO: 25181 - DNA, 342 bp, Glycine max
  Peptide Sequence Number=SeqID_141959
atgaacgcacctgtcaacgcagatttgttaaagcacgattctactcctctcacgcgtttacgtgaaatcccgtacaactatacttccttctctgaccgtgaaattgtcattcggtttctgggcgaagaggtttggggtattttgaatatcttgcgcgctgagcgcaaaaccggccgtagcgcacgcatgctgtttgaggtgctgggcgatctgtgggtagtgtctcgcaatccttatctgcaggatgatttgctggaaaatcctaagcgtcgcaaagccttgatcgaggctttgtaccaccgtatttctgccattaatgaacgcagcggtggtaacgataaa

SEQ ID NO: 25182 - DNA, 267 bp, Glycine max
  Peptide Sequence Number=SeqID_141960
atgggtagtgccactgattgcattgatattgtttgccgcatgcaagcgctgcgcggcaaaaccgtcctggtgaatttctgggccactgattgcccaggctgcatcaaagaaatgccagaactcattgacacataccagcagtataaagacaaaaatttcgtcgtaattgccgtagccatgccctatgaccctccggcgcaagtggccaactacaccaaggaaaaaaacctgccattcgccgtgatgcatgatggctatggcgaaatg

SEQ ID NO: 25183 - DNA, 159 bp, Glycine max
  Peptide Sequence Number=SeqID_141961
atgtcgacagcaccaatcgagtggcccctggtggtttgtggtggtttaggaggcggcattggtgtttgggttgtgatccatgtttggtggaatggtcgttatggaggtgagacacttagagtacacaagaaatgcattttaataatagagaaagtgtga

SEQ ID NO: 25184 - DNA, 192 bp, Glycine max
  Peptide Sequence Number=SeqID_141962
atggagatgagacttgggaggatctgcacccatgattatgctctcaagtgtgctttatgttggttttgggctgttgtcaataaaaagcgaagacccttctctctccataaggaaccaaagacaaaaactggaagtggtgccacatatgaaaatgctagtgtagggctttggcgtttgcttcttttcttatga

SEQ ID NO: 25185 - DNA, 978 bp, Glycine max
  Peptide Sequence Number=SeqID_141963
atggcctctgatcagcacaacacgttccatgaggaaggaggtggcaaatcagcatgttccaggagcagaaagggtccaaagaagccaccccagagaggtttaggcgtggctcagttagaaaggttgaggcttcaagagtcttggaagaagatgaatgaagggtcttcttctggaggaggagtgctacaagtaccactaccaaccctccatgatcaccaccatcatcaacaacaacaactttttcagtgccaccctcctccagtgtttgcagcaagtggtggtgttcctatgaggtatggtgcaccatcaccaaaccttggctttcagtactttcagcatcttcaacaacatgtgatcaatggccacaacaacactattggtggagattgtatgcttccttcatttggatctgggcctccacttttggttggaacccctcttgagacctcaaaagagctctcttcaattccaaatcttcattctcagcctgagtgttttgatttttgcctcaagaaaacacgtttcaatgagtacaatgaaaagggatcatcaaatgaaaggggagagagggctttggagatagggcccaatggcaatggccatgattttctcggatttatgccccaatcttctgccccaagctttgttggggaaacttgtgatttctataacaaactggtctatcatgatgctgctgctagtgctagtgcttattcttgtgctactactcccaatcttgatgagtgtgtggaggttgttgctgttcacaggaggggaaactcagggagtggcagggttttcatggaatatgagtttttcccagtaaaagatggcaatgacactacttccaaggagctggaattgccctcaataggttcagttgttgtaggtggtgctgaagcttcttctatcactgctgcagcctatggagattctgcttctaattatgttgatttgtctctgaggctttctcgctag

SEQ ID NO: 25186 - DNA, 327 bp, Glycine max
  Peptide Sequence Number=SeqID_141964
atgatattagtcattagggtcgtcaatgtttattatgtagcgaacaaatgcaatgatcagcagagttatgcatttcggggaatatacaaaaatagacccaaggatggggaatatactttgccattgatccatgtttatggattctccaaagcacgagatccagaatttgattttcacgagagaataagaattgcgctgctagaagttgcggtcaacgtagacatgcgacgggtacgacttgttgctcctggaaaatggatgttgtgcgcatcgtttattctccctaaaagtgtagcatttgctgatactgctgcagttgatacctaa

SEQ ID NO: 25187 - DNA, 1197 bp, Glycine max
  Peptide Sequence Number=SeqID_141965
atggattccaaaaccgagtttccaattcctagtgacaaagaacgtcaagctataaacaattacctccagatcgagcgcgaattcatggccaccaagggcttttataaagcagaaaggaaccttctgcatcggaagcacgcggttgcaacaattgctaagctctctcaaggccaagttgttgatgcgtatgttgcctatcttgcaatgaactacttcgatcgctatgcttcttccacgaatccatttgcagttgggctaggctcttctgtaactgatacagtttgtttcgttgcaacctgttgcttcatgctttccgctaagatgaggtcaaaccaattcgatctccaacagtttctgttcgagaaagatttgaattaccagcctactaggttagcggcaatggaacttagcattctcagtggccttaactggcgaatgctacctataactccgttttacttcctagatcactattaccccaccttcagcgaaatcggtggtttcaaacgccgatcgatcaatgagatcatagtccagtctcaaggagtgcaccaattcactgaattcaaaccttctcatattgcaatatccgcttttctagctgctactttcgttggatatccctcagagtttaatgcaattcaaaaatcacttgacaaaccggggaagctggagggctgttggaggcagctggtccatctttgtcataggagcgccatcgagatatgtagcgcttcaggaactgtaatatctgcaactaaaattaggacaaagctcccaatccaatctgaagaagctgcagcggaagaagcatcagagatacagacaaggaaatctgaagtacaaaaatatagcacaaccaagttcatccagttcacggtattggatactgaagaagaagaaaatgtagcaccattaatccgccgacgaagacgggaaagggtggaggcaactgaagaaggtgcagagccagaagctgagactgaggcaacaaagcaacaaggacttgaccagggaaaggctgtgacagtgggagattcatctgaacaaaaagatgcagaagctgagactaaggtaaacccaaaagaacatgacaagggtataggggagatagaggaaatatgtgaagaacatgtggaagctgagagtgagttacgactaagaaaggcaaagggcaaggccaaggtgggtgaagag

SEQ ID NO: 25188 - DNA, 2214 bp, Glycine max
  Peptide Sequence Number=SeqID_141966
atggcggctgcatctgccgcattctctcgcaatataagggttttctggctcactgtaacgcgatcacaacggcaatttaaaaccatgattattatatatgacgaaattgtgaagcatcttaactggcacaagagctgtcccatttgtagtccacttgttggtcttctaaggatagtagctaatgcaatatgctatcttgcctctgataataccaacattaagactcttgtcaggatggaaggtggtatccctcctcttgttgaattggttgaattcaatgtcacagagttacagaaagcagttgcatcggggttggcaactcttgcatatgataatcatgacaataaaaaacagattgttgaatgcggtgcattacgcactcttgtactaatgcttcaatcagaggattcaaaaatgcattacgaggcgggtgttgtgattgaaaagctggtccattcatcgccagatattacgaaagaagtgcttgcagctggggctttagaacctgttatttgtttacttagtagcaaaaagcaagcagcccgtttaattggtatatttgcagcaacagattcagattgcaaggttcatattatccaaagaggggttattccacaattacttgacatgcttaatagtcatggggaaatggcggtttttgcacttgggagtttggcaccggaatcacataatcaagctgttttatctctctatggtcttgctgataatgagcttgcggattttatcgaggctggtggttttcagaaactgaaggatggacatttcaaatatcaacatcttcaccattccaaagtagagaaagcttcgaaacgaacacactctcaaagtagggttactcagcgcagagcaatctcctccgctgtcaacatgctccacaacaagtcctttgtcaagaaaaccaaaggtggcaaagtcataaagtaccaagtgcgggagcactacctgcgcgacgatatatactgcggcgcaccgttttgcaccgtttgcgattcttccagtgctcgcctcagtgcttcgccttccaccattctcttcgtcgacaccaatgtcgttctcaaccagattgatttgctggagaatccggcgattgacgatgttgtggtgttgtccattgtgttggaagaggttaagaacaagaacatgtctgtttacaaccgtataagagctatctgtagccattccatgaggaagttctttggtgagattgtgttacagtattacataggagaggaagggaaacttaaggatgcagtaagggatacatatattaaggaaatgagtggggaaactaaaaatgataggaatgatagagctattcgagtggctactcagtggtatcagaatcatcttggtggtgcagtaaaggtgttgcttataactaatgaccaagagaacaaaaggaaggctagtgaagagggcattttggccgaaacagttgagtcatatgtgaagtctttggaccaacctgatttacttgatctgcttgtgcggcctgcatctgaagatgtggacatggaagaggttgaagatcttagaccatccaagaggaaagtcatctactccgagcataagccgatgtcagaaattacttctggtttgcatcgtggaatatatcatcaagggaaacttcgtgttaaccgttataatccatttgaagcatatgttgggagtgagagcatcggtgatgaaataattatttatgggcgctcaaacatgaatcgagcatttgatggggatattgaagcagctgaacttctgcctcaggaccagtggcaaggagtctcatctctatctatagcccatgaagcaacaaagatctggtccggatctagaattctagatgtcatacggtggagtgtggtggtggagcgtggtggtgatgggggatacgcagcgacggtggagtacttgcatgcacttcgacgtccaattaggcagttatggtcacatggtccgtatgacctgtccagggtcacatgttctacgcttgcccccttgttggtgttatgtgcctctcaagttatcggtccagaagacgaggatgaggatgaagatgttcatctagctccaaatagtgctgatgatgcacctagaactattcctcagcagggttcttctgaacaagtaaatgctgtgcccagtcgtccttctggtcgtattgttggcattataaagagaaactggcattcgtaa

SEQ ID NO: 25189 - DNA, 1703 bp, Glycine max
  Peptide Sequence Number=SeqID_141967
atgggtcactccaattcttcctcctcctcgtcaccttccaagcgcggccacgcgctgcggcaatggcggctcctggacttggtctccggcgtgttcttcttcctggtgctgctcttcttcaccatggtctttaccccgctcggtgactcgctcgccgcctccggccgccagacgctgctccgctccggcgccgacccgcagcagcgccaccgcctcgtggcggcgatcgaggcgggtggacgcggcgtggaggcgtgccccgctgcggacgcggaccacatgccgtgcgaggatccgaggctgaacagccagctgagcagggagatgaactactacagggagaggcactgccccaggccggaggactcgcccctatgcttgattccgccgccccatgggtaccgggtgccggtgccgtggccggagagcttgcacaagatatggcacagcaacatgccatacaacaagattgctgacaggaaaggtcaccagggatggatgaaactagaaggtcaacactttatattccctggtggtggtacgatgtttccagatggagcagagcaatatattgaaaaacttggtcaatacattcctataagtgaaggtgttctgaggactgcgcttgacatggggtgtggggttgctagttttggaggatatatgctatctaaaaatattttaaccatgtcttttgctccaagagattcacataaagctcaaatacaatttgccttggaaagaggaataccagcttttgttgctatgcttggcactcgcagactcccatttcctgcgtttggatttgacttagttcattgctctaggtgcttgatcccatttacagcctacaatgcctcttatttcattgaagtggacagattacttcgccctggtggatatttagtcatctccggtccccctgttcagtggcctaaacaagataaagaatggtctgatctccaagcggtggcaagagccttgtgttatgaactgattgctgtagatggtaacactgtgatctggaagaagcctgtgggagaatcatgtcttcccaatgaaaatgaatttggtcttgagttatgtgatgattcagattacccaagtcaagcttggtacttcaaattgaagaaatgtgtcagtaggacatctgttaaaggtgattatgctattgggataattcccaagtggccagagaggctaactgcaatacctccaagatccacactcctgaaaaatggtgttgatgtgtatgaggctgacactaagcggtgggcaaggagggtggcacactataagaattctctaaaaatcaagttgggcactcgatttgtgcgcaatgtcatggacatgaatgcattatttggaggttttgcggcagccttaaaatctgatcctgtgtgggtgatcaatgtagttcctgcactaaagccacccactcttgatgttatctttgacagaggccttattggagtctatcatgactggtgcgaaccattttcaacatatcctcgtagctatgatctaatccatgtggccagcattgaatcccttataaaagatccagcatctggtcaaaacagatgtactcttgttgatttgatggtggaaattgatcgaatgttgcgtcctgagggaactgtggtggtaagggatgcccctgaagtaattgacagagtagctcgcattgccagtgcagtgag

SEQ ID NO: 25190 - DNA, 222 bp, Glycine max
  Peptide Sequence Number=SeqID_141968
atgctaaaggtgtttggatgcccgacatactatcatgtaagtgaaggtatgctagatcccagagctaagaaggaattctttatcgggtatggagatggagttaaaggattccaagtttggtcttcatatgaaagaaaggtcattctgagtagagatgtcgtctttgacgaactctatatgatgcattctaaaagatttgggcaaggccaagaatgtcactaa

SEQ ID NO: 25191 - DNA, 639 bp, Glycine max
  Peptide Sequence Number=SeqID_141969
atggcacaacaatttcaagaacccccgttgttctcccatgttgctaacacttgcatcaatcatgtagtctacataacaatcattttaacaagttttgatccgagcagtgctgccgaagtttgtcgaatgcagtcaccaccaattgaacgcgacattttcaatcatccgtctatatgtcatgatatattaaggcaattgcttgcatactcgtttgtacctataaacttttacattggccaggactgtgacctaattccaaacctttctactaggttatgcgagtcagtattacagcgatccggggttcatataaattattttcaggtgttcattacggtattccagacccactgttgttataatgtagtgggtacaccatttttttttcaagctgatgaacttccatcaagagaaatggtgcaaagaatgacctgtgatggcggtgaacattctttgcctgcgggggcaatggcactcaaaagatttttgattcaagatgaacaggaggatccatgtgccatatgcatcaaggatttcaactctggtgataatgcagcaagaagagtacgtgccctttgtgctgtttcgcttgtagttgtgtctcttgatactgttatgattagcatttatgtactgtga

SEQ ID NO: 25192 - DNA, 513 bp, Glycine max
  Peptide Sequence Number=SeqID_141970
atgacacgacaatttcaagaacccaccttgttctccaatgttgctaatactttcatcaatcatatggtctatataagcatctttgtctcaacttttgatccaagctttggtgtgagactttgtcgaatgcagttaccaattcaacatgacattttcaatcatcagtgtagccactgttgttataatgtagtgggtacaccattcatttttctagctgatggacttccatcaagaggattagtgcaaagaatggcctgtgatggaggtgagcatttgtctttgcctgcgggggcaacgacactcgaaagatttatggttgaagatgaacaggaggatccatgtgccatatgcatcaaggatttcaactctggtgataatgcagcaaggttgccttgctctcatgtcttccaccctgattgtattttgcaatgggagaaacaaaagaatgctgagaaaaagaaaagccagaacatagatcatagagagagtagaaacgagagtaggggcaaataa

SEQ ID NO: 25193 - DNA, 321 bp, Glycine max
  Peptide Sequence Number=SeqID_141971
atgatgagcatgaagaagataatggaagccaatgcggttgcagctgccgctaccagcgttgttgctaaggtgaacccgatatatagtaggcaaagatttgggaagtacgggcggccccttaatgtgcaaattcaaaatgagcacgccttcccgccatatggcttgcctcccaactatacaccacccaatgcggcatacactcccaatgagaatatcaataactccactcctatacccattgagagccaacaaccccgaactatcatgcaaatgtctcttaacccatgggggaggcacatgaaattccccgccacaatctag

SEQ ID NO: 25194 - DNA, 813 bp, Glycine max
  Peptide Sequence Number=SeqID_141972
atgggcggctatgtggtggcggcgagtttctttacgctgggtctggcgagctggcaggtacttatctgcctgttagccggaattgttatcgtccagctttgcgccaatctggtggccaaacccagccagattgccggcgtgccctatgcggtcatctgccgtcaggcgttcggcgtcttcggcgccaatattccagcggtgatacgcgggctgattgctttcgcctggtacgggatccaaacttatctggctgcgaacgccttaatgctggtgctgctgaagttctggccctcgctggcggcaatgacgcaaacgtcattgctgggtctttcatcgcttggctggatctgtttcgccaccatgtggctgttgcaggcgatggtgttctggcacggcatgagcgcgattaagcgctttattgatatcgccggcccggcggtatatgtggtgatgctggccctggcgggctggattgtatacaagacaggcctcgacggtatctcctttaccctcgccagtaagacgctgaccgccagtgagcaaagctggcagatgatcaccgccaccgcgctggtggtctcctacttctccggtccgctgcttaattttggcgatttctcccgttatgccagaagcatgggcgaaattcgccgcggcaaccgctgggggctgccgtttaacttcctgctgttctcggtagtgaccgtagtaatcgtctccgggacgcaatctttatttggccggatgatccccgacccgatcgaaacgatgaaccatgtgggtaacgatctggcggagccatcggcctgctga

SEQ ID NO: 25195 - DNA, 744 bp, Glycine max
  Peptide Sequence Number=SeqID_141973
atggcggtcgccccccatcatctggctagccaaagcgcgctgtccgtgctgcgcgaaggcggaagcgcaatagaagcgatggtcgccgccgccgcgactatcgcggtggtctatccgcatatgaatggtcttggcggcgatggattctggctgatcgtgccgccgcagggcgatccgatcgccattgacgccagcggcgccgctggttcactggcgacgccggaagcttatgccgggctaacgcacatcccgcatcgcggaccgcgatccgccctgaccgtcgccggcaccgtcagcggctgggatgaggcgctgaaagtttcacaatccctgaccggtaaatcactaccgctttcgcgcctgttacaggacgcgattggctatgccgataacggtattccggtgaccgcgtcacaagccagcgccaccgctggaaagttagatgaacttcagcgccagccgggcttcgctgagacctttctggtcaatggccgccctccgcaaagcggcagccgcttttgtcagcctgcgctggcctccacgctaaaacggctggttgcggaagggcttgatagtttctatcgcggctctctggcggaacaactggcggacggcatggcccgttacggcctgcctattacgcttgacgatctgcgccagcatcgcgcgcgtcgcccgcaaccactgcggttacagcatcaacacggtgagttatggaacctggcgccgccgacgcaggggctg

SEQ ID NO: 25196 - DNA, 195 bp, Glycine max
  Peptide Sequence Number=SeqID_141974
gttgactaccaaggatgtcagggaatggctgaggatttaggagcgattgttgaggatttggagcgggtcatcaacctcaggatggtcactgaaggcactgacttatatgacttcatgactcgttgtctgaggagagctagaggtgacgccgcagatggaagtcttaggtcgcgccagagacgccgcatagattag

SEQ ID NO: 25197 - DNA, 107 bp, Glycine max
  Peptide Sequence Number=SeqID_141975
gtcatgggaatttcttggactggaaaaaaatggaagaattcctgcaaactctgcttggaggaaagcaagatttggagaaaatataatcatcgctaatatcgatacag

SEQ ID NO: 25198 - DNA, 321 bp, Glycine max
  Peptide Sequence Number=SeqID_141976
atgcagtcccagatgcaatcacagggattcgcattgcctcctgaggctgaggttggtccttctgctgctcgtgtcagcacaaaggaaagttgtgtcgatccctcgggagtttataaggggttggcgaccttccacaatgttcctttgggcaatgatctagtgaagggagtcaacgacagtcaagaaagtaaatccaaggttgctgctagatggattgtagttaaatgtaataagcaaaaaggaagcactacatgcgggtactacgtagtgcatttgatgtcaacaatagttctaggaggtttcaaggataactcggaaatg

SEQ ID NO: 25199 - DNA, 561 bp, Glycine max
  Peptide Sequence Number=SeqID_141977
atggccttaagggataggaatttgaggaaacatagaactgattcaaaagctaagcagggtagcaatagattccagaagacctcgactcaaccaaccaattttatggaaacccctacaaagccaactgagtcaatggcaatgcttggtgtgaccccaaaccaaccaactaggtcaatgaaaatatttggcgtgacccttacccaaccaactgagtctatggcagcgcctagtgtgacccatatccaaccaattgaccaatctatggaaattccatgcgtgacccatattcaacaaattgagcctatggaaatgcctggtttgatcccaatccaaccaactagttctatgaccatgcctggtgtcacccctacccaacaaactttgactatcgaaatgcctagtgagacacctccttctcttgagtttatgaagcagaggttggagatgatggcatcaaccatggagacttcagggcatacactttcccctcaaatgagagcccaactagattctggaattaaaaatcttctgagaagggtgaatgccaggctaaatgcctga

SEQ ID NO: 25200 - DNA, 564 bp, Glycine max
  Peptide Sequence Number=SeqID_141978
atgtacctaagcaggcgagctcctggcagtcaacagataaaaggaaaacaagaccacaaagcaaggaggcttgtggtggctggccagctgcttgaaaacgaggtcaggaagctaaggaagcctctgatcgtgatggtggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcactgtggagtggatactacccacgcctacaccatatcgtctagtggagcccgttcaagtgatcgaggtaacgtcatccgaggaagaccctgaggaggacctggaggagctacctcctgagcctgctgtggatgcccttgaccttctagagggtgatgaggatccacttcttgaggtggattctcccgaggaagtcatgtcggcatctgaggcagactctacggaggatagcggcccgagggagatggcgatcagcggaggctcttcatcctag

SEQ ID NO: 25201 - DNA, 411 bp, Glycine max
  Peptide Sequence Number=SeqID_141979
atgcgcttagcggataagaggaatctagaagggaatctgtcatgcaggcacgcgctcagcgcgtcatcagctcactcagcgagtcgtttgtcatcttccaggcttagcgtgagtttggcgctgagcgattattcatttactcgcgttaaacagaatgtaagacgtctagagagagcactgaatagccgtaagagcttgaagagtgaaatacacagaggcaaagaacagagcaaagaagccaatttttactcttttaggaagatttgtgagtttttgagtgattgtgaggttcctagaggtggaggagacatccccactcctttgggctttagcattgaaagatgtattgtctccttagagcttgatagagcaggattaggttactgtatgtttggacacggagtatggtaa

SEQ ID NO: 25202 - DNA, 714 bp, Glycine max
  Peptide Sequence Number=SeqID_141980
atggtacacgccgtcaaggaggagccggatcgggcattcccgcaggcccagtcggcacatgacaatttttgggacttcatcagcctgacaccagaatccatgcacatgatcatgtggatcatgtcggaccgcgccataccgcgctcgttccgtttcatggaaggatttggcgtccatactttccgcttcgtgaatgacagggatcagtcgacctttgtcaaattcatctggaagccgaaacttggcctccaatccatcgtatggaacgaagcggtcaagatcaatggcgccgaccccgatttccatcggcgcgatctctggaatgccatccaggcgggtgactttccggaatgggaactgtgcgtgcaactctttgatcaggattttgccgacagcttcgacttcgatgtgctggacccgaccaagctgatcccggaagaaatcataaagcccatgccggttgggcggctggtcctcaaccgcatgccggacaatttcttcgccgagactgaacaggtcgcgttcatgacgcagaacgttccccccggcatcgacttctcgaatgatccgctgcttcaggggcgcaatttctcctatctcgacacgcaattgaaacggctgggtagtcccaatttcacccacatccccatcaatgcacccaagtgtccatttcaccattttcagcaggacggacatatggcgatgcgcaaccct

SEQ ID NO: 25203 - DNA, 432 bp, Glycine max
  Peptide Sequence Number=SeqID_141981
gtacacactttctaccctccttctctattcattatgtctcattccaaaaagggttctatgcactccgtcaggggtaggatgttgttgccggaggaatctagtattccccttggtggcaccactgtagttggtggcattgctcatctagtcatcgacattgtcgcccctgctagtgagggagagcctcacccaaacccgtgggctcactcccttcctagggaggaagagaccgagtcctctctacccattcctcctcataatgttattgacctagactcagaggctaatgttgttcaagtcttggaagtcgggtcctatgaatgtagtttccttacttatgagtctattactgacttcctcgagtctgtcgagttctatcacatcgaaggattggatgtgatggtcatcacgtcttgtcttgctaatttctag

SEQ ID NO: 25204 - DNA, 240 bp, Glycine max
  Peptide Sequence Number=SeqID_141982
atgccagctgagccacgatctctagtggtgaatccacctccttctcctgagcttgaagtagttcccccatctccacctcttattatcatctccgatgcatcatcagatgaaactattgcccctcctgattcaccagctggggaaacagctgatccccctaattcctcagttggaggaattgcctatctttctgattcatcatctggagaagttgttgctctcactgattccccagtttag

SEQ ID NO: 25205 - DNA, 360 bp, Glycine max
  Peptide Sequence Number=SeqID_141983
atgtcgatctccccctgcgaaggtatcggttggtctgtgtcatcccaacatagggcatggggtttccagctcaggttacgggcctctgttagtcctacagggtgcccgtcccccccagcaaggtcataccatcgtgacataggtaaggatcatgcccgcaagacacccagtggacccgaagaagtccaacagggtcttggagttgccagctctgattacgggcctctgtcagttctacgaagtgcctgtcgcctccagcaaggtcatcatgcccctactaatcgagctttcatcaagaagtactgcgcccccaggcaggcgcagggcgaaacaccacagcagcattgggatggccggtag

SEQ ID NO: 25206 - DNA, 462 bp, Glycine max
  Peptide Sequence Number=SeqID_141984
atggagggagggagaggagttgtgaatggaaacccttcaaacgcagatgttcggtacagaggaattcgtaggaggccatggggcaagtttgcagcagagattcgtgaccccacgagaaaaggggctcgcatatggcttggaacctttgacactgctgaacaagctgcacgtgcttatgatgctgctgcttttcattttaggggtcacaaggccatactcaacttcccaaatgagtatggtaatgtcactcctaatccaaataacaattattcttcaacttctttgcctcttcctttgttgtcgtcttcctcttcttcttcttcttctttcccttcctactatggcgagggttcgtcgcaacaacaacaaggaaatgatgatgacacttttgaattggaatgcttggacaataagttgttggaagaactccttcagcaggcgcctgatcgttcaggcaactga

SEQ ID NO: 25207 - DNA, 204 bp, Glycine max
  Peptide Sequence Number=SeqID_141985
atggccatgatgccatttactttgatgctcgtggaggtcaaccttcgtgccactattgcagagagtgaaatgaacctttcgaattgtagaaaaggaatgattaacatttccattatgggtgatgccaattcaattacaaaaatgaaattgaaatggcctcattctgtgatccacacttcctcgtatctttctttcggcgattga

SEQ ID NO: 25208 - DNA, 837 bp, Glycine max
  Peptide Sequence Number=SeqID_141986
atgaatgctaaaattgaggctttagaggctaatcatacttggattttgactgacctcacttctaacaaatttgctattggatgcaaatgggtttataaacttaaacacaaggctgatgggtcagtaaaaagatataaggtcaggttaagactaccttggtattgtgctttagctgctattaacaactggcatttaaagcaattagatgtgaataatgccttttttcatggagaccttcatgaggaggtttacatgactttgcctcctggtatgcactcaaccaaatctaatcaagtttgcagattacaaagatctttgtatggccttaaacaagccgatatacaatggctcattggtcgtcttatttacctcactaatacaggacttgatattacatatgcaattcaacatgtaagtcagtttgtagcgtatcattcttcagctcatcaacaagcaacttataagattcttagatacttgaaagcaacaccaggttctggtttatttttctctgcttccagcatattccagctcaaagcatttagtgactctgactggtcaggatgtattgacaccaggcgatctatcattggctactcagtttatcttggcagttcctttatttcttggaaatccaaaaagcaggacacggtctctagaagttcttcttcagaggctgagtattgtgcactagttagtgctacatgtgaattacaatggttaacctacttgcttgatgattttgggattgtttacacttggctagttcttttgttttgtgacaattgcgtcgcacttcacatttctactaaacgaatacacaaaagatattactga

SEQ ID NO: 25209 - DNA, 2991 bp, Glycine max
  Peptide Sequence Number=SeqID_141987
atggcttcaatcacattgtcgaagtcggttctctctcgagtcattggttcgattcactcgtatcaaatcaagaacattgttgacgaactcgtaggcatcgacaatccggtacctcatgaagaacacatcgatgccattcttaaaggcctaccacaggattatgcaccaatgatctttattattgaaagcaagttcgagactcctcctgttgctgaagttgaggctctccttgcacatgaatctcaatccaacagatttcataaacaatcattttctccctctatcaattacactcaagggtatgtgctccctaacttaaatgatactagcactcgcaataattctagtggtggatatggtcgcggcggtggaggtcgtggcaacaatggtggtcgtcgtggcggcgctactccgagtgccatgctttccaatgtctcttctactggtgttgcccattctgcatggatccctgacttaggcgcatcatttcatgtcatcggtgagcctcataacatccatcagctaggtcactttgagggtctggaccaaattttcattggaaacggtcaaggtttgcatattaatggttctggttcttcttcctttttgtctcctattaactcacatgggactcatgaaactttgcttcaaggtgttgttggtgttgatggtctgtattcctttcccaacctaaatcttcaagagtcatttgtgttgctgtcctctgcagctaaatcaccttcaagttctgttgatttgtcatctagttctagggttgtttttaattctagtgatcaaagtcctactcaggctacctctttctctcaatattttacacttaatcctgacttgtctccaccttgtcataactcccctttgacctctccaacccctacacatcaactttctatttcctctcccatctctgttgatgtctcctcacaacaacctaatttgtcctcaaataacaatctccataataatgaagccagtcctacatttgtgtcacaacctgaatctgattcctcatcccctcgtgaatcccttgaacatggtgaacctgtttctagaactaccaatgctcatcctatgcaaaccaggtccaaatcaaggatatatactcctcaaattcatcattcattatttttggctcatagtgaaccaaaaggtgttaaacaggctctcactgattcaaattggctttctgctatgaaacttgaatatgctgccttactaaagaatcacacctgggatttagttcccttgccctccaatagaaaggcagtagggtgtaaatgggtttttcgaataaaagaaaatgcgaatgggtccatcaacaagtacaaaactcgattagtggccaaaggctttcaccaagtccatgagttatttcagttggatgtgaataatgctttcctcaatggccttttagatgaaatagtttacatggtgcaacctctaggatttgaagttgaagacaaatcccttgtttgcaagcttaagaaggccctttatgggctgaaacaagcaccaaggcaatggtttgaccgactaaaagttactttgattcagtttgagtttcaagctagcaagtgtgatccatccttgttcatatataagcgacaagctcacactatttttcttctagtatatgtggatgatattatcctcactagcaactcatcttctctcatccagcagattacaactcaacttcattctgcattctctctcaaacagctaggtcaattggaatatttcttgggtattgagatcaagtatctacctgataggtctcttctcatgactcaaagcaagtacattagagacctccttcacaagactcacatggctgaagctcattttatttcttctcctatggcctcttcttgcaaactgtctaaaactggtgtttgccaattcatggaaaatcccttagacactcattggggggcagttaagagaatcctaaggtatcttaagggcaccctttcccatggttttctcatgaaacctgctgctgttgggaaacctttatcaattacagccatgtgcgatgctgattgggcttcagatgttgatgacaaaaggtcaacctctggctctgctattttcttaggtcctaatttgatctcttggtggtcaagaaaacaacaagttacattcagatccagtactgaggctgaatatcgcagtatagctcaaacctcagctaagttaacttgggttcaggctctgttacaggaactccaggttcccttctctactcctatactgctctgtgacaatcatagtgcggtagctattgcacacaatcctatttttcacagtaaaactaagcatatggagattgatgtcttctttgtcagagagaaggactacttaactattcaagaatggcacaacttgacccttctgagtaagctacctcagaggctgccggttaagccccttgttttgcttttcaagtccttaactgtttttagggacttgagagctatactcataatatttgatatggaagcttttgatttcgtcaatgtgtgccgagaggtcggcgtcaatgtcaagaatgcctcagtgacctggcctactgatcctcttcctccaccatgcctttcttctaaggatgttgttccttctgcaaacaagaataagaagaagaggggtcgtaaagagagcgaggaggagaaattttttaattcggcttatcatccacaagccttgatgccgagtggtgtagtgtcggattttggcaaagacatgctgcaaggtgccaacgcatcatctgcgcggttgaagaaagagctggaaggcatgaccaaggaaagggatcaagcccttcatgctaatatagacttggctgctgacaactctaacttgaaggctgactcgaagaagttcgaggaccgagaggcttcgtggggccggaaaattaagagggaaaaagatgttgatgctgccgtgagggaaaaatatgtgcaaatctag

SEQ ID NO: 25210 - DNA, 1116 bp, Glycine max
  Peptide Sequence Number=SeqID_141988
atggcttccaggaaattcgacaaccctcactccggcgacggcgccagtccagggttcgctctcttctccctttgttcactttcttccttctctctctcgcgtttcgcttctcactttccccttttccatgcagcaaaatcttcatcggaggagacgttcgtgaagtactttgagaagtacggggagataacggactccgttataatgaaagaccgtcacacgggtcggccaaggggattcggcttcatcacctacgccgatccctccgtcgttgaccaagtcattcaggagaaccacgtcgtcaacggcaagcaggtcgagattaagaggaccattcccaagggctcttcgcaggctaatgacttcaaaaccaagaagattttcgtcggcggcattccaacttctgtgtctgaagatgagctcaagaacttcttctccaagtatgggaaagtggtggagcatgagataatacgggaccacaccacgaagcgatcccggggttttggctttatagtttttgacagtgaaaaggttgtggataatattttggcagatgggaacatgattgatatgggtggtactcaggttgagatcaagaaggctgaaccaaagaaatcctcaaacccagcttctcttcctccatttgctagtgactctagggcacgttcttacaatgatggttttggtggttttggcgattcttatggaagttttggtggtagcgggtatggtcctggttcttataggtcacttggaggttttgggggtaggcttggtgattatggtgggtatggggctggagatgaatttggtggtagttttgggggttatggtggtgctggtgctggtggctatgctggttttcgaggagaatcatcgtttggctactctagtcgctatggatcgtacatgggtggccttggtgctggttatggtggcagcgggttaggcgcatatggacggggtggtggggcttatggaacctatggtggtccaagcgctggtgggggttatgaatcaggtcccggtgctggttatggaggagcaggaggtggaatgtatcccagtaggggaagctatggtggcagtagtcgttaccatccttatgcaagatag

SEQ ID NO: 25211 - DNA, 444 bp, Glycine max
  Peptide Sequence Number=SeqID_141989
atggcagcaatgtccgattcggttcgttccctcgcacttctctcccttgcagtgatgtgtagcgtcgcgaattcgatgcggttcgaccttcaatcgggtcaaaccaagtgcatttcagaggacattaagactaacgcgatgagcgtgggaaagtacagtgtcgttaatccccaagaaggttacccacttcccgattcccacaggatcattgtcaaggtgacgtcgcctcatgcgcacacatatcactttggagatcatgtggattctggtaattatgcatttacggcatctgaggctggtgactactcagcttgcttttgggtacaggataccagggatgccccgtcggtggtaactattgaatttgagtggagaactggggttgctgccaaagattggtcaaaggttgccaagaaagggcagattgaaccttcccaagcctga

SEQ ID NO: 25212 - DNA, 702 bp, Glycine max
  Peptide Sequence Number=SeqID_141990
atggatccctgcccatcgattaacaaagttttctcttatagggcacaacaagaaagccaattcgcaagttctaatgcatttcacaatctgagtttggttaatgctactgctaatacacggtcatctaattcttgcagttactgtggtagagataatcacacaacagaaacatgttataggaaaaatgattttccacctaatttcttctccaatagaggttttggtagaggagggctaggaggcaaaagcaacaatggtaaagtttacacccactgtggtatcactaatcatatagtggatgagtgctataagaagcacggttatccacctagtcacgaattgtataaacctgaaggagctttagttaataacactgttatggaagaagaaaatgttttgagttcagagactagtaatggtggtcaagatattaaaatcactcagcaatacaataatagctctcatggatcacaggttaaccagattggtacaagttctacttatacatcaagcatagatatttggggcccttgtgccacaactgttttgaatggacacaagtattttcttaccattatggatgatcacactagatttgtttggatttttataatgacttctaaagctgagactcaaactcatttacaagcctttgtttccaatgttgagaggcaatttaacacaaaagtgaaagctatttga

SEQ ID NO: 25213 - DNA, 1788 bp, Glycine max
  Peptide Sequence Number=SeqID_141991
atggagttcagtttcgggctgcctgcccagaaagaaggaaatgtgactgacgtgaagaagccagagaggaagaatgaagaaattccaaaggtttctccctactttcgaaatcactatgggaacaatggaggcaatggtgaagagaatcaaggaaaagttgcaaccagaaagatcgttttagcactgcctgcctactgtccccagaaattaccaactgtggttgacttaaaggagccgatgaggacgaataaagaagcttataacaacattaagattggacatgatttgcaaagtagtggcaatgaaattggaactggaaacactacaaccaataatgggaagagaacatctataaagcatgaggaagttcaaaaggtttccccatacttttggaatgactatgggaagaagggagacaatgggaaagaaaatggtgatgaaattgcaattgaaacggtcaaatctaaaaggaagagaaggttgaagaaccggttgaagaagtatgagcttcatggtgacaacgagaagaagaatggttctgaatcatgctgttatggcagtgataggaatggagatgaaactgcaattggaaagatcaaaccgaaacaaaagagaaggctgaagagtcatgaggctcaaggtgacaatgagaagaaggttgatactgaattgtgttatggcagtcaagagaacggagatgaaattcctattgaaaagatcaaatccaaaaggaagaaaaggtccaagaagtgtaagcctcaaggtgaaaacaaggagaatattgatcctgagcttagttgttatggctgtgacattggatttgttgaagacaagctgctgacagatggaaagattaaatcgaaggaaaagaagaagaaatcgcttgaggataagctgtgggagaatatagctgcagatgagggtgatgatgctgaaatcagtaaatacatactcaagaagcgtgagcctcaaggtgacgaggagaagattgatcctgaatttttttgttatggctgtaacattggatttggtaaagataagctgcttgcaggtggaaagattaaatcaaaggaaaagaagaaaaaaacagtcgaggttgaggatgaactgcaggagaatatagttcataatggtacagcgaagaagacaaaagtcaaaccattggatatagaaagcatgtctgaaccaattgctttacctacctatggagacttgaagagggataaactggaggaagatgggagcgaggtacagattaatcatcgaccgggacatgcaagttatgctgtttctgttgttttaacttctgcttctggagactgctttgaggataagctgaaagaaaatggaaatggacttgaatccattagcattgaattcaagaagagtaaatttaattgccagaaaactgttgaggagagtgtcaaggttagaaaggtttctccttactttcagagtgacaatgtgaagaacaaagtctttgcagataagctgctaaataagagaaatgatgctgaaaccagtaatgttaaacccatgaagatggaatctgtggttcagaaaagactggaggtaaatattagtggggagaagagtgaacaacagggtcaagatagtcatattgattctgttgtggttacagttgcttctggagacttggaggaagtgcaggaaattggaagtggaattgaaaccattaaagttgaactcatgaagaaaagaaaatcgaataatccaaaaactgccgaggagggtgacaagattcgaaaggtttttccttacatgtga

SEQ ID NO: 25214 - DNA, 543 bp, Glycine max
  Peptide Sequence Number=SeqID_141992
atgaagaagattcaaggcctacaagctccacatggagctacatcaccaaggatttttgggctttgtgaagcattatgggccttctacaaaaatgggagttttggttcatttgtcactttgctttggattattattcttgctccttgtcgagtactctcgttcagggtcgacaactctgtgactctaaagggtcaggtagacagtgaggtgggttcttattattctcgatacaatgataaggccagccttcttcacctcattaatcatgtcagtgtgcgcacgttgatggacaaggacaatagccctatccatctttgctgttgtcgtacagatgcttacgagaagttggattgggtgttcttagagaaagagtcgattgttgacatgcctcctacaagggactttttttacgtctatgattgcattttccacaatcttaatgtggaactcccttttgatgatttcactatgagcatccttcgtatattgaacatggctcatttgcaattgcatccgaatgggtgggcgacaatgcaagtgtag

SEQ ID NO: 25215 - DNA, 153 bp, Glycine max
  Peptide Sequence Number=SeqID_141993
atgcctgtggaacatgagaaccgcacgggatggcatgaaccatgcatagaatggaacatgggagaaggagagtatggatgtgggagaagaagaggattccagggtgagatagatgatacgcataaacatagacacggttgtgcttgtatgtaa

SEQ ID NO: 25216 - DNA, 4026 bp, Glycine max
  Peptide Sequence Number=SeqID_141994
atggagtacattttagcgttgcctgcgcagaaagaaggaagtttggttgatgtaaagaagccaaagatgaagaatgaagaagcttccaacaacaaaaagaggttgatggaacatgatttgccaaagagtggcaatgaaatgggagctgcaaacaccaaaaccaataacgggaagagaacgtctaaaaagcatgagaaagagaaagttccaaagatttatccgtactttcggcacaactatgagaagaagggagacaattgggaagaaaataaagatgaaattgcaactgaaaagatcaaatccaaaaggaagagaaggcccaagaagcatgagcctgaaggtgactgtgaggagaaaattgatcccgaatcatgttgttatggctctgacattggacttgttgaagatatgctgctcgcagatggaaagattaaatccaaggaaaggaggaagaagaagaagaagaagaaagcagttcaggataagctgtgggagaatggtgatgatgctgaaaccaaaaaattcaaactcaagaagcgtgaacctcaaggtgacaacagagagaaggctgatcctgagttgtgttgttatggctctaacattggatttgttgaagatatgctgctggcagatggaaagattaaatctaagcaaaagaagaagaaaaaagcagttcaagataagctgtgggagaatggtgatgatactgaaaccagtaaattcatactcaagaagcgtgagtctcaaggtgacaacagggagaagatcgatcctgagtcatgttgttatgactgtgacattgaatttgttgaagataagctgccggcggatggaaagattaaatctaaggaaaagaagaataagaaagtggttgaggataacctgtgggagaatggtgatgacactgaaatcgataaattcatactcacgaagtgtgagcctcaaggtggcaacgaggagaagattcatcctgaatcctgttgtggctgtgacattggatttgccgaagataaactgctggcagatggaaagattaaacccaaggaaaagaagaagaaaaagaagaaagttcagaataagctgtgggagaatggtgatgacactgaaatcagtaaattcatactcaagaagcgtgagtctcaaggtgacaacgtggagaagattgatcctgagtcatgttgttatggctgtcacattgaatttgttgaagataagctgccggcggatggaaagattaaatccaaggaaaagaagaagaagaaagcggttgaggacgagctttgggaaaatggtgatgatgctgaacccagtcaattaaaactcaagaaaacgggacctgaagttcataaacataaagttcaggttggtgttagatatgtttcaccttattttcataatgataatgcaaagaagataaattttgaatcatttgataaggtgaaagaaaatggaaatggatccaaatccatcagcattatatccaagaagagaaaatctaatagccagaaaactgttgaggagagtgccaaagttagaaaggtttctccttactttcagattgacaatgtgaagaagaccgtcgaagtagatgcacttgatcatgaaaatgaatttgattctgctgctttaatgggtacttgtggatacatggtgcaagacagggaggaagagaatggagataacattgcaattgaaaagattaagtccaagtgcaagggaagatacaagaagcttgagcctgttgagcatgatccagttcataagtttttgccattctttcaatgtgacaatgagaagaaggttgatgctgattcacattttgagattggatccattgcttcacaaggtattggtagtagcttccttagagataagctgctggaggatgaaaatgaaatgaaaaatggaacaattaaattcaagaagaagaaaaagaagaacaaagccttcacaaataagctgcaagaaaatggaaatgatgctgaaacttgtaatgttaaacccaggaagatggaatctgtggttcagaaaaatatagcccaggttggtgttagatatgtttccccttattttcataatgatagtgaggagaagattaaaggcaaaccattggatatggaaagcaaatctggatccattgctttacccacctttggaaattccattgagaataaactggacggaaataatagtggggagaagattaaacaacacggacttgatagtcatattgattctgttgtggttagatctgcttctggagactttgaggaactgtatgggaatggaaatgaaattgaaataattaaagttaaatccaagaagaggcgaaaatccaatagtaaaaaaacttacaaggagcatgacaaggttcggaaggtttctccttactttcagaatgacaaggagaaaacagttaatgtagaagcgcttgatcgtgaaaatgtttttgattcagtttctttagtgggtaagtatggtgataaggttgcatttgaaaaatttaaattccaaggcaagaaaacatctgcaaagaacaagatattggagcatgctcaaattcaaaaggtttctcctttctttcaaagtaacaaagggaagaaagttgatgatggatcatgttgttatgacagtgagattggattcagtgctttacctggtaccggtggtggcttccttgaagataagctgccagaggatggaaatgcaattgagaaggcaatgactaaattgaaaaagaagaaagtcattgcaaataagctgcaagagaatggaaatgatgctgaaacttttaatgttaaacccaagatgacaaaatctgtggttcaggaaaatatagtccaggttggtgttagatatgtctccccttattttcacaatgacagtgggaagaagtttaatgttcaaccatcgaataaggaaagcaagtctgaatccatggttttacctacctttggaaatttcgtggaggataaactggtggaaaataatggagggaaaaatgttaaacaacagtcaattgaaactcatgctgattctgttgtgttaacagctgcttctggaaacttctctgaggatggactgcaaaaaattagaaatgaaattgcaaccattaaagttaaatcaaagaagagaaaatctaatagcaggaaaacagctgaggagcttgccaaggttcggaaggtttctccttactttcagaacgacaatgagaagacagttaatgtaaaagaacatgaccatgaaagtgaccttgattctgttgctttaatgggtacttgtacttttggaggtaaaattccaattgaaaagtttagatatgaaggcaagagaacatctaaaaaggatgagacagctgggcatactcaaattcaaaaagtttctcctttctttgaaactgacaatgtgaagaagattggtgctgaatcaagttgtactgctggtaggctccttgaacataagctgcaagaggatggaaatgtaactgaaaatggaatgattaatgtcaagaggaaagtcatttcaaataaactgcaagagaatggaaataatgccacaactagtaaagttaaacccaagaagaaaaaacctctagttcagaaaaatggccatggtattagatatgtttccccgtatttttgtaataatagtggtaagaaggttaatgtcaaaccttttgataagggaagcacgtctgaatccattgctttgcatacctgcaaaaacttcgtagaggataaactggaggaaaataaatctaattgcagtaacaaatctattgaaattaaaagattccctcctgcttctgagaagtgggatgaggcttacaaaagaaaaacacctgataatacatggaagcctccacggtctgagattgttctcattcaagaggatcatcttcatgacccttggagggtgttggttatttgtatgcttctcaatcggactgctggtggccagggtgtgattgtggaaggggtttttggggggtgccaacctagttggggttccctgccctctcactaa

SEQ ID NO: 25217 - DNA, 369 bp, Glycine max
  Peptide Sequence Number=SeqID_141995
atgatgccgactttttttagggttttatggtgggttgtggtgataaatgttgttgaggatgacgtcactagtgaggcacttctgctagttgagagggacgtcaagtttgtcaaagtagcggagaagctcaggggggaggcgacgcagttgaaaggtgagattgcattgaagaagaggctggtgttgaaagcggtgagggtggtggcggggtttgaagggtttgaggggtgtgaggtgaggaatgtgaagaagaaaatgatgatgagagtcgaggagaagagaaggaacagtggagagagaagtctcgtgggcttatttcttttccagacatttgccatagaaaaggactgtgttcgttatggaagctga

SEQ ID NO: 25218 - DNA, 1125 bp, Glycine max
  Peptide Sequence Number=SeqID_141996
atgtcgtttttctcaaggggccgtcgcgacgacgacacggtggacgactacgacgagtacgaccccaccccttacggcggcggctacgacatcgccctcacctacggccgccccatcccaccctccgatgagacctgctaccctctaggagcctcttcttctgatgacaacttcgattatgatcgccctcaatacacctctaacgctgaaccctctgcttatggtgatgaagccctagctactgagtatagcagctactctcgccctaagcccaggcctgctcctgcaggcttcaaccccgccgcagggtccgggtacggagggtccggatccgggtatgggaggaagcaggagtcggaatatggatccgggtatggtggaaggaaggaagaaggtgaatacgggtcaggatatggtggaagaaaggaggagccggaatatggatctgggtatggtagaaggaaggaagaaggtgaatacgggtcaggatatggtggaagaaaggaggaaccggaatatggatccgggtatggtaggaaagaagagggtgaatacgggtcaggatatgggtccgggtatggtgggagaaaggaggagtctgaatatggatctgggtatggtggaagaaaggaagaacctgaatatggatctgggtatggtgggagaaaggaggaatctgaatatggatccgggtatggtgggagaaagcaagaatctgaatatggatccgggtatggtggcaggaaggaggaaccagaatatggatccggatatggtggaaggaaggaggaatctgaatatggatcaggatatggaggaaggaagcaagaatcagaatatggatccgggtatggtggaagaaaggaggagagtgaatatggatccgggtatggagggaggagtgagtatgaggagaaacctagctatgggaggagcaactatgagagccaaggaggaggaggaagggttgagtatggttatgaggggcgtccaccccggcaggaggaggaggaggggttccgcaagccctcctatgagaggaaggctgatgatgatgatgatgagggctatggtcgtaagaaatatgtgagtactagtactactctttccattccttactcatga

SEQ ID NO: 25219 - DNA, 711 bp, Glycine max
  Peptide Sequence Number=SeqID_141997
atggatgctagggtgatagggactggaacctttggttgtggcaccatcattgtggaagggggggactttattgctgagaatattaccttcgagaattcttcccctcagggtgcagggcaagcagtagcagttagagtaacagtagatcgttgtgctttctataattgcaggttccttggatggcaggacacactatatttacattatggaatacaatatttgaaagattgttatattgaaggaagtgtggacttcatatttggcaatagtactgcactcttggaacattgtcacatccattgcaagtccgcagggttcataactgctcaaagcagaaactctccacaggaaaaaactggttatgtattcctcagatgtgttgtcacaggtaatgggggaacttcatatgcatatcttggaagaccatggagacctttcgcaagagtggtctttgcattcacttacatggatcaatgtataaagcctgctggctggaataattgggggaaaattgagaatgaaaaaactgcttgcttctatgaatacaggtgttttggacctggttggtgtccatcccaacgagtaaaatgggctagagaattacaagctgaagcagcagagcagtttctcatgcatagcttcattgacccagaatcagagagaccttggcttgctcaaagaatggctctgaagattccatattctgcttaa

SEQ ID NO: 25220 - DNA, 303 bp, Glycine max
  Peptide Sequence Number=SeqID_141998
atggttgtacatgtacatgtagggtggttggattgcccttcatatggccaggaaattttttgcatgataccttctaaggttacacttggtgaatcgttcaatgactgcattcctcctggtaaaagatactcatttaaacaagtgatacatcaacaaagagttttagggagaaaacttgacacagttaagctccgtcgcaatgtaataagaagcattaaaattgcatgtatatttcattttgaagaatttctcaaaagagacaaggtcacttacatgtgctatactggtcatcttaaagtttaa

SEQ ID NO: 25221 - DNA, 561 bp, Glycine max
  Peptide Sequence Number=SeqID_141999
atgatgacaacaaaagatgatgacaaaggtgatgaacaaaaagctcaaaagatcaaagaacaactcaataaatggtacatctacttgggtttgactgagaacaagagagggtacatctcttgtgaatcagttctagtggagggtacatccactaggttcaaagagaacaagggagggtacatcccttgtggatcttttcttgtaaaaggtgatcatatttcttggatgatgtggaatttgtggaaaggtcaccatgtttattctgagtggcctattttctttgttgtgattgtagaccagatttggaggagacacaataattacatcttcaatggtgttgtgaggttctcggaggatgggaacctttatagtgaccatgtactcacttctcttgttctatcatgggcgcctcttgagatggattggttcaaagtgaacatcaatagggttatacgacgagcacgaatggaggctgcttgtggtggtgttgttggagatcaccatggaaagttcttgataggttttcaaactggtcttggaatgaaattttttctgtattga

SEQ ID NO: 25222 - DNA, 441 bp, Glycine max
  Peptide Sequence Number=SeqID_142000
atggtacgacctgatgatgtatgctcacaggttggcttatgtttcaaaaggactaaatcagagagcaatggaattgagatggtgaccgaaaaggaacagagagagttgtcaactgaagatactgctttgtgcacttcctgtcagatgctcgtggtttggattcagaatcaactaaaacaaaagaagaccaaggagatagtattcaactatgtaaatcagctgtgcgagagcttgccgagtccaaatggagagtcagtagtagactgtaatagcatttatggattgccaaacatcacgtttactgttggagacaaacctttcacccacactcctgagcagtatattctgaaaactggagaaggcattgcagaagtttgccttagtgggtttattgcttttgacattcctttcatttttctcatagtacagaacagcgcatga

SEQ ID NO: 25223 - DNA, 228 bp, Glycine max
  Peptide Sequence Number=SeqID_142001
attatggttagaatcagacatttggattggactttatgtaggattataggaagagccttagggagagaagcaaattgcgattcggatgaagcttccagcggtgaaggcccacaacatctgcacgtaggcaacaagaagctgcacttgttgctgaggatgttcaacatgtggatcatgcaactgacgaggtccatgaacaacctgaagaagcagctgttgatgatgtag

SEQ ID NO: 25224 - DNA, 459 bp, Glycine max
  Peptide Sequence Number=SeqID_142002
atgttatgcatagaagatattgatgatagatggattcaattttctgaatatcttgcaccggtgggtcagatatgtgttgtgcttagacaatgtgcaacaaactacatagagtggttctacatgatttctcatcccttcatgagtttggcacaacctacggatccacctagacatccatttatggtgcacgatgacacatttattgaaccagatattcctcagcacccagtggcggaggcttgccaagcaataactgaaaggttgcaacaaatgctcaacctaaggataatgacagaaggtacaaaagcatacactatcacgaaagactgcctaaggatcgccaaaggtgtgattgcaaaatgcaatgccactgctttgcttgagaatcacagtgtgcacaccataacaaagctgttgacggtaaaggacaacgatctcttagaaatacttgttacataa

SEQ ID NO: 25225 - DNA, 210 bp, Glycine max
  Peptide Sequence Number=SeqID_142003
atgccacatggcattgtactatctcagctcttgcaacaaaacttcatccaaatgaaaagccttaaagctatggaagacgcttgtgatatgcagatgaagcaacgatgccacatcatcgaagtgactaagccttcattctctggagcaggcctgccaaatttctcaatcttccttccatgggaggataacttcaactcaggatgttcctaa

SEQ ID NO: 25226 - DNA, 393 bp, Glycine max
  Peptide Sequence Number=SeqID_142004
atgaggaatgagatgtatagggagagaagaagtcataaaagatatggaggtaggcaaagagaggaaacgattgagggagtgaaggtaaagatccctactgctaaagtggcttatgatccagaagtgtatcttgagtgggagatgaaagtcaagcaaggatatgccttagtatggtggaatcaagtgaggaatgatgttaagaggatgaaaatgcctttaattaatacttggctagacatggagagagttttgagagagagatttatgttgtcctactatgggagagaccttcataacaagtttcaaagaccaattcaagaaaataggagtggggatgagtattacaaagagatggagatttccttgatcaaggctcaaattgaggagtcttaa

SEQ ID NO: 25227 - DNA, 1335 bp, Glycine max
  Peptide Sequence Number=SeqID_142005
atgggaagacactcttgttgctacaaacagaagttacggaaaggcctttggtctccagaggaagacgagaagctgctgaattacatcaccaaacatggtcatggatgttggagctcggttcccaaactagctgttgtgcactatgaagtacaattcacaaccttaattgtaaacatgccaggtttgcagagatgtggcaagagctgcaggttgaggtggataaattacctgaggcctgatttgaagagaggagcattctcacaacaggaagaaaacatgattgttgaacttcatgcagttcttggaaacaggtggtctcagattgcagcacagttaccaggaagaacagacaatgagattaagaacctatggaactcttgcctgaagaagaagctgaggcaaagaggcattgacccaaacacccacaagccactctctgaggttgagaacgaaaaggacatgatgccaccctcaaccgacaaaagcactcagaaagcgtctgtgggatccaatgaagtgagtctggttgatcatcaccagcaacaaccaaaaatcatgcctaattcatcatcagagagataccctcttgaagtttccacaactagttccacccaggaactgttcctagataggtttggtacccccaccacctgccaccaccaccacaacaacaacaacacttctgatgttgtaggatcatacttctccttccagcacttgaactatggaacaacaacaaacatgtccctctctgcaaaccccaacgcctctctttgttttgttccagcctccacttcttcagaccttaataacaattccaccataacctcctccatgctcccttcaattttcccaacacaacacgtgaagctccaatctaataacaacaacccttccatttcatctgatggggttcaaaactgggaaacaagtaacttaaataacagcaacagcacaaacaaaaacaatgggagtatgcagttacaaagctgcacaaacttcattgacaacacgtggggggtgggagagtctatgaaggttgttaacatcaacaaagatgctgatcaaatgcctctacaagcagaacaagaagatctgaaatggtctgagtatcttaataccccgtttattctgggaaacaacacagcgcagaatcatcaaattcatacctctcaatctatctatagtgaggttaaaccagaaacaggtttcataacagacgagtcatgtgctacatggcaccattatcagaatcagacaccagcttttcaactttccgatatatatagcaaggatctgcagagattttcagtgactttcggacaaaccctgtaa

SEQ ID NO: 25228 - DNA, 512 bp, Glycine max
  Peptide Sequence Number=SeqID_142006
acgaggataaggagaataaacaaagatgggttgtcgatgagaccatatctgagttagtggtggctcgtggtggtttgacaagggtcaaccgacgattcaactactatcgcaaaccaacaagcatccgaacaagttattttggtgatgtgttgagtggaactaatggtggtgttggaagtaatgtgggcaatgtggattgtgggagtaatgtggatgtgaatcatttgttgtcacaaatggaggagttgaagcttaaagttgcaacaaatgaagaaagaatttgtttgtatgaggaacaaatcatggagttcaagaagatgctagctaaagaagaacatcaatctcaagaaaattctaaagttgttgttgaactaaggaaaaaaattgcaaagcaatatactgatattcacattgaacgaaagatgatcaaggtttttaggatgcattgtagtgttcctttggggtttattgagtgctattatcattgcatttacaatgaaatagtgttctag

SEQ ID NO: 25229 - DNA, 534 bp, Glycine max
  Peptide Sequence Number=SeqID_142007
atggataaccattcatggtgttatccagcttgtgttcaatgtcataggaaaactgacatccaaacaggaccattcacatgcggatgtggcaaggataatgatcagcctgttctgaggtatagagttgaagtcatggttacccaaaacaatgagagtagcaagtttttgctctggtaccgtgaatgtgctgaattgattggtgaaacagctgatgatgtgaatagggtcaagattgaactggtggatttgtcctgtttctggcaggatggtgatcttgatttgaatgcttcccctcaagcactcgacaaattgttgggtcatgtgtttgcttttaaggtcaggattcaatcaaaattcaaaaatgcagttgttcttagatactcaaatgacctagatttgatcaatgttgttctcgagatgctgcctgataatgaggcatgttccaaaatagatccttccaatgttgattgcaataatactacgcatgttgaatgttttatgctttatgcagtaatctctgtctgtcacaactga

SEQ ID NO: 25230 - DNA, 549 bp, Glycine max
  Peptide Sequence Number=SeqID_142008
atgagtaaagataaggaggaatcacgtaacattcctccagctcaagatctcaataaagaaaatgttgagaaaaaacgtattgctgagaatggtggtgtcaaatctgctgacctttctactacctcaccagttgccaattatgaaatcaaggaacactatggcaatggaaaaactaagcctaaggatgacaagaatgttgaaggacctagtggtgttaaatctggtgacctttctgctacctcacctggtgtgaatgctcctcctcactctgacgatgagaccgagtttgttgatatcatcggtattgatgaggatgagaacaaaggacttacagctgcacaagttctgagagcccaacttgatgcagaagagcagaggtggaatatgcaaagagcttcaagacaaagacaaagacaagcccaattggatgaacaagagtggaggaggaggaatgagcaaagatctgaaagacaaagacaaacgtctagtagtagcagcaatgacattgaatcctgtgacgaaaattcggttaacccaatagttgattaa

SEQ ID NO: 25231 - DNA, 366 bp, Glycine max
  Peptide Sequence Number=SeqID_142009
atggaggccatgatgagcatgaagaagataatggaagccaatgcggttacaattgtcgctaccagcgctgttgctaaggtgaacccgatgcccccatctgatctcaaccaaatgaatcatccaacctcaaatatggtgggaaaagatttgggaagtacggacgaccccatgatgcgcaaattcaaaacgagcacgccttcctgccatatggcttgcctcccaactatacaccacccaatgtggcgtacactcctaatgaggatgtcaataactcctctcccatactcattgagagccgacaacctcctcatgtacatgtctctcaacccatgggggagacacatgaaattccccaccacaatctag

SEQ ID NO: 25232 - DNA, 729 bp, Glycine max
  Peptide Sequence Number=SeqID_142010
atgttattggcagtagaaggaggaggattcttctctgcttcggcttcagggtatactaagggcctgagccttctcctcttgggtcagaggaatgaggataaacccatgagagtagcgccgtggaaccagtatcagttggtagaccaagaatctgaccctgagctccagctggcttccacaaagaatcgcctctcccgcggctgtgcctcctttgtttgctttggtcgcacttccgcaggacttgatactccgtctcctcttaaagtgggccctgctcaacaacatgatgtctcaccagggccactggtttccaacaagggaaaggatccttctgcacatgtagatgatgaaagtgataacagaaaggctacactaaaaagtagcataaagaagccacaaaatagaaaatccgttcctgttgaggttgctaatgaacatgaagcatcaagtggacaggggatttgtactcctggaggtcaacccgaaagaaggaaagtgcagtggacagataattgtggtagtgagcttgtggaaattcgagaatttgagcccaggttctacggaatcctagaattgtctagtgctcaggaggatatgacctttcttgatgctttatataaggctatagctttcaagtttcaacatcagttggaagcaatgttgttaaataaccgttatagtgccgccattgtggcatttttcaacccctccgccataggcaatttgtga

SEQ ID NO: 25233 - DNA, 489 bp, Glycine max
  Peptide Sequence Number=SeqID_142011
atggtggcatctcctatttctacaaagtgtgtcccacttcccacactaccaatgaccctcatgattctcaaagcccaaaagggcactatcaaacaccacacatggggtgccaccacacaggatcatgatgttgatgttagtagcccttccctctctaaaaaccctcaaccagcttgtgccatttttgcttatgtaatacaaatatttcctgtttcatgcactgagagatcgaagagaagcaagtcattccctgaatactcctgctcctacactgaatttggcttcagtgaaaggtccaactcatataattttaatggtccaaaccagaagggaaatgggttttctgcatcaagtgatccagaaatcaagagaaagaagaggatcaaggcctacaatgtattgacagtggagggaaaacttaaaacaaatgtcagaaacagcttcaagtggatcaagaacaagttcagcgacattcgctacggtgtgtga

SEQ ID NO: 25234 - DNA, 456 bp, Glycine max
  Peptide Sequence Number=SeqID_142012
atgaatggaattgagctctggcaggagtccttgtgtttagggttaattggttgggtctggaggcaacaagagagtggatcaagagttgcaactgttgatatactcagctacattcagaatgagctggattactgtggagaggagccatgcatgtcccctagagctccactgcatcaacaacagtcacaaccggtaatgcaagtcactactggtgcaggttttccagtaactacaggattttctggccaaactattgtggggcaggaggtcagacctgagcactgtgataatcaatcaaagaattctatgttttcaaatgctttgtcaaaccctgttcgtcaaattggtgagggagggaaccacccaagtggtctttccatggggaatggaaaccagagcaccgactctgctgctttcagttccaatgattctgccatggacatgcatgcagactag

SEQ ID NO: 25235 - DNA, 378 bp, Glycine max
  Peptide Sequence Number=SeqID_142013
atgggcaaacaacaacaaagccttattccaccaccaagtgagctcggatacatggattacacgacaccattcagctcggaagtagatggaatggaaaggggaattgcatacaagggagtggcgttcaccggcttggaaggagagtttctggtggttcatggagagagtgtagaggtgagagagggaattggcggcactggagaaggaagagtagatggttcgatccacctcgtcgaggcttgtggatatggattttctcttcttggccatgcctctgcggtacccaatgggaagaaggggcttgtgggttttatgtgggagaggagagggaagggtgttgcggttttcatcggtttccacccaaaacattcgacttga

SEQ ID NO: 25236 - DNA, 1005 bp, Glycine max
  Peptide Sequence Number=SeqID_142014
atggctccggctagcaaggctgagaagaaggcaacagtggacgcagctgcatgggtgttcaatgttgtcacttctgttggagttatcattgtaaacaaagctttgatggccacttatggcttcagttttgctacaacattaacaggtcttcattttgctactacaactttgatgacaaccttactaaggattctgggatatgtccaaccttctcatttacccttaccagagcttctaaaatttgttttctttgctaacttctccattgttggaatgaatgtcagtctaatgtggaactcagttggattctatcaaattgctaagttgagtatgatccctgtatcctgcctgttggaagtttttttcgacaacattcggtattcaagagatacaaaactgagcataggtgttgtacttttgggtgttggtgtttgcactgttactgatgtgagtgttaacacaaaaggtttcgtttcagcctttatggcagtgtggagcacttctctgcaacaatatatttcatactcctgcacggcaacattaccaagagagtatgttcatttccttcaacgaaagtattcactaagttctttcaaccttttgggacacacagcacctgcacaagctgcatcactacttttgttaggccctgttctagactattggttgacaaacaatagagttgacagatatgcttacaatgcaggttctttgattttcatatttatgtcatgcactatagcagttgggaccaacctcagccaatttatctgtattggcagattcactgctgtctctttccaagtactaggccacatgaagacaatacttgttctaataatgggattctttttctttgggagggaaggtctcaatgttcacgtggttctagggatggttatagctgtgtttggaatgatatggtatgggaatgcctcatcaaagcctggtggaaaagagcgtttgaatcacactctccccaccaacaaaatagaaaaccgatag

SEQ ID NO: 25237 - DNA, 711 bp, Glycine max
  Peptide Sequence Number=SeqID_142015
atggtaaacccaatagaaacagaagatggttccaatcatgtggttgcactggataaacatggctcggcagcagccagcgaaggcccgtcgtggcaatggaacaacatgtccagaggtggaaagaaaaaaaggaaaggtcgaggcaacaattacaaaacatcccgaagaggactaggctttgtgcacctcaatctggcaagcctggcactgaaaacgatggccggattccctgctatgcgctgggaacaggggttgtttgactgctgtttggcacagcaaaaggaagtgcatgagagtgtgtcggtggttctttcaagacgctgtcaatggcgcggggtagatcggcagaaggtggttcagatacgtgggttgtttggccagaaaggtcgttggagcaccagcagcagccgccgacagtcaccagaaaaccttaaacaggagtccacaacctggtgcattcttgatgtatctaagaatgtgcatgatagcatcccaatggctattacaaggggcattaaggaattgacttaccacacttactgcaaaggtgatgtctggcctggtgaaaggaaggcaattgaatctaccaaacatggacccacagctgaattggaaacggaaccatcagaagccatgaaaacagaagccaaacagcacaagggagggtcgttagaagagggtgttgcccacctattaggtgaaagcgcatga

SEQ ID NO: 25238 - DNA, 1347 bp, Glycine max
  Peptide Sequence Number=SeqID_142016
atggatatgaagatgaacatgcttttctttctcgtcctttttgcttctgcaatttcctcttctcttgccaagggttccttgcaacaaacccttcttccttcagaagaattcaatgacggtagtaatgcaagcagtgcaaggcatttattagaggatgagtctcaggctcagacaagtgttgatttggcacaaggatttatgtccaatgatgaacttgaatgggccatccaagaatttggacaaagatgcagcaacatttccaggggattcttggaatgggctatcagtattggaaagagtgtaaatggttttccattgtgggtgatagagatttctgacaagcctggagaagaagagactgaacctgcatttaagtatattggaaatgtgcacggtgatgaacctgtgggacgtgagctgcttatatttttggccaattggttatgtgataaccatttgaaggatcctttggcaacattgattgtggagaatgttcaccttcatttacttccatcaatgaatcctgatggttttagtttaagaaagcgtggtaatgctaataatattgatctgaatcgggattttcctgaccagtttgtttttataaatgatgatgaggattcccggcaacctgaaacaagagcgataatgaattggttgagagatatacgattcacagcatctgccactttgcatgggggggcacttgttgcaaattatccatgggatggcagcgatgacaaaaggacaaagtactatggttgtcctgatgatgatgcatttcgattcatgtcaagtatctacagtcactctcattacaatatgtcttcaagcaaggaatttctcggtggaatcacaaatggagcagcatggtaccctctatatgggggaatgcaagattggaactatatacatgctggctgttttgagttgaccctggaaattagtgataataaatggcctaatgctgctgagcttccttttctttggagatacaacaaaatgagcatgcttaatcttgtggcaagcctggtgaagacaggagtgcatggaagaatatattcttcaggcgatggaaggccattaccaggctctataactgtcagtggaataaattacacagttagagctggaaatacttttggtgactatcatcgcatactcgccccaagagataaatatgaagtagtggcaaccatgcctggctacaaatcaaagaatacaactatttggttggacgaaggaccagtgacattggattttgttcttgaccctgaaagaagacaaaaagtcaaattttcaacaagcagacagtcagcgggggcaaaaagaactgttgaggtctaa

SEQ ID NO: 25239 - DNA, 945 bp, Glycine max
  Peptide Sequence Number=SeqID_142017
atgtctgttcaaaaggatcaagataagttcttcttgtccatcagtcaaggagagaaaaaaccatttgactttttacgtgttttatatgatggttgcattgctggaggtgctgctggtgttgttgtagaaacagctttataccccattgataccatcaaaactcgactacaggttgctcgcgacggagggaaaattgttttgaagggtctgtactctgggttggctggaaatattgttggtgtcttaccagcttcagcaatttttattggtgtgtatgaacccacaaagcagcaattgctaaagtcattgcctgaaaatctcagtgccgtggctcattttgtacatttcaacatttgtaaacaaaatgtggaagacactgcaaagtgcaaagctgcaggtgctattggaggcattgcttcttctgttgttcgtgttccaactgaggttgttaagcaaaggatgcagattgggcaatttaaatcagccccagatgctgtccgtcttattgttgctaatgagggttttaaaggtctttttgcgggatatggatctttcttattgcgagatttaccatttgatgctatagaattatgcatttatgagcagctccgtattgggtataaattagcggcaaaaagagatcctaatgatccagagaatgctatgcttggggcagtggctggtgcggtaactggagcagttacaactcctcttgatgtagtaaagaccagattgatggttcagggatcacaaaaccattacaaaggcatttctgattgtgtgagaacaatagttaaagaagaaggaagtcatgctctttttaaaggtattgggcctagagttttgtggataggaattggaggttcaatatttttttgtgttcttgagaagactaagaaaattcttgctcagaaacggcactccaaagctgagactcagaattga

SEQ ID NO: 25240 - DNA, 354 bp, Glycine max
  Peptide Sequence Number=SeqID_142018
tatcagcaagagccctttactcggcttctgaaacaagagaacggaccgactctaactaatccactcctaataacaggaaggctaaaggcagacctcgtcctactaaaggaaagggctctttctattccgagttggcctgcaccggtcctatcctattcgattaggaaactgatgattctagagcaagtgacatccatatcaaatcctccagaagttatgctcaacaggaaagtcattaagaagtgccacagcactattgctattgatcggacattcacaattgcattacctgaatggaatggcagcagtcttcttagtcccaatccctgcgcattcaagaacaagcccatctag

SEQ ID NO: 25241 - DNA, 579 bp, Glycine max
  Peptide Sequence Number=SeqID_142019
atgacattgaccatcccagagcttttcttgaggccttatcaggttagatgggatgccaccgtgttcggggtcgttaatccagatttccccctctacataaagcacgaagacctctccgaaatcgcacacggtggtcaatgtctcagcatatcagtgttacagttgtggattttgcatctcactgaaacttgtatgcgagtggggaattctgatatctatggatttctcgacccacagtccattcagaggtctgcgcaatcacagtttgagtctgaaagttacataaagagttggatgcagagttcacaacgcgatgtctatcttggagcctacctaaatgggttccactgcagcggacattggcagatggtggccatcctgcccaaggaacacctagttgtctggttttgttcattgcataacaggccagacaactaccttaaggggattattaatagtactatcaagggtcttgatgatggtccacagcctaaatcaaaggcttctgctaggtggattgtcgtcaagtattttaacgatcctagaccattggagctagagagattaaaagcattgtga

SEQ ID NO: 25242 - DNA, 216 bp, Glycine max
  Peptide Sequence Number=SeqID_142020
atggcagctttaccgatacacataattgtagaaatcttgcgagatgagcatggggtcctcaatccttgctcccatgaattggttgtggttgaggttgttgtccctactagaaaagtgacattcaaagaaagttataatttccattcaaagatagttttggaactgtgtttgaagccaatgacgttaaaagtaattgacggacgacgacagttgtga

SEQ ID NO: 25243 - DNA, 789 bp, Glycine max
  Peptide Sequence Number=SeqID_142021
ttcaggccagcggcaccggtgccagaaacttaccctggccagccagcgaatgagagcgtgaccaatgtacctgtcactgaggcaccaccactcacctggcaaagctactttccagatgccgacttgcagaaactcatacaagtgggcttacagcataaccgcgaccttaaaaccgcagtcttgcgcatggacgaagccaaggcgacttatggcgtgcaaaaggctgaccggttgccaacgattcagggtaacctgaattacgaccgcagccgcaccgtgttcagctctagccaggcgtttgaggccgaactgttccgtgtaggtgttggtattagtgaatatgaaattgacgtctttggccgtgtcaaaagcctgacgcaatccgcgttagagcaatacctggccgtggcggaaaaccggcaagcggtgcaggtcaccctggtgacagagattgcgacgcagtacgtgaactacctcgccattcaggcgcaactcaaagtcagccagcaaactctggctgaccggcagcaaatgttgcaacgcacccagcgccgtttcgatgcggggttagatcaagtgctggatgtgaaagccgcgcaaatccaggtcgagcaggtgcaggcacaacttgcccaatggcaacgccagcttgccactacgcaaaacgctttatatttactgctcggtgagccttcgcaacgcacgccgttaccggtcaaaccgctggaggatttaaaactgacttcgccaaattgttctcggataccggcagtaatggggatcctctag

SEQ ID NO: 25244 - DNA, 414 bp, Glycine max
  Peptide Sequence Number=SeqID_142022
atgagcatgaaggagcatgaatctttcaaagaatacgcccaaaggtggagggatctggtagctcaagtagcacccccaatgatggagagggagatgataaaaatgatagtagacacattactggtgttctactataagaagatggtgggttacacgccttcaagatttgccgatttggtttttgctggcgaaaggatcaaagtgagtctgaaaagaggcaaatttgatcatcctgctatgatgaataagaagcctggggcaaatggagagaataaggagggaggaacccatgctgtgaatgtcgttcctacatggccaaatttcccaccagctcaacaatgtcaatactcacccaatatcaaccctcctcattacccaccaccctatcaaccaagaacactcaatcatccataa

SEQ ID NO: 25245 - DNA, 159 bp, Glycine max
  Peptide Sequence Number=SeqID_142023
atgcatgtgcatcattgttgtcctgtaagtcggaggataggagaagatttggtcgataccacaccaagtccaaggccaaaggtacgagcagatattgggcccgtgatcgacaggttgtcgtcctacgtctggctcaagacattaaagaagcgctactag

SEQ ID NO: 25246 - DNA, 576 bp, Glycine max
  Peptide Sequence Number=SeqID_142024
atgattacacgtcctcgccttcagagggctacacgtctttaccttagagggctacacgccctcaccttcagaggactacacgtcctcatccttaaagggttgcacgcccttaccttcagaggacaaaacgtcctcaccttcagagggctacatgccctcaccatcagaggactacacgtccttgcctttacattactacgcgtcctctccattagagggctacacgccctcgccttcagaggactagacatcctcgcctttagaggactagacgtcctcgccgtcagaggactacacttcctcgctatcagaggagggcttcacgccctcgccatcagaagactacacgtccttgccttcagaggactgcacgtcctcccctttagagggctacacgcccccgtcttcagaggtatgcatgtcctcaccttcatagggctgcaagtccttgcctttagaggactacacgtcctcgccatcagagggttgctcgccctagccattagagggctgcacgctctcacctttagagaactacacgtcctagccttgaggcctacacgttctcacctttag

SEQ ID NO: 25247 - DNA, 354 bp, Glycine max
  Peptide Sequence Number=SeqID_142025
atgaagatagaattcaaacatttgcttttggtacaaggattcctgctgcttgtcaggtgcaaggattatgtcaaagcatggaaacgccttactgtgaaatgcgctccaaatattcttacaattgccttaaaaagattccaggtcttggacagtgttgaggaaattatcgaagtttcaaagactttcaatgaaaaaattagaaagtgctctgacatgacactactttcatgtgcctatgctggaattggaaatgttctcaagaatattcgccgagcaattcctttggcccttggtttactctgtatatcaaatccaaaggttggaaaaaatatagagcaaactagttatcaataa

SEQ ID NO: 25248 - DNA, 676 bp, Glycine max
  Peptide Sequence Number=SeqID_142026
cgagtctgcaaaagttattaccttttgtgcaatgtcattttattcgtgctcatctcaaccaccgctatcagacaaggaaacctcacttctcaagcagtggcggtgcgcaacaaagacaacctcatcaaaaccccaaaatccaaatatggttggccaaggcggcgctcgacggagtcaacaccctcactcaccatcaacgtcgaagtcgagtacaacatcgacaacaatcacgggagtgacgacgagggagaccgcaaaagcaataatgagggacaccgcaagagcgacagtgaggggctaggtcaagatgaaactaatgagggtgtgggtaacatatgcttaccgatgagcgccgatcaactccgcgagagtgcggcggcgccaccgcgctggaacccaacgacggcgtggaacaaccagctccggcagctatcgaagcaacgccaatacagagaagccctaaccctataccgccacatgctccgttcctcctttttccccaacaccttcaccttccccttcctcctcaaatcttgcgcctttctctctctccctctcgccgcatcacaactccacgcccacgtcatccgaaccgggtcccaacccgacccgtatacccgctcctccctgatcaatacctacgcgaaatgctccctccaccaccacgccccgcaag

SEQ ID NO: 25249 - DNA, 309 bp, Glycine max
  Peptide Sequence Number=SeqID_142027
atgaattcaactcaattaccaatcttgggaacattgcaaaagaggtgttggcttatacccaccttcactgtgccatctgaatctgcctttagtgttggaggacagaagtggtcttccctcaagatggtggtgttagctcaagctatcctattctttatgaggattaaaattgaaatactatctattcttgtgcttgaagattctatgctggagagtagagaaaggtgcatgcaattggaagaagctgtaattagttttaatttttactatgatgttcatgattgctcagatttaactgttgaaggctag

SEQ ID NO: 25250 - DNA, 378 bp, Glycine max
  Peptide Sequence Number=SeqID_142028
atggggcattggtgtaccaaacgagttaaaaggttctaccttatattggctttaaagatattggaggcttatgtaaaagcaatagggaggggcttctcagcctcaccttttaagactttcactattcgattaagagaccttatgaaaggagacaaccatgctcgagatatgtctcgctcttgcaaagcacctgatgttactgttgagccttcggatgatgtgaagaatccgtcaagcaattggcagtttgtggttctggagttggctggttctcattacgctgccgtttgtatagaacaggatggtaccgatgcaggcaatgggagtattccaataaatctgaccctaaggaaaacaatcccatatgttgaggattaa

SEQ ID NO: 25251 - DNA, 246 bp, Glycine max
  Peptide Sequence Number=SeqID_142029
atggctaagcatactgctgtatcgaatactggttttgggcatagcctcacttgtagtcacagtaagaggatcctaagtcaaaagagaaggctatatgcagccattgccgttgcactcaagtgtggtcacggaacaagttccatgaaatgcaagattgatccaaatagtgaagtgaacaagaagctgaaatcaacttccttctcaacaacaaatgcttcttacccttcacaagccaaatttgactag

SEQ ID NO: 25252 - DNA, 1461 bp, Glycine max
  Peptide Sequence Number=SeqID_142030
atgcggagagaggaagaagacggcctggacgttgacgttaatgttaatgccgttacactgctgagtttggtttctgggtgttccgtcgctacccatttgaccattggcgtgtgccttcacggttgctgtgttaggttcgggtttgtgactgatttggctgtggccaatagtctggtcaccatgtatgttaagtgtggggaggttgaacttgcgcgtaaagtgtttgatgaaatgcttgttagggatttgattacgtggaatgctatgatttctgggtatgcacaaaatgggcatgctaggtgtgttttggaggtttatagtgagatgaagttgagtggggtgagtgccgatgctgttacccttcttggggttatgtcggcttgtgcaaaccttggtgcacaagggattggtcgcgaggtggagcgtgagattgagcggcgtggatttggttgtaatccatttctgaggaatgcgcttgtgaatatgtatgctaggtgtgggaatttgactcgggcgcgcgaggtttttgatcgctcgggggagaagagtgtggtttcgtggacggcgatcattggtgggtatggcatccatggccatggggaggttgcattggagctttttgatgagatggttgagtcggctgttaggccagataagacggtttttgtgagtgttctttcagcgtgcagccatgctgggttgactgataggggcttggagtactttaaggaaatggagaggaagtatggtttgcagcctggtccagagcactattcttgtgtggtggatcttttaggccgggccgggagattggaggaagctgtgaatcttataaagtcaatgaaggtgaaacctgatggtgctgtttggggtgcccttttgggtgcttgcaagattcataagaatgcggagatagcagaattggcctttcagcatgttgttgagcttgaacccacaaatataggttactatgttttgctatcgaatatatacaccgatgctaacaacttagagggggtttcaagagttagggtcatgatgagggaacgcaagcttaggaaggatcctggatacagctatgtggaatataaaggaaaaatgaaccttttttactcgggggatttgagccatccccaaactaagcaaatatataggatgctagatgaattggaaagtcttgtgaaggaggttcatccaccaaatgagaaatgtcaaggacggagtgaagagctcttaattggtacaggggtgcacagtgaaaaattggcaattgcatttgctctcttgaacactaagagtggaacagagattactgtcatgaaaaacttgagagtgtgtgttgattgtcatttgtttattaagttggtcagcaagattgtcaatcgtcaatttattgtcagagatgccacacgctttcaccatttcagagatggaatctgctcttgcaaggactactggtga

SEQ ID NO: 25253 - DNA, 243 bp, Glycine max
  Peptide Sequence Number=SeqID_142031
atgagggaggggagttttgggtggaaagaaactccccctccctcgtttttatgtttccaggtgcaggggtgctcgcccaggcgagctcagctcgcccaggcgagctcagctcgcccaagcgagctaaccctgatactaggctgcctcccagctactctttccgcttgtccagagatgggcatgggacgaagatctatcgatcgtgatcctagcctctactcacgtccgtccccaagtacctga

SEQ ID NO: 25254 - DNA, 332 bp, Glycine max
  Peptide Sequence Number=SeqID_142032
ctcttccattcaacgtggctaccctagttcccacactagtagtcccgcgttggaggatgatgcatgcaaaagaagaagaagaagaaggagacttgaaaatgaatattgaaagggacaaagagggtgatgatcatgtgtccattttggcacttttggttgttgcattgagaaaatctttgattggttgcagcaaatatagtagtagtagttgtgacccttcttccatggagattggcttgccttccaatgttagacatgttgcacatgttacctttgatcgcttcaatggctttctcggcttgcctgtggagtttgaacctgaagtcccataa

SEQ ID NO: 25255 - DNA, 350 bp, Glycine max
  Peptide Sequence Number=SeqID_142033
atggcagatcctttgacggctttgatgcatgtagtacaagtgatgaattttctcaagacccttgagatgaagacactaagagaaagagaggggtctacggtaaaatcaaatactgtttcagacttaaattcttttggtgatgataatcaccagagctcttcacagcttaaactcaaggatggcagtgaaaatggaagtgattttagtgaagaggataaggtatttgtcgctgaagaaccttctcaaccaagctaccctagtcatcttattgaatattatggctatgaaacaaaaagtggatccaaggatttgcatacacctactaagaatatcattcctagagaaaatag

SEQ ID NO: 25256 - DNA, 453 bp, Glycine max
  Peptide Sequence Number=SeqID_142034
atgcagctttcctatgatgccaccagaggaaatagtgtacctacattactcttgttaatgcaaagacagctgtatgcacaaggaggtctacaggttgaaggaatcttcagaattaatgctgaaaatagtcaagaggagttagcctggttcagagaacttctaactggggtattggaccctctttcaccagagcaggtgatgcagtcccaatcagaagaagaatgtgctcagcttgtgaggtttcttcctcagacagaagctactttactagattgggggataaaccttatggctgatgttgctcaactggaacatttgaacaagatgaatgctcgtaatgttgcaatggttttttgcaccaaacatgactcaagaaaagaagatgaagatatggagatggagaagactcaagatacttcaaatatgaaatcttttgttgttggagatgtttaa

SEQ ID NO: 25257 - DNA, 372 bp, Glycine max
  Peptide Sequence Number=SeqID_142035
atggtatcattgaagaaactagccaaaagggttaagggtgttggaggagctgatcactctgaccctccataccaagaatgtttgctaaaggggtatgaggaaggtaaagaatcaccctctagcacaaccccaacaggtttttttgcactttatgttggtgaggagcgtcagagatatgtggttccaaccagctacctctctcaccctctattcaagatgctgctggagaaggcctacaatgaatttggctttgcacagaggaatggcctagtggtgccatgcagtgtttccacatttcaggaggtggtgaatgctattgaatgcaacaatggcaagtttgacttgggcaagatttttgaagattttgcttag

SEQ ID NO: 25258 - DNA, 312 bp, Glycine max
  Peptide Sequence Number=SeqID_142036
atgagattagaagcacttattaaagagaaggaagagagagaaaaagaacatggatcttggccttgccgttgtcgatggtgtcgttgctctccacctcaaagtggagaaagggaaaatgaagaagatgaaggtgcagtgtttctcctgcaactggctcatcgtcatgcacttaagtcatccatcacacacacgaggtggaagatggaggttaaggaggagaagatggagatgaagcctggtttcattacgacggaggtggaagatggagaaaccctagcgcaaaaatgcgaggttggcacacagagtgagtaa

SEQ ID NO: 25259 - DNA, 252 bp, Glycine max
  Peptide Sequence Number=SeqID_142037
atgttggcgttgagagaaaaactcttcttttctcgcagaaacccagagtcgtttcgggagaaagatccatcgcatgtaggaccatggaatagagacttcaatctcttctccttttctctaacgtttgggaaccctaacagagcaatcggaggaggaactctagagagcaccgaaaatgtcccaattgataatggagaatgcttgagtgactacatcgagataaaggatgagttattcatatttggggagtaa

SEQ ID NO: 25260 - DNA, 681 bp, Glycine max
  Peptide Sequence Number=SeqID_142038
atggatttttggctggtgagaacaattgaggaaacaggtattgaaatgatgctgagttgggtttccaatgcgtgtgcccatgtcaatacaaaagagagttgtgttgatccctcagggaacgatccagagacgggagactcagacaaatgcgggctggttggtgttgaggaggttaaagatgcagaggcttccgttcctgtacccactgacgaggttatgtgggatgctaccgtgttcggggtgtttaatcaaaacttctcgttgtacataaagcatgaagatctctctgaaattgcacacggtgcggggaatttcgatgtgtatgaattcctcgagccacagtccattcagagatctgggcaatcacaatttgaatcggaagttacatcaagagttggatgcagagttcaaaacgcgatacacttgcaaatggtcatcattccgcctaaggaaaacctagttgtctggttttgttctttacataacatgccagacaactaccttaagggaataattaacagtgctttgaaaggacttgatgatactccacaacctaaatccaaggctactgcttggtggattgttgttaagtgtaatagacaaaaaggaagcactgagtgtgactattacgtcatgcactggatgtccacgataatcttaggaactttcaacaataattga

SEQ ID NO: 25261 - DNA, 349 bp, Glycine max
  Peptide Sequence Number=SeqID_142039
atggctaaggtggtgacgacaaaatgttggaatgcgaggaagaggagcaaacacagcggagaagcaaagaggcgcaaggaggagaataggcgagaggaggcgaacagacaagaacgcgaggaagaagagaatgttcatctgcttgaaagtgttccagaacaaaatatcgctcgagctcccctggtcaatatgggttgtcttgactatgtagttggttatctttacactgataaccataggattgtcttatatcggtcgaccttaggtggagtgttagcccattttggcatagccaaaatgtctatagccaatgctttatccatgatatgtgatctactagcagtaagag

SEQ ID NO: 25262 - DNA, 222 bp, Glycine max
  Peptide Sequence Number=SeqID_142040
atgactacaggtgatccaccccaacagaagacaagacaaggaaatgagaaaaagaaagaagatgagaatgttactcaaggcgattcacctcaagaggagagaattctaagaatcgagatagaggaagaactcaagaatattacagaaggtgatccacctaaacagaagagaagtcaaggaaatgagaaaaagatagaagacgacaatataactcaaggttag

SEQ ID NO: 25263 - DNA, 168 bp, Glycine max
  Peptide Sequence Number=SeqID_142041
atgaggatatgggctacgtgggagtacgtgagctcagttggaggtgggcaacaggggatgagtggtacctggagatatgtcgcgggggtcaagagaccttggggacgtcaggtggggtgctattgcccaaaaccaagcttgaccaatcccgacccaacccgggcatag

SEQ ID NO: 25264 - DNA, 168 bp, Glycine max
  Peptide Sequence Number=SeqID_142042
ggttatggccttcttaggtcacggtacatagggacggatgcaagtggggatagggtcacgaccgaccgatcgttgccccttcctggcgctaaacaagcagagaacgtcgctgcaaggcagcccagtatcctttgcattcgcagtttcttttacaattgtttgttttaa

SEQ ID NO: 25265 - DNA, 450 bp, Glycine max
  Peptide Sequence Number=SeqID_142043
atggatagagctaggttaatctttggcctagtctctcagctggacatgaatgtaggagctctcatatctggccagatcacatctatggcccagtctaactcctctagacttggattccctgctcttatcacagctctatgtaggtccagaggggttgcttctgacagcctagtcttcgaacgcttgatcccagtcattaacttagcctatatcaggaaaaactattggaaccctactgatctgacagttactattagaggggctaggagagcgagggcaaggccagtcgaggctccttccacatttgcagctcctcctccagcaccctggcccgagactcagcccccccttcatagggaagacgaaggtctcaccgctcaggtaccacagcagagggaggatgagtcatcagagacttccatgccaaagcccctaatcagaaggaagagg

SEQ ID NO: 25266 - DNA, 221 bp, Glycine max
  Peptide Sequence Number=SeqID_142044
gtggccttgttggtgcttgtgcgcttagcacgaatttggaccgcttagcgtgcatcagtgaatttcggcttagcgtgcgtcttcttgctcagcgggtggactcaagcggtgcgcttagcaggataacagcttgctcagaaaacatgcacagctcatccttcttgcaaattcttccttgcgctcagccaaaggagtgttgcactcagcggatggctcgctga

SEQ ID NO: 25267 - DNA, 566 bp, Glycine max
  Peptide Sequence Number=SeqID_142045
gcttttcgtcctacagatagcaaaaaaaaatgtttatacggaataccactcgggtatctccgcccgtcagcgtgactcaaaagtcagtatgacagatcttgtgagcgcggaagattatgcttttggtcttacagatagcaaaaaggtttatacggataaccactcgggaatctccgcccgtcagcgtgactcaaaagtcagtatgacagatcctgtgagtgcggaagatgacgcttttcgtcttagagacatcaaaaaggtttatacggataaccactcgggtatttccgcccgtcagcgtgactcaaaagtcagtatgacagatcttgtgagcgcggaagatgacgtaaatctccgcgtgtcaacgggcttgtcggccgcgattgacgaagggcgcaggagacgaccaaaaaggaatgtttatacggataaccactcgggtatttccacccgtcagcgtgactcaaaagtcagtatgagagatcttgtgagcgcggaagatgatgtaaatctccgcgtgtcaacgggcttgtcggccgcgattgacgaaagtcgcaggagacgac

SEQ ID NO: 25268 - DNA, 243 bp, Glycine max
  Peptide Sequence Number=SeqID_142046
atgggtgccaagtacctcaaagtggtcaaacgagggtcgcatcccaacaaacggaaggcacagaatgaccataatttgtctctgtgtgccatcggacacgatcgggcctggatggaaaggcacagaatgaccgtaatttgtctctgcgcgccatcagacacgatcgcctctggatggcgaaaaggtgtgcggaatgaccatattttgtctccgcccgccactcaactcactgctcctgaatga

SEQ ID NO: 25269 - DNA, 606 bp, Glycine max
  Peptide Sequence Number=SeqID_142047
aggcaaaaccttcacaaacacctcgccaaccttcaggaagggagcatagatgtggcagtggttaaagaattttatgctagtttctacagtctagcagatcaagctcccaaatgtgctagaataagaggccatttaatcaagatagatgcagacagcctaaatgagttcctccaaactccagtgttattagaggagggggaatctttacccacttattatagattttacaacttaaggtctgatcccatagagatagaggctagtctatgcattccgagcaagggctttattctaaacacggagggccaaccatggaagctcctcagaaaagatcatactaccctggctcaaacatggagcgtcttctcttactcaaacctagctcctacctcccgcacttcagatttgaacatagatagagctaggttggtctatggcttaatcacaaggatggacatgcacattggtggtttgatctttgggcagatgaccatgatggctcagtctaactcttctcgcttaggcttcccagctttaatcacagccttgtgtagatcgaggggagttggatctgatgcttttacctccaacgagaacctaagaccg

SEQ ID NO: 25270 - DNA, 621 bp, Glycine max
  Peptide Sequence Number=SeqID_142048
atggtaggtcgccagcggtttggcgatcatcacaaattcgtagcccatgcggtcggcgcggatgcagaagtcataatcctgatggcgaatatagcgcgcatcaaactggattctggcggcatcttcgcgtttcagcacgatagtactggtctggataaagccgtaacagccaaacaggtactccgccacggtctcatttttccccggcggctgcatcggcatcactttgaggaagctgccgtcctgatgaatattgacctggctgaagatgacatagcgcgatttaccctgcgcttccagcttgcggatggtatcgcacacttccagcagcttgtccgcgtgccactcgtcgtcggcatcgaggaagctgatgaagtcgccctgcgccagttcaatacctttgttgcgcgcgccggcaccgttgagtttgacctcagacagttccagtttgatgtccagatcctgatagcgctcaccgcgcaccacctgcgccagttccgcggcatcggcggatttgtcatccacgatgatgacttcaaagttgcgataggtttgcgctttgacgcaatccagcgtcgtgacaatcgatttcgacgcgttataagcgggaattacaattga

SEQ ID NO: 25271 - DNA, 891 bp, Glycine max
  Peptide Sequence Number=SeqID_142049
atgctaggcgggcagcggctcgggcttgacccgcaccgcgcgcagtacgccgatcatcagcagcacgatgccggccagcgtcaacggctgcggcaggctgcctcgcaggatgaaggcataggccagcgcggccagcgtctcgaacacgatcagttgcccggccagcgcggtcggcaggcgctggctggcttcgttccagcacagcgtgcccagccacgaggcgaacaggccgatgatgatcatgagccccaggaacacctcgggacgcggccccagcggcatgtcgaagccactgccggtggcggccatgccgccccacaacaggccatagccggccagcgccagcggcagggtggccacgccctgggcggtggcccaggtgcgcggactgcggccaggatggtcgcgcagccagtcggcgttgcgcagcggataccaggtccagcacgccaccgcgcccagcgccagcacggcgccgatcgcgtagcgcgacaggtcggcatcggcctgctggcgcagggcttgcagttccgcctggttgacgcaagcgatgcccagtgcgatcagcgccagcgagggcgccagccgcttccagggcagccggccgtcgcggcgcgcgttgcgcaggttggcgcagatggcgatcaccactggcagcgtgccgatgatcatggtcggcaccgggccgccggcgcgctggatggcgctggccaggcacaggtagtacagcaggttgccgatggcggccagcttcagggcctcgatccagtcagcgcgactgagctggcgcagcgccttgcggtccagccaggccagcggcagggcgatcaggccgaaggccaggtagcgcgccaccgattgcagggcggcggggtattccggcagcagtag

SEQ ID NO: 25272 - DNA, 288 bp, Glycine max
  misc_feature (276)..(276): n is a, c, g, or t
  Peptide Sequence Number=SeqID_142050
atgcataccaggggatcgcgcccacaagacacccagtggacccggaagagcccaacagggccctgggatttccagctctggttacgggcctctatcagtcctatagggtgcccgtcccccccagcaaggtcatgccatcgtgacataggtaaggatcacgcccgcaagacacccagtggacccggagaagtccaacagggtcttggagtttccagctctgattacgagcctctatcagttctacggagtgcctatcgcccacagcaaggtcatcangccccctactaa

SEQ ID NO: 25273 - DNA, 1011 bp, Glycine max
  Peptide Sequence Number=SeqID_142051
atgagtgaagaacaagacgaatctctgagtattcatagcccttactacctacaccctagtgaaaatccagcaatcgcattagtttcgcctcttctggatccaacgaattacaattcttggagcagatcaactctcatggccttgagtccgaagaataaagtagaatttgtgatggttccctttctcgaccaacctcgaatcatagattttgcaacttccatttgtcaaagcatcttatggatggacaacgcggttgatatctggaaagatttgaaagcacgatactcacaaggtgatttgcttcgaatttctcatttacaacacaaattaacttcaattaaacaaggagacatgaatattactgattattttacaaagctaagaacaatttgggatgagcttgagagttatcgacccgatcttgtgtgtacgtgtgcttctaaatgtggttgtgatgctcttgttgaagtaaagaaaaggaaagatcaagatagaataatggagtttatgcgtggtctcaatgatcaatacaatcatgttagatcaaacataatcataatggatcccttgccattgattaataaagctctctcttatatggcacaacaagaaaggaaatttgcaagttttgatgcacttggcaatctgagtttagttaatgctgttgctaatacaagattatctaattcttgcagctactatggtagagacaattacacagtagaaatatgttataagaaaaatggtttttcacctaacttcttctccaatagaggaggtggaggtagaggttttggtagagggaagacaggaggcaaaagcaccaatgataaagtttgcacccactgtggtatcattaatcatacagtggatgagtgttataagaagcacgattatccacctggtcacaaattctataaacctcaaggagcttcagttaataacactattaaggaagaagaaaatgtttcagttcagagactagtgatcatggccaagacattaaaataa

SEQ ID NO: 25274 - DNA, 801 bp, Glycine max
  Peptide Sequence Number=SeqID_142052
atgtgtttacaaaacaacatggaagcaacagatcaagaagaaattgcagcttttgcacaatggattatagatattggtgatggtattattggagatgaaaatgatggctatgctactattgaaattccacaggaactattaatcacagaatataatgatcctattcatagtataattagctctacatttccagatctatcttgtcatcacaatgatcctgaatacttccaaaccagagcaatattagcttccacaaatgaaacagtgcaacgagttaatgattatatgcttacaatgataccgggtgaacaaatggaatatctaagctctgattcagttgacaaatccaaaaccattgaaagttgtcatttccgctcactgtcaactaaatttctgaattcattgacaacatctggcttacccaatcactgtctcaaactcaagattggaacaccaataattctattaaggaacttagaccaaactcaagggttgtgtaatgcaataaaaatacctcttcacctgcctccaccaccacagtctttcatacttatcattctgccaattcacgtccaatctttgaacggaacattcaatgctccacagttctcaaaccacttaacttgccgtcacttacaccccgcccccccgaaaagcaatgacccttccaccacccactactttacattatcagaccatggttcatttctctgccaccttcatttcaactctaaccaaattattctctcaaagcaactaccaccatgtctcgcgcttcatccactgcctcaagcaaagtaa

SEQ ID NO: 25275 - DNA, 721 bp, Glycine max
  Peptide Sequence Number=SeqID_142053
atggcgggtgaaagcttccggctcgcccatgctgcggcgaatcacaaacgacaccagcgccggcagcaggccaaccaggaacataccgcgccagccaatcacgctcagcagcggcggcgtgataaaggccgccagcaatacgccgagctgccagccgataccgacccacgccgaggcgcggttgcgcttctccttcggccaggcttcggcaatcagcgccatgccgatgccaaactcaccgcccagccccatgccggccagcgtacgatacgccagcagatcccagtagccctgcgccacggcgcacagcccggtaaacagcgagaacatcaggatcgtcacggtcagaatgcggatgcggccgtagcgatcgctcagatgaccaaacacaatgccgccgaccaccgcgccgatcagcgtccaggtcaccagcgaaccggcctgcgacgcatccagcgccagcgacacgctgatcgccggcagcataaagcccagaatcagcagatcaaatccatccatggcatagccgctgatggcagccaccatcgctttcgccggcgtaacggcggttttgttgttatttgcagaggacataaaacagcacctggcagaaaaatgtgcgccaagtataaagagagcggcaggttgagaacaggcagaaatcaagcgcactgcctgtcagcctcagcgctaacaggcagtcatcacgtcaatcaggagg

SEQ ID NO: 25276 - DNA, 330 bp, Glycine max
  Peptide Sequence Number=SeqID_142054
atggtcatccaaacactcctcggatccgccttacgcgagccctattttgctcgtgctctcttctttgatctctatctaatctcttcttcttctccatctaaggtgtcttcttctccgtctaagcttcttcttctccatcgcgctctcaaccctgacagctcgccaccttacataggtgaaaatcctttgcttccagtaattgttatctatattgccaatacaggagagataaatgttctaataataattgagcaggctgtaaaggtgcaagaatggtctttttgtgtatctagtggactagtggttaatttgtttgagtttaatttctaa

SEQ ID NO: 25277 - DNA, 387 bp, Glycine max
  Peptide Sequence Number=SeqID_142055
atgcccttgggaggttggattgcattagtacatcctttgtgttcaagtggagggtacatccacttggttgttcaaagagaacaagggagggtacatcccttgtggatctttgcttgtaaaggattttacaaggttattggaaatctcaagaaccggtggttgcttggggactggattaaagacacgttcataattaattcaacccctcttcttgattattccgaggcactttatccaacaatcaatctagtttgcaacaaggtagatgatgcaatcctacccccaagggcattggataaaagactccaagaagattgggccaaagatgcacgagaaagccctaggattctcatgagccttagggtagattttgggctcatgggctaa

SEQ ID NO: 25278 - DNA, 123 bp, Glycine max
  Peptide Sequence Number=SeqID_142056
gttcagaagagaaaagtcatagcaccacaatttgatgcacgcgctagttggtggactcaaggacccgatgctataatgcagttggtatctttggatatttgtggtcatcttcatgttgcttaa

SEQ ID NO: 25279 - DNA, 159 bp, Glycine max
  Peptide Sequence Number=SeqID_142057
atgaaagagcaaatgaccacaatgatggaagccatgatgagtatgagaaaaatcatggaggtcaacacaactacagtcgttgccgcacgtatcgccatagaagtgcacccgactcacccacctggctttaatcaagtaaatcatccagccttagatatg

SEQ ID NO: 25280 - DNA, 177 bp, Glycine max
  Peptide Sequence Number=SeqID_142058
atgacgttgccggattcctaccaccatgtcaaatatggtggtgttgatgcttcgatttttaaaattgggtttgccttattcatcatcagagatgtctcggtggacttgccagagctgttagcaccaacgattcgaggtgcaaagacaatcttgaaaaatgggtcacaaaggatttag

SEQ ID NO: 25281 - DNA, 354 bp, Glycine max
  Peptide Sequence Number=SeqID_142059
atggctacaaccaggtgggcactcaagcatcctgtttatggcattgtgatactacggttgagaatttacacagacagacccaacgtttccaagttatgttctttcatcagttcaatgaattcatccatccttatctcggacgacgttcctaaatggaaaactctacatgactccggaatttcaaaaaacactattgacaacaacgaagtaaatactaacgtaacagttcaaacgacatcttcgcatgccaccggtctcttgggacacggtaacaaaaagtggggtggtcgacaaaagcagggcttttgctcctacgtatcctcaatgtgtgatgaggaactcagacctacgtag

SEQ ID NO: 25282 - DNA, 548 bp, Glycine max
  Peptide Sequence Number=SeqID_142060
gtgaagaaactcaaagatcaatcatgttggatggaggcaaatctagcgaggaatcaaccttggcatcaagaaagggttccactagaaggtcatcttcctatgagaagttttccataaaggataaccgtgagaagtgttacatttattataaatggtcacgccatattaaggataattgttttgaacttcttgggagggaaaaggtccttgaacgcatgggaggacaccaagatcctgcacaaactttcaatacaagggatctccatgtccacggtcatcaagtcgaaccatcggatttgatatcagttgttggaaaatcgaggggtgttgttgttcagaatcaacatgcacctatcatctctataattcagtccttccttgaccatgacttgaagcaaactttgttgggttacaagttttgggttaaagtgtggtatcaagttctcttatgtggtggctcgtggtccatcggtgtaaatctccccggtgtttactcccctcgaatttccccaacaactggtattagagtcgttggttcgacttggtga

SEQ ID NO: 25283 - DNA, 2373 bp, Glycine max
  Peptide Sequence Number=SeqID_142061
atggcttctcatattgttggatacccccgcatgggccccaagagagagctgaagtttgctctggagtcattctgggaaggaaagagcagtgccgatgatttgcagaaggtggctgctgatctcagggcatccatctggaagcagatgactgatgctggaatcaagtatatccccagcaacactttctcgtactatgatcaaatgcttgatactaccgccatgcttggtgctgttccacccagatatgggttgaacaatggggagatagaattcgatacctacttctccatggccagaggtaatgcctctgtgcctgccatggagatgacgaagtggtttgacaccaactaccactttattgtccccgaattgggacctgatgtgaatttcacttatgcttcccacaaggcagtgaatgagtacaaggaggccaaggcgcttggagtagatacagttccagtcctcattggccctgtatcatatttggttctctccaaacctgccaagggtgttgataaatccttttgtcttctttctctcctcccaaaagtccttgctatctataaggaagttgtggctgatcttaaggaagctggtgcttcgtgggttcaattcgatgaacctatctttgtcttagaccttgactctcaaacgttgcaagcattttctacagcatacgcagaacttgaatctactttatctggcttaaacgttcttattgagacctactttgctgacattaccgcggaggcataccagaccctcacagctcttaatggagtcacagcatttggattcgatttagtccgtggaaccaagactcttgatctaatcaagggtggatttcccagtggaaaatacatgtttgctggagtggtggatggaagaaacatttgggctaacaatcttgctgcttctctcgatacattaaatagtcttgagggcattgtgggaaaagataaacttgtcgtgtctacctcctgctcacttcttcacactgctgttgatcttgttaatgagaccaagttggataatgagataaaatcatggctggcttttgctgcccaaaaaattgttgaagtaaatgcattggccaaggcattgtctggtcaaaaggatgaggcctttttctcttctaatgctgctgctcaagcttcaagaaagtcctctccaagagtgactaatgaggctgttcagaaggctgctgctgcattgaagggttctgatcatcgtcgtgccacaaatgtcagtgctagattggatgctcaacaaaagaagttcaaccttccaatcctcccaaccaccacaattggatccttccctcagactgttgaactgaggagggtgcgtcgtgaatacaaggctaacaagatctcagaggaggagtatgttagttcaattaaagaggaaatccgcaaagttgttgaactccaagagaatcttgatatcgatgtcctggtacacggggagcctgagaggaatgacatggtggagtactttggtgagcagttgtcaggctttgcctttaccgttaatggctgggtgcaatcttatggatctcgttgtgtgaagccgccaatcatctatggtgatgtgagccgccccaagccaatgactgtcttctggtcatccactgctcagagcatgaccaaacgcccaatgaagggaatgcttactggccctgtcaccattctcaactggtcctttgttcgaaatgaccaacctaggtacgtacaaacaaactcaagagctcagaaagagaatatggttatttctaacatggtgttaacccccatctacaggtctgagaccacctatcagattgctttggctatcaaggatgaagtagaagatcttgaaaaggctggtattactgttatccaaattgatgaggctgctttgagggaggggctaccattgagaaagtcagagcaagctaactacttggactgggctgtccattccttcaggatcaccaatattggtgtgcaggatacaactcagatccacacccacatgtgctattctaacttcaatgacatcatccactcaatcattgatatggatgctgatgtgattaccattgagaactctcgctctgatgaaaagctcctgtcagtgttccgtgatggagttaaatatggagccggaattggccctggagtgtatgacattcactccccaagaataccaccaactgatgaaattgctgataggatcaataagatgcttgcagtgcttgagaaaaacattttgtgggtcaaccctgattgtgggctcaagactcgcaaataccctgaggtgaatccggccctcacaaacatggttgctgccacaaaactcatccgtaaccagcttgccagtggcaagtga

SEQ ID NO: 25284 - DNA, 549 bp, Glycine max
  Peptide Sequence Number=SeqID_142062
atggctatcccagtaagacttttctggaagaaatgcatcaataattttccatctttcgcgtatgctcccattttcctgcaatacatctcagatttctctccaatttctcttaacactgaaggtccaacctcttcctcagcctccctcatgcctatttatagcaaaaaaagggcacttggtggacttacagctcgcccaagcgagctggttccttcacccctaagcaatttgggggcccatgagagccagaggctagcttgggagagccaagcctcctccaatgaagaaatcaagaaaatctgtcatgtctccatcatcctcagctccaccttcgtccccttaggcagctccttgcgcatctataggacctgcctcctcctgaaaattgggcctatccccaggccatgcagcagtggctctgaactgcttgggagtaggccacagccaaatgcagcacgtatgcgtgcatctagagctccatcctttgcatgtgagctgagatggactctaaggatggtggttgatatggaggcggtgatcttgccctga

SEQ ID NO: 25285 - DNA, 1836 bp, Glycine max
  Peptide Sequence Number=SeqID_142063
atgtataatgtggcctgcaaatttcacgtatttggtctgtatgatggggttattgactttagaaaacctaagggcacttggtctagaaagcatttgggcaattgcgtttttgctgtttcaaaatatgaaaattctggtttgaaaggtaatctgcaacattctgaaagattctctaaaggggctttaaatggggtggaatcctcaccagatagggtcaatacttccctgaattttgaggagtctgagattcgtcatctccgcaggttgattagaaatggggaattggaagaaggttctaggtttcttgagtatatgactaacaaaggcaaaagtcctgatgtcattgcttgcactgctttaatccgtgagttttgcaagattggcaggactaagaatgcaagtcaaatcatggggattctggaggagtctggagctgttattgatgtaaccagttacaatgttttaattagtggttattgcaaatcaggggagatagaggaagccttgcgggttctggatcgcatgggtgtttctccaaatgctgctacatatgatgcagttttgtgtagtttgtgtgatagagggaaattgaagcaagccatgcaagtacttggcaggcagctgcaaagcaagtgttacccagatgtagttacatgcactgtattgattgatgcaacttgtaaagaaagtggagttggtcaggcaatgaagctgttcaatgagatgaggaataaaggctgcaaacctgatgtggttacatataatgttcttataaaagggttttgtaaaggaggtaggttggatgaagcaattagatttttaaagaaattgccatcatatggttgtcagcctgatgtgatttcccacaatatgatcttgcgtagcttgtgtagtggtggaagatggatggatgctatgaaactactggctaccatgcttcgtaaggggtgtctcccaagtgttgttactttcaatatcttgatcaatttcttgtgccagaaaggcttactaggtaaagcccttaatgtcttggagatgatgccaaagcatggccatactcctaattccagaagtttcaatccattgattcaagggttttgtaatggaaaaggtattgatagagcaattgagtacttggaaataatggtatctaggggttgttacccagatatagtgacctataatattttgctaactgcattatgcaaagatgggaaggtggatgatgcagttgtgatactgagccagctaagttccaagggatgctctccttctctaattagttataatacagtgattgatgggcttttgaaggttggaaaaactgagtgtgctattgaactttttgaagagatgtgcagaaaaggtcttgaagcagatataattacttacaatataataattaatgggcttttaaaggtgggaaaagctgaactggctgtagagctcttggaagagatgtgctataagggtcttaagcctgatctaattacttgcacttcagtagtagggggcctaagtcgtgaaggaaaggttcgtgaagcaatgaaatttttccattacttgaaaaggtttgctattagacccaatgcattcatttataactcaataattacgggactgtgtaaatctcagcagaccagtcttgccatagattttctggctgatatggtggcaaaaggatgtaaacctactgaggctacctatactactctcataaaaggcattacttatgaaggattagcagaggatgcttcgaagttgtcgaatgaattgtactccagaggacttgtgaagagaagtttggttgaaaaagttagtctagaagtagaataa

SEQ ID NO: 25286 - DNA, 408 bp, Glycine max
  Peptide Sequence Number=SeqID_142064
atgatcactcctgtcgttgtgcgtggatatcctctagtgctttctgtgaaggagaagggagaggaaaaaggaaagggaagagacgaagttagagggaaaggggtaatagggaagggagggttggaggggaaggggaaaggaagtggtgatacacatcttgttggtctgtggcttaatgtctcaatggatccaattgttggtgatggtcaagcaagagaccatttttggatgagatccaaaacaccagtagaagattctgaagttgacacattgtctcgaattgtttatccaatgggtcaaaaggaagccaaaagaaagagcaaggggaaaagagtaggaacatctaccaatcctgtggacttgactggtgtggaggaagggaaagaaatgttctcaatgtcaaactag

SEQ ID NO: 25287 - DNA, 870 bp, Glycine max
  Peptide Sequence Number=SeqID_142065
atggagttggcgtttccgggggaggtatggaagaaattggagagtcaatacatgttgaaatcgttgacgaacaaactgtatctaatgcaaaaactgtatggactgaagatgcaagagggtgcggacctccaacagcacgtgaatgccttcaatcagattatcagtgatctggcaaggctggatgtaaatgttgaggacgaggataaaacatgtattttgttgtgttcttacgaacatttggtgacaaccttaacgtatgagaaagactcaatcactctagaggcaatacagattgcaattatgtctcactctcaagggagacagaatgcagtgggaaagataattgatgcaactatgccagtgtttgatgaagcttaccctaactccatggaggttcaggttgacctaaagcaccagccagtgattcttgagagggcagaaccatgcagtccaagacctgaggcgacacccatacttgagcctggatctatgagtctagggaaaaagttcaaggctcgcccagtagcaaaggggtatgcacagcataaggaggttgattataatgagattttcctccctgtcataagacacacttctatcagggcggtgctaaccttggtagctagtcgtgacatgcacttggagcaaatggatgtgaagacagcttttcttcacggtgatctaaaagagcaaatttacatggagcagccaaaagggttcaataaaggtggatcgaataagctagtttataagttgaagaggtctctatatggattgaagcaatctccaaggcagtggtacaagcgatttgattcctacatgcttcagattggttacaggcaagtgagtatgactgatgtgtttatgtga

SEQ ID NO: 25288 - DNA, 704 bp, Glycine max
  Peptide Sequence Number=SeqID_142066
atggacttggtggtaccccatatacagttttgctcatataaacacttctacccagaaagctatagcactggttctgcattcaattcggtgagggtatgcaatatggcctgcaaatctcaaatatttgttctgcctgatcatattagggttattgattttagaaaacccaatggcacgtggtctacaaagcatttgggcaattgcgtgtttgctgtttcaaaatatgaaaattctggttcgaaaggtattttgcaacgttttgaaagattaccgaaaggtgctttaaatggtgtggaatcttcctcggcaaatggggtcaatacttccctgaattttgaagaatctgagattcatcatctccatgtgttgattaaaaatggggaattggatgaagcatctaggactaagaatgcaactcgaatcatgggaattctggaggagtctggagcagttattgatataacaatttacaatgtttttgattggaacattggtggggtagatgctgatctgagttgccccatgtgccacggcgacgatgtaacaaccactcacctcttctcctgcaggttacggtcactggatgacattttggttagtggttatttggttgatctggttgcagaggaacaccatcattttccgcgggaagcaggcttgtgtgcaggaggttgtgattcgttgtgttcaaaacgtggagctgg

SEQ ID NO: 25289 - DNA, 162 bp, Glycine max
  Peptide Sequence Number=SeqID_142067
atgacagtgagagatccatggacatggaaatctcttgtatcgaaagtcttcctggtgagtgagtccatgcatgtaggccaggcttcagggctcgcaggtgttgcgacggagcaagaaattttcacaaagttcattagtactgctactcttggagatcattga

SEQ ID NO: 25290 - DNA, 315 bp, Glycine max
  Peptide Sequence Number=SeqID_142068
atgtcatccagtgaccgtaaccttgatgatgccagaagtatgcacaagaactacctggtagcacctgctcaaacccaagccgctggagaagaggtgagtggttgttacatcgtcgccgtggcacatggggcaactcagatcagcatctaccccaccaatgttccttcagaacagagcttctctggtctgagttctattaaggatcacctgccacccaaaaacaatgaccttcaaaggtgctttcgctctccacaacacatcaaagagcttcatgataacaccaatcaaaaacattgtaaattgttatatcaataa

SEQ ID NO: 25291 - DNA, 399 bp, Glycine max
  Peptide Sequence Number=SeqID_142069
atgatgggggaagaactgtcaggcttgacagtcaaagaattacaaaatttggagaaccaattagaaattagccttcgaggtgtccgaatgaaaaaggatcaacttttaatggatgaaatacaagagttaaatcggaagggaaacctcatacaccaagaaaatgtggaactgtatcagaaggtaaacctaatctgtcaagaaaacatggaattgaaaaagaaggtctatggaacaaaagatgataacaaaacaaacagagattctgttctcacaaatggtctaggcataggagaggatttgcaagtgcctgtgaatctccagctaagccagccacagcaacaacactacaaggaaccttcaggaactacaaaattggggtatgagctttcaatcatttaa

SEQ ID NO: 25292 - DNA, 975 bp, Glycine max
  Peptide Sequence Number=SeqID_142070
atgaaggtggaagaagaagaagaaaagcctggcgggagagaagaagaaaagaagcgctgggtgcacgagatttttaaaaaaataaaagggcaattttgtcttttcgctttaagtgctgggtgcaccagcatagcaactcccttaattctattgtctttgtcctactatgaagggttcgattgcagttcctttgttgtctcgtcagtagtggaagttgtgaagaacgttgaaggtgaaggaggaacagcgagcgagcgagcaatgtacaaaacgaggttgcaggaattgtgtcagagaaggtcatggaccttacctacctacgacaacagcagagaaggccccgatcacaaccctcgcttcacttccaccgttaatgttaacggcgtctccttccacaccccttctcccacccgcagcgccaaacaggcccaaaacgacgccgccatgctcgccttcctccatttctccccgccctcaccgtcaacgtcatgtcccacttttcctcaacactctctctccatttcggctctttcttcttttcctcagccttctcttttcgcctcatcttctggttcacctgatcccagctctgttgttgatgatatacttctcacaaatggagtgttgcaacctaaattagaagaagtgtgccaaacatctcaaatcagtggccctgtaatagctgttagagatacgataacagcagaagatcaaaaaaatatgttacatttgtacaagaaccagctgcaaagctatgttcaaaagaacaatctaagtcttccagtatattcttctgagtgggagggtcctcctcatgctatgcgtttcaagtgcaaagtcactgttgatggacaaacctatgaaagtgacaagttctattctacgttgaaggatgctgaacatgcagcagctgaagctgctttaatatcattatcaccaggcagagttcaagaggctagtcttagtcacttgtag

SEQ ID NO: 25293 - DNA, 1878 bp, Glycine max
  Peptide Sequence Number=SeqID_142071
atggttaagactagagggttaggttgtgtgttaggtagggttgttgctagaggtctggggagagaaggggatggtgatgatactgacggtgctccccagcgccgaaggccgaccgcatcggcatgcaggcgacgggtaccagtcattattgatgatgttgtgcctgtggtgcctacggacttgcctgcggtaccagaggcagaggctgctgtagctggggatgagcccatggataccggtgcacaggatattggggatgagcttgagggatttcctggtggacccagggacccatcagtgcttacaaagtatgctgaccatgttgcgccaacgtatggtctggacagacctgttcctgcaattgaggacatggttgctgggacaggattaagtcctttgatcgcgtgttctattgacactggcgatcagggacttatatcctcctttgttgagaggcatagtgtgcatcctggtcattttgtgcattttgagcatttcgagcattctgagtattttgttgctggtgattttgaatattttgattttgagcattcgactactaattttcatactgagaacatggctcaacctccacctcgtgaaaggactcttagggaaatggttgcacctgatttcatttatgaaagcttgtgtattcaatatcctgatgagtgtgttccatatgttctcaagactggactaatacatttgttgcccaagtttcatggtcttgcaggtgaagatcctcataagcatcttaaggagttccatattgtctgctccaccatgaaaccccctgatggagtggcaaaagattggctatattaccttgctcccaggtccattttcagctgggatgaccttaagaagacttctagtttccaccttcctgtgggggagatctcgatcatgctggacgatgtcgcggctcttctccatctgccgattgtggatgcattacatgacttccagcctctacgcaccgacgaggcggtgctgctcttggttgagttatttatggtctcaccagaggtggccatggccaagacaggccaatgtgacggaccatacgtgtgcctgcagtggctgcgagacatataccagtgcagatgtcagacgcggcactggacagctgccgctcgtgcttatcttttgcatcttttgagttgcactctctttgctaataagagtacaacctatgttcatgttgtacacttacaggccctgtgtgacctcactcttgctaggcgtctcaacaccaaccgacagcttgttggttacatcaccttgttacagtgttggatatacaagcactttctgtcagttgtggagtgcaatgctgatccagactacgacgaggtgtcaccacgtgcgtgtcggtggattgcgacaaagaagactatgaagaaggtgtccacagcgatgtacaggcagtgcctggatcgtctgcagatcccacatgtccgctgggggcctattgttgtcaaatacagactgaagagggttatgcgccagtttggctacatccagtgcattcctgcacaccctgtccatccatgggtgtcatatgatgacgtagacgatacgtggacacactactcagaccatttggcgacagcagatgatccatgtgttgtgccaggtcccaaagtcagatatccctcaggtccagagtcagatatccctcaggtctcggatgatccagtcaggtctgatgtcgacgagcccagacatgcagtggaggcttgcgatgcgatcgccgagagattggagcgtcaccttagccttggggtagtcacgtcaggcacatcgacatatgaggtcatcaaagaatgcctcaagattgccaggagtgtcactcaggatcacattgtgtac

SEQ ID NO: 25294 - DNA, 249 bp, Glycine max
  Peptide Sequence Number=SeqID_142072
atggagaaaagttcatcatctcctagaacaggcttgctttcgtgtttggggtgtctcaaattgaagcttccttggacaaggagaacaagcacttacaaacccgttggtggctttgggtatgaccctttaagctatgctcaaaacttcgatgagggttgcatggacgacgaggaagaatctacttcgcgccgtagattctcagatagatttgctgctccctcatcaagttcaactaaaactctcaaatag

SEQ ID NO: 25295 - DNA, 272 bp, Glycine max
  Peptide Sequence Number=SeqID_142073
gatgcgtgtgtggccatagagggtgggccgggggactcgtgcttcaggaactggggatcgaggttctcaagctgccgaagcttggacttcacagccttgacggcatgatcatagatcatggcggtggggggaagaggggcgggaggcggagggagccacaacagcggaggcaaagagaggagagggcggaggcccgcctatcagagcgatgggccacagagaggaggcggttgagggacatggcttggctccgcactcgcaattgggtctag

SEQ ID NO: 25296 - DNA, 1152 bp, Glycine max
  Peptide Sequence Number=SeqID_142074
atggccatggctcttcgcagactcaacaaacctttctccaacgccacttccatttatcgccagtcctcttcgctctccgctcacgaaaaacacaaatctcgcgccgattggataaagcagctcaacgatcctctcgaggccatcgatcccgagatcgccgacataatcgaactcgaaaaggcgcgtcaatggaaggggttcgaacttataccttcggaaaatttcacgtcgctgtcggtgatgcaagcagttggatcggtgatgacgaataaatacagtgaaggatatcctggtgctagatactatggaggaaacgaatacattgacatggctgagaccttgtgtcagaagcgtgcacttgaagcttttcagctggatccagcaaaatggggagtcaatgtgcaatcattatctggatccccttctaacttccaagtttacactgctttattgaaacctcatgagagaattatggcacttgatcttccccatggtgggcatctatcgcatggttatcagactgacaccaagaagatatcggctgtatctatattctttgaaacaatgccatacagattgaatgagagcactggttatatcgattatgaccagttggagaaaagtgcagcactttttaggccaaaattaatagttgctggtgctagtgcttatgctcgcctttatgattatgcacgtgttcgcaaggtctgtgataagcagaaggcagttctgttggctgatatggcacatatcagtggattggttgctgccggtgttattccttctccttttgattatgcagatgttgtaacaaccacgacacataagtcacttcgtggaccacgtggggctatgattttcttcaggaagggtgtgaaagagataaacaaacaagggaaggaagtgttgtatgactatgaagacaaaataaaccaggctgtttttcctggacttcaaggtggtccacacaatcacactatttcaggcttagcagttgcactgaagcaggctatgacaccagaattcaagaattaccaaaagcaagtacttagcaactgctcagcatttgcacagagtttgttagaaaaaggctacgaacttgtatctggtggaactgacaaccatttagtgttggtgaacttaagaaacaag

SEQ ID NO: 25297 - DNA, 1717 bp, Glycine max
  Peptide Sequence Number=SeqID_142075
tgttgttgaaacacctaatgttgatgtagcactcacagaaacacaacaaaaggagttggaaggactgaagttgaaaggtttaaaggaaaaaaattacttgtttcaggccattgatcgctctatcttggaaacaattctttgcaaagaaacttccaaagatatttgggattcaatgaataaaaaatatcaaggctctaatagaacaaagcgtgcacaacctcaagccttgagaaaggaatttgaaatgttacacatgaagagtgatgaatcggtaaccaactattttgcaagaaccatgacaattgcaaataaaatgtgtttccatggtggaaatatggaagatgttgttatagtcgagaagatcttacgttccatggcaccaaagtacaactatgttgtgtgttccattgaagaatccaaagatgttgatacactctcccttgacgagctccagagttctttgctgattcatgagaactcacaacagcctatacaccacaacaaaatggtgtatcaaagaggaagaataggacaattcttaacatggcaacaacctacccaagtatttcttgatgaaaatgacgagaaaggacaaacttcagcctctggtacatctgaaagaattgctccaatagtcactgaaacttctccaacaaacagtgacaatgaagaagaactacctccccgtattagaaaaagaccagcttggatggatgactttcttgtaactggaattccatattcaattactcactttgctttgttttcagattgtgatcctacaacttttgagagtgttgtcaaagaagagaagtggcaaaaaacaatgaatgatgaaattgatgccattgaaagaaatgatacttgggagctgtgtgatcttcctaaagaacacaaaaccattgttgcaagacatgacacaatcagattgatgattgctttagcaacacaaaattcatggcccattttccaactagatgttaaatcaacattcttacatggatacttgacggagcaagtctttattgaacaaccaccgggttatgtcaagattgaaagtgagcataaagtttacagattaaaaaaggccttgtgcgggctgaaacaagccccacgtgcatggtatagttgcattgaagcttattttcttaaagctggtttcacaaaatgtcctaatgagcatacactctttgttaaaagcgaagataaagactttaagaaatccatgatggatgagtttgaaatgattgatcttggtatgatgcattactttcttggaatagaagtgaatcaaatagctggtggaatctttatttgtcaaaagaaatatgtgggagaagttttggacatgtttcagatgaaggattgcaatccagcaaacacaccatcagattttagtttaaaacttcacaaggatcttgaaggaaagaaggttgacagcacactttacagacaaattgctggagatcaagatgatagaaagagtacttctggttatgtctttgtgttgggaaccagtgccatttcatggttatctaagaagcaaccaatagttactttgtcaagcacagaagctgaatttgttgctgctacagtttgtgcttgtccaaccatttggttaaggagaattcttgaagaactgaagttcaaacaaccggggaatgaagcaatgatggcaccattgatctacaatattgtaaaagcaaggatcagatag

SEQ ID NO: 25298 - DNA, 441 bp, Glycine max
  Peptide Sequence Number=SeqID_142076
atggcaagtcagataagagttcttcatttccattttcaactcataaaaggacaggctccggagttctcgtctgaccactctgagtcaaatgtggtaactgctctgcaatacaatgctgatccaaattcacttgtagaccctggattagtcacctggaatcaacatagcaaagataaattgaagaatgtatcgtcttcatctgaaaatacgaatggctgcacagaggattcttccttgtcaagtgacaagtctgcaccttcactctctggcagcaccaaagtggtttctgactcaagtaacacgtattcaactgcagtagaacgggtcgttgtttactcacgcaagaccaatgtggaaattgaagatggtggcactatattgccgattagcgatgacaggaaactgaagcagattagttattattctgtcatcaacagctag

SEQ ID NO: 25299 - DNA, 1140 bp, Glycine max
  Peptide Sequence Number=SeqID_142077
atggagataacgaacatccatatagataatgaaccatcaatccatgtagagcacttctttgatattcaagaacttgaaaaagttggcagcacttatcatgagggatggagaggcttaagactcccatgtaaccaaggctctgtacaaagaaaatgcagagaaagtggagtctatcatgtatttgattggatgaacaaggactcaaagcacaccatcatagttaaaggcttagttgttgctaagcaacataagttcaacaaaaccaactttaaggctatgaaggttgtggtgaataagtccctgaagaaggtaccccaagtggacgaggagaccatcaacagaagaaaacaaaaaaggctggctaaagctatcactgatgaagacaagagcttactcagctttagcattgccaagaagatctataaaagaatggagcacaaaacgatgaaaaggcagaagccgactggtgcatccatcccttctcgtttagccagagaaaagatagctcctcaggggttgaaagacctcaatgaaactgatgatgaagaagaagacaatgtcaagccatatttcgacccgaacgttttcgggatgcccccaataaccaacgaatggaaagtgcgccagtccttcatcaattgcttaaagaaccttcccattgtattccatgagactacttacaatctctccaagatggaagaacaagcattcatagaccatcaagctgctatagaccaaaccaaggttgtatatgacaacattgtaaataaggttattattgatgtgactgacactgttgttatagaagaaatccttgaggatgcacctgacgtcatcatcatctactccacaagttcaagtcctactgctcttaattatgctccccccactattgagaatgagcaatttaggttgtccatgcaaaatgccattaccacacaattctccaaccttggtgttacactgcttcaaaacttacaacaagcccaaatgccaatgttgggttatgttgctactcctacacctattgttactacacatgcacttgctcttatccaacaaccaccatttgttgagcgaacaccacacctaccaccatcttcaacactaccgataccaccacctgaagttcaaaggtga

SEQ ID NO: 25300 - DNA, 1926 bp, Glycine max
  Peptide Sequence Number=SeqID_142078
atggaggatgctcgcagggtgtttgacaacatgcttagaagaaacgtggtggcatggaccacgttaatggtgggttttgtgcagaactcacagccaaagcacgccattcatgtgtttcaagagatgttgtatgcaggaagttacccttcagtttatactctttctgctgttctacatgcttgtagttctttgcagtctctcaagttaggagatcaattccatgcttacataatcaaataccatgttgactttgacgccagtgttggcagtgcactttgtagtttatactccaaatgtggcaggttggaggatgctcttaaaacatttagtagaatcagagaaaagaatgttatttcatggacttcagctgtttctgcttgtgcggacaatggtgcacctgtgaaggggttgagactttttgttgagatgattgctgtggacataaagcctaatgagttcactttgaccagtgccttgagccagtgttgtgaaatcctgtctttggaacttggaactcaggtttattcgttgtgcattaaatttggctatgaatcaaacctacgtgttagaaattctttgttgtatttgtacctcaaaagtggttgtattgttgaggctcataggttgtttaatagaatggatgatgccagtatggttacatggaatgcaatgattgccgggcatgcgcagatgatggaactcacaaaggataatctttctgcatgccatagaggaagtgaagcactgaaacttttctccaagttgaatctatcaggcatgaaacctgatctgtttaccttatctagtgtcttaagtgtatgtagtagaatgctggctatagagcagggggaacaaattcatgcgcagactatcaaaactggattcttatcggatgtgattgtaagtacttcactgattagtatgtacagtaagtgtggaagcattgagagggctagcaaagcatttctggagatgtctactagaactatgatagcatggacttctatgattacaggtttttcacagcatggtatgtcacaacaagcattgcatatttttgaggatatgagcctagcaggagttagaccaaatgcggtcacttttgtgggtgttttatcagcatgtagccatgctggcatggtcagtcaagcactcaactactttgagattatgcaaaagaaatataaaattaagcctgctatggaccactatgaatgcatggttgatatgtttgtgaggttaggtcggctggagcaagctctgaatttcattaagaaaatgaattatgagcctagtgagtttatttggtcaaactttattgctggttgtaaaagccacgggaatctggaattggggttttatgctgctgaacagttactaagtctcaaaccaaaagatccagagacttatgtattgttgttgaatatgtacctctcagctgagcgttttgaggatgtttcaagggtgaggaagatgatggaagaggagaaagttggaaagttgaaggattggagctggattagcattaaagacaaagtgtattccttcaaaaccaatggaaaaacacacccacagagttctctaatatgtaaatcattggaggatttacttgccaaagtaaagaatgtaggatatgagatgctagaaagtgtggaaataagtgatgaagaggaggaggaggaaaagacatcatcccctaacatttatcacagcgagaagctggccattacatttgggttggagaacttgccaaattcttctccaataagagttgtcaagagcaccttaatatgcagggatagccataactttattaagtatgtctcaacactagccggtagggaaatcatcgttaaagatagtaagcggcttcacaaatttgccaatggagaatgctcatgtggaaattttggcggttttctctaa

SEQ ID NO: 25301 - DNA, 300 bp, Glycine max
  Peptide Sequence Number=SeqID_142079
gaaccccctgctctcacatctaggggatttgttgaggaagattttgaaaaagtagctgaatactttgatgcggctgtcaattttaaaagcatagccagtgtcttaacgttacgtaaatcacttttcttcttgatggttacatcaacttcaggtacaaagttgaaagattttgtggcagctatgcaatcagatgaacaaattcaatctaagattgctaatctctgtcatgaagttgaggattatgctaagaagtttcccactattggttttaacatagaaacaatgaagtatggtaagtga

SEQ ID NO: 25302 - DNA, 1065 bp, Glycine max
  Peptide Sequence Number=SeqID_142080
atggattctcgcgactcctccccttgctcccgcgaccccgacgccgccgacaaccaccaccaccaccgccgcccttccttcgacgacgcccctcccaaggtcaagctcatgtgcagcttcggcggccgcatccagccccgcccccacgacaaccacctcacctacgtcgccggcgacaccaagatcctctccgtcgaccgccacgtcaagttcccctccctcatcgccaagctttcctccctcgccaacaacgccctctccaaccattccttcttcaagtaccagctccccggcgaagaccttgacgccttaatctccgtcaccaacgacgacgacctccaccacatgatgatcgagtacgatcgcctctcccgctcctcatctagacctgcgcgcctccgcctcttcctcttccccctccacaacaacaacaacaacaatttcgctccaaccgaattgaaatccgagcgccagtggttcgtcgacgctctcaattccgttcacgttccagaagattctccggctccgccgccgacggcgaatccggattttctgttcggcctcgagaagccaccggcggaggatgctccggcgaaggattcggagtgttttcccgaggatcgtgaagccgaacctgagattcagaatgagaataacaatgagcaacggaaaatgaagacagaggaagataatgataacggtagggtttacggtgttaacggcggggactgttttgttcagaagaacgcggagaaagtgacgccgttagtggcgcattcgcatgcacacgcacacgcgcaattcgttcatcctggttcggttactggaactggaacaggaacggtgtcgtttatgcaggagaggaataataacgcgggttattcgttggcggttcctactacggggaatgagatttatctcattcacacgccttctggaatgtttcaagcggttcggcccatgactggaccggttgggcagccggtttatctggttcacgcgcccggtccggtttcgcattcggagcttggagcggcggtgggacgcggcggcgcgcggtggtga

SEQ ID NO: 25303 - DNA, 806 bp, Glycine max
  Peptide Sequence Number=SeqID_142081
attgggaccaacacttggctgggataggaggtagaatagtcaactggtttccacgatggaaagaaggaaaggagggagttctcttctcatgtgggggctacccaaacatcccgctgataggaacgaggggttgcattaactacaatcccgcacttgctataagacagttagggtacctcatgaggggagcaccgacggaagaaagcctgtctcctttccttgtgagagattttggcgcgcaaaatttcaaggttatacaaagagtccataaggcgtgggaaagcccgttaaggaaagataaagaacttaggggcattcgtaatggcatcattgggggttatcatgaatggctgaaagtttgtacacggggtttagattggctcttcaagttaaagattatcaacaaagagaacttcgaagctccggaggaggatgaagaagtccgagctctgaaaaccgaactaggaaaagcgagacttgccaaagaaaaattcaagttggtcgctacagacgtccggaaagagtgtgccgggttacgagaagaaaatgcagctaccgcaaaagcccttgaaaaagaaaccaagagggctcgcaaggaagagcatggccgtgacaaattccgtggagcattgtgggggcagcaacagtccaaaagaaacttgtctcagcgtttatgcgagacagagaccaacatgttagctatcatcaccaagtaccaagaagaactaagtctagccatggcccacgagcatagggtggtggacgagtatgcccaagtgtacgcgaaaaaggaggctagaggaagg

SEQ ID NO: 25304 - DNA, 1062 bp, Glycine max
  Peptide Sequence Number=SeqID_142082
cacgaggaggtgctgcggttctggttcgaccgcggcgtcgcgggggtccgcatcgactccgctgcgctgccggtcaaggatccggcgctgcccgatctcccggtcggctcggcccctgtcgtcgggcatccgcacatcgaccgcgacgagctgcacgacatctaccgcgagtggcgtgcggtcgcggacgagtatgacggggagcgggtgctcgtcggcgaggtgtggctcgacgacgccgagcgcttcgcccggtacctgcgtccgggggagatgcacaccgcgttcaacttcggcttcatgacgcagccgtggagcgcacgcgcgatgcgcgagtccatcacccgcacgctcgcagagcacgcaccggtcggcgcgccggccacctgggtgctgtcgaaccacgacgtgacgcggccggtcacccggtacggcagagccgactcctcgttcgcgttcgaccgcaagaggttaggcgtcgcgaccgacctcgcgcgcggaacgaaccgggcccgcgccgccgcattgctggtggccgccctgcccggcagcctctacatctaccagggcgacgagctcgggctgccggaggtggagctgccgctggacgcgatcgaggacccgatgcacttccgctcgggcgggatcgaccccgggcgggatggatgccgcgtgccgctgccgtgggcaggcgcagcgagcccgtacggcttcggcggatcgccctggctcccacagccggtcgactgggcgccgctgacggttgaggcgcaggaggcggatccgagctcgaccctgaacctgtaccgcgaggccattgcgctccgccgccgggtcgccgacctcgccggagagcagctggagtggctggagctgggtgccgacgtgctcgccttccggcgcggcgacggcaccgtcagcatcaccaacctcggcgcagtgccggtgcccttgcccgcccaccatgaggtgctcctcgccagcgccccgctggacggtgtgcttccccccgactgcacggcctggctcgccctccacgccgcccccggacgctcctcgtga

SEQ ID NO: 25305 - DNA, 135 bp, Glycine max
  Peptide Sequence Number=SeqID_142083
atggagttcctggagctcaagcatgggaacatgactgtggctgaatatgcagccaagtttgaggaattggtaagaaagggcatattcagagagattgcctatatcccaagaaggagcggaatggtgtgggcctga

SEQ ID NO: 25306 - DNA, 1120 bp, Glycine max
  Peptide Sequence Number=SeqID_142084
attcagagggctacacgtcctcaccttcataggagtacacgtactcgccatcagaggggtgcacgtcctccccatcaaaggactacacgtccttgccattagcggactagacgtcctcgccatcagaggactgcacgccctcaccttcagaggactacatgtcctcgccatcaggggactacacgatgtcgcctttagagggctgcacgccctcaccttcagaggattacacgtgctcaccttcagagggctgcacgccctcaccatcagaggactacacgtcctcgcctttagaaggcagcacaccctcgccattagaggactacacatcctcgcctttagaaggcaaaacgtcctaacctttagaggacttcatgtcctcgcaatcaaagggctgcacgtcctcaccatcagagggcagcacgccctcgccatcaaagtgttgcacactctcaccgtcagaggactacacaccctcacctttagaggattacacatccacaagtttagagggctgcacgccctcactttcagaggactacaagtcctcacctttagagggctactcatcctcaccttgagaggaccacacgtcctcgccttaagagggctacacgtcctcaccttcagaggactacacgacctcgccatcagagggttacacgtcctcgccatcagagggctgcacgccctcgccatcagaggactacacgtcctcgccatcaaactgctacacgccctcacctttagaggattacacgtcctcacctttagagggctgcacgccctcaccttaagaagactacacgtcctcgcctttagaatgctacaagtgctcacctttagaggactacacgtcatcgccatcagagggctgcacgtcctcaccatcagagggcaacacgcccttgccatcagaggactacacgtcctcgccatccaagtgttgcacgctctcacctttagaggactacacaccctcaccttcagaggattacacgtccacacgttcagagggctgcacgccctcaccttcagaggactacaagtcctcacctttagagggctactcatcctcaccttgagaggactacacgtcctcgccttaagagggctacac

SEQ ID NO: 25307 - DNA, 249 bp, Glycine max
  Peptide Sequence Number=SeqID_142085
atggaggattgccttgagggtccgcacttaggcaatcatgaaacacggctccaaactcgaaagtggaggacacatgaacgaaaacgcaattcatggagctccggaaaagggggagaatggaggattgccttgagggtctgcagtcaggcaatcatgaaacacagctccaaactcgaaagtggaggacacaggaaccaaaacgcaattcatggagctccgaaaaagggggagaatggaggattgccttga

SEQ ID NO: 25308 - DNA, 650 bp, Glycine max
  Peptide Sequence Number=SeqID_142086
gtcaacaaagtgcgatccatcttactgggagtatgtagatgcttttcattctacgcaaaatagcaattcgtcagtgaagcgtagtgcatcatcttttgagcaacccaatccaagaaggatcatgcctatgttggatcaatttcagccatttatccacgacttcattgacaacattattgatgtccaagctgatggaaactatgggtattggtcggtttccggtttattaggtatgggtgaagactcttggtcattggtccgcacccatttgcttatagaacttggcaaattcttagaagactatatcaagctctttggtggcacggacaaatttgaggaattaaggatatcactacatgttgatgggttaaccaaggtcactatggataagtggatggatataaccgacatgggatatgtgattgcgtcaagtgttggtctgattgagttattatgcaccattggtagaacaccagatggtatattaaacatacttgaagccactatgacccctactcgtcaaaatgagtttgttggttacttgctcacaggaataaatcccaaaaagtttgacattccttccggatgtaccatggatgaaccgaaggatttgatcaagcaaattgcgcctcatgggattcccccttatg

SEQ ID NO: 25309 - DNA, 432 bp, Glycine max
  Peptide Sequence Number=SeqID_142087
atggatcaaggaaggaggaaaagtatgcttagaggggtggttgttgatggggtttgggaggagaaccctactcttgttaaggagaaaggggaggaggtgaagcttaactttgatgggattgaattctctcgaatttctatggaggataacctaatgttgacttcacctttcgaggaattggaatttaaggaggctacttgggatagtggaggatcaaaaagcccgagatcaaacggatgcaacttcaatttcttaaaagctttttggggtactttgaaaggtgacatactcggatttgtccaaggattttatgctaatggtgtgtttcctaaaggcaccaatgcgtctttcgtctccttcattccaaaggtggatgaaccccaagggttaggtgaatatagacctatatccttggtggcggtgcatgtataa

SEQ ID NO: 25310 - DNA, 210 bp, Glycine max
  Peptide Sequence Number=SeqID_142088
atggcgacgttcgaactgtaccgcaggtcgacgattggaatgtgcctgacggagacgctggacgagatggttcagaacggcactctaagccccgagctcgcgattcaggttctggtccagttcgataagtccatgactgaggctctggaaacgcaagttaagagtaaggtctccatcaagttggttgtagttagggttgaagtgacttga

SEQ ID NO: 25311 - DNA, 297 bp, Glycine max
  Peptide Sequence Number=SeqID_142089
atgcaggagtggtgcaacatgatgcatggaggttcatgggtcacgtggtggtggtgggtggaagcacagtggtgggtttggtgtggtgtggaggtggtgttggatggttgtggtggtggtgtttggggggaggttgggagccacggtcatggagtgtacttcatcacaaaaatcctgtgtattgagataccgaggataaaaacaggtcatatggccacacatccaattttgaagactccctactcctcataccaccccataatttacgaggtaatcagcaaagactggttgggttag

SEQ ID NO: 25312 - DNA, 299 bp, Glycine max
  Peptide Sequence Number=SeqID_142090
atgcataaggcattgcgattaaatgctcttttgccctatcctcacttagttactttgttccttcaacattttaatatccctcttgattttgaaccctatgttccaatcaagagatctttcttaatcggtgctgatgtggttgcctcctttggttaccgcaaaaagcgtgatggctcttgggtaaaaaagggtgctcaaccaaatgatgatgaaggacacttactggttgaaggggactcttctctccttcagagtaatttggataggtttgatggacttcaaacctgtgttggtgagag

SEQ ID NO: 25313 - DNA, 363 bp, Glycine max
  Peptide Sequence Number=SeqID_142091
atggaagctgtttcggatcaagacactagtatatgcactcactgtgatcgggctattcctgctgcaaatattgacttgcattatgctcattgctctcggaagcttgaaaaatgcaaagtttgtggtgatatggttcccagaaaaaatgcggaggatcactatctaagcacccatgcaccgctctgtttagtgcatgttgtttctacttttcacagtgttggatcctcgtcaagagagaagcttcagattgtagcttttacattttaccttaccattgacgtgaaacagaccccagatgcacatatgcaagaacaagcagctaggaacccagaacgggttctgagttcttacagagaaagctga

SEQ ID NO: 25314 - DNA, 315 bp, Glycine max
  Peptide Sequence Number=SeqID_142092
atgttgaggcaactaccgaagtttcaaagactttcaatgaaaaaaattagaaagtgctctgacatgacactactatcatatgcctatgctggaattggaaatgttctcaaggttaaaaatctattgggtcattgttcacaacatcttgataaaggtgaaactcaccaaggtcctattgtgcttggaattgctatggtagctatggctaaagaattgggagttaagatggaaattcgattagaacatcttctacaatatggagagcagaatattcgacaagcagttcctttagcccttggtctactctgtatatga

SEQ ID NO: 25315 - DNA, 300 bp, Glycine max
  Peptide Sequence Number=SeqID_142093
atgattacctcaaagaaaccgcgaaaggaggattggaggcaagcaacatattgtttcgagttgagttttgaagattccgctccgattaaattgttcttctccgtgcggtggtccggcggcaagcaaaggtggctcgtggcagtcaccggtggtcagtggtggtggaggagaaggttggggatgtccggggagggtttaagggaagagatggagagttgggttgcaagcctacaatccaaatgtgaaggcaatccaacggttaacaaatccaggattgcggttttagtggaacatgtttag

SEQ ID NO: 25316 - DNA, 1059 bp, Glycine max
  Peptide Sequence Number=SeqID_142094
atggtagaaagacctaaccttgcaacccaacatctcttggatcgtatgactattgtactaaagactctaatacatgatcgcaaggctagacctgttgagtatcatgggttgtccacttttaccaagcatggtccacctaggttcaaagggggttttaacccgaaaggagctcaactctggctctcggaaattgagaagatctttgcagtcgactgttatgaggagcacaaggtgacctatgccacctacatgctaaggggtgaggctgaggattggtggatttttgccctacagacattgccagctacagatgatgaatttctggagttaaaacaagggaatataatcatcagagagtacgcttctaagttcaatgagctgatgaaattccaaccgcactacaagaagggtgagaatgatgaggacatatgtactcagtttgaaaatggactgagggctaacatccaaactacagtccacagaggaatgatagaaagcatcatggggatcacaagaagccctactacaagtcaaattagccttctgggagaagttccgaacaaaggaacaatccagtgggagggttcaacaagcctaacaacaacaataatgctattaagtgcttctagtatggaggaccacatcaaaataaggaaggcgctcagcctgaacagtagtgggaagctaagagtggcagagaaagtttttgctatgtgtgcctatgaggttatggcatttaatgactttatccaagggttatccttatcatctttgccttatgagattgtggtagcaacccctaccaatgagcctattactacttctcatgcatgtctagattgccttgtatggattgaaggtaggatcttttttgtgaacttgatttttttgcctctttcgcatcttgatgtgatgctgggaatggattggttatcatccaatcatatccctcttaactgtaaagacaaaaccttgatatttggagcttctactccaagttctctacgatctaggagtttagaaaccgtcaaggatgaagtagtaaatcatgttatataa

SEQ ID NO: 25317 - DNA, 237 bp, Glycine max
  Peptide Sequence Number=SeqID_142095
atgtgtcctccaccttcgagatgggagctatgtttcatgattgcctatgtgcggaccctcaaggcaattctccattctccccctttatcggagccccatgaatgttattgccgagagctgttcatgtgtcctccaccttcgagattggagctatgtttcatgattgcctatgtgcggaccctcaaggcaatcctccattctccccctttttcgagccccatgaatgttattgcctag

SEQ ID NO: 25318 - DNA, 198 bp, Glycine max
  Peptide Sequence Number=SeqID_142096
atgtcaagagttggaggagggaatgaggagggaaatgacactagagagagcgttgggaatgccgttactccccaagctgataaccaacaacactttacgcattcacatactaatgctagcaaggataatgtgatcacactgtttactttaaaaatgggactttactatgtaagtaatccatcaagtgctaagctctag

SEQ ID NO: 25319 - DNA, 387 bp, Glycine max
  Peptide Sequence Number=SeqID_142097
atgcagcgcggctgccagtacagcgcgaattttgatccaaaactgaaggcgtgggcggatgaaaccggcataaaagtgtatccgtatacgcttgacggctacggcgacacgtccttcccggtggcgctcattccgcgtaaagccgggccgaacgagcccatcgccggcgagatcctgacgttcttcggcaacggtctgcccatcgcgacgccgaccacctttatggtcaacgtgaataccaacatggcttatccgctttatcagggcgacaccgacataggtacggtaagccagcgcctcgcgcagatgatcgaggccgacattgaccacctgccgcccgacacgctgggcccggtaccgagcagcgcctcgctgaccccgcagtaa

SEQ ID NO: 25320 - DNA, 294 bp, Glycine max
  Peptide Sequence Number=SeqID_142098
atgttcttccacgttcagctgcagcattttttccggcgtaagggccctgaaaagggtatgcaggtgcgtgccggggcggtaaaggccgcggtcagtcatgaatccgtgccggcgcagcgtgatgctgaccagcgcgccgcagccaaagccgccggcaagggcaaacagaaacagcagcgggtagagctgcagcccgctcagcagcagcgcatcggtgccgtaagcgacactggggggcaggcgggcaaggtcgcaggcaagccaggcgtaaatcccggccgccgccagcattga

SEQ ID NO: 25321 - DNA, 222 bp, Glycine max
  Peptide Sequence Number=SeqID_142099
atggatgcttggaccaagaaatccaagctagcagtttttctagcgggatccaagtcgaaggaacatctgaccaagaacttaaaagaggttcttcaactacttcaagaccaagaagaagaagagtcttcgttaaagaaagaagacgccaagtcggcaaactcttcagatgatttttaccagaacaaagatgattgttttgctataaatttagttgaagattaa

SEQ ID NO: 25322 - DNA, 393 bp, Glycine max
  Peptide Sequence Number=SeqID_142100
atggatcgagttacatcactgcttcgtctactgccaaacacatttaggactgttgatgcccttgttacttccagtttcaccttgacgaaggccgacatgaaggcattgaaagagcaaatgaccataatgatggaggccatgatgagcataaaggagataatggaggtcaatgtggttgcagttgctgctgccagcgctgttgctaaggtgaacccgacgcccccatctggcctcaaacaaatgaatcctccaaccttaggtatggtaggcaaagatttgggaagtacgggcggcccccattatgtgcaaattcaaaacaagcatgccttctcgccatatggcttgcctcctaactatacaccacccaatgtggcatacactcccaatgagaat

SEQ ID NO: 25323 - DNA, 318 bp, Glycine max
  Peptide Sequence Number=SeqID_142101
atgaactcaataccaactctacttatccttatctgggtatgccttcggcttcctcaggggctactacttcctgggaaacctttggctaggatcctagcagcaacttcgctcctaaccgtcaacaccgtctcacagcggagcagcaagaacaaagggaagagaggggcattgggagtgcctgctttggtcacatctggtcgcgaaggtgaatctctttctcacttactccgcatccttgctcgtcgaaagaggaagaatagcggatttagtgacggaaaggcattcggaaactattcaagtgcgaggaactctccttaa

SEQ ID NO: 25324 - DNA, 747 bp, Glycine max
  Peptide Sequence Number=SeqID_142102
atggcttcaaatggtaatgctgtattagaagcctctgttgatgttagttatccaattaaatgccatgaggcagcgacagaatcctgctgtctgttttggagccgggtacttcagcggtttgcaagtgtgaagactcatgatgcttctgagctgaaatccattatagagaatcttgttacagatttactgacaactctaaatttacctgaatatcctgcttcagctcctattctagagaatgccgggccaaaatctaaggatgtctctgcacgttccctggcgattgatattcttggtacaattgctgcaaggttgaagcgtgatgctttggtttgtagccaggaaaatttctggatacttcaggatttacttagtcaggatgctgctgctcagcatcatccaaaagatacatgttgtgtctgtttgggaggaagggtagaaaatttgttcatatgtcatggttgccagaggctttttcatgctgattgcctgggcattaaagaacatgaagtttccagtcgaaaatggtcttgccagacatgcatctgtcataagcaactacttgtattacaatcatgttgcaattcccagcaaaagaatgatgtgaaaaagaatcatgatacagattctgaagtttctaagcaagagattgttcaacagttacttctgaattaccttcaagacgttacttcagctgatgatctgcatcttttcatctgctggtttgttctcacgacagatttctaa

SEQ ID NO: 25325 - DNA, 348 bp, Glycine max
  Peptide Sequence Number=SeqID_142103
atggtatctggctgcaaatggtgtcatttcattaacgacaaaaatgttgacaaccgcacggttgcacagctacttgagagtatactattcataattgatgctgtgcttcccatgcttgggaagttgcctccgagtattgttggggaacttgagcaagatttgaaacagatgattgtccggcattctttcttgacagttgtccatgcctgtatcaaatgcctctgctctgtgagtaagatgtctggaaaaggggctgctgtagttgaacaacttattcagtttttcttcaaatgtttggatactcaggcagttgataacaagcaggtttattgcaagattcgtgtttaa

SEQ ID NO: 25326 - DNA, 519 bp, Glycine max
  Peptide Sequence Number=SeqID_142104
atgattttcgatgaaagaattaaaagaaaggctttgggttccttaaaaaatgcactttgggactttattcttcaacattgtcctgttaatcctattgttgcaacccttgtatgggcagagcaccatcaccttcagcaccgtcgttgttactgcatactgtcccaaaaatcaaatcacaaaaaagtatgggcacaggctgcattaggttctcctgaggacggcgtcacgactcgcgagctccgagcctcacctttccggcgacggaggtggcgagattccgacaaagcgatgagagagaaagttgaaactgcgctttttagagagagaaggttttcggacatgggagaaagtgtgttacacgtccacatcgacatgactggagaagcctggacagcgagacatgtgggagaggcaacaagggaattaagtgaaattaaatggggagttagaaatccgtcaatcagggagtcacatgtggctgggacaacaggaaaaaaatggtgcaaaaaatggatgtaa

SEQ ID NO: 25327 - DNA, 1773 bp, Glycine max
  Peptide Sequence Number=SeqID_142105
gcactagggtttgtactaattgctaggcctgaatatatgctggaaaatgatgttggaaaagtactggaggaaacattatcctctgcatctgatactcgccttaagattcaaggattgcaaaacatgttcgagtatcttctagatgctgaaagtcaaatgggaacggataaagataatgaaaatgttgctggttactcagttggagccgggaagagtgtacctgttgctgctggtgctggggatactaacatatgtgggggtatagttcagttgtattgggataatattttgggcagatgtttggatttcagtgaacatgttcgtcaatcagccctgaagtttctattcctccaaatcttttggattggtggagtgaggtataaaggggatgagaaattaggtagatgcttttcagaggagtttaaaggtgaatcttgctgttgcaagttagtctcttggaatgtgattgttgaagttgtgctgcgccaaggtcttgttcatccaatcacctgtgttccataccttatagcccttgaaacggatcctttggagtcaaattcaaagttggctcatcatcttctgatgaatatgaatgaaaagtaccctgcattttttgaaagccgcttgggtgatggacttcaaatgtcatttatgtttatgcaatctatttgtggcagttctgaaaatgttgatcataagattcaatctaagacctctacttctggaaaagggaagcccgaggctggctcccttgctcaagctaaacttggggtttctcgaatttacaagctcatccgagggaaccgggtgtcaaggaacaaatttttgtcctcgatcgtgcggaaatttgataatccaagatggaataaattactaatagctttcttaatatactgcacggaagtcctagcattgctgccattcatttcacctgacgagcccctttatttaatctatgctatcaatcgagtagttcaagtaagggctggaccactagaagcgaactttaaagcctggacttcaagcatttcacgtcattgcacacctcatgggaatggaatgtatcaacaggggaccgatgagcctactgttgcaagccaagtaatgccattggatttgaatggaacatttcagcaaaatgtagatcttcagccaaatatgaatgacatgagaaccctggatttaaatggatcaaatcatcaactgacagattatcctttatcgtataatggtagctcagaagcaaatctgcattctgtgggttacacagatcctttttccttcgcaaaagatgatctggagaaagttcaggccgactgtttatcagcaattgcattgcagcttcttttgaagctaaagagacacctaaaaatcatgtatagtcttgatgatgcccgttgtcaggcttattctcctaccgaacaaccgaaacctggagaggttatctccagacagaatattgcttttaatattggtgattcacagttcagtttgcctacaagtccgcaagaattgatacaaagatatcaggaatttaaacatgccttgagggaagacactgtggactattcacattacactgcaaatataaaacgaaagcgacctacaactacgccaagaagagttcaagttcggaaacctgtatacgtggcaggtgggtacgacaacggggatgatgatgaggattatactggcggaagtgcgacacgcaagataagttttagtggccgcaggagtagccttaagaactcaaggcaatatggattgatgtaa

SEQ ID NO: 25328 - DNA, 1053 bp, Glycine max
  Peptide Sequence Number=SeqID_142106
atggagcagagaaaaagcatatggtctcccgtcacagatccaagaagtggtttcaaccgggaatccagaactttccacagcctcaagccccctctccgtctccctccccccaacgccgccgtctccgcagccgccttcgccctcttcctccgccgcaactcgcagttcccggactcctccaccgcctttatcgactctgccaccggccaccgcctctcctacggcgagctcctccaccgcgccaaaaccctagcctcgaatctcgccacaatcctcaaactcaccaaaggcgacacagcgctcgttctctcaccaaatattctccaagttccgatcctctgcttcgcgcttctttctctcggcgtggtcgtctcccccgcgaaccctctctccacgcgctccgagctcacgcgcttcttcaacatcagcaacccctcaattgtcttcacagtaacctccgtcgttgaaaaaacacgcgagtttcaagtgaaaaccgtgctcctggactctcccgagttcgacacgctcacgaagtctcagattcacacaaaatacatccaagagggactcgtgtcaaacatgcaagtgactcagtccgacgtggcagcgattctatactcctcgggaaccacgggaacgataaagggtgtgatgctcacgcaccgtaacttaaccgcgatcgccgcgggatacgataccgttcgggagaagcggaaggagccagcggtggtgctctatacggtgccgtttttccacgtgtacgggttcacgttcagcttgggggcgatggtgctgtcggagacggtggtgatcatggagaggttcagcatgaaggcgatgctgagcgccgtggagaggttccgggtgacgcacgctacgatggtgccggcgctggtggtggctatgacgaaagactgcgtcatcgccggctacgatttgacgtcgctggaagggatcgtttgcggcggatctccgctgaggaaagaaaccgatgaggcattcaaagctaagttccccaacgtcctcgtcatgcaggttggtttgccttcctaa

SEQ ID NO: 25329 - DNA, 303 bp, Glycine max
  Peptide Sequence Number=SeqID_142107
atggcgcatgacaggagaaaggtgtatgttccaatgcctgactcgatccctagtggaaccataacttttggagggaataaaaaagagctaataacaagagtgggtaagataggtataccgccatatcatcctattaataatgttttatttgttgaaaggatgagtgcatcgtacagaatagtgacaagtccatacttttttctcttttctactaagaggaaaagtaatctctataagattagactagatgagctatcagatcaaaatgtgtcatgcctactttttgtcaaaggagatcactag

SEQ ID NO: 25330 - DNA, 627 bp, Glycine max
  Peptide Sequence Number=SeqID_142108
atggtattcttcataattgaactaaaaacacctcaacaaaatgggttagttgaaagaaataaaggatctctacaagagatggccaaaaccatgctcaatgagctggatgagtcttttgcagatctcatattagacgatgattcaatagaaactagcacatccaggcataacccaaaaataaaagcgtccaccgaacaagtagtccaagaagaggtcatgcaagatgaacttgatcaatttcaaaagaatgatgcttggaagttagttgaactaccaaaaggaaacaaggttgtggaagttaaatggattttctacaataaactagatgaaaatgcttatagaaatatgaagctacatcaaatggatgtgaaagtacatttctcaattgccttatccaataggaagttgtcgcaacctatccttttgtgggcgagtgaggcgaggctcacgggtgcgtcttccaaaggaggaaaatgcgcggagtcgccaccaacgtttatttgtggaaaatgtcggaaaaaccgaaggaaaccggtcataaagaatattccagattcgggagttgtatttacgtttgagaaaggtattggcatctctcacgtttgtcccaaaggacaacagccttaa

SEQ ID NO: 25331 - DNA, 480 bp, Glycine max
  Peptide Sequence Number=SeqID_142109
atgaagaactatgctgggccattggagagtttggatgcaacaaaaaaatttattgggagagctcttggtatggtttgtcaccagaaaaagaaaattgaaaatgctgatgaaagaagcaaagctatgaatattcaattgaagaatatgaagattaagaaaaccaaaaaactggagatggctcttgctagcaatgctaaagtcaaatttgatgacttgtcttcagaaattattgtcgtgcaaacaaaaaacaaaacttctaaggaagaaaagaaaagtgttgaagacatattgatatctgctaatgaagagcttaccaacttaaagaaaattgttgcaagattgaaagattttgattataagagaattgatgtgaattgcgatttgcttgatggtgagattattagagaatctcaactttgctctgatgaggaggaagaagaagaagaaaagaatgaagtagactcaaccatggttaattag

SEQ ID NO: 25332 - DNA, 456 bp, Glycine max
  Peptide Sequence Number=SeqID_142110
atgcctaaagaaaagaaagataaagataaaaactctattatctgctatgaatgcaagaagcctggacacttcaaatttgagtgcccaaaattggagaagggtcaaggcaagaagaaacattacaagaccaaagaaaaggagggtcttatgattacctgggaagatctggatgacacttcatctgatgaggatgatgaagaagccaatatctgcctgatggcagatacaacccttgaagaatctaaatcagatcaagaagatgagtccaagatatgtcttgagattgagacaattaccaaggaagaatctactcttcttaagaactctcaggagttggaaaacaaactgaaagatcttcaaaaggatctaaaggagttgaacgaacttcatgattatcaaaatgaagaaaaaaatgatatgtggatagaatgtgcacaagcatacaaagattattaa

SEQ ID NO: 25333 - DNA, 288 bp, Glycine max
  Peptide Sequence Number=SeqID_142111
atggagatgaaacgtgtctccgaatttcctcacacttatatggatcgtcgcccaagaaagagagttcccaaggttgtagatctggtgaaatttgtgtacattggtattatgttccaagacattactactctattgcttgatcccagagcatttaaggacacaatagatttgttcgttgagcagtacaagggcaaaaacatctatgttgttgcaggttattttcttcttcagtcatattcccttagctcttcactttctctttgcttccttttgcaactcaatgtgtga

SEQ ID NO: 25334 - DNA, 570 bp, Glycine max
  Peptide Sequence Number=SeqID_142112
atgtcaatctccccctgcagatgtatcggttggtctgtgccatcatggcatagggatcgcgcccacgagacgcccaatggactcgaagaagtccaacagggccctggggtttccaactctggttacgggcctctgtcagtcctacagggtgcccattcccccagcgagggatcgtgcccacaagacgcccagtggacccgaagaagtccaacggggccctggggtttccagctctggttacgagcctctgtagtcctacagggtgctcgtttcccccctgcagatggatcgggatcgtgcccgcaagacacccagtgcacccgaagaagtccaacagggtcttggagttttcaagctctaattacgggtctatgtcagttctacggagtacctgtcacctgcagcaagggcatcagaccccctactaatcgagctttcatcaagaagtactgcatccccaggcaggcgcagggcgaaacaccacagcaacctggggatggccgacagcgggcaacagacgcaccgccatcacctctagagttcacctcagctcatccacaaaaaggttag

SEQ ID NO: 25335 - DNA, 186 bp, Glycine max
  Peptide Sequence Number=SeqID_142113
atggtgagaatggcaatgtgggtcggtgagaatataagccaaagaggcgttgagatcgaagagagtgtgcgtgtgaggaatctgagaagacaccgaaaaaggacttttagtttagatttttacaagtgtggcttcgatgattacgatgcaagtggtgcattaaccatcaatgtgacacagttttaa

SEQ ID NO: 25336 - DNA, 522 bp, Glycine max
  Peptide Sequence Number=SeqID_142114
atggcaactgcgaggaccgtgaaggatgtttcgcctcacgatttcgtgaaggcttatgcttcccacctcaagcgttccggcaagatattctggaaattgggggagttaatgttttatatctggggttcatttaagagtgaaaacagtttggtgtatagtggtgtatggaaaaagatggagcttcctgagtggaccgatattgtaaaaacagcaaaatttaaggagttggctccatatgatcctgactggtactacattagggctgcctcaatggcaagaaagatctatttgagaggtggtcttggtgttggtgctttccagaggatctatggtggaagcaaaagaaatggaagccgtcccccacatttctgcaagagcagcggtgcaattgccagacacattctgcaacagttgcaaaacatgagcattgttgagattgatacaaaaggaggtaggaaaatcacttctagtggtcgaagggatcttgaccaagttgctgggcggattgtggttgctgcctga

SEQ ID NO: 25337 - DNA, 342 bp, Glycine max
  Peptide Sequence Number=SeqID_142115
atgagtttgtcagggtttgcggaagagcaacacagagatagaggtcctcgatgtccatgttcgcagttaaacattgaattcgctgcatattcagttaaacaaactaagcctcaatctcatacatcagagcaaaacagagaacggcctatgactgaagtccaacctagaaaaatgtggacaaactcactattgacagaccaattgcaatttcaagatgtcagactcaccaggagtaacatttcgatgaagaatcctcaggaatatttctgttatgatatccagattcgtgtgcatccaccacacatccccagatctgagcaagctgcaaccatatgccattag

SEQ ID NO: 25338 - DNA, 327 bp, Glycine max
  Peptide Sequence Number=SeqID_142116
atgggacccagttggtggatccatgatgagacccatctcttatcctacaaactcaaaggctactccttctacctagatatctctgaggtcaattttgagaaggaggaacatcctgaggaggatcctaagatggttgggaaggatctcgatatgtcgaggaggacactacagaggagcatccattctctcgtgatattcctcatcgaagctcaacctcaacctcaacctgacgcacctcaacctcatcgcacctcaacctcatcctcattgaacctgacgcacctcaacctcatcaaagctgacgcacctgaacctcatcgaagctga

SEQ ID NO: 25339 - DNA, 606 bp, Glycine max
  Peptide Sequence Number=SeqID_142117
atgacatgtgagagtgagattggcactcaacgtgcattgggaaatgggatacaggtacaacagaaatacactaatttgtgttccctgttctgctcgtgtagtactgctggaatggaggcaagtggaactagcaatatgaaatttgcaatgaatggctgcatattgattggaactttagatggggccaatgttgaaataagggaagaggttggtgcagacaacttcttcctctttggtgccaaggctcatgaaattgctgggctgaggaaagaaagagcagagggaaagtttgtgcctgatccacgatttgaagaagttaaagaatttgtcagaagtggcatttttggatcttacaactatgacgaattgatgggatccttagaaggaaatgaaggttttggtcgagcagattatttccttgtagggaaagactttcccagctacatagaatgccaagagaaggttgatgaagcataccgtgaccaaactaaatggacaagaatgtcaatattgaacacagcaggttcatacaagtttagcagtgaccgcacgattcatgaatatgcccgagagatatggaacattgaaccagtccaattgccatag

SEQ ID NO: 25340 - DNA, 2379 bp, Glycine max
  Peptide Sequence Number=SeqID_142118
atggcttcttcttccacgacaatgcggttctccgcggcctccaccggcgccgcggcggcgcttcctcgccggagctccgtcgccggattcatcggcgtcgcggccagatcctccgccaaatcgaggctccgcttcatcggaaggaacgcgaacttgagcctccggatgaggaggatgagctctttctccgtcgtgaagtgcgtctccggaagcgaggccaaggtgcaggataccgtggccaaacaacaagaagctacaacctctctcagctccttcacgccagatgcttcatctattgcctcaagtattaaataccatgcagagttcactccattgttttctccagagaattttgatctaccacaggcttttcttgcaactgcacaaagtgttcgagattctctcattataaactggaatgctacctatgattactatgagaaactgaatgttaagcaggcatattacctttcgatggaatttttgcagggtagagcattattaaatgcaataggcaatctggagctaactggtccctatgctgaggctttgagcaagctcgggcataaattagaaaatgtggcataccaggagccagatgctgcacttggaaatggtggtcttgggcgtcttgcttcatgtttcttggactctttggcaaccttgaactatccagcttggggttatggattgagatataagtatggtttatttaaacagcgaataaccaaagatgggcaggaggaagttgctgaagattggcttgagatgggcaatccctgggagattattagaaatgatgtttcatatcctgtaaagttctatggcaaggttgtttcagggtcagatggtaaaaaacattggattggaggagaagatataaaagctgttgcacatgatgttcccataccaggatataaaactaagactacaatcaacttgagactttggtctacaaaagctgcatcagaagaatttgatttatctgcttttaatgctggaaggcacactgaagcatctgaggctctagcaaatgctgaaaagatatgctatatactctaccctggggatgaaccaatagagggcaagatccttcgcctcaagcaacaatatactttatgttctgcttctcttcaagacatcattgctcgttttgagagaagatcaggagcaaatgttaattgggaagagtttcccgagaaggttgcagtgcagatgaatgatactcacccaacgttgtgcatcccagagctcatgagaattttaatagatgtaaagggcttaaattggaaggatgcttggaatattacacaaaggactgtagcatatacaaaccacactgttcttccagaggcattagagaaatggagcttggatcttatgcagaaactgcttccacgccatattgagataatagaaatgattgacgaggagctggttcggaccataattgcagaatatggcacagaaaattcagacttgctggagaaaaaattgaaggaaatgagaatactagaaaatgtcgaattgactgcagaatttgcagatatactggttaagtccaaagaggccattgatattcctagtgaggagctgcaaagttctgaacaagcagaagcagaagacgaaaaagatgatgatgaagtggaagcagttgctaaaaagaatggaacagatgaaagttccattgaggatgagaaagaagagttgcctgagccagtaccagaaccaccaaaattggttcgtatggcaaatttgtgtgttgtgggtggtcatgcagtgaatggggttgcagagatacatagtgaaattgtaaaagatgatgttttcaatgcattttataagttgtggcccgagaagttccaaaacaaaacaaatggtgtgacaccaaggagatggatcaggttctgcaatccagatctgagtaaaataataaccgagtggataggtactgaggattgggtcctaaatactggaaaattggccgagctacggaagtttgtagacaatgaggatctacaagtgcagtggagggaagcaaagaggagtaacaaagttaaagttgcagcattcatcagagaaaaaacagggtattctgtcagtcctgatgcaatgtttgacatccaggtgaagagaatccatgaatataagcgacaattaatgaacatatttggaattgtttaccgatacaagaagatgaaagaaatgagtgcggcagaaagggaagcaaattttgttcctagagtttgtatatttgggggaaaagcatttgctacatatgtgcaagccaagagaattgtgaaatttattacagatgttggggctacagtaaatcatgaccctgaaataggagatctacttaaggcatattgttgttga

SEQ ID NO: 25341 - DNA, 795 bp, Glycine max
  Peptide Sequence Number=SeqID_142119
atggtgaaggagtgcattttcttggggcacaagttgtctcatgttggcatagaggttgatcatgccaaggcagaggtagttgcaaaattgccaccacaaaattgtgagttcctacgtacattcaatattcttaaggaaagtctagtgaatgcttctctggtgacaacccctgactggtcactaccttttgagctcgtgtgtgatgtcagagatacaattgtgggggtggttttgggtcaaagaacggatgaggagttttataccatatactatgctagtagaacccttgacgatgcccaaaagaactacaccacgaccaaaaataagcttttagcagttgtttttgcttttgataaatttaggaattacttggttttgtgtaaggtgtttccaattgacattaactatcaaaccaagaagaggcttatgtgtgaggccaggaaatattttttggatgatccataccttttcaaggctggaggtcatttaggtccttctaggactacccataaagtactccagtgtaggttcttttggcctaccatccatgtggatgctcatgcatttatagctacttgtgatagatgtcaatgcactgaggccttatctaggaagatggaaatgcctttaaataacatgcttgttgttgagatgtttgacgtatttggcacacctagagcaatcattagtgatggtggtatccatttctataataagttttttgatgaccttttggctaaatatggggtgaccacaaaggttataaccccataccacccacaaactagtggctga

SEQ ID NO: 25342 - DNA, 848 bp, Glycine max
  Peptide Sequence Number=SeqID_142120
gggttgagggtgtcacagtaagtctaccattccctcataaagttaagaatgaccagcgagatgtgcaatttagaaaattccttgaggttatgagaaaaatgcacatcaacctccctttcattgaggctatttcacagatgccatcttatgtgaagcatttgaaagaaatggagtcttactttgataagtgtctatgtgatttgggggctagtgtaaacttgatgccctattccgtctttaagaaattgggcataacaaacttagaacctactaacatctctcttcaccttgctaaccattcaattgtctgtcctaaaggggtcactatcatattgggacaacctttccaaagtacttgtgattttcttgttgagtctgttgataaatctgatgcattgattgaaggggcattctcaagtgtggggatgcctaacgatcttgagagagttctcactaatgagggccttgattgggaactgaacccaaaatcttctgttgaggaacctcctaaattggagttgaagcctcttccttccaacctcgagaatatttttcttaaccccccatcttctcttcaagttgtgattattgcaggtttacatgaaactaaggaggagaaactgttgtgggttctaaagggcaacaaagaagcctttgggtggagcattcatgacataaagggtttgcaccataccctgtgccccaacaaaatcaatattagagaggggtttccacccaaatggttaccccaaaggaagcttaatcccaacatgatggaggtggtcaaaggaaagataattaagttgttagatataggcattatctatcctatttctgatagtccttag

SEQ ID NO: 25343 - DNA, 228 bp, Glycine max
  Peptide Sequence Number=SeqID_142121
atggcacatcaaaaccccccatacttagccttttgcactcctgggcaaaatgaaataaagaacaaaatccaaggatatcaaagagagacaaacaaaaacatttacatatttctcaatgaacatcaaggaatgaaaggaatggcacatgcatatgaggatcaaaaggtctttaaaggttgtaatggggccaaggacaaggtagggaaaaaatatggaataagtagttaa

SEQ ID NO: 25344 - DNA, 318 bp, Glycine max
  Peptide Sequence Number=SeqID_142122
atgagcacaaagactgccatacacagcgatgacgggtcatgcaagataggggtgaaaggaggagaaaagcacattgagaaagaaaggacaaggagaaaagctccatcaagtcaaaatgcacaaaaccagggcatttcaaatcagaatgtcttgatcttgacaaatcaaataacaagaaaagaaacaaaagaggaagaagtcaaactctatctgatggcagacacaacattagaaggatcaaattcaaaatcagatgaagaggtaaatataaacaaccatgaaactgatgcaatcctatcccataagtgcattggatag

SEQ ID NO: 25345 - DNA, 264 bp, Glycine max
  Peptide Sequence Number=SeqID_142123
atgtacaaagataattggacccaaccttggcccgtgggctcagaaatctaccctgaggttcatcagaaccctagggccttcttcaacagctctagcccaatcctctcggagcctcttgctcatggctctagtgactgtgttcttccttctccattctgctgccatgatcttcaagaagtaaaggactccattgatgaagaagatccaaggcctacaagctccacattgagctacatcatgtggtatcagagcatcttcgtctag

SEQ ID NO: 25346 - DNA, 381 bp, Glycine max
  Peptide Sequence Number=SeqID_142124
atgactacaccacctaggtctcctcctcctcctattgatgcaacatcatattccccttctaccttgaagcggacaagaaaagccacacgcctaagatcgttggctactagaccagttggggcagagagacccctggtccatgtggatcctgcgaccgggaaagctgatggtccccacagaaagaagttacgaacatatttggggattgtcgcttgtgataaggtggatgtgacatacgagaattggaaacaagtcactactgcgcagaaggatttaatatgggaggatattcagccaacaagaacagtgtcaatgacactatatgcgaaaagtacaacattagcaaggagaagtggacccaattttgccaaagccgcatag

SEQ ID NO: 25347 - DNA, 373 bp, Glycine max
  Peptide Sequence Number=SeqID_142125
tacagatacggaaaaactgaaaacagcaagcaatatccaccattacagagacacgcctttgtaaaatggtggtcacaattcgatacttcaaagactgctccagatcaagtcaagaactggttccagagcaatcctgagttccttaaacctgctgatccaaagacatctctattcctgaatcagaagtcgcaactggcagcattcttagcaagctcaaaatctaaagagagtcttgctcagaatctcaaagaagttctccaactacttcaacaggaagtggaagaagaaccttccaagaaggaagctgaatcatcagagactaatgatgaccaagaagacgatccattctaccagaatgaagatgactgtttcg

SEQ ID NO: 25348 - DNA, 171 bp, Glycine max
  Peptide Sequence Number=SeqID_142126
atggcctcctatggtgagatcagcggaataaaatcaaacggacaggttggaagtaagaatgcaatatcaagggcacaccgaagcggcttacaaacccaggtttttgaaaacaaagaaaccgaagcggcggcagagccgcacaggatcggtgaggggagaagggagatatga

SEQ ID NO: 25349 - DNA, 231 bp, Glycine max
  Peptide Sequence Number=SeqID_142127
atggagtgcagcatctgtggagtaaaaataaaatatgctagacctgcaaatactagagttggaaatggcatctttgaaggtgctggaggaatcattggaatctctgtggaggaagagggaggaagtgtagaagaaaaaggacttcctgtctctagtgctgaagtggaaggggcctcaaatctctttcctctagccttcctaagtcctctcaaagatttcgagccagactaa

SEQ ID NO: 25350 - DNA, 855 bp, Glycine max
  Peptide Sequence Number=SeqID_142128
atggacaaaatgaattttcatcaagatcctctagtgcacattaaggactttgaggtgcatgactttgttgaagatcccaacttagatcagttcatcgacttgattcgttgggagcataaagatgccatctataacttcaattctaagtctatcaatgaagcattcattgttgataactcattcttgtcacaccctgcaatcccatttgatcactgcaatagtaattctgtgaatgtttatcatccaattagctatacacatagctccttctcttgttttgatggggaagccaaggaagaaggaggaggagaagaagataacatgggggattcttctgctacaacaaccaccaccacaacaacaactaaaagtgttaatcctaagccaataccaaaaactgataggtccaagactttgatttctgagaggaggagaagagaccgaatgaagcagaagctttatgcattgtggtctttggttcccaacataactaagatggataaggcttctatcattggagatgctgtttcatatatgcatgagcttcaagcacaagccaacatgctgaaggctgaagttcaattcaccaacagcaaccgttcaatctgcaagaagataatcaagatggacatgtttcaagtggatgaaaaagggttttatgtgaaaatagtgtgcaataaaggagaaggggtggctgcctcactgtgcaagtctctcgagtctttgacaggcttcaatgttcagagttcaaacttggccacagtttctgacagttttcaacttacattttcattgaatgcgaaaggccctgagccagaatttaacctacccaacttggaagttatgggtgactga

SEQ ID NO: 25351 - DNA, 468 bp, Glycine max
  Peptide Sequence Number=SeqID_142129
atgcagataccactctctggccctaattcagtagttggaagagccttggtggtccatgagcttgaggatgaccttggaaagggtgggcatgaactcagtttgacaactggaaatgctggtggaagattagcgtgtgtttgtgatgaaaacatttggtgtgaaaaagctttaggaagacttatcatctctagggcattgattatcccattgaatgctaggcttggcattggggcgggtaggctgctaggacaggtgtggttgttaccaatgcaaactgtaaagcataatgtccttctaaagatgagtgtgcaaatgaatcgtgaaaacatgttagtcctttactggagattcatcatgcagtcgagtgtgtactccccaataaaattcatcatgcggtcagatgtttattccccaacgaaattgatttgtgtagtccttgttgcctgcttgagaaagaacctatgttaa

SEQ ID NO: 25352 - DNA, 173 bp, Glycine max
  Peptide Sequence Number=SeqID_142130
atggaacctgaaattctgaattttgggtacttcttcatgtcttatgatgatgatcattttcagttttttccagcttttgtttcaggtgcatgcattacagaaggagatgcaagatcagagtgccgtgctgtgatgaggtttttgactgtaggcattgccataatgaagctaag

SEQ ID NO: 25353 - DNA, 300 bp, Glycine max
  Peptide Sequence Number=SeqID_142131
atgactgcagatgagagttatttgacaaatgggtatttggacacaaaagtggactgtattccaacaaattgtagatatatatgcaatgaatgggacattggggttgaaaatgataccaatgtgaagagagaggaagtggaaaagctggtcaatgaattgatggtgggagagaaaggaaagaaaatgaggcaaaaggttatggagttgaagaagaaggcagaggacgacactagtaccaatggtcgttcatacatgaaattggacaaagagattagtgaggtgcttcttagacaaaattag

SEQ ID NO: 25354 - DNA, 693 bp, Glycine max
  Peptide Sequence Number=SeqID_142132
atggatatgaacttggagtacctcatctgccaccagatctcccttattgcacaacatgatacatctagacttggattctctgccttgatcatagctctatgcaaggccaggggagtccaatcagattctagatccctggagaacttgagccataccattaacttggcatatattaagaagaactattggaatcttgatgatccaacagtgacatttagagggccaaggaaggccaggggtaagagatcagaggtccccactacttcagcagcaccagagacaccaactcctacttcttccacagctccagtacctctcattcagactccagttattcctcctacatttacacagctaccacttccagctcctttatatgcaggaccctcagatttttcatttacaccacagatgcttcattccatggcccagagcttacatagggggcagtccatcatcatgcagagcctacagggcttgggcttgccatccattatgagcatggatgagtttaatatgcaggaggaggggacttccatagatcaaatacttaagccatctcctgcaccagttcctgaggagacccagccatctacaccagtcacggagccagagcagcctatccaggattcatcagcagctccaacactagatcataatgaagatcaggcacaagatgagcaggatgtttaa

SEQ ID NO: 25355 - DNA, 558 bp, Glycine max
  Peptide Sequence Number=SeqID_142133
atggtgagatttgttagggtttctaagaatgtggtttttggtttaaccagtaaggaggatgatctccttaataggagaaggagtacaaagaagattaaggaggacttgaagacctatatggacggagtatcaatttcatttgcagataaacttttgcaactagtcgggggcagtgaggttcctatagagatggatttgggggtgcacaaggatgttattgaagaagtgcctaaggagaatgattgtcatgggactcaaacgatggatggtccagtgattccattatttgatgtggagctattgcattggtcttccacttggttaaatactttggtggtcaacgttttaggtaaaagagttaattttcgtatccttgaaacgaaagttcagagggactgggaaaggaagggcactattcagataattgatcttcatgatgcttggggtgtgttagtactcgtggccatcgggatatggaaactttcccctaaagttgtggaacaaaaaggttttcggatgtttatggaagaggaaagcatcgctgagaaagaagcttaa

SEQ ID NO: 25356 - DNA, 609 bp, Glycine max
  Peptide Sequence Number=SeqID_142134
atgccaaaccaatttatccaaaatctaaaacatattcactcaacaacaacaacaaaagccttatcaaacatcccatcagcattatcagatatccatccagttgaagtcggctacatggatcacccgatatcattaggttcgggcttatcagatatccatccaggcgaagtcggctgctacatggatcacgcaataccattaggttcgggtaacaagagcagtgagaataaagacaaagggcaacaagaaagcgaggatgaggatggtgtggaagagggttcgataggaaatgtggcaagctgcgaccttgatcttcatcaagtcaataaacccatttttgctcgatatcgtgatgcttctcatgctaggcgagaagtgaagctgcatcgtcgtctatgctgctgccgcaccaccaccggatcgttgccccccacaacaaccctacaaccacctgaaaccatcttcatcacccatgtccccaccatcatcagatccacgattttccttcttcaaggagggtctcctcctccaacaacaccgcattggagctttcagccaattgggtatcggagtttagcccaaaggtttcaactttcttctgggttctga

SEQ ID NO: 25357 - DNA, 894 bp, Glycine max
  Peptide Sequence Number=SeqID_142135
atgcagaaatttgagagagaaatcagagaatctaaattttcagagctgatgaataaacattttgcagcaagttcagttcctaaagggattcattgtctgtctttgcgtttgactgatgaatattcgtcaaatgcccatgcacgcaaacaactgcctcctccagaattactacctacactgtctgacaactcttaccatcattttattgtttcaacggataacatcttggctgcttcggtagttgttacttctactgtgcagtcatctcagaaacctgagaatatagtcttccatgtcatcactgacaaaaaaacttatgctggtatgcactcatggtttgctctaaatccagccactcctgctatagttgaggtcagaggcattcaccagtttgactggttgacgagagaaaatgttccagtacttgaagcagtagaaaatcaaaatgggatcaggaattactaccatgggaatcattttgcgggaaccaatctcagtgataccaatccatataaatttgcctcaaaattgcaggctagaagtccaaagtatatatctttactcaaccatctccgcatttacatacccgagcttttcccaaaccttgacaaggtggtttttctggatgatgatgttgtagttcaacgtgacttgtctccactctgggaaattgatatgaatggaaaagttaatggagctgtggaaacttgcagagggaacgatcagtgggtaatgtctaagcattttaggaactacttcaatttttcccatcccctcattgcagaacatttggatcctgatgagtgtgcttgggcttatgggatgaatttatttgatctgcgtacgtggagaacaacaaacataagagagacatatcatacctggctgaaagag

SEQ ID NO: 25358 - DNA, 685 bp, Glycine max
  Peptide Sequence Number=SeqID_142136
atgtgggcacagtcgatggaggagctgaagcagtctctgatgtacactacccttgagctggaacaaacaagagcaactgtccaagaagagctaagaaaaagagacgatcagcttctcaccctaaaggagcttctcaacaaagtcataagagaaagagatgaagctcaagagaaatgccagagactagtgttggagaaaatggtttttcagcaccaaaccgcacctgcttctggagtttccagcattgaggacgagccaagaaggggaattaatgactcctccaacaatggcctctcttcatcagattgtgaagaaagcattgtttcctctccagttatggagcatttgccaccacaacagcaacagttgccagagtcaatgattgagctaatctcaccagataaaccgttgccagaaaagggtaagcttttgcaagcagtgatgaaagctggtcctttgctgcagacactgcttcttgcaggaccacttcctcaatggagacaccctccaccccctcttgagtcctttgagattccacctgtcaccattccttcaccaccacaaccacaacttcctcatcaagattccttcacctcgaactgtgggagagtcatcgttggggttggggttggggggatggtgtggccaaccaccaagagcgacggccacgagttctgtgtgtcgg

SEQ ID NO: 25359 - DNA, 384 bp, Glycine max
  Peptide Sequence Number=SeqID_142137
atgaggatgttgcggtggatgtgtggtaagactcgacaggataaaattagaaacgaagttattagagagagggttggagtagcgcctattgtagagaagatggtggaaaatagacttaggtggtttgggcatgtagagagaagaccggtagattctgtagtgaggagagtagaccagatggagagaagacaaacaattcgaggcagaggaagacccaaaaagactataagagaggttataaaaaaggatctcgaaattaatggtttggatagaagcattttctcggtcaaatctggttataatctagttctgggcatatttggagatgttgatcattttaaagctgatgttgatcattttctcctcctgctgctggctttgtga

SEQ ID NO: 25360 - DNA, 642 bp, Glycine max
  Peptide Sequence Number=SeqID_142138
atgatcaagaaagagcacatagacatgatctgtattcaagagacaaagaaggagataattgagaaatccatgtgtcaagcattgtggggagatcttgaagtaagttgggaagcgcaacctgcatctaacacagcaggagggattttatgtatatggagtgaaaaaacattcaaactagaaaggaaagttattgacagtgggctgttggctaaaagactgaagaagatgatgccactcataatggatgaaagacaatttgcattcatagggggcagacatttgttgcatagtgcgatcataacaaatgaggtggttaaggaagcttataggagtcaaaaatcatgcctgatgttcaaagtagactatgagaaggcatacgattcagtctcgtgggatttcttgatatacatgttgagaaggataggcttttgttccaaatggattcaatggattgatggttgcttaagatctgcatccatttcagtattggagaatggaagtccctcggctgaattcatcccacaaagaggacttaggcatccattagtgtctcttctgtttaatattgttgctgaagctctaaatggattgatgagagtagctgtggagaaaaatctgtttagaagattcctagtgggctaa

SEQ ID NO: 25361 - DNA, 669 bp, Glycine max
  Peptide Sequence Number=SeqID_142139
atggcaacaaactgttggatgatgcaacattcttactgtggacatggttcagaaatctggagacagcaacacactttaaccaatggtccattaatcttagaaaagctctgccttacaaacagacttgctcaaagaattgttcaaggagatgttcctcaagctttgatgaatcgaaggcttatatcccttgatatgggtgcacttattgctggagcaaagtaccggggagaatttgaggatagactgaaagctgttctgaaagaagtaacagaatctgatggtcagactatccttttcattgatgaaatccatacagttgtcggggcaggtgcttcaaatggtgctatggatgctggtaatctcttaaaacctatgcttggtcggggggagctgcgatgtattggtgcaacaacattagatgagtatcgaaagtatattgagaaggaccctgcacttgagcgtcgtttccagcaagtttatgttgaccaaccttctgttgaggataccatttcaatactaaggggactgcgggaaagatatgagctgcatcacggagttcgcatttctgacagtgcacttgtggatgctgcaattctctcagatcgatacataagtgggaggtttttgcctgataaaggtattaatacagttttccctggtaaatactag

SEQ ID NO: 25362 - DNA, 422 bp, Glycine max
  Peptide Sequence Number=SeqID_142140
aggagaaagtagaggggaaggtggaagagatgatgatgatgatggaaggagtagcatcaatagcattgttgccatgtggctctatctcaggacacttcattcaacttccacattatatttgctatggcctttgtggcactgtaggggtgaggattatcgcctcatcaaactcacaataacagatttcaatgcaaagaaagaacaagccactgttgtggagtgcaaaggccatgatgctgcttggttccacagcattgatcatgctcatggttgggacaaggatatcaccggtatgattgaaccaaaggatgggaagaaaagaatctcagtttcatttgagtgtgagacacttaaagctgagaaagcagctgaagaccatatcaggaagttcatgccaaaattagccggactggatgctgttg

SEQ ID NO: 25363 - DNA, 392 bp, Glycine max
  Peptide Sequence Number=SeqID_142141
attctgacattgaaggaccacctcaaaacattagagcttggatcagatgtgtcactgcttgttgtctgataaggagtaaaaaggctatcttctccactgtagaagctgaagagatagttgaaattattatttgtctattcctagatcgccaatttcagggtttgttggtgcttttgaatgactgcatggaagcgattgtcaattactttacagaccaggaatggtgctcaagttgtgagaacatagcaaaattcattgcttgcagcgtcagttgtgacttgtcagtcatgagaaggaaattgggtctctcaaatacctgggtgaaagagcaaaggcttgtgttcttgatctctgttctctataacatggatactggtgcagagattgattga

SEQ ID NO: 25364 - DNA, 1143 bp, Glycine max
  Peptide Sequence Number=SeqID_142142
atggcagattctaccagatcgaaggtcgcttccgaccaactggaggatgccattgccaagctcacctcccatcagttttccctgagcgagactctacacaccatgacccttaagattgacaaactgattcacaaaatgaccccctctgagcttcctctgccttcacccacttcgtccacaacaacccaatctcctgctacttccatcccccatcgaatgaaactggacacacgcttcgtactgtcccgatacgacgatcccaccgacgcccttttcaaactcactcaacgcacaacaataaataattacctctttgagttggaggacttggcgaatcgtatcatcggattgccgccaaccttcctcttgagttgtttcatctccggtctgacaccgaagatccatcgtcaagtacaggctcaccaacagctcactctgacccaagcagcagggttggcctggcttcaggaggagaagctccttaacagccgtgcccaggctcggagtcgtccacccttctcaccgccacgaccgtcagcccaaccccttccttccatgcaacctccattattagttgctccttcgaagccttcctcgacctttccccttaaacgcctatcgcctgaagagcttgcctcccgccgggaatgcggcttgtgcttcaactgtgatgagaagtttcatcgcgggcataagtgcgcctcatgggtttttctcgtcatcgcagatgatgaagatgaggcaaccctagacgcgagtgtgcctttggaccccccacccgacccacctgatattaatagcccaacttcagaccagataagccttcactccttctcgggtcatgtagcacctgaaacactacgattattgggccacattgctaatcaccagtgccatcttctttgtgaagttgttccagttacgatccagacagttacttttcttattgacctgctccggtgctggccttatcggacttcacaattccattcacgatcgagacggatgcatttggcattggcatgggagccatgctttcgtagaacggtcaccccatcgctttctttagcaagcctttcacttctaaccttttgcgggcctccacttatgttcgagaattatttgccatctcgaccgccgtag

SEQ ID NO: 25365 - DNA, 396 bp, Glycine max
  Peptide Sequence Number=SeqID_142143
atgaagaaaaagagaagaatgcatgtgatcttggctcttacaacatcttcagaaaaaaggaacaaccatctggtaatcagatcgaatgtcaagacagttctacttaatctggaaagcatgaaatacatctcaataccattgacacctccttggcacaggctggcttggtggcctctacggctccctggcttgggccgtcttaagaatcgggcctccctcaaagccaacatagccctgctcaagcccacccacgtcttcaatgctgccaacatcatgggccgccctaacgtcgaccggtgcgagtcccataaagtcaagaccatccaaactaacgtcgttgaaacccttattctcgtcgaagtctgtcgtgactacgacctttttctcgtcaactaa

SEQ ID NO: 25366 - DNA, 312 bp, Glycine max
  Peptide Sequence Number=SeqID_142144
atgcagaggaagataagcgtagtaaagaagaagattaacacaataaaaaaggataagcacagtaaacaccaacaaaaacataataaagaagcagaacaagcagcaacaaccaacaacaatggcatcatccaagcagcaacaatcaccaacaaacatcgaaaaaaggataacttacctcgaaggacaaaccaagtagaagaagaggaagcagcaacgcacacaaacagcagcaacttcatgtattcatgtcaccgtagcacaaaccacaagtcttatggagtaggaagaagaagcaccaagccgaagatataa

SEQ ID NO: 25367 - DNA, 291 bp, Glycine max
  Peptide Sequence Number=SeqID_142145
atgcttgttgtcacaacctgcccttcggtgggagggcgacgcgaggctcatgggtgcatcttccaagggaggagaatgcgtggagttgcctccaatgtttattcgaggaaaacgttggaaaaaccaaaatgctgtctacaaactttaatcgtgaaaggttcgagagttgtatttacgcacggggaaggggtggtcgacaaaagcagggcttttgctcctacgtatcctcgatttgtggtgaggaactcagacctacctagttcttgcaaaagcggtaaagttacgtgttga

SEQ ID NO: 25368 - DNA, 453 bp, Glycine max
  Peptide Sequence Number=SeqID_142146
atgaatgttgaagaacggtcgagaacgacgaagaacgatgaagaatttccacagaatcgcttacgaaagcgttacggaagcacttcgactcgatttttcttcacgaaaacgtgttttttgcccaaaatagccgaaatgcatagccaaaggggtcttgaacattttgaaacagctcccccctcccctatttatagaaaaaaagggaggtgcttgccgcccagagacttaatgaagaagatttctaagcgcacacgaattactaagttcaccccccttttcgtattttacggaaaagttatggaagccttacggaagggaatatacttacccaaggttttcagaaattttacggaagtattacggaagccccggaaaccatttttcaaaaacgtggaggagctttgtaacatcctggaaattctacccggagtttacggaaacgatgtattttga

SEQ ID NO: 25369 - DNA, 405 bp, Glycine max
  Peptide Sequence Number=SeqID_142147
atgttttgcgtcatctgggtgttccttggtttcttcaaactgaagaaaattattgggttggatgatcttcttaaagatcattacatagaacaggacaagcttttagagaagaggaataagcagaaaaagaaggctaagactaaggcaaagaagattgaaagttcctatgatgatgaagatagcaaggaagctaggttgactaggattgttgagaaatcttttggtgaagaacaagaaattccaccctggggagtaaaagtttttggagataagaaagcctttccccctctggagtctcctgatctgggaagttgtaaccttttacagtcctttttgaacaacaagctaaattccatggtggaattgactgcggacaaaggttgctccagtgtctttgtttgttaa

SEQ ID NO: 25370 - DNA, 1782 bp, Glycine max
  Peptide Sequence Number=SeqID_142148
atggccaatgaaagtggtgaattaccagtgaccccagaagttactgagtcacctggggttgaaataagaaggcattcagatggcaaagctagttctggaactagtgttgaaaaatttgttcccaattatctcagagcttccactggttcatgtcatgatttttgtaaatacgggaagaaacatgcatttgattcgaaggaaagacgttctatacctaatagagctacaagaaaactgcttcaccacagttcagaaggtagtgttggtgggacaatgatgccagttgctaggctcagtgcatctgtggattctaccaagtccacaaagatttcaacggtcaaactcaaactatcagttgattccaagacatggatttctgatatctctgacacttataagcaggaacggccaacaaaatcatttgacggccaaaaagtaacacggaatgaagttctggtgaacaggaacaaatcatcattggccaaggtcaagctatcgatccttccgaatttgcaaacatctccatcagtgaggcaagaaatttcatcaattaaggaggtccgatccctgtcaaattcaacttccaaaaaggtggaaactccatcaaaatcaaccgccaataagacggaaactccttcaaaaccaactttcaataaggtgggaaatccattaaaatctacatccaaggtcaaaacttcatctaaaccaacttccaatatggtgaaaatgtcatcacaattatcttctctcaaaggtaaagaaacgaagttgtctgaaaaacaagtgacttatttaaattcaagcagtgtcagaaggaagcaaatatcttctatgaattcctcagaaggcgttggtggccaaagatatagtaagatcaagacaggaaaggaggcaacctcctccaattccaaagcagcttcaaaaaaattgatgtcaccttcaaaggctttattgtcccccagaccttcccttattagagttgcaagtataaattcaagaaagcataagagtctgaaaattgcttctcatcttaagaatcagtgtactgcccgaaaggatgaaaatgaggaacacaataacaacgtgttagaggaaaagactttgcacgtcatcaagatggaaagtgaaaacaaaactttgcaatctgatcaaaatgcaagctatgatgatgaatcatacctccctcagttgtcatcaccaaagtcttcagtatcctcaatttctaaatccttatcccaagaagaccaagaggaatctgaatatacaactagtgaatttgagcaggattctttttcaggaaaccatgaaattgaatgcatggaaaatgaggagactttgggagttgagaagaaaggcaagcccaaaaaggatggggttgtatattccagaggcaagggcaaccaaatgataaaattaaagttcaggaggggaaaagtggttgaaaatcaaactgagataagtagtccacgaaggcttaaatttcggagagcaagagtgctgggggagaaagccaatggtaaggtcaatgtccggaaaagctttgaaggaaatgaagcctgtgatgacagcaatggtgccacaactggtcctgagaaggttgttttgaggcatcaagacatgcaggacaaaaaagatgcacagggattattaaataatgtaattgaagaaacagcaagtaaactggtcgaagctcgcaagagcaaggttaaagcattggttggtgcctttgaaaccgtgatctctctgcatgagaaaaaaccttctgcaaacacagtcagttga

SEQ ID NO: 25371 - DNA, 228 bp, Glycine max
  Peptide Sequence Number=SeqID_142149
atggatcaaaacaaaatatatagatacagtagggaaaaaaagggaacatctattgttgcagttgaagaagctttgggtgatagagatgaggaagaaccacttagtgttgtgacctcctccttggcgaccaaggtagaggcagtaatggtcggagatgaaggtttaaaacctcctgcaaccaatcattttagtggcacagaggtgagggagttttggacttcaccctaa

SEQ ID NO: 25372 - DNA, 315 bp, Glycine max
  Peptide Sequence Number=SeqID_142150
atgacagaaagaagaagcatcgtaggaagagaaagacgaagaagaagaaggtcgtatgaagaggaagaagaagatgaatgggtcagcagtggccgtaggaacacgaacaagaagaagaaggtcgtaggaatagaaagaagaaggatgcgtgcagtggccgaccgtaggaacaggaagaagaaggatgcgcgtgcggtggctggccgaaacaggaatatgagaaagaagaagggtatttttagcattttaccttacgtgatggatgccccagcaaaaatgctgggtgcaccaagtaactcccgtgatcttatttga

SEQ ID NO: 25373 - DNA, 2394 bp, Glycine max
  Peptide Sequence Number=SeqID_142151
atgtgggaggagcttgacaactatcgtccctttccagtctgtacctgggacgctaagaaataccatcagcaggacttcatcattcacttcttgaaagggcttgatgatcgtttttccgttgtccgctcgcaaattcttctcatggatccgttttcggccatcaaccgtgtcttctcgatggtggttcagcaagaacgacaacttcacgttccttcctctgcttcatcagagcctaactccttcgtgaatgctactgccaattcattccaaggcaagggtcgtggcggttatggctctacctcaaccgttaaaggcgctgtcttctccaagaagtgtgcgtactgtcatcgcgccggacataccgccgatgtttgctggggaaagcacggttatccactgggacatccacgctaccccggacaccctcgtttcaacaaccataactcctcttcttctgcaaacagcgttgtcgtcgatgaagtggtggaaggcagttgctctcactctggcacctcctcttccaaccctatcaatttaacccaggcccaatatcaatctctcatggcactcatccaacctatgcagctgaaatcaacttctgatagcattgggccccattctccacaccaggccaaccttctccatgccatcccaaatggcccaaaacgtgtctctaagtctaatggtgcctcatcttcctctccttctcgacaaaccttcttttcaccatcacccattccagaattcacaaaccccatttctccacctctttgcacctcacacccttctccaattcactctccaatacctcaatcttcacctaacaatcgaattcctttcgttcctagatgctcatcccgtccttaccaacctcttgttcgtcttgtcgattacatatgcggtagcgtacaaaatcaaccaagccaatcatcgtcaacgtgcctctatccgatccagtctgccttgtcttattcccatgtctcagagtctgatcgccattatctcatgaacctctcctctgagatcgagcctcgtaactatcaggaggcgatttctcaacagtgttggcatgatgctatgcgtgatgaaattgcagctttgaaactcaataatacatgggaaatagttgatactcttgctaatgtcaaacccattggatgcaaatgggtttacaaaattaaaaggaactctgatggcagcgttgagcgttacaaagcacgattagtcgccaaaggattttctcaagtagagggtattgatttcttcgagactttttcacccattgtgaagatgaccaccgttcatgttatcttggcccttgcttccatttaccgttgggatcttcaacaactggatgtcagtaacgcttttcttcatggggacctttcagaagaagtgtatatgagtattccaccgggattacaaggtcatggatctcctcggtgttgtaaatcgaagaagtccttgtacggcctcaaacaagctagccgcaaatggtacgaaaaactctctactctgcttgtgtcctctggttatcaacaagtgaatcaatatgatgagggtatttgcgtttctcaaagaaagtattgtcttgaattgcttactgattctggaatgctgggctgtaaaccaagttcaacacccatggacagttctatgaggcttcgtcaaaatgactccagttattttcttgatgatcctttgtcttatagaagtcttgttggaagattaatatatcttacaacaacttgccttgatattgtttatgcaacccagcagctaagccagttcatggctcatcctactaagtctcatcttggtgcaacaaggagagtccttcgatatctcaaaagctgtccaagcaaaggtctattcttcaaacgagattctcatacacatctcattggttttagcgatgccgattgggcaacatgtgttgacactagaagatccataacagtcgaatacagggctcttgcaaccagcacttgtgagttacaatggctgtcctatctccttgatgacctcaagattacttgtaccaaatctgcagttctatactgcgacaatcaaagtgctctttatatagctgctaatcctgtgttccttgagcgcacaaaacacctagaaattgattgtcacctcgtccgtgaaaagtctcaagcaggcctgatgcgtttgctccctattccttcttgtcatcaactcgcagacatgtttaccaaagccttgccacctcgctcattcacctccaatgtatccaagctggagttggtagacctctacacaccaccaacttgtggggggctaacagaaaatggcccaaaaccattagaggagacccatgataatttggcccatataaatcctgtagatacctcaaattgtaaatag

SEQ ID NO: 25374 - DNA, 783 bp, Glycine max
  Peptide Sequence Number=SeqID_142152
atggcggaaccgtcgtccaccgccgccaccgctgccaccgccgccaccgcttccaccgctgatcctccggcgccagtgactaaaagctgggccgacgaagcagacgaagaaaccaacaacacctccaccgccgagtcagaaagctcctccattaacctggaagcgttaaccatcgacgataaagaaaataactcttccaaattcttggatgatcccgatgattccaatatccaagcgggttttgaattgaatattattagggttttgaattgtgtccaggttacttctggcgacacgccgtacacctcggcggcgaggttcgaggacctgagcctctcgccggagcttttgaaggggctctatgtggagatgaagtttgagaagccgagcaagatccaggcgataagcttgccgatgatcctgagcccgccccaccgggacctgatcgcgcaggcgcacaatggctccggcaagactacatgtttcgtgcttgggatgctcagccgcgtcgacccaaaggtgcaggcgccgcaggcgctctgtgtctgccccacccgggagctggccattcagaacgtggaggtgctccgcaggatggggaagtacaccgggattgcatctgagtgccttgtgcggttggaccgggatgccgttcatgtatcgaaaagggcacctattatggcgcaggtggtgattgggaccccagggacaatcaagaagttcattagcttcaagaaacttggggacctcgaggttgaagattcttgttttcgacgaggctga

SEQ ID NO: 25375 - DNA, 2214 bp, Glycine max
  Peptide Sequence Number=SeqID_142153
atggagactacaaggagatggctagacatggatgaatggagaatgcatgacttatatggtcaaggaggtctaagaattatggaacaaatgctactcacgctattatcttgtgtgattcaagatgaagggagttgtcactcatatggagatatgttcaagctaactgtagaaaattattcctattggaagttgatgatggaagaccatctgtattacaaggatttgcatgagccaattacccacaagaataaggcaaaggggaagaaagacaacgaatgggagctccttaatcggaaggatgtagctatgatttgtaagtatattgaccgaagcttgtttgagcatggatcaacttataccaatgcgtatgagttatggacaaagcttgaatctttgattctaaagaagacactgatgaataaagctcatcttgtcaaatacttggttaagctagagtatatggatggtcagaacatgattaagcatctaaacactttcatgagttgggacacattggttgtcactctcaacaactctgcactagatggaaagcttagcatggataatgtcatagatagtttgctaaatgaagagtccagacaaaaagagagaggcttgagtagtcactccgaagcaaatattgttgaaaatagacggaggagcgaacaccatggtcataagaagtttgagtgcaaattcttgaagagagatcagaaggctggaattgtccatgctaaccaaattgacccaaaaaagaaaaatgaaggtggaaccactactgttgtggcgtcagaggatgaaaatgtttttcttattggtaatgaaaattatttaaatattgcatctgatgattgtatatggataatcgaatttggagcatccttccatgttactcctcatgaaggatttttctcctcatatcaaaaaggggattttggaagtaagactttgcttgagatgcatttaaaccttatctcaataggaaagctagatgaagctgggatgacaaaccagttcaatgctgacaaatggaagcttagtagaggaagcatggtcgttgctcaagatatgcaaaggagagatggatattgctcaagatacaaccaaagattatggcacaagagattgggtcacatgagtgagaaaggtttggagtttctaacaaagcatcactttccaaacataaaggggcaaccacttgaatcctacgaagaatgtcttgtagatgtttgctcaacttctaaaaagtcccttggtggtgcccaatactttgttaccttcattggtgatcactccaaaaaggtgtgggtgtatccatggaagacaaaagatcaagttcctcaaactttctatgaatttcaagcctcaatagaacaagagactgaaagaaagctaaaatgtttaagattagataatggtggagaatacagaggcccattcgaggcatactgcaaggctcatgggatacaacatggaaagcccatcgtgagaaactcaaggggagagactcttataaaagagacagaacccactaagatgatagaaaccaatcagacaaagcaacctcctcagatagaacaacctgaccaaatggagcagagtctgatggagcatctaacttggatgatggaagaatcaacaatggagactgtccattcagaagatgaatcccaagtgaggcaatcaataagagtcagacaaccatcaaagaggtatttctctgatgaatatgtcaatctcattgatgatggggaacctcaaagtttcaagaagtcattcaaagaaatgttatggatgaagaaattcttaaatgagttgggacatgatcaagacgattatgtggtaaactatgataatcaaagtgccatacacttagccaagaaccctatgttccattcacgctccaaacacattgacattcgttatcattggataagagaggtaaccatgatgggtatgatgaaagttagcatctttgtgtttttaaccctgatgatcacaatggattgttatggtgtcacaaacccgaatgatctcagaattctgaatgatttcagaaaagggttgaagaatccaaagcttctcaaatggccagacaatggaaatgacccttgtggccctccttcatggtcttgtgtgtactgttctggagggagagtcactcagattcagaccaagaatctaggtcttgaaggatcattgcctccaaaatag

SEQ ID NO: 25376 - DNA, 171 bp, Glycine max
  Peptide Sequence Number=SeqID_142154
atggagagtagtgtgacactcgtcgaagatgtgtcacattgttttgagttggaggcacatgtgaacaaagtgacgatctttgacgacagtgacaagtattgttcacccacgaaaaaaacaaaaagatccactaggaatgccttgaggcaaagggagagaagatcagtgtga

SEQ ID NO: 25377 - DNA, 846 bp, Glycine max
  Peptide Sequence Number=SeqID_142155
atggcggcggcgaaaccccaacgcactccgcaggaagtggaggacatcgtcatccgcaaaatctttctagtctcgatcaccgaaatcgccaccactacggattcgagaatcgtgtatttagaactgaccgcggccgagattctcagcgaggacaaggagctccgcctctcgcgcgattgcatggagagggttttaatcgaccgtctctccggcgaattcgccggagccgtagacgagtctccgttccagtacctcgttggctgttaccaccgagcgcacgaggaaggcaagaaaatcgcgaacatgaaggacaaaaccctacggtcggagatggaggcggtggtgaggcaggccaagaagctctgcgtcaactactgccggattcatttagcaaatcccgagctctttccgagccggggttcggcgaattcgggcggtgccaattcgccgttgctgtcgctgattttggcggaggtaggcggcgggaacgtgttcggcggtggcggcggaggggcaaagagtccgccggggtttctggaggagtttttcagggacccggattttgacagcttggacaagattctaaagggtttgtatgaggagctgagagggagtgtgatgaaggtttctgctcttgggaactttcaggactcattgagggctttgttgtatttggttaggtttcccgttggtgctaagtctcttgtgaatcatgaatggtggattcccaaaggggtttatatgaatggccgtgctattgagatgaccagcattttgggtcccttttttcatatcagtgctcttcctgatcatgcttttttcaagggccagcctgatgttgggtga

SEQ ID NO: 25378 - DNA, 234 bp, Glycine max
  Peptide Sequence Number=SeqID_142156
atggctgtggccatgaggcacaacgtgcaacgcagaaggagtaatagagaaggaggaacccatggagaagaaacattgagtttgtcctgcgttttgcgtttaggaattaggatgaattgggttgggggcttggctaatggctggtggttgcagtaccattccaatgaaaatgcctcaagaacaacccaagagtaccaacgaatagaagatatcttcgttggcaccatcctttaa

SEQ ID NO: 25379 - DNA, 279 bp, Glycine max
  Peptide Sequence Number=SeqID_142157
atggcaatcatggaccaccgtcacgatctaccggcagaggtcggtagcgacgtgctcggagtagtggcccttgacgatgatccggtggaagtgcttgccagtgccgtagagctccatgatgaggttgacaaagtggcaatcctcgtaagaacccttgagctccatgatgttgtggtggccagtaaggtggtgcatgatctacacctctcgctggacatcccccaagttgttatagtggacaagtttacgcgtgggtcacaacagagcaccacggcctag

SEQ ID NO: 25380 - DNA, 156 bp, Glycine max
  Peptide Sequence Number=SeqID_142158
atggaatatgaaataaataagttattgcccgagccaagtcaacccgggttctacacaggaggaagagaccattcaaccgtgacaaattcttcttcaagaaattgtgaagcgtactccctcaacgaaatgtctgactcattgctcaagccaagatag

SEQ ID NO: 25381 - DNA, 1666 bp, Glycine max
  Peptide Sequence Number=SeqID_142159
gcagcagtgtttttctgatgcatcaactaggcggcctgctgatttgttatcttcattttccaccatcaaaactgtcatgaacaacttatatgatggcctagctgaagtactcctcatcctccttaaaagccaagatactcgtgaaagtgtacttgagtatcttgcggaggcgatcaatataaatgcatccagggctcatatacaggttgaccctattacttgtgcaagttcaggcatgtttgtaaatctcagtgctgtcatgcttcgtttatgtgagccatttttagatgcaaatttaacaaaaagggataaaattgatgcaaaatatgtgcactgctcaaaccgcttgaagctaagtgggttgactgctcttcatgcatcatcagaagaagttactgaatggcttaatagtaaaaacccagctacaactggggcaaccaatcaatatagtgatgatcaaaaacgcttgcaacaatcccaagaggccagcagttctggtagtaataattttggtgagctgtcaaatgaaaattctgcacgtgctgaaaagacaaaatattcatttatttgtgaatgcttctttatgaccgcaagagtgctcaacttgggccttttaaaagcattttctgacttcaaacacttagttcaggatatttctcggtgtgaagatgctcttgccacacttaaagccatgcaggagcggacacccacccctcaggcagaattggatataaatcggcttgagaaagaaatggagttgtactcacaggaaaaactttgttatgaggctcagatattgaggatgcctctaccaccaacttgcccaatggaatttgctaccatgcctgaacattttgtggaagatgccatggaacttttaatatttgcttcccggattccaaaggccttagatggagttgtgctggaagaatttatgaactttataattatgttcatggccagccctgaatttatcaaaaacccatatcttagagcaaagatggttgaagtattgaactgctggatgccccgcaggagcggctcaactgctacagccactctatttgaaggccaccaactctctcttgagtatcttgtgaggaatcttctgaaactctacgttgacattgagttcactggttctcacacacagttctatgacaagtttaacatccgccataatattgctgaactccttgaatacctgtggcaagtccctagtcatcgtaatgcttggagacagattgctaaagaggaggaaaagggtgtctatctgaatttcttaaactttctgattaatgatagtatttatcttcttgatgaaagtctgaacaaaattcttgagctaaaagaattggaggctgagatgtcaaatacggtcgagtgggagcgacgaccagttcaagagaggcaggagaggacccggttattccattctcaagaaaatattattcggatagatatgaagttggcaaacgaagatgtcagtatgcttgcatttacttcagagcagattactgctccattcctacttcccgagatggttgaaagagtggctagcatgctcaattactttctgctgcaattggtgggtcctcaaagaaaatcgcttagtctgaaggatcctgagaaatatgaatttcgtcctaagcatttgctaaaacag

SEQ ID NO: 25382 - DNA, 1857 bp, Glycine max
  Peptide Sequence Number=SeqID_142160
atggaaaactttgatattcttggtgtgtgccttttgttcctctccttgataaccatgtcctccacgttggacatggttacaacaattcaaccaatcagagatggtaagaatgagaatgaaactctggtttcaacaaatggaacctttgaagcaggattcttcagcccagaaaacttcgacagccgttacctcggaatttggtacacaaatatatttccaagaacagttgtttgggtagccaacaaagaaaaaccacttaaagaccactctggagtcttagaagtagacactgatcaaggcattcttagtatcaaggatggtacaggagcaaaaatatggttctcaagtgcatcacacacaccaaacaaaccggttgcggcggagttgttagaatcaggaaacatggttcttaaagatggagacaataactttttgtggcaaagctttgattaccctggtgacactttacttccaggaatgaaaattggagtgaacttcaaaaccggtcaacatcgagctctaagatcatggagatcctttacggatcctactccaggtaatttttcacttggtgttgatactcgtggccttcctcaattagttattacaaatgagaatactaatagtaatgacatagcttatagaccagggtcatggaatggtcttagtatcacggggcttcctggagaaataactgaccaattaacaaaatccctttttgttatgaatcaagatgaggtcttctatgagattcagctcttgaatagttcaactaaactcatgagaagcagattgcttccagaagggtatcaagtacgttttatatggtcagatgagaaaaaaatatgggattctcaattccctaaaccatttgatgtgtgtcagacatatgccttgtgtggtgcaaatgctatttgcgatttcaatggaaaagctaaacactgtggatgcttgagtggattcaaagccaactctgctggttcaatttgtgctcgaactacccgtctagattgtaataagggaggtatagataaatttcagaagtataagggaatgaaattgcctgacacatcttcatcttggtatgataggactattactactcttctggaatgtgaaaaattgtgcttgagcaattgctcttgtactgcatatgctcaattgaatatcagtggcgagggaagtggctgcttgcattggttttctgacattgttgacatcaggacactcccagagggaggacaaaatttttatttacgaatggctacagttacagcttcagagttacaattacaagatcaccgcttcagcaggaagaaattagcaggaattgtggttggctgtactatcttcatcattgcggttactgtattcggattgatattttgcattaggaggaagaaactcaagcagtcagaagcaaattattggaaagacaagagtaaggaggatgacattgatttaccaatatttcactttttatccatctccaatgccacaaatcagttttcagagagtaacaaattgggacaaggcggctttggacctgtgtacaagggcatattgccagatgggcaagagattgcagttaagagactttctaaaacttctggacaagattcaacaagacgcacattattaggttgggctaagcgattcgaaattattggtggaattgctcgaggacttctatatcttcatcaagactctagactaaaaatcattcatagggatctcaagactggtaatgttcttctcgatagtaatatgaacccaaaaatatcagattttggtatggctaggacatttgggctggatcaagatgaagcaaacacaaatagagtgatgggaacatag

SEQ ID NO: 25383 - DNA, 648 bp, Glycine max
  Peptide Sequence Number=SeqID_142161
atgattttgagcctatcttcacaccaaaatgagcaggcttcacagaagtccagtaggctttccttttttcaaccatctcagcactctcattcaacccaggaagaccatggggggattcagttagagttgaaagtgttcttccaacaagagttgcatctgctgaagctagtgtattactcaatgtatgttcatgtggaaagactagctagggaaatattgcgcggggctaattctgtagagggtcttgaggccaaactgttgcagcattctcttccaccgcaagccaccgcgagcccagctgctgcttctttcgcctggacgccattgccgttcgagaaccatagggtagaagacgagtgcaggaggtgccggaaaaaatggggaaagggggctgacggcgagacttccggaagatccgttaggggttcttccggaacttccggaagaacattttccggaaactttccggaagaagtgttcttccggaagaaaccaaacgttttccggaagaaccctgcttccggaaactttccggaagaaggtttcttccggaaacgtttgggatttccggaagaagtttccggaagaagtgttcttccggaattattccggaagaacagttcttccggaaaattttatgaaaaatga

SEQ ID NO: 25384 - DNA, 177 bp, Glycine max
  Peptide Sequence Number=SeqID_142162
atgtttctcttaaccagtgtttttaagggattcgaagatattcaaggatgtaaatccaaggctattgttggattgattgcagttaaatgtaataagcaaagagaaagtactaagagtggctattatgtaatgcattggatgccaacgataatcttaggaggtttcaaggataattag

SEQ ID NO: 25385 - DNA, 264 bp, Glycine max
  Peptide Sequence Number=SeqID_142163
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggccttcgtggcttacgtgctgacgattggttcctgtgttgcctacctaccaaacggtattcgtgtggcta

SEQ ID NO: 25386 - DNA, 798 bp, Glycine max
  Peptide Sequence Number=SeqID_142164
atggactctcccgatgtcggtggtgcggtggcggatgtacgcaaatcacaagcagacttgcaacttaaacagcaggcattggagcgtagccggatgctggtggatcacggtgtattggcgaaaaaggaagtggaagtcgcgcaggctgattgggctagctcacgtgcagagtcagaacgtgctaccgcccgcttaaagaacctgggagtttcgacagcagccaatgataactacgcagtgcgctcaccgattgcaggtatggtggcagaccgtaagattaatcctggcagtgaagtgcgtccggatgcagccgatcctttgtttattgtgaccgaccccaactatttgtgggccagcattgatttacccgagcgagatttaagccggatctcgcaggggcagaaactcagcatacaagtagatgcctatcctgatgaagtatttagcggtgaagtgaaaaccataggcgtcatggtggacccgacgactcggcggattcctgtacggtgtatggtagaaagcaagggcaagctcaaaccagaaatgtacgcgcggattacgccgctggatagcagccagcaccgcgtgatccgcttgccaaatagcgcattgattaccgaggggctgtatagctatgtgtttgttgaagagcgccccctgcattttaaaaaacgcaaagtcacgctggatttgcagcgccgcgaatatgccaccgtgaaagaggggttgaagctgggagagcgcgtggtagtcggcggggccatcctgctgaattcggatttgtccgtcagtaaataa

SEQ ID NO: 25387 - DNA, 717 bp, Glycine max
  Peptide Sequence Number=SeqID_142165
atgaccttggctgccttggccagtctacgacaagcagacgatgaatccctcagaaagttcattggcaaatttgggcgcacagtcgtccagatccgaaatctcaaccctgagataaagttgcattccatgcttctcgcactacaccctagcaagttcgtagatagtttgtgcaaaaaactacctggtagcatggatgagccgcacgaacgagccaagggttacatccagatagaagaaatgtccaaattctggaatgaagtgcaaagcaaacaccaagaccgacttgcacaagtcggacaagaggcacaagctagacaagcgccaacctctctccaaaaggctcggtatgagcgttacgtaccattgacggccaatcgtaccacgattcttgaggaagccttcgacctggaggtacctgtccggctaccccaaatgaaatctctgaggccagggtcagacgcaaccaagtactgcaggtttcaccgcggtattgaacacaacaccaaagattgttgggccttgaacggcaagatcgaagaacttatacaggctggatacttagcccagtttgttaagagaccagaccactaccaggaaggagtaaggcctaaaggacatcaagaggagcaacacaagaaccaagaagtagacaagagaagactggaagaccgaggtagacagagacaacaaccacagcggcacgagcgatcaccttaa

SEQ ID NO: 25388 - DNA, 360 bp, Glycine max
  Peptide Sequence Number=SeqID_142166
tcaaaggagtttcaaagaccaccaactgcatgggaggagaaatatcaacatcgtcaagatgaaatcttacaacattcgacaaaggaaggcacatctacacgtgattcccctaacactgctacttttgttaatgataatgaaatatatttgaatgctgatggaggtccaaattacaaggggaatgtgtacgagctaggtactttgagcaaaaggtttagttgctcaaaatcagctccatctacttctattgcacccgtggaagaccaaatagagaaaatgcgtgagacaattaataaattgaatgttgagcttttagcaaaggcaaataaggagaaaatacttgaggaaaagatgttgtag

SEQ ID NO: 25389 - DNA, 791 bp, Glycine max
  Peptide Sequence Number=SeqID_142167
gactacacgtcctcaccttcagaggacttcacatcctcaccttcagaggattacacgtcctcgccttcagaggactacacgtcctcgccatcagagggctgcaagcccccaccttcatagggctacacgtcctcaccttcagaggactacacgtcctcgccttcagaggactacacgtcctcaccattagagggctgcacgccctcaccttcataaggctacatgccctcacctttagaggactacatgtcctcacctttagaggacttcgtgtcctcaccttcagaggactacacgtcctcgcttttagaggactacacgtcctcaccttcaaagggcttcacgcccccgccttcagaggaccatacgtcctcaccttcagaggactacacgtcctcgcctttggagggctgcacgccgtcgccgtcagaggactacacgtcctcgccttcagaggactgcacgtcctcaccttcagaggactatatgtcctcaccatcaaagggctgcacgccatcacctacatagggctacacaccctcacctttagaggactagacttccttgccttcagaggactagacgtcctcgcctttagaggactagacgtccccgccttcgaaggactgcacgccctcgccttcaaagggctacacgtcctcgcctttagaggattacacgccctcaccttcaaagggcaacatgtcctcgacttcgaaaggctacacgccccctcacctttagatggctacacgtcctcattttcagtgggctccatatccacaccttaa

SEQ ID NO: 25390 - DNA, 339 bp, Glycine max
  Peptide Sequence Number=SeqID_142168
atggaatctgaaacatcagaggaagtacctggatcggctactaatgaggtggttcctttgtcataccctaatttcgttcgaggactattgcttgatggcatgcaacctttgattgaccgcttcgagattcttcctccagaaggcggttgcttctggaggaagcaacctagctcgcctgggcgagctgggaaagggttcagccttctcggcacttcgtattcacttgaaattgctgagaaaaattttttccgtgaagaaaattcaagccgagacgcttccattttcaactgttcttcgtcattcatcgttcgttcttcattgttcttcggtcttcaaccg

SEQ ID NO: 25391 - DNA, 297 bp, Glycine max
  Peptide Sequence Number=SeqID_142169
gggaggagcttgccacccagctcgcccaggcgagctaggttgcttcctccagaagcaaccgccttctggaggaagaatctggaaggcccaagtgggcctgctttcaaagagttacggaaactcacggattgcgtaacaatacttccttttgatttccggcacgttacgaaatttcatggattgcgtaacaacgcttcctttcgatttccggcacgtctcgggacttcacaaattgtgcaacaaagagtgccaaattccatggccactaatgatattgcttctattaccaatccctaa

SEQ ID NO: 25392 - DNA, 264 bp, Glycine max
  Peptide Sequence Number=SeqID_142170
atgaagcaaaatcttgaaaatgaagtgaagcgccaaatcgtatgcatattggaagagttgtcgacctctgaatcacctactaactcaagtgctcagatctggaaaattcgtaagttgtatacggatgagcttacggatgcagttcttccgtatgagtttacggaagaagttcttccgtggaaatggcctggaaacgaagaagaagaaaagcgacaagctacggacaccaaccagcagaacgaggaagaagaagcggaagcgtag

SEQ ID NO: 25393 - DNA, 492 bp, Glycine max
  Peptide Sequence Number=SeqID_142171
atggcgtggtatcaaagtaatactattatttatttaaatatgcaactgccaatgaattttgaaactagtcaatcgtcaagggcaacaaacatcgtgcaaccagaatgtaatcctgcaaacacaccaattccccacatgacaaattatgttccacccacatacacaccaatcccccccatgacaaattacgattctcttagtgcttcaaacatggactacactccaccgattgtccaaccagatgatttcttgagcaatgtttttggaactgattttgtggaactgattttggcacgccagcatcagctcgtgaatacatgcatagcctacaaaacaaagtggaaccaagtttcaactttatgtttagcaaggatgtataagacaataatccatcactgcctgacataccagatgaacacccacgttgaaatccaggacgtaacaagagatgccctccatgtggaacaggacaccattatcgggattaagtag

SEQ ID NO: 25394 - DNA, 513 bp, Glycine max
  Peptide Sequence Number=SeqID_142172
atgatttcttgtttagccaggcctcgttacaagccaataaaagtccttagtgatccaccaagtataagtcgtaaaaatttcaaacactcaccccagacacttgtgcgcagagagaaacactacccttctgaggaaaattatggcaaatgcagaaaagaccagttgaaagaatttgaaaaaattggagctatcgaaagtgttggagcattcggagcctgctctcatttttgtttttgcttgaggacaagcaaagttttaatttgggggattgtgataactgctaaatatgagttgtcgcaacctacccttttgcaggcgagtgaggtgaggctctcgggtgtgttttccaaagtaggaaaatgcgcggagtcgccaccaatgtttatttgtggaaaacatcggaaaaaacgaaggaaaccggtcataaagaatattctagattcaggagttgtatttacgtttgaggaaggtattagcacctctcacgtttgtcccaaaggacaacaaccttaa

SEQ ID NO: 25395 - DNA, 1083 bp, Glycine max
  Peptide Sequence Number=SeqID_142173
atggttgtcctagatgatgctatctcaggagatactctcagttctacctcctctggtgataatcagccaattgtggaacttggaaatgactttgttggagagtatattactgataagccaaaggctcgaaactatgtgtctcgttctgcagttgcattgcgttgcagggttatgcctcctccttgtattagaaacccctttttgaaatgcctttcagaaaaggaaatcgacccttttgaaagtcaaagatcaaaatttgcaggcctcttccctgcacttgttggtggtggtggtggtggtgattgtctttcacgctaccgcaatgactttcatgagattgagcaaattggtataggtcacttcagcaatgttttcaaagtaataaagcgaatagatggttgcttgtatgctgtgaaacacagcaccaggaagttgtgcaaggaaacagaaagggaaaaagccttgatggaagttcaagctttggctgccataggttcccatgagaacattgtggggtactattcttcatggtttgaaaatgaacaactgtatattcagatggagctatgtgatcacagcttatccataaaaaattgtccatcattagtcactgcaggacatgaaatagaagctttgtatcaggttgccagtgcattgcaatttatccataagaagggaatagctcatcttgatgttaagcctgaaaatatttatgtgaaaaatggtgtttataagcttggtgattttggatgtgcaactctacttgataatagccttccaattgaggagggtgatgcacattatatgcctcaggaaatccttaatgagaattatgatcaccttgacaaggttgatatcttctccctgggagcttctatgtttgagctaattagcagctcgtgtttgccagaaccagaatcaggaattcagttctttaatcctaaagagggaaaggtgccattcttgccaggagtttcagtgcaatttcaaaacttactcacggtcatgatggaccccgatccggttaagcggccttcggctacaaagttgctgaagagggtccttgaaatggcaagaaattga

SEQ ID NO: 25396 - DNA, 369 bp, Glycine max
  Peptide Sequence Number=SeqID_142174
atggcattcttgggagaaacaagcagtcagaccattgctaactcgagattagccttcatttttccaaatggaccaatcactcataaccaaactggtgtttattttcaaagtctcactccaacaccaataacaccggatggtatactcaacctgcttcaatccactatcactcctactcattatgcaattatgtattacaataggaagtggaacataccacgccaaggtgggtttttgggttactccttcactggaacaaatccaataagatttgacattcctttgggatgtagcatggacaaactcaaggatttaatcaagcgagttgcacctatgggggttcccccttatggaattcatgaatcatag

SEQ ID NO: 25397 - DNA, 272 bp, Glycine max
  Peptide Sequence Number=SeqID_142175
gagcccagccttctccttctggaaagggtggggcctccgaagcccaggagcctgaactagagcagccaacagtagcagcagagggggaggatgagctcacccctcctgagcctttttattttgatgcaaatccacacatggctcaggaggagaggacttccacagataagaaacctgagccatctccagcacccatacctgatgatgccataccatctacaccagcatctgagctagagcagtctatccctcaggattcaccaactgcttag

SEQ ID NO: 25398 - DNA, 291 bp, Glycine max
  Peptide Sequence Number=SeqID_142176
atgtctcggagttttgatatgattagagctattgatgatagcaaagatacattcaagcttgcagttcggattgtggacctgtgggatagaatccatgccattgttaagaaagaggatttggaatgttgggaagttgaagttaaggaaggaaaaacatattatatgtacaactttagggttgttccaaatgatgaccaatacagagtttgtgcacatccattcaagttttatttcacttgtggtacaactatgaggaaagtggatcttgctgaaattcctcttcaattatga

SEQ ID NO: 25399 - DNA, 384 bp, Glycine max
  Peptide Sequence Number=SeqID_142177
atgtctcttgtcactctcattggaaaacttcaagaacatgaaatggaacttatgagactccatcaacatgaagagaatgatataaagagaaaaggaatagcactcagagcctcattatcttctagtcaagaagaaagtgacaaagaggacttgactgaaatagaagaagatgatgatgatttcagattctttgtgaaaaggttcaataaatttataataaacaaacgaaataaaagggaatcaaacatcaatacaaagaagaaagaagaagattcctccttagccccaacatgctatgaaagcaatcaacttgggcacatgagattcgattgtcttgtctttaaaagaagaatggaaaaatccgacaagagaaatctcaaataa

SEQ ID NO: 25400 - DNA, 471 bp, Glycine max
  Peptide Sequence Number=SeqID_142178
atggctggtctcagaatgttaattccgtattgcagcagtgttaagtcaacatccatccatataacagaacaattatgtagagtctttctgtgtgcgtctagtcggcatgcagatattggtggtgccggcgacttggtcttcgagaaaaacctctctttgccattggataggaattcttggatccgggctgttggtattttttgctgcgaaggaattcaacaccaattggtggggaatgtcaaatcacctttggaattgtctgaggaggaatggaaccatgcgttcagaacaaacttaactgggacatggttggtctcaaaatatgtatgcaaacgcatgcgtgatgcacaaagaaaaggatcaatcattaatattgcttcaattgctggtttgaaccgtggtcaattgcctggaggtgctgcatattcatcctcaaaagcaggcgtcaatatgctaacaaggattccttaa

SEQ ID NO: 25401 - DNA, 348 bp, Glycine max
  Peptide Sequence Number=SeqID_142179
atggctaagcaaccagctcgcttgggcgagctgcaaccaccccaaaatggctttttctctataaatagccatgatggggggtgttttaaggggctagaagattcaacattaaagggaattaagagaattgagagaaaagaagaagaaagagaggcagaaggagaagaaagaagaggaaacgaagccgaggcgctaccgaatcacgaccgtgatcaatccccatgtcatttcttgttctgcgttcttcatgcgacagtcgcattcgctaagcgcaacactcagtggctaagtgcgaggaagaatccagaagaagatgagctgtcaggtttgctaagcgcaccgttccag

SEQ ID NO: 25402 - DNA, 1209 bp, Glycine max
  Peptide Sequence Number=SeqID_142180
atggagtctaaggagtcaagttccacgcttaggggtctagatgaagaggtatttgtcatgtcctcgtgttctaattccatggagtcatattcgttgtctcttaccattttgtttgttgaagagggttcattcgactttttggcttttttggatagcttaccggagcatatagtcgataatctcagtcgtggcactagtggtgtggccgatgtcatgtcagatgctccaaaccatctagtcagggctccccaaaggtatttcatggtagaggaagaggaggatgagactcaggttgaagtcgtcacccaaaaaagtcaacgagtccaagttgagaagaaaaagtatccttcgatcactctacctcaatactcgtggatggatggggaagtgggaaccttcttttcccgtgcttcggattttgaacgtggcccctacccagcttcatccgaatggttaggctgtcatctaagcgttctaggccttatgcctattacacatgtgccctgccagtacaatgagttccctttggattacttgtctggagaggaactaggcaacttggctttcctcgagtcgctccctcgacgccttccttcgaaggctatcatgaatttgtttaagtcccctaatccgattaggaatcttgaagcttatgccatttcccttcttactagggaagccaagcaaaaagaccaggggaagcactatgaccaaaggcaaggttcggttcagccttccggccacgagggctcaaagaaaatgaaacaacaagcacttgaattctcgagcgctcatcccctcagcaacatcttgattttgaccaacattgacttcttcaccaatgactttgtgtcgatccacatggttgaaccgacccacatatcaaagcaaggctgccatgtgctgaataggagcgatgatgccgccaactggaccaatttttgggttttcatgcatgagtggtggccatcgctcaacaccttcaaagtaccagatgagtccatctttgatatggacaaggatgtttataatggggagttgattcctattgatgacattcttgaggatggggcaccctgtgctgaattgttggcgacccctcctagcaagatccaaatgactaaggggctcgagaggagaaaggtgacaatgatgaagatggtaaagtgcaggccaggagtggtgacgatggagaaaatgcctaaatag

SEQ ID NO: 25403 - DNA, 858 bp, Glycine max
  Peptide Sequence Number=SeqID_142181
atgtaccggttgtcctgcaaatctgaagagatagaaaaaaattgccgcaaactgtcatgcgtctatcctggggtgtgtgagaacctcaacaccgatcattcggccttgatccagctttaccgcaaggcgcgtaatctgcgcggcgtgaagaaaatcctcattggctcaggactgcgctatgacctggccgtgaagtcccccgagtatgtgaaggagctggtacagcaccatgtgggaggctacttgaaaattgcgcctgagcactcagaagacaatgtgctcagcaaaatgatgaagcctggcatgggggcttatgatgagttcaagcgcatgtttgaaaaattcagcgccgaagccggcaagaaacaatacctgatcccttactttattgcagcccatcctggcactacggacgaagatatgctcaacctggcgctatggttgaagcgtaatgatttcaggctagaccaggtgcaaacgtttacaccaacgccgatggcgatggcgaccgccatgtatcacagtggcaaaaaccctttgcgcaaggtgacagctgattcggagcccgtgccagtgcctaagaccgggaccatccgcaaactgcataaagcttttattcgctatcatgatccgcagaactggcccatgttgcgtgaggcgctgaaaaaaatgggccgtgcagacttgatcggtaatggtaaaaagcacctggtgcctgcttaccagccggcggtcttacctaaaattgtgcagtctgatggtagccgcttccaggccaagcctttgcctaagggatttaaccagaccaaaagctttgccagcccgaaaaagcatactggcggccgccacaagcattaa

SEQ ID NO: 25404 - DNA, 243 bp, Glycine max
  Peptide Sequence Number=SeqID_142182
gtagctgctaccactcctgagcgatcccttgaggctacttcagagcattctgcaccagtggtaaacctaccctttcctcagcctgcagcagacccctccactcctcttctacagatgccagatgacccaactacaccagtcctagctgtggacacttctcctcccactactccaatgcttcagctgacagatgaggaggatggtcagacacaagatacacaagaccagtcacaggaattttga

SEQ ID NO: 25405 - DNA, 240 bp, Glycine max
  Peptide Sequence Number=SeqID_142183
atgaagaagatccaaggcctacaagctccacatggagctacatcacctttgagggaggatctactggtcagtaagccatcacccactctttatattgaagctgctgaggaagccttggagacctcattccaagggcttgaaattgtgaatgctatttatgcaaaggatgggaagacgattacccaatcgttaggtgcttctatgatggtagcaaaagttatgctagagaatgggtattaa

SEQ ID NO: 25406 - DNA, 312 bp, Glycine max
  Peptide Sequence Number=SeqID_142184
atgaccccagccatagtgcttcggcaactcaaatggactcaagtagtgcccaaagttgaagaattgggagggttaagtttccaatatgctttaggcaatactaatgtagatcaagcaaaggttagaacaacttgggataaggtcaaaaagaaaagggagaaagagtcaggaaaacttcgtgtgacagcttcctcagagtataaagaatggagaaagctcagaggagttcccactccaatccttgcagaaaccccatgtggggatagttcatcctatgaatctgtccaaatgattgcctccttgactttttag

SEQ ID NO: 25407 - DNA, 810 bp, Glycine max
  Peptide Sequence Number=SeqID_142185
atgacgttgtttatcaataccttgcgtgagccattttatgataagatgattgggtgtacctcatcaaaattttttgatatagtcgtcataggggagagagtggagaacggcatgtggaaagggaggattgattaccctagatcagccaattcaaaaactcttctaagtgggtcggggaaaacaagaagggaacaccaatgcagtgatgtttcattctcctggggcacctttacagtgcgaagcaaggaatcactcagtgttttgatcaagaaaacaaaaagataccaaggaagggggcaaaagggtacaccaaattacatcgtgagtggaccaaagctcatcactatacaagtttcgaaagcttttccttacaaggataataaagcagtgccttggagatgtgaagtcaaagtgtgtgttgatagttttgatgaaaatatgactcagagcattcgaatctatagtcctagtgaatcaaggaccgaaccatctaaagaaataaagggtaaagaagttgtgaggagtccaaaggaacaaaggaaagagatttatgatgaaaagtcttgtgaattcataatacttataaaacaaagtgaatacatagtgatggatcaactcaattgcactattgctaaaatatcacttttgtccctgatgttgaactctgaaccccatatgaaggtactattgaagatattgaatgaggctcatgtcattcatgacatctctgaggagatattcgaaggtattgttggtaatgtcaccacaagaaattaccttatgctcactgatgaggagatgcaagcataa

SEQ ID NO: 25408 - DNA, 414 bp, Glycine max
  Peptide Sequence Number=SeqID_142186
atgcatggattctcccctgttgatggttttgtggagataagcaattgcttggcagaagtgattaaatatgtgggtaatgaatcgtctactggtctcttctttatccaacatcacacccaaaacgcagtccccaatgtcatcaaacttaagaacaacattattgacaagtctcatgaaacaactttgcacaccgaagatttggaggattccgtctcaatgcctctttgcatatgcaagggtaaggctgcgtacaacatccttccctcataccttcgcatagcgaagagcctctgggcaatgggcttttcaaaacagaagactaacagcctcaagtggccacaacttgattctactggatcagtaaggtccaatgctgagaagccgcagatgtaccgtagcatcttcacaagctga

SEQ ID NO: 25409 - DNA, 2523 bp, Glycine max
  Peptide Sequence Number=SeqID_142187
atggatcccccactccaattttcctctccccaaaaccccaaccccaaccccaaccacaacgtgttcttggacccaacctccgattcaatcccaaacctcctccaaaacccgatccactacctctccttctccgtccccaagaaacgccgccgcggccgctcccagcgcaatccggcgtcgtttcgcctccctcctctcaccaccctccctaccgccgccaacccttctccctcagcctccgacgaaatcatcttcatcaacaaagagcccaaaaccgaagccctaatcgccctcaccgctgggttcccagcggactccctcacggaggaggagatcgacgccgccgtgctcccggtcatcggcggcatcgagcaggtcaactacactctcatccggaaccacataattgccaaatggcgcgaaaatgtctccaattgggtgagtaagaaaaccttcctcgattacattccgccgcattaccattcgcttttggattctgcgtataactaccttgtctcgcatggttacatcaatttcggagtggcttcttcgattaaagagagggttcccgcggaggcgagcaggccggcggtgattgtcgtcggcgctgggcttgccgggctggctgccgcgcggcagctcctgaggtttgggtttaaggtgacggtgttggaaggaaggaagcgagccggggggcgggtttatacgaagaagatggagggagggaataggatgtgtgctgctgctgatttgggagggagtgtgttgactggtacattggggaatccacttgggattgtggctaggcagttgggtgagttgcttcataaggtgagggataaatgcccgctttattgtgtgaacgggatgccggttgatccggatatggatgtgaaggtggagtctgcgtttaatcggttgcttgataaggcgagtaggctgaggcagctgatgggggaggtttcggtggatgtgtcgctcggggctgcgctggagacattcagtcaggtttataaggacgcagtgagtgatgaggaaatgaatttgtttaattggcatctcgcaaatttggagtatgcgaatgcggggttgttgtcaaatctttcgcttgcgttttgggaccaggatgatccatatgatatggggggagaccattgctttttgcctgggggaaatgggaagctggttcaggctttgtcagagaatgtgccgattttgtatgagaagactgtgcatatgattaggtatagtggcgatggagtgcaggtgactgcagggagtcaggtgtttgagggtgatatggcattgtgcacggttccattaggtgtgttgaagaaagggtttatcaagtttataccggagttgcctcagaggaagcttgatggaataaagagattggggtttggtctgctgaataaggttgccatgctttttcctcatgtattttgggagatggatcttgacacatttgggcatctttctgatgatccaagtcgtcgaggggagttttttttgttttacagttatgtaactgttgctggtggtcccctgttgattgctttggtagcaggggaagctgcgcataagtttgagagcatgcccccgacagatgcggtcacacgggttctccaaatactcaagggtatctatgaaccaaaaggaatcactgttcctgaacctatccaaaccgtatgtactagatggggcagtgatccattctgctttggttcttactctaatgttgcagtcggagcttctggtgatgattatgatattttagcagaaagtgtgggagatggtagacttttctttgctggggaagcaaccactaggcgctatcctgctactatgcacggggctttcctaagtggtctaagagaagctgctaatatggcccaccatgataatattcgaacactgaagatgaaagttgataaggccccttcaaatgctcattcctgtgcttcccttcttgcagatttatttagagaacctgatatagaatttgggagcttttctgtcatttttgctcggaagaatacagaccccaagtcaccagcaatcttgagggtaacatttaatgaggctagaaagaaatgtcatgaagttgcaaaacaggaccaacaacactcaaacaaattactttttcagcagcttcagtcacattttaatcaacaacagcagcttcatgtttacactttattgtcaagacaacaggttattgacctaagagaggtaagaggtggtgatgaaatgagattaaattacctttgtgaaaagctaggagtgaaactggttggaagaaaaggattgggaatgaatgctgattcaatcattgattccattaaagctgaaaggggcaatcgtaagcccgtttcaacctctctggctcttaaaccaggtgggggtgtcgtcaaagctaaaggcggcgggcattatgaagcgcaagttagtcagaagggcaaaagtggtgaggaaaagcaatgggtccataaatgtgcggagtgccatcaaagtatctga

SEQ ID NO: 25410 - DNA, 201 bp, Glycine max
  Peptide Sequence Number=SeqID_142188
atgaagtgcatcagttggaactgtcgtagtttaagggcaccacaggaagttcgagccttaaggaaactcttggcatctgaagtccctgatatggttttcttaatggaaactagaaagaagaggaaacgagaaggaaaggattggaggcttgatgatgctagaatgaggccttggaggttgatatccagtcgagctccttga

SEQ ID NO: 25411 - DNA, 345 bp, Glycine max
  Peptide Sequence Number=SeqID_142189
atgctcctaattgatcatttggccaggaaacggagtccccacttgtatcgcttcgagcaagcatggcttagaagtgaggattgtagggagattgttcagaggacatggaggataggaggcgcaataacaagtaacctaaatcgggttggaggtgtacttggcgagtggggcaagatgactttcaaggagatcccaaggaggattcttatgtcatgtcactctttgtgggtattgaggagcacatcaacaaaggagaagcaagcatctgaggtttccacagaagatttccgaaaggtttctagagtagtaaagttcatggcatgccttcgtcttttatgcttttag

SEQ ID NO: 25412 - DNA, 405 bp, Glycine max
  Peptide Sequence Number=SeqID_142190
atggaggccatgaaagagcaaatggccaaaatgatggaggccatgatgagcatgaagaagataatggaagctaatacggttgcaattgccgctactagcgctattgctaaggtgaacccaatgcccccatctggcgtcaaccaaatgaatcatgcaacctcagctatggtaggcaaagatttgggaagtacgggcggccccattatgtgcaaattcaaaacaagcatgccttcccaccatatggcttgcctcccaactatacaccacccaatgtggcgtacactcccagtgagaatgtcaataactccactcccatactcattgagagccaacaaccccaaactgatcatgcacatgtctctcaacccatgggtgagacacatgaaatgccccaccacaatctag

SEQ ID NO: 25413 - DNA, 156 bp, Glycine max
  Peptide Sequence Number=SeqID_142191
atggccaaagaatttgtgaaggactctgttcatcaaaacgacatcgctatcataaccctcgatcaccccaaagatgtaaatgttttttgctttgtttgtggttttccctcttatgagatgatccacgaaggagcatccacaaggcaagtttgttag

SEQ ID NO: 25414 - DNA, 150 bp, Glycine max
  Peptide Sequence Number=SeqID_142192
atggcagccataatcccagccaaggttcctcaacctccatttttccgaggatacaactcgaatgcaacattggcatgcgctcttgagttgatctccaattctgttcaatcagaaattgctcgttctccacgtttggtgagggtgccataa

SEQ ID NO: 25415 - DNA, 375 bp, Glycine max
  Peptide Sequence Number=SeqID_142193
atggaggtattcggtactcgagatgatgttttgcaatgggctcgaacagttgcccatgaaaatggatttgttgcagtgattatgaggaatgaagaattcgttagaaaagacactgggagtaggaaatgtggttgtcccttcaggcttcgtgggaaaccagtgcatggaggggaagtcgatggtgaaccaacaaacatcttgctaacgttgaaggaacacaatgccaacagttgcaccacgataaagcaattttacaatgcaaaaagtgcatatcgttcttcaataagaggagctgatatcgaaatgcagcatctgatgaagcttctcgagcgtgatcaatacattcattggcatagattgaaggatgaagttgtg

SEQ ID NO: 25416 - DNA, 477 bp, Glycine max
  Peptide Sequence Number=SeqID_142194
atgttgggtgcacctagcaacactcaaaaaatggtcatgaattggcctacaggcccattatcgcaaataacttgttgggatatgctaggtgcacccagcaatattgctagtgcacccaacaatttattgaaagcattctctcttcttcatttctctcttccacgaaagcttcttaagttcttctcttctctcttccgcgacgagctcggtggtggtcttcttctccgccagcccttggacccatttgcattcgagaagacgccgaaaaaatggcaaaagcttggtgacggtggcgccttccggaagacccgtttgggtttcttccggaacttccggaagaagggttcttccggaagtaatgaaacgtcttccgaaagtactggtcttccgaaaagctcccggaacacctcttccggaaagtttccggaagaagtagttcttccgggaacattccggaagaagggttcttccatatga

SEQ ID NO: 25417 - DNA, 2329 bp, Glycine max
  Peptide Sequence Number=SeqID_142195
tgggtttggtgtagcattgatgggttctagaaaccttgttatgctcaaaacacacattggttcaatcaatttgtcttttgctaatggttttgtgtatgaaaacgtgctttgggccttggcttctctttgggttttcttctgcaactatgtcatgtattacttggggttgattctcagatacatcttcagatttcatgtagaagataggaaaagtgagcactttgttccacatgatctgcttgatcaaaccaagagaaatcagactgaagatcctaaggttgatggagtcgcacaagagttggcaaatttgttatttccgatctttgaaaattttcatgtagcaattgatgaaagagaaggagaaacagagtgccctgttttattggaggtagactctgatataaaaattcatcaagatgctaggaaattagaaggagaaacagattgctctgttttaatggagatagactctgatgttaatgaagatgcaaagaaattggtaggagaaacagagtgctctgttttaaaggagaatgactctgatatgcatgaagatggtaggaaaagagaaggtgaaacagatgagtctgttttcctgaagagtgttgcatatgttcatgaagatgttaagaaaattggtgaaaatgaaacagagagctctgttttcttggagggtgattccaatttttctcaagataatagggagaaagttgaagaagaagaaacagaagagtctatcttcatagatacttactttgttgaagctagtagtttggtagaagaaccaaggatcttgaccttcactttccaacaaaattatatagctgcaaatgcttcttataatgcattttccagcactcaaaatattgctaaaatggaatttcatgagaagaatttggagaaaacccttgttgctcaagaagaagagaatgagcactgtgttctagaacagagaaacatcacatccaattccacttccggtcaaatctttcaaattaatgcggttggtagaagtgactcatcggatgatgatcacgttcgacacgatggtgacgcatttcaatctgattttaggtcagaatcatgcagcggcagcattgatgattcgttaaaacatcgaattccgagttctaaccattcttgtgaaggatttgattttgtaagtcataaagatgaaagagttgaagacattgaggaaactcaatattcatgtgaaagtgaagtctcaaacagtcagaaaacaaaagaaaccatgtgggaagataacttggatgaatcagattttgatgaagcagaggatgaagatgaagatgattttgagtgggagcatgatgaggtagtggaacaattgagaatggaacttaaaaacgcaagacaaggagggcttgccactattttggaagaggaagaagaagaggaaacagagtctccaaaaaatgttgaggatctaaagccattgaagattgaagagaagttagaattcaaggatcacattattgaaattcaaaaggtttataggtgctatgcagagaaaatcaggaaacttgatgttttgaattaccagaccatgcatgcaatagggcttcttgaactaaaagaccctctaaaattaatgtcaatcccaaaatcaaccgtccaaagtgcaaaacctctatctcagaatttgtggccacgcaaagcacaaaagcaaatatctgacccaatattgaagtttgtccaagaactgcatggagatttggaattggtgtacgttggccaggtttgcctctcttgggaaatattgtgttggcaacacaagaaagttcaagagttgaaacaatatgattcacaatggccacgtagctataatcttgtggctggtgattttcaactttttcaagtcctcatgcaacggtttttggaggatgaaccatttcaaggcccaaggattcagaattatgtcaagaaccgttgtgttattcgcaacttgctccaagttccggtcattaaagatgataatacgaaggacaagaaaataattaagttgggtgaagagcatgcaattgatagtgaaaggttggcacagatcatcaaagagtccatgcgggtgttctgggaatttgttagagcagataaagattatgggaatgtgatcaaaatttctcatcaaataggagttgatgtcaaagacccagcaatttcagatcttcttgggaatgttcgaacccaattgcaaaagaaggagagaaagctcaaggatatagtgaggagtgggaattgcatagtgaggaagttccaaaagcaccatgaggaacaaattcaacttgatgaagaacagttgcttgctcaa

SEQ ID NO: 25418 - DNA, 317 bp, Glycine max
  Peptide Sequence Number=SeqID_142196
cgctcttgcgccgaagatgaacggggctaaagcgatctgccgaagctgtgggatgacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacag

SEQ ID NO: 25419 - DNA, 632 bp, Glycine max
  Peptide Sequence Number=SeqID_142197
atgcagatgctccagttcttgtacccactgatgaggtttccttagtggggcaggcacttcacaccttccttgcttggtcgacacatctggtcaagtcattatcaaagcatgtagttgtgtctccggcaaaaccacctccaaagcccgatccggaggttacatgggatgccaccgtgttcggggtctttaatttagatttcccgctctacataaagcacgaagatttgtccgaaattgcacacggtggtcaatgtctcagcatttcagtgttacagttgtggattccgcatctcactgatacaagtatgcgagcggggaattctgatatctatggattcctcgagccacagtccattcagagcggacactggcagatggtggtcatccttcccaaggaacacctagttgtctggttttgttcattgcatagcaggccagacaactaccttaagggggttattaacagtgctttaaaaggtcttgatgatgctccacagcctaaatcaaaggctcctgctaggtggattgtcgtcaagtgtaatagacaaaaaggaagtactgagtgcggctactatgtcatgcactggatgtccaccatcattttaggaacttttaggaataactgggaagcg

SEQ ID NO: 25420 - DNA, 558 bp, Glycine max
  Peptide Sequence Number=SeqID_142198
atgaagccaataaactcagtctattttcattttccttggcaggagaagccaagaggtggctccactcatttaagggttacaggttgtaccatttgtggtgaggctcatgaaataggccaatgtattcccattgaagaaaacactcaagaagttcactatatgggaaatcaacagaggcaaggatatactcaaggaggattctcaggcttccagcagggtccttataatcaacaaggacagtggagatcacaccctgacaatcaattcaacaaggaccagggtggaccttctaacaagccaatccaacaagggcctaacatctttcagaggactactaagctggaggagactatgactcagtttatgcagcttcttgaggaagctacatggagcttcctcggtaaaaacgctgcccagccttcgttaaccgttggatcttctcgaaatttgggtctacagcttcacaagacacttgtccacgatttgaccgttgggatctttgcgaagatgtctggagtgtgctcgacacttccgttcccgagagcatttcttatttaa

SEQ ID NO: 25421 - DNA, 960 bp, Glycine max
  Peptide Sequence Number=SeqID_142199
atcaagctcttccgactcgtatccttcccgccgtgcccctccttcaccgggtatcctgagtggattcttgcgggatcgtggcggctatgcctcgtcttcagatgatttctctgatgactcttcatctcccaccacggggacgatgagcaaaaatcagcagaaacgccttgcgcgtcagcagcgccgacaagaacgctctcgtctcagcgaggagcatcattctgaagaatctgaacgtcacaaggaggctgtcgcagctgccgctcgtgaggagactgcagagatgaaggctcgctatggcgagctgccactcctccagtcgcgctctcgcccgcgggagctccggaccaagtttgaggatatttcggtggactcggtggggcaaggaggtcctcttcacggcgcgcttgcatatcatccgtcgcatgagtgccaagctgtacaggttcgtggcactattcaagccccagaggtgccagtgttggggtgcaccattcatgatgttgaactggccattgatgcggttcacgttgtcgttcggcgggaggaacctgtcccgttcagcgtctatgaagccgagatccagactcctgaggaagagcgcgttgaaggtcgacgtagtcacatccctgaccgcacgcgtctaaccaaccgtttgctggacttgcgtacacccacatctcagtcaatcttccgcattcaatctgcagtgggaaatctcttccggacagcccttgatgaacagaatttcatcgagattcatacacccaagctgcaagggtccgccactgagtctggagctagtgtctttgaagtaaattactttggtcgtgatgcattcctggctcagagcccccagctggccaaacagatggctattgcggcggacttcggtcgagtgtatgaaattggcgctgtgttccgcgcagagaattccaatacccaccgccatttgacgga

SEQ ID NO: 25422 - DNA, 246 bp, Glycine max
  Peptide Sequence Number=SeqID_142200
atgaaatggcagaagaaaggacagttggagcaaatcatagatcaaacgcttgcaggcaaaataagaccaaattctctaaggaagtttggagaaactgctgagaaatgcttggctgactatggtgtggacaggccttctatgggagatgtcttgtggaatatgctctccaacttcaagaggtcatggtgtaccctattagctggagaaagagctgaatcagcaagtgcggcaaacttctctgattaa

SEQ ID NO: 25423 - DNA, 1941 bp, Glycine max
  Peptide Sequence Number=SeqID_142201
atggaggacggcgcgtggggcacgagcgtgatcgagctggttgaagatgcaggacgacgcgtgggtcacgtggtgcttgctgttggcagcaaggtggggagcaagcatggcctggaaggcggagttgataatggtgcgagacttggttgcatggtgcagagcatggtggcagagttggtatggaaaacagaggcgacgatggtgactgcacggaggaagaagatgggtagtattaataacgcgaaagtcatagcaaaactgctggacacccctagcagttcactgggtattttcgtttgggacgcaacaccattttctcctccaagtggacctatacatggacaaagcagtggttgcccattaagacttaaagagagcctttctcttcttgagaatgtccatgccaccgagaaagaagacgatcggcgacagagtggcccagtcctcgttctcggcgctgtagccagcaaagagttttcttctgggataaagcttgcgcttcaccaacgtggttgggtcgaacactggtttgagctcgctttggaactggtaatcgacccagtcaacgaagaaggacacagcgctgtacaacaagggataatattcttcgttcagagcaaacgagggagaaatagaagcctcgctcactacgcccttttctttgaggttccttatgagctgtcccacgcactcgataaagtcaccgggggaggcatcgatgtgctcgtaaagcacgtcgatgccgtccacgtggaggttgtagtcttcgttcttgatgaggtgcgtgagggactcggtggcgttgtcgatccaggggtgttgggtgccgcggttgccgatgctgatgaagactttgatgtcaacgttggggttcttgtccttgaagcgcgcgatggattcgggggtgaccttgctcaggtcccaggtcggtcggaaaacgccgttggtgggggcaccctcgtcgtcgtagtcgctggcgaaggtcagagcgatctggtactccttcaggaatttcgccgacacaaacacttgcgagaacgagtcgtcgaacgtgtattgccggaaaatcgacaacattgtgccaagagaccaatatatggaattgcaatttgggtgttgtgccagaaattgcccagcccaaggtgcccttatatacttcacttgtgtccaggccatattagaattaacatggagtatctatcacattttgattcgattcgattcgattcagtcgaggttttaagcagcagcaagatgtctgggcgtggaaagggaggaaagggattgggaaaaggaggagcaaaacgacatcgtaaggtgctccgcgacaacattcagggaattacgaagccagcgattcgtcgtttggctcgcaggggtggcgtgaagcgtatcagcggtttgatctacgaggagactcgcggtgttctcaagatcttcttggagaatgtcatccgtgacgccgttacttacacggagcacgctaggaggaagaccgttacggctatggacgttgtttatgcgcttaagaggcagggaaggaccctctacggatttggtgttggatttggtcgtgtgcttgcaacttctaaatccaaagtggggcacgaatatggaagcatgacacatcttccccttaggccaaccttcgtaaacctcaacaaatggccagaatccgaggtagttgatagattctcgtgtcggcaaatgtacttaaggagttacaaattctcaagggagaagaaagtgggtgtcactgagaagaccctcaagtgtttcgataaactgaaggagaaggtcgtttgtgtcagaaataaattaaatttgaagaacaagtataaggttctcatgagggccacggatgtcacttatgctgcgttctcaatctttcagagctttctaccctgctctgccaagtttgatgtgcttcatgatttctag

SEQ ID NO: 25424 - DNA, 322 bp, Glycine max
  Peptide Sequence Number=SeqID_142202
atggcactgtttgagatggtagttgagtcctatgggtctgccatggtcgcacgcaaatgccaactagttgcctttgcactatgcacaactgcgaaaccaggtgcatttcaccggaatagaccttgggatctcggtattgcttttagaagccatgatttgaaaatccaacaccttgaggacaagaatccattagaaggtgttgagctatcaggaggatactggttcacagggaggtggggtgagttccaatatgggaggaaagaagcaaaaagacattttggtatttgcgcattcataatagaggccaaaagcaattttggag

SEQ ID NO: 25425 - DNA, 2502 bp, Glycine max
  Peptide Sequence Number=SeqID_142203
atgactgattggagaaatattggtttctttatatgtgttttatcaatctttccgcttgtatgcttctgtgccacctttgttccagtagataattatcttatagactgtggagcaactacgagtacttcagtaggtacacgcaatttcatagcagataacaaggatctcctttccacacaaaaagatattgttgccactacctcctcaaaatcagctacttcttcctctgatgattcatcgctctatcaaactgcaagagtcttcactgcttcctcgaagtacacttttaaaattaatcaaaaggggaggcactggatccgtctctatttccttccattcgcttatgaaaagtacaatttgcgtgctgcagatttcactgtttccacccaaaaccatgtccttttcagaagcctcaacatgcagaaagatcctgtgatgaaggagtactcagtgaatgtgacctccgactcccttgttcttacctttgccccttcaggaagttccattgcttttgtgaatgccattgaagttgtttctgtccctgatgacctaattgttgatgatggttttgccttagatccatcagtaacctcttctgggttggtgacacaagcacttgagacagtttggagggttaacatgggtggtcctactgtgacccctataaatgacacccttcaaagaacttgggttcctgatcaaagtttccttttgcaatccaaccttgcctcattttcttccaatattaagggtgttaagtatgagaaccatgggcaagcaacagaaaacactgctccgcctaccgtttatgggactctcacacagatgaactcgacctatgatccccgtaatattttcaatgtaacatggcagtttgatgtaagtcccggatttcagtaccttgttcgacttcacttctgtgatgtagtcagtaaagctctcaatgaactctacttcaatgcttatgttgactccaaactggctgcttcaagtgctgatcccagtactactagcaataatgctttgggtgttccatactatagggatctggttacagccgtggctgtcagcaaaacacttcgtgtaagtattggcccttctgaggtaaataaggagtaccctaatgccattttgaatgggttggagatcatgaaaatgaacaattctatgggcagtcttatcccaggagctgtggctattacttctggctcaagttctaaaaaaactggcatgattgtgggtgtgagtgttggggtagttggtgcagttgtcttggctggagttttctttgtactgtgcaggaaaagaagaaggttggcacaaaggcagtcaaagacatgggttcctttatccatcaatgatggaactacttttcataccatgggaagtaaatattctaacggcacaacactgagtgctgcttcaaactttgagtaccgagtcccttttgtggcggttcaggaggctacaaataattttgatgagagttgggttattggcattggtggttttggtaaagtgtacaagggagagttaagtgatggcacaaaagtggcagtcaagagggggaatccacgatcacagcaggggcttgcggagttccaaactgaaattgaaatgctttctcaattccgtcatcgccatctagtgtctttgattggttattgtgatgaaaggaatgaaatgatcttgatatatgaatatatggagaagggtactctcaagggtcatttatatggttcaggtctgccaagcttaagctggaaggagaggcttgagatatgcattggagcagctagagggcttcattaccttcacactggctatgctaaagcagttattcaccgcgatgtgaagtctgcaaatatcctacttgatgagaacctgatggctaaagttgctgattttggattatcaaagacggggcctgaaattgaccagacacatgttagcacagctgttaaaggtagttttgggtaccttgatccggagtattttaggaggcaacaactaacagaaaagtcagatgtatattcatttggggtagttctgtttgaagttctttgtgcaaggcctgtcatagatccaacacttcctagagaaatggtaaacttggcagaatgggcgatgaaatggcagaagaaaggacagttggagcaaatcatagatcaaacacttgcaggcaaaataagaccagattctctaaggaagtttggagaaactgctgagaaatgcttggctgactatggtgtggacaggtcttctatgggagatgtcttgtggaatttggagtatgctctccaacttcaagaggccgtggttcaaggtgatcctgaagaaaacagcaccaatatgattggagaactctctccacaagtcaataatttcaaccaggatgcaagtgcttctgttacacaatttgctggctcaagcctcgatgatctgtctggtgtttctatgagtagggtgttctcacagttggtgaagtctgagggtagatag

SEQ ID NO: 25426 - DNA, 586 bp, Glycine max
  Peptide Sequence Number=SeqID_142204
atgctctatgaggaagaggaaaaggaaatgccaaatattataatcatgctaaagtcttctctgaatgggtctgcttcaaatcttccggatggtgctgggcgttcttttgctacgtcattctctggttctattcagggattgcacaacattcatgggaactttaatgtacccaatatgcccagtacactcacatcaagaaactcaacaataaatagtgttccaactgggggaggagttcagcaaccttcggcaagcctttctagtggaagatttgcatcaaataatctacctgttgctctgtcacagctatctcatggaagctcccatggacattcaggagtcaacagcagaggaggtataagtgttgtaggaaatcctggatttaatagtagcacaaatggagttgctggtcctattcctgggattcttccaacttctgctgcaattggtaaccgaaatgctgttccaggattgggagtatccccaattttgggaaatgcaggtccccgaatcactagttcgatgggaaacatggtcggtggagggaacattgggaggataagctctggaggattgtctgttccag

SEQ ID NO: 25427 - DNA, 276 bp, Glycine max
  Peptide Sequence Number=SeqID_142205
atgttttcttattgcattatcattgtctttaaagagaaagagattgtaaagaagcaaatcaaccccattacccatacctcaggcacagaatttgataaaagacaaaaaagggcaattattgttgggttgaagaagaagctcaaccctcaccgtgaaagccatggaaatatgagatttgaggggaggtttcaggaaggcaagagcttggcagcacaccctgtaaggaacagcattcaggatatgatatatataaaaaggtgtggaaaagttacatga

SEQ ID NO: 25428 - DNA, 1002 bp, Glycine max
  Peptide Sequence Number=SeqID_142206
atggatatgtaccagaaagaacaacttcatgataatactgtgtcaatgatgcaatctcaacatttctcccagatggggaggtctgctggtttcagtttgggaggatcatatccatcacatcgtacacaacagcaacagcagcatgccccttctgtcagtagcaatggtgtctcattttcatctgtaaacaatcaagatcttctccatctgcatggaacggatatttttccatcttcacactcaacatatcattcccagaccagtgggcctcctggcattggactaaggcctctgacttctccaaatacggtttctggtatgggttcatatgaccagcttatccagcagtatcaacagcaccagaaccagtcccagttccgccttcagcagatgtcagctgcaaatcagtcttttagggatcagggcatgaagtctatgcaaactgctcaatctagtccagatccatttggtgcacttggcttgttcagtgtagtccatataagtgatcctaacctgaaatatcttgctcatgggattgatcttacaacacttgggttgaatttgaattcatcagaaaacctttacaagacttttcggtccccgtggtctgatgaaccagccaagggtgatccagagttcagtgtgttacaatgttattatgttaaacagcctcctgctcttcaccaagcatgcccaaagatgaagcacaactatacgcggcaaatgaactggtgggttattgctggcagttacaaacgtggttggttttatcataaagagcatcgtttatggtttataagagttcccaacatggagccgcttgtcaaaacaaacacatacgagagaggatcttaccactgttttgatccaaacacatttgaaacagtccggaaggcctctaacggacagccttcttgcaggataattttgttcttcattatgaaatggtggaaaagagaccgtctgtgcctcaacattgaggaaggaaaaagaaaaccttaa

SEQ ID NO: 25429 - DNA, 1638 bp, Glycine max
  Peptide Sequence Number=SeqID_142207
atggcaacaccagcaatgcaggcagtaaacaccacaaggaaaaaaatgacaaaacaattgacaggaaaaagggatgatacacctttgcattctgcagcaagagcagggaatttggctgtgctgaaagataccattttggaaactgatgaggctgaattgcatgaattattagccaagcagaatcaagatggagaaacgcctctttatattgctgctgaatatggttacgttgatgtagttagggagatgattcagtattatgatcttgctgatgctggaattaaggctagaaatggttttgatgcattgcacattgctgccaaacaaggggatttagatgtacttaagatccttatggagggtcatcctgagttgtcgatgactgtggatccatccaacaccacagctttgcacacagctgcaattcaagggcacactgagatagtgaaattcctattggaagctggaagtagtctggcaaccattgctagaagtaatgggaaaacagctctgcattctgctgcaagaaatggacatttggtggttgtgaaagcacttcttgagaaggagcccggtgttgcaacgcggaccgataagaagggccagacagcacttcacatggcagtgaagggacagaacattgaggtggtggaggagttgataaaagcagatccctcatctataaacatggttgatagtaaggggaacacagcattgcacatagcaaccaggaaaggcagggctcagattgtaaagttgcttctagaacagaaggaaaatgttacaagtgcagtgaacagatgtggtgaaacagcagtagacactgctgagaaaacaggaaaccatgccgtgcaagccattcttcttgaacacggtgttgagagtgcaagaaccataaaaccccctcagggcacaacagctaccacagcccgtgagttgaaacaaacggtgagtgacataaagcacgaggtccaccaccagttggaacacacacgccaaaccagaaaacgcgttcaaggcattgccaaacgtataaacaaaatgcatgcagaaggactcaacaatgctataaattccacaactgtggtggcagtgctaattgccaccgtggcatttgctgctattttcacagtccctggccaatttgttgatgacccaaataacattcctgcgggaatgtcccttggtgaagcaaacatagccccccaagccacgttcatcattttctttgtgtttgattccattgcactgtttatctctttggctgttgtggtggtgcaaacctcggtcgtggttatagaaagcaaagcaaagaagcagatgatggctgtgattaacaagctgatgtggctggcttgtgttcttatttcggtggcattcttggcactgtcttttgttgtggtgggaaaggaagagaagtggctggccataggagtgaccattatagggacaaccataatggctacaacgttgggtactatgtgttactgggtcattaggcatcgcattgagacctccaatttgaggagcattcggaaatcttcgttgcaaagcaagtcaaagtctttttcagtgtcggctttttcagattctgagctactaaacagtgagtattataagaaaatgtatgcgatttag

SEQ ID NO: 25430 - DNA, 585 bp, Glycine max
  Peptide Sequence Number=SeqID_142208
atggtcccaacgaagcttgcctcaaagagatccaggaaagacaaagcggctgaaggaaccagttccgctcccgaatatgacagccatcgttttaggagcgctgagcaccagcagtgcttcgaggccatcaaaggatggtcattcctccgggacgatgagtataccgacttccaggaagagatagttcgccggcggtgggcatcgctggttacccccatggccaagttcgacccagacatagtcctcaagttttatgccaatgcttggcctacagaggagggtgtgcgagatatgcgatcttgggtgaggggtcagtggatccctttcgatgcggatgccctcagccagttcctgggataccctttagtgttggaggagggccaggagtgcgagtatggccagaggaggaaccaggccgatgggtttgatgaggaggccatcgcccagttgttgtgtataccggggcaggattttgcccggactgctgctgggagacgggtgcggatcatgtgcaccaacatgaccaccctgacccagatatggatgacgtttgctgctcagcaacatccagcccaacgatcataa

SEQ ID NO: 25431 - DNA, 420 bp, Glycine max
  Peptide Sequence Number=SeqID_142209
atgacagaaggcgcggaagacaatactctgagtctgacggatagtgaaagagtgtttatacggataaccacttgggtcacgatagccgaaggtggggtggtcgacaaaagtgaggcttttgctcctacgtatcctccatttatgaccacattggcctctgcttgtcaatcgaacttggggtctccgaatgatgaggtgcggataaccggaaggtgtttctgcttgctaccagactcttgggtcatgatagcaaaaggtgggtctcggctggaagatgctgacatctctgaaaagggtgcagatgaccacattggtttctgtgtgtcaatcgggcttgggactcttgggtcacaggataacaaaaaatgtgtgcgggttaccgtcgggtgtctccgcataccaccggactcttgggtcatg

SEQ ID NO: 25432 - DNA, 528 bp, Glycine max
  Peptide Sequence Number=SeqID_142210
atgaatcagaaatctgcacctgttgcaagagtctgtggtctatgttcttctgtagatcaccatacagatctttgtccttctttgcaggaatctggagtcaatgagcaacctgaaggttatgctgcaaacatttataatagaccctctcagcagcaaaaccaacaacagcagaataattatgatctttcaagcaacagatacaatccaggttggagaaatcatccaaatctgagatgggcaagtcctccacaacaacaacagcctgtccttcctttccagaatgctgctggtccaatcaagccatatgttcctcctccaatacagcagcagccacaacaaagacaacaagcaactgaggctcctcctcaaccttccttagaagagttagtgaggcaaatgactgtccagaatatgcaatgtcagcaagagacaagagcctccattcagagtctgacaaatcagatggggcagatggctactcagttgaaccaagctcagtcccaaaattctgacaaattaccttcataa

SEQ ID NO: 25433 - DNA, 963 bp, Glycine max
  Peptide Sequence Number=SeqID_142211
atggacctgggcgtggggacgttgaccaaccgcgagcatgcgctgatctatgcggcaggcgacctgcggatcggcggcgcgctggacggcgccggcaaggcgacgggacaggcggcattgttgagcaacgaatcggccaccatcgaagccgagcgcaacgcagacatcgccgcagccagcattcagaatcgcaacctgcatttcactagcgaaaccgtcgaggtcagtcgggggccgaagctgtactaccgcttggagaattcgactgagttgctggatggttccaagctgtggctatgcgattccgtgacgacggcttgcgggagggatcccgtgacctttctggaggatgattccgagcggcgcctgttgctgccttcagacaagtaccctgaatcgcgatacggcccgccatttgactacgtgcggggcgtcaagggtaaggagggccgagatgcgcccattcctcctgcctatttgcccgatccctatgtgtgcgggccgggtggcgatgcatgcaattacgagccaggcggcccccgctatgaggcgggtgatggcgtatggcgtgtgttcggggtggccgagccggtggtggttcccgccctggtagagcaaaagtgcaacatcaaccaggtttgcctggtgtctaccccagagcgcgagcaggcgctggcgctgaacaaatctcgccatgacgaactggcggcgaagatctatgccttcaacgcggacttcaaccgccggctggtcaagaacttcttctactacaaggtcaacgaagtcgtgatggagagccgcacgctctcgaccgatcccgccaggatcgtcgtcggcggccaggccaagatcaccggcacggtgacaaacgacaagagccgcatcgtcgcgggtggcacgttgacggtggaaggccccgccatcaataacatcggcgccgaaggcatccgatccatcgaacgg

SEQ ID NO: 25434 - DNA, 717 bp, Glycine max
  Peptide Sequence Number=SeqID_142212
atggcgggccgtatcgcgattcaggtacagcttcggcccccgactgacctcgacggtttcgctagtgaaatgcaggttgcgattctgaatgctggctgcggcgatgtctgcgttgcgctcggcttcgatggtggccgattcgttgctcaacaatgccgcctgtcccgtcgccttgccggcgccgtccagcgcgccgccgatccgcaggtcgcctgccgcatagatcagcgcatgctcgcggttggtcaacgtccccacgcccaggtccatgtcgccacgcgaggcgatgacggcgttgggctcgttctgcagcaacggcgtctggatgccgatgcggtcgccataaacgcgtccggtgttgaccaggttgccggcggtgatgcgggtgtagccgccgtcgatcaggccagcgttggccagcaggccgccgatgaccagttcgttgttgcgcacggcgatcaattcaccgcccgcgcggttggtgagcgtatccgccgttatcttcaggtcctggcccgagtggatcttgccatcgttgtccaggttgtcggtcacgagttccagcgatgttcccgcggtcagcgcgccgcccgtgttggccaggcgggtgaaagccagcgtggccttggcatcggacgacacgttgccacgcgcgttcctcgagcgtgccggtggtcagcgccaggtcctgtccggcgcccgatgcggccggcctga

SEQ ID NO: 25435 - DNA, 523 bp, Glycine max
  Peptide Sequence Number=SeqID_142213
gcttgaaaacgaggtcaggaagctaggagagcttctggtaattgattaccaagggaggaatgggtcactggtaatcgattaccagatcgtgatggcggcgcagctaatccatgatcgagtggagatggagtgcctagagggagcttgggagaccctcgaaggcaacgcgaggtgccgatttcggggcacgattcgattcacgactacttcttttgtgcatccagatgaacccgtgcgcacgtttcaacgtactgtggagtggatactgcccacgcctataccataccgtctagtggagccagtccaagtgattgaggtaacgtcatccgaggaagaccctgaggaggatcttgaggagctacctctcgagcctgctggggatgctcttgactttctagagggtgatgaggacccactccctgaggtggattctcccgaggaaatcatgtcggcatctgaggcagactctacggaggatagtggcccgagagagatggcgaccagtggaggctcttcatcatag

SEQ ID NO: 25436 - DNA, 1860 bp, Glycine max
  Peptide Sequence Number=SeqID_142214
atggtgttgggtgcgcaggatcaacaaaagcagggcaaagtgttgctgctgcgctcggcggacctgcgtgagtggcacaatctgggcgagattgccggcagcggcctgaacgggctggcggcagccagttatatgtgggaatgcccggacatgtttaccctcggcgatagcacgttcctgatttgctgcccgcagggcatcgcgcaggaagatcatcgttttctcaatgcgcatcccagcgcgtggctctccggcgatcttgattacgctaatgcccgctttagccatggcgaattacatgagcttgacgccggtttcgaattttacgcaccgcaaaccacgctaaccgccgacggacgccggctgctggtgggctggatgggcgtgccggacggcgaggagatgctgcagcccacggtggccaatggctggatccatcagatgacctgcgtacgcgaaatgggcacgcgtgatggccggctgttccagcgtccggtcactgaactgcaggcgctgcgcagcgctgaacagcactatcaggggccagccgccgatgcgccggtcattgatgcgcagcggctggagttactgctgagcgggcagggcgacatcaccctgaacttcgccgaccagctacggctggagtggcgcgccgacgggctgcggctcgcgcggcgcagtctggcaaacggcgagtggcagttccgttactggcgcggcgcgccgctacttcccgtcgcatccggcgcaattaaccctgaccggacacgcagaagtgacggcgcgctactggtcgttacggccgtgcatggtagaataagtcattgtttccttaaccgatgcactgacgtgagaaaaaccaaacgcgttaccatagcggatatcgccgcgctggcgggggtgtccaaagccaccgccagcctggtgctgaatggccgtggcaaagagttgcgcgtagcgaaagagacgcgtgaacgggtactgacgctggcgcgcgaacatcactatcaggccagtatccacgcgcgctcgctgcgtgataatcgcagccatacgctgggtttagtggtgccggagatcaccaaccatggttttgccgtgttctcgcacgcgctggaaaatctgtgtcgcgaggcggggttacagctgctgatctcctgcactgacgagaacgccgggcaggagcgggtggtggtggataatctggtggcgcgtcaggtggatgggctgattgtggcgtccagcatgttaagcgacagtgactacgtcaaactgagcgatcaactgccgattgtgctgtttgaccgctacgttaatgatacgcaactgccgctggtgatgaccgattcggtcacgccgactgccgagctggtggaacggctggcgcgtgccaatccggatgaaatttatttcctcggcggtcagccgcgtctgtcacccaccaaagatcgtctggccggttttatgcagggtctcgaacgggcaggtgtgacgccgcggccggagtggatcattcacggcaactatcacccaagcagcggttatgaaatgtttgccgcgctgtgcgcccggctggggcgtccacccaaagcgattttcaccgccgcctgcggcctgctggaaggggtgttacgctacatgagccagcatcacctgctgcacagcgacatccgcgtggccagctttgacgaccactatctgtatgactcactaactctgccgatcgataccgtcgagcaggatgtgccgcgcctggcgcaggagtgttttacgctgctcactaccatgattaacggcgatgaccccatcagccagcataccgtgctgccggcaacgctgcggctgcgctttggcagatag

SEQ ID NO: 25437 - DNA, 387 bp, Glycine max
  Peptide Sequence Number=SeqID_142215
atgggcttgttgctggaggcaggcatcggttgcgtggttattctgtgcgccaacatcctgctgcgcgagctggcacagggcatcaatcggcaaagcatcattattgcggaggacgccagccagtattacaaagtgcagatcatctgtctggcggccgatgaggtgcaggtgcgcagcctgatgctgcatagccttggcggcagcggtctgcggctgcaatccctgcacagtgaggatctggaaccctcacaccgcatggcggtaaatgcggaagtgctgggtaaacccagcctgaccgatcagctggaaaatctggtcagccgcatcagcctggaaaaaggcgtcagctcggtcagatggcaggtgtgtgagccggagaccgattga

SEQ ID NO: 25438 - DNA, 1371 bp, Glycine max
  Peptide Sequence Number=SeqID_142216
atggattttgttactctttcccggtcgctgctgccgctgctgggaggccgggaaaatatcgccagtgcggcgcactgtgccacacgtttgcgcctggtgctggtggatgacgccaaagccgacaccgccgcgattggcaagctggagggcgtgaagggctgttttcgcaatgccggacagctgcaggtgatttttggcaccggcgtggtgaataaagtgtatgccgcgtttatccgcgaagctggcatcagtgaaaccagcaagtcgaaagcggcggatatcgccgcgcgcaagctcaatccgttccagcgtattgcgcgtctgctgtcgaacatttttgtaccgatcatcccggcgattgtggcctctggcctgctgatgggactgctcggcatggttaaaacctacggctgggttaaccccgacaacgcgctgtatatcatgctggatatgtgcagctcggcggcctttatcatcctgccgatcctgattggctttaccgcggcacgtgagtttggcggaaacccgttcctcggcgccacactcggcggcattctgacccatccggcgctcaccaacgcctggggcgtggcggccggcttccataccatgaactttttcggtatcgaagtggcgatgatcggctaccagggcacggtgtttccggtgctgctggcggtgtggtttatgagcgtgctggagaagcagctgcgccgggtaattccggacgcgctggatctgatcctgacgccgttcctgacggtgattatcgccggcttcgttgcgctgctggtgattggtccggcagggcggatgctgggcgacggtatctcattcgtcctcagcacgctgattgcccatgccggctggctggccggactggtgtttggcgggctttactcggttatcgtgatcactggcgtgcaccacagcttccatgcgattgaagccgggctgctgggcaatccggcgattggcgtcaacttcctgctgccgatttgggcgatggctaacgtggcgcagggcggtgcctgtctggcggtgtggttcaaaaccaaagatgtgaaaatcaaagcgatttcgctgccgtccggcttttcagcgctgctgggtattaccgaggcggcgattttcggtatcaacctgcgctttatgaaaccctttatcgccggcctgattggcggcgcgctgggcggtgcctgggtagtgtcggtgcatgtgtatatgacggctgtcggtctgaccggtctgcctggcatggcgattgtgcaggccagctcgttgcttaattatgccattggcatggtgattgccttcagcagcgcatttgtgatctcttatctgctcaaatacaaaacggacgcggaataa

SEQ ID NO: 25439 - DNA, 804 bp, Glycine max
  Peptide Sequence Number=SeqID_142217
atgaatgcgggcatttgtcaccgtgaacagtccgacaggcttcagacttgtccgttgctgggatcggtttcgccctgccgcatggtcgtctgcgtattgacgtctatgcttaaagttttccaaaaccttataaaaatcggtgtcattgagatttcatttcgccacttgtccggaggcaaaggcatgagcaacccacgcgatgagaagacgcagcggtattcaccgcagcaggaagagacagagcgagcccggctgacagcctgtgccggttccgccgcgccggcacctgtcacagtgccggtcacgctgcaggtgaacggcgaacctcagcagcttaacgtcgatacccgcaccactctgctggacgcgctgcgcgaacatttacacctgaccggcaccaaaaaaggctgcgatcacggtcagtgcggtgcctgtaccgtgctggtcaatggccgccgcatcaacgcctgcctcactctcgcggtgatgcagcaggatgccgaagtgaccaccattgaaggcgtcggcacacccgaagatttgcacccgctgcagtccgcctttatccgccacgacggctatcagtgcggctactgcacgccggggcaaatctgttcctcgctggcggtgctgcaggaaattgcggcgggcattcccagccatgtcacgggcgatctgactgccgcgccagcgctgagcgatgacgaaattcgtgagcgcatgagcggcaacatctgccgctgcggcgcctatgccaacattcttgccgccattgaagagtacgccggaggccagaaagcatga

SEQ ID NO: 25440 - DNA, 571 bp, Glycine max
  Peptide Sequence Number=SeqID_142218
atgcagcatccaggcgcacgctttattgccggcggtaccaatctgctcgatttgatgaagctggaaattgaaaccccatcgcacctgattgatgttaacggactggcgctggacagcattgaacccaccgccgggggcggcttacgtattggtgcgctggtgcgcaataccgatctggcggcagatgcgcgcatccggcgcgactatgccgtgctgacgcgcgcgctggtggcaggcgcttctggccagctgcgcaatcaggccaccaccgccggcaacctgctgcagcgcacgcgctgtccctatttttacgatgttaatcaaccctgcaataagcgtcagccgggtacgggctgtgccgcacgcgaaggattcagccgccagcatgcggtagtgggtgtcagcgaagcctgtattgccacccatcccagcgatatggcggtggcgatgcgactgctggatgcggtgattgaaaccgtcagccctgacggcagccagcgcgccattcccatcgctgaattctactgcgcaccgggtgacacgccgcatatcgaaaccgtgctgcagccgg

SEQ ID NO: 25441 - DNA, 831 bp, Glycine max
  Peptide Sequence Number=SeqID_142219
atgtcgccgctggcgaaccgcattggtcagtactggctccagcttcccgccacctttgccccgcgcgatctgcctgcgctctggcagttcctgaatgccctgccccgtgacttcacctacggcgttgaagtccgacacccgcaattctttgcgaagggcgaagcggaaaaagccctcaatcgcggcctgcttgagcgttccgttaaccgggtgatccttgacagccgccccgtccacagcgccatcccgcacagtgaagcgattgtggatgcccagcgcaaaaaaccgaaagtgccggttcacgccattgtgaccgcgcagaacccgatggtcaggtttatcggcagcgataatatgcagcaaaaccaggcgatgttcgccgtctggctgcagacattagcgaagtgggaacagaccaccacgccgtatctctttttgcacacgccggatatcgcccaggcacccgaactggtcgatgctctgtggcaggccttgcaggctgcggtcccaacgcagtaccgcgtctcttacggcgacggcggattttccgagctacaaagcgctatccgcattcacggcaatgcggttgaatatatccccgcgggattaattctgttgctttttatggagatgaatggcgcagaaacctggatggtacacatctgtggcctgctgctgattgctggccggctaatgcattattatggctttcaccatcgcctgttccgctggcgtcgttccggcatgagtgcgacctggtgttcacttttgctgatggtgctggctaacctgtggtatatgccgtgggagttggttttctccctccattag

SEQ ID NO: 25442 - DNA, 225 bp, Glycine max
  Peptide Sequence Number=SeqID_142220
atgctcaagagtgaatcagaaccatggtcatggtgtaaaatgtggtatttatggtgccaattctgcagaatggattatgagcatgcaggtgttggggctatagagtttattatatgccattcagaggtctcaattgcacttgcagaagagaagaagatacctgagctattcaagacatttccaaatgcaacaaagtatctcaagagatcaaactcagagctttga

SEQ ID NO: 25443 - DNA, 281 bp, Glycine max
  Peptide Sequence Number=SeqID_142221
atggtgggttacacaccttcaagttttacagatttggtcttcgccagcaaaaagatcgaagtggatctgaaaagaggcaaatttaatcatcctgcttggatgaatgagaaaattggggcaaataaagagggtgaggatgagggagaaacccatgttgtgactaccattcctgattcaccccaaattccagtgtcatatgctaacttgctcccatatctacttgataatgcaatggtagccataacccctgctaggtttcctcaacctccatttttccgagg

SEQ ID NO: 25444 - DNA, 1008 bp, Glycine max
  Peptide Sequence Number=SeqID_142222
tttgttgccaccgtgctgacgcgcggttacgccggtcaacttaccgatcgcgttggcggtaagcgctcggcgttgcagggcgcggcggtgtgtgcgctggctggcgtgctctactggctggccgcgctgccgggcttttcaccggcggtcagtctggcgctggtgattgccggacggctggcggcgggcatgggcgaaagccagttcgtcaccggctgcgtggcctggtcaatcgcctcggtcgggccacagcgtgccggtctgtcgatgtcctggaccggtatcgccatgtttgccgcgctgtcgctcggtgcccctgccggcatgatgctgtatcagcacgtcggcttagcggcggcgatgctggcctgcatcgcggctccgctgctggcggcgctcatcgccacggctgccagcggttatcgcgcggtcggaggaacacgtttgccgttctatcgggtgattggccgcatctggcgtgaaggctgtggcctgatgctgcagggcgtcggactggccggcctgacagccttcgcctcgctctattttgccgcgcgccactggcaactggccggctgggtgatgaccgcgtttggcgttggttttatcgccgtgcgcctggtgctgggacatctgccggatcgcattggtggctaccgcgtggcggcttattcactgctggtggaagcgctggggcagatgctgctgtggtttgcgcctgacgaaaccctggcgctaaccggcgcgctgattaccggtcttggctgtgcgctgatctttcccgccctcggcgtggaagcgctgaagcgcgtgccgccagccagtcgcggcagcgccatgggtgccttcgttgcttttctcgacatcgcttatggtatttccggaccgattgccggtgccatcgccagccacttcagctatgccgccgtctatctgtttggtgcggcctgtgcgctgctcggtgcgctgctggcgctgacatcgcgcgccgcttcacttcacgcttaa

SEQ ID NO: 25445 - DNA, 629 bp, Glycine max
  Peptide Sequence Number=SeqID_142223
atgaatttattgcctagtgttgttcatgcatcctccaccaacgagtctggagccccgcgaattgattgcctagcgctgttcgccaattctccattctccacatttattcggagccccatgaattcattgcatagtgctgttcatgtgtcctacaccttcgagtctggagccccgcgaattgactgcctagcgctgttcgccaattctccattctccactttttttcggagccccatgaattcattgcctagcgctgttcatgtgtcctccaccttcgagtctggggccccgcgaattgattgcctagcgctgttcgccaattctccattctccacttttattcggagcccaatgaattcattgccaagcgctgttcatgcatcctccaccaacgagtctggaggctcgcgaattgattgcctaacgctgttcgccagttctccattctccacatttattctgagccccatgaattcattgcctagcgctgttcatgcatcctccaccatcgagtctggaggcctgcgaattgattgcctagcgctgttcccctgttttccattctccacttttattcggagccccatgaatttattgcctagtgctgttcatgcatcctccaccaacga

SEQ ID NO: 25446 - DNA, 420 bp, Glycine max
  Peptide Sequence Number=SeqID_142224
atgggatcattacagtccattgatttttctaggaatcaactttctggtgaaatccctccaaccattgcaaatttgagctttctgagcatgctagacttgtcttacaatcatttgaagggaaaaattccaacaggaactcaattgcaaacctttgatgcctccagcttcatctccaacaatctatgtggtccaccactgcccataaactgcagctccaatgggaaaacccatagttatgaaggaagtgatgggcatggagtcaattggttttttgtcagtatgacaattggatttattgtgggattctggatagtgattgctcctttgctgatttgtagatcatggcgagggagagtagctgaacgtaaagaggggaaggataggaggtgtggggaaatggaactaaggataaccaagtaa

SEQ ID NO: 25447 - DNA, 810 bp, Glycine max
  Peptide Sequence Number=SeqID_142225
atgctgatcatgttcggcatgggcgtgacgctcaacattgacgatttcaaacgcgtgctggtgcgtccggcaccggtgattgccggcacgttcctgcactatctggtaatgccgctggcggcctgggcgctggcgaaactgttccagatgccgccggatctggccgccgggatgattctggtcggcagcgtggccagcgggacagcctcgaacgtgatgatttatctggcgaagggcgacgtggcgctgtcggtgaccatctcgtcggtttcggcgctggtgggcgtgttcgcgacgccgctgctgacgcgcttctacgtagatacccacattcaggtcgatgtggtgggcatgctgctcagcatcgtcaaaatcgtggtgatcccgattgggcttggcctgattattcaccactccatgaacagcgtggtgcgccgcgttgagccgtatctgccggcgttttcgatggtgtgtattctgctgatcattagcgcggtggtcgccggtagccagggctttatcggctcggtagggctgatggtgatcgcggcggtgatcctgcacaacgctattgggctgctcggcggctactggggcggcaagctgtttggctttgacgaatccacctgccgcacgctggcgctggaagtcggtatgcagaactccggactggcggccacgctgggcaaactgtacttctcaccgctggccgcgctgcccggcgcactgttctcggtgtggcacaacctgtccggttcgctgctggcgggttactggtcgggtaaaacgattgagaagaagcagaaataa

SEQ ID NO: 25448 - DNA, 261 bp, Glycine max
  Peptide Sequence Number=SeqID_142226
atgctgatcgccttgattctgatgctgctgttcctgttcgccgaccagcaccagcggcctgcccgccggcgaagagccgttcctggtgccgctggcgatcccgctggtcgccgggccctcactgctcgccaccctgatgctgctgtcacatcagtatcccaaccagatgacgcacctggtcggtgccctgctgattgcctggggcgtcacggtggtgattctgctgatgtccggcgtgttcctgcgcctgctgggggataa

SEQ ID NO: 25449 - DNA, 471 bp, Glycine max
  Peptide Sequence Number=SeqID_142227
atgtcagtgggcactgttgaagatgggatgaagttctttggagcaatgtttttctctataatgaacataatgttcaatgggttttcagaacaagccatgcttgtttcaaggcttcctgtcttttacaaacaaagggatttcatgttctaccctgcatgggcatttgggttacctatatgggttctcaggatccccatttccttggtggaatcaggaatatgggttgttttcacatactacacaattggatttgctccttcagctagcaggtttttcaaacaattcttggcactgtttggcgttcatcagatggctatctctctatttcggctcgttggtgcagttggtagaacatatgttgttgctaatatcctgagtggcttgacttttcaaatagtattggtgcttggaggatttattgtctccaaaagtgagacatcattcatttctaatcttttagagatattttag

SEQ ID NO: 25450 - DNA, 135 bp, Glycine max
  Peptide Sequence Number=SeqID_142228
atggttccttttgacttctggcatgtcacggaacttcacggattgcctaacgatgggtgccaacagcaggccaagctggagcctagcgacagtggcgtgccatcttccttagagatttcagacaccattgtctaa

SEQ ID NO: 25451 - DNA, 258 bp, Glycine max
  Peptide Sequence Number=SeqID_142229
atgtttattcaagagagtctacgtctttatgggcctggagttacaaccgcaagggaagtgttggctgagatgaagttaggggaacatgttcttcttaaaggcatcaaaatgtggttgtacttgccagcaatattgcagcgtgacactgataactggggaccagatgcaagggagttcaagctagaaaggctggctggtggtgtttctgcggcctgtaaatatccccaagcttatataccatttggcctcgggagttaa

SEQ ID NO: 25452 - DNA, 255 bp, Glycine max
  Peptide Sequence Number=SeqID_142230
cccccaagatttgatggcagagaagctgcagaacatgtggctacccctggggtcactgttggactagtttgggctgcttttggtggagaagttcagtttgtggaggctacagctatagttgagaagggtgaactgcatctcactggacaacttggtgatataaaagaatcagcttatcctgtgagagatcagtctggcaaagtttcagctgcagaactggtgcaggctgtcaatgaaatcctctctgctgcttag

SEQ ID NO: 25453 - DNA, 3768 bp, Glycine max
  Peptide Sequence Number=SeqID_142231
atggcggaacacggcacccggcgcaccaccaccgaccgcctggaagaagccattgccgccctttcggagagacattcagacctcgccaacaaagtcgaggctatgtgtgaacgcctttcgcaattcaccacccccactccgctggcaactcaaccttcctacccttccagaccgccagtcaagctcgacgtccctcgatttgacggccacgatccacttggttggatcttcaaaatttcacagttcttcgaatatcagggaacgccggaagaggagcgcattaccgtggcctctttctacctcgatggaccggcactcagctggttccagtggatgttcagaaacggcttcattatgtcatggccggcgctgcttcaggcaatcgaaacccgtttcgccccctccttttatgatgatccacgagggacattgttcaagcttgttcaacgcagcttcgtcacggagtacctcaccgaattcaaaaagctagccaaccaaatcactggtctctccccttccgtcttattaagttgcttcatctccgacctgagtccggaaatccaacgagaggtacaagcttttcaacccatttcattaccccaagctacttccttagcacaacttcaagaagacaaaataaattatcgaagaaaacactactccagacccccaccttcccttccaccatcacagacatccttccctctcactcacaataaccagccacccaaacacaaacctcctttcatccaaagaacccaagaggatatggcttacaggcgcgaaaaaggcctatgctacaattgcgatgagaaatggagctcatctcaccgctgcaagggacgcgtcctgttcctcattgcggactctgaggaaccccttccatcaggagtaacccttgatgacctgccacaaaccaacccacctgaacttcaccccgactccctcgagcctaagtccactttcgatccttccacactccaaccccatgtcagccttcacgccatggcaggagttccagctacagacaccttccgcctttatggattcattaacaagaaacacgtcactatactgatagatagcgggagcacacataattttattcagccccgcgtcgctaagtttctgaacttgcctgtcaaagacaccttacctctcatggtaatggtgggtaatggctccgtaatgacttgcagccagctatgctctgatacgaagcttctcatccaagatcatacattcacggtgactctacgcatccttcccctcagtgaagctgaagtggtcctaggtgtagaatggcttcaaaccttgggatctgtcatcaccaactatgcctccttcaccatgcagttctcatactcaggcaactccatcaaccttcatgctgatgtccagtctgactccaacctagcctcagctaaccagccttcgtccctacccccttcccgtcaacacgaccaccacatcaacctcctccccacagcaaaccccattaatgtacggccttaccgataccctcacttccagaagacaaagattgaacgtcaagtctcctccttacttgatgtcggcctcatccggccaagccgaagttcattttcctccccggtactattggttaagaaaaaagatgggacatggcggatgtgtatcgattatagggcgctcaatgcaatcacagtccgagatcgctttcctcttccaactatcgatgaactccttgacgagttaggaagagcattgtggttctccaagcttgatctatggcagggatttcaccagatattaatggctgaagaagacactccaaagacagctttccgcactcaccacggtcactacgagtaccgggtgatgccattcgggctctgcaacgcaccgtcaatgtttcaggctgccatgaacaaccttctcagccctttcctgcggaagttcgcgacagtttttttttacgacattctgatctacagcgaaatcttcagtgatcaccttcatcatctcgaatgcgttttcaactctcttctgcaggctcattattatttgaagcaatcaaacggcgtcagacctgatccaacaaaaattcaggctatcgtcaaatggatcacgcctcgatctcccaaggacctttgcaccttcctcggcctcgttggattctacataaaatttgtgcaagggtatgccgccattacagcttcactcacgaagctcctctgcaaaaacgcattccagtggtcctcagaatctcaaactgccttcaagagattgaaagttgtcttaactgctgctctgatattggcccttccggatttttcgatccctttcatacttgaaacagacgcatcaagcacggccatgggcgcggtccttcaggaacacggccaccccatagcttatttcagcaaatcattttgtcaacgcctccaacacgcttcagcttacgttcgcgaattgcatgccatcgttgccgccgtccgcaagtggcggcaatatctactgggccataaattcaccatcttcacagatcatcggagccttcgtgagctcatgtctcaggtagttcagacgtcggaacagcaattttacctagccaagttgcttggatacgactacgaaattcagtataaagtgggttcctcgaatatagtaactgattctctctctcgcagagacaatcatccccctggtcaatacctcatcctctcagctcctcactctgagtttatggttcaactgaaggccacactcttggcaagcttagagttccaaaagcaacaggaggccatacgttcccaacctaatgcatatcctgagttctcaatctcggacaacttcatcatcttcaagggcgcaatatgggtagactctcagaacccattcatcccatccttactacacgaatatcacgcgacacctatcggaggccatttcggggtaaagaagaccatgcatcgtcttcaatccaattttcggtggcacaacatgctcgaggatgttaaaactgtcgttcgtcgttgcgcaatatgtcaacaggtcaaacatatcacacggaaaaatgctggtttactacaaccaattccgatacccaccggaatttgggaggacatttctatggacttcgtcacccatcttcccgcctctcatgggttcaccgctgttatggttgtggtggatcatttttctaagagtgtccacttcggcgccctacccactcaatttacggccttcaaggtagctacccttttcatggataccgtgtgtaaactccatggcttcccccgcaacatcatttcggatcgagaccccatcttcatcagttcattctggagagaactcttcaagatgactggcacaaccctgcatgaagttgtttacggcaagcctcctccctctctttccaagtatcttcgaggatcatcccgcaacgacgccgtcgatgccatacttagtacatgcgaagagatccacgcgattcttcaacgcaagcttctcaaagctcaggaagccatgaagcacttcgcagatcagaagcgtccccccacacgactcgtactggtgcagtgggtgggtttagcccccgaagactcgacctgggaaaaatggactgacgtttgcaacgcccatcaccttgaggacaaggtgattttcccaggggcgaataatgttagtagtagcagcgagagaggagcctcgtcacctgcaacccacgaagaaaggccaagaaggaacattacgcgccctaggtacttagaggagtacgtgtaa

SEQ ID NO: 25454 - DNA, 255 bp, Glycine max
  Peptide Sequence Number=SeqID_142232
atgattgacgtggtaatcctaggagccttaggtttcaccggcaaacaagtcctcaaagaagccctcaaattcttcaatcccaacaatttcaccttcttagccatagcggcccaacaggtggaggcctacttgggcttggagtcgaagaagaggattgtggggaactttgagacatttgagtctgctattatggctgtgaaggatctgaaggaaatggaactgtctagagtcaccagagtgagccctaagctatga

SEQ ID NO: 25455 - DNA, 423 bp, Glycine max
  Peptide Sequence Number=SeqID_142233
atgaagacactcttgtttctctctccagtctccattatctctgcaaccgaacagagccctctactctctctggactctctcgattatgcggtgcaccttcatcacctccacggtcggattcagatctcgtgccacccgtccaccatgcggctcgccactgtcgtcgccgtccagttcaccgctggagaggctggtggagaagtggaagaagaagacgaggcgcgagaagcgaaagccgagaaccaagttgatgaggcagcagacaccgtggattaccagccagaaaatcactgtcggagacttcacagcgccgttgccagacgaatccaactgcgccaatcctctgaagctgttcccctggcgcgtgaggtaagtttgttgcaacaccgagagcttcattttctggttcaaaaatgtgcgtaa

SEQ ID NO: 25456 - DNA, 204 bp, Glycine max
  Peptide Sequence Number=SeqID_142234
atggagaattggaggggtgctcggatgatggtggtggcgagtgcggtggcgatggggtggctttcggtggtggccatgggaagtccggtgcttcacaaggtgggagggtccaaaggttggatcaatcaagacgtgaactacactgaatggtctgctcaagagcatatctatgttggggattggctcaggttgtcaaaggtttaa

SEQ ID NO: 25457 - DNA, 261 bp, Glycine max
  Peptide Sequence Number=SeqID_142235
atggattttaacagcgaggatgaggacatagtagagcgcgaagaagatgagcgtgtggatgaaaatggctttgccgttggtcttcatgctaccgaactcaagctgctccctgttcccaggaaaggagaaaagcaaccctggttgaagcagcacgaacagaaccaccccgatcaacactggaaaatgcaacgaaagggatggtatggaagagtttggaagcaggagaaaaagggtggtagaaggataagaaccatgctttga

SEQ ID NO: 25458 - DNA, 1314 bp, Glycine max
  Peptide Sequence Number=SeqID_142236
atgtactttgtggaccttggacaatacataagcccccttagctctaagccgacttacgggcgaaagaggttgttcaatgttgaagcccccaagcatggacaagtttcattcggtatcgagagtggtggccttgacaagatctggacaagtgttgtttgggctgcttctgttaagttgtctggggtggacatacttttggttttgcaggcgaggtctgacatgtcagcgcacgcacaacactcctacatacgtatcactcgtggagtgggcatgtattggagacatgatgtgtgggtgagtggggttgcgttgtgccaccatcactttgaatttttgtcttcttcctcccgaaatctctttgctttcatgcttgcttcttgtaattccctttcttcttccttcgccttcttcgatacttcaagaccctcctcggagaatactgaccacggtgcctctgatgataaatcctcttcctcaaagaggaagcctattccggtcattgtgattctacctccttttgtttctggggaagcaaggaagagcggtggggatgtgagggacgatgttatggtgtataagtcctttttcacctctgcggcgagtgtcactgctttgcaacgccaagtgaagctgacaaaccttgaggactcctacaagatagtcatacatgctagcgaaagtgatgacttccctttcttgatggttacgtcgagcaacctgccattcttcttcatgtacaggttcttgtttgagatcttgggtctcgttcttgaacttaaaaatttctttcatctagatgtagtctttggctcgttcgtgcaactcgtccatgctactaggattgcagatctgaacggcaatgtgtccaaacctatccatgaattttctgatagattcatcatctacttgtcacaggctgggaatccaccgtatcaggacaatgttgcccctttgagggacgcggggaagacaagacacatgattgcatcgtcattggtgtacatactttcctgggttaggaaaacatccaaaggttcatccgagtcagtggtcccatcataccgcttcaggacggtgcatgtgggagagacttggatcatcttgagtgttaactatgcttcaaggccttctcagctcctcctcatggggttgctccatctctgcgatgaggttttggagttgttggagagtattaatatctggcatgacaattgcaagaggattggagccttcaaatggggtcttgtatctaagggtgccaaatgtactttccaaaatttggagtttgatgcacgtcagggtgaacgaggctaa

SEQ ID NO: 25459 - DNA, 1163 bp, Glycine max
  Peptide Sequence Number=SeqID_142237
atggcttcttcttcttcttcttcttctattcagtgttcagtttgggttccttcccttctcaacactaacactaacactaacaccattcactttctttcacttaaaccaaactctattactttctcttcttccttttcttcttccctcaccagaatcagaatcagagcctcctcttcctccccaaccgttgaagaagccgctatgagcatcgacaacctccgacgtttcatcaaccttaactccggaaagtggaacggctctttctatcaatttgattcgagtggaaatatgttgcaacaactgagtaccaagctttccgctagctcttatggggaagatgaactcatgagtctcattcaaacgctgtatattaaacaaccttcatcaagtacttcaatttccggagatgacaatgatgcagaatgggcagagtacaaaataaaagaaaccaatatgtttactgttgacaaatatcaacaaataggctttttcccatctgagaaagcatttgcactgaggtaccaaacagctggcatgttggaaacagtattaaggcaaggtgttctgggagaagatgacactggtgaagagtcgcccagaaatctcaagcttccctctcggcgaccttctgttgtatgtgagaattgcctgtactctctagagagagatatgagagcaagagcctttcacattttggagccaagaggcactgtagatatgcttattgtcttcctagaggaaagaagtgatggggctcctcctctacttgagagttctagggatgtgaagagtaggattattccttttcttggtaaatggaaaggtcattccattacaaaacgaagtggtgtgtatggatctacaattactaatgctgataccgttgtgttacatgagatggataacaatggccaactaattcaggatgttacttcaagttcaacttctgatggggaaaatgttactaccaatgtgcattggacaggcacagtatcagaccatttggttacatttgatggaggttatcagatgatactattacccggtggcatgtacatggggtgcccttgtgatgtagcaaaaagtgtggcagaatcaaaatcgttccatttggagttctgttggttggagacacctgacaagaggcaaagacttgttcgcac

SEQ ID NO: 25460 - DNA, 129 bp, Glycine max
  Peptide Sequence Number=SeqID_142238
atggagaggaacgaaaatgaaagatggagaggatacaaatgtgagcgtatcacgaaacccttcgagttcactcagttcaaaaatcacgtcattggtaccatatttggtacatcgataatgatgctataa

SEQ ID NO: 25461 - DNA, 132 bp, Glycine max
  Peptide Sequence Number=SeqID_142239
atggcgcttgggatttctgaaggaagagagatgcaaaagtggtgcactgtagctggaggtgacatttttgggcgggaaattgggttaaccacagtgcgacacgtaggcgtccagggccttgtttgtatatag

SEQ ID NO: 25462 - DNA, 246 bp, Glycine max
  Peptide Sequence Number=SeqID_142240
atggttagaactagaggtttaggtcgtgcattaggtagggttataggcagagccctaggtagacaagatgatcatcatgtagatgatgttacccaacggcataggcctatcgcatccacacgtagacaacgggaagctgcccctattgttgagaatgttcttgagatgactaacgacgtacctgcacctggtgcagagggattagctggtgatggtgttgagggatcaactgctgatgatgcttag

SEQ ID NO: 25463 - DNA, 1179 bp, Glycine max
  Peptide Sequence Number=SeqID_142241
atggcaaggaagagaaaggttgttgaagtggtggaagagggagagctatgtgagggaaccttgggttgggatgagatgatgaaacaagctgcagcacttggaggggtgcaaagagcaaggaagaggtttgttggtgtaaggcaaaggccatcaggtagatgggtggctgagatcaaagacaccattcagaagataagagtgtggttgggaacttttgacactgctgaggaagctgcaagagcctatgatgaggctgcttgcttgcttcacggcgccaacatgaggactaacttctggccttgctctcaatcctccacaagtccagctctttcctcaaagatcaccaatctcctccttcaaaggcttaaagaaagaaacaacaacaacaacaacgcttgttcctcgtcctcgtcctcgtccacctcacttctcatcaaccaccaacaaatgcaacaccaccaacaggttgatgcatatggagaaggttcaacacaattctcaattgaccaattcactgatttcctcaatgaccctgaagattatagcacaagcaacaatgacttcatcaacaacactgcacaaattgactacattactagtagctttgagtcatgcttaactaaaaaagatggtgggacaaaaatggatatgcaattgcaatacaaatcaagcaatgtgacaccacagacttcaagcaatgacagcaattcaggagtggtggagagtgaagaagaaggaaatgatttgggtgtgcaaagtactaatttggatgtccatgattttaggtttttggacaacattgttccacctagttactattctccctttgagatggctgaagagatggaggaggaacctgtggagcctgagaatgagaactacgatgacgagccttcaatgcttagagctttgaaacttgaatcaggaaacatgaagggaagagtactagctgatcaattaacaagccttcaaatggcttgtagcaaaaacaagcttgagaagaataaggaggagaaagagttcatggcaacaatggataggaaaaaggaacaagaacaccaacatgcatcacctgacatggattcttcaagtgttgatggggaactgttactttggaattcacttgatcttcctcctatttgctttgttaacttacttgaaaacggttcattcaattaa

SEQ ID NO: 25464 - DNA, 231 bp, Glycine max
  Peptide Sequence Number=SeqID_142242
atgttgaaatgtatagcttctgtccacgttgctaccaaccaagatcatcatccaataacccatcatcaaaacaaaggctgcacaattaaagttaataatcgagcaccatcatcaaaacaaaagaaaactgattcaacctttgcccccaaacaacaaaggatgaaccctaaactcaacaacaacaacaacaacaacaacaacaagaaatcgaacaatagagaaataagatag

SEQ ID NO: 25465 - DNA, 1641 bp, Glycine max
  Peptide Sequence Number=SeqID_142243
atggtggacttgtctccttttgcatgtgagaaagactttgacgatggagggaacatgtgtcacggtggccttaatcatgcgtcgcgatggacacaatttgggttctatctgaaacagaaaacgagcaagacatcgaacctcaactatgttccttacttgatcgatattctcaaccactctttcacgaactcttcactctctcacgttcacttcccttcagacatttcccaaacgaactccctcatcgcctcttacgttcgccgaggcgaccctgtctccgcattgaccctctttcattctctccgtcgtcgcgcgcattccgatgtcgtcgccgacgcctacaccttcacctccatcttgcgcgcttcttctctcttgcgtgtctccggacaattcgggacgcaagtccacgcccagatgctcaaaacgggcgctgattccggaaccgtggcgaaaaccgcgctgcttgacatgtactcgaaatgtgggtctttggatgaagcaacaaaggtgtttgatgaaatgcgtcacagagatgttgttgcttggaatgctctgctttcgtgttttttgaggtgtgatcttcccgttgaggctgttggggttctaagagagatggggagggagaatgtggagcttagtgagttcactttgtgttctgcgttgaagtcttgcgctttgttgaaggcgttggagcttgggaggcaggttcatggtttggtggtgtgtatggggcgtgacttggttgttttgagcactgctcttgttgatttttacaccagtgttgggtgtgttgatgatgctttgaaagtgttttacagtttgaagggagtagggaggtatgatgaggcttttagagttatgggttttgtgaggcccaatgctgttgcactcactagtgctctgggtggggttgctctgagaatttggatttgtgggcaggcaagcagattcattgtgctgtgcaatgccttgttggatatgtatgcgaaatgcgggaggatttcgcaggctctgtcagtgtttcatggaatttgtgagaaggatgtgatttcttggacttgtatgattgatgcgtatggaagaaatgggcaaggacgtgaagctgttgaggtgtttcgggaaatgagggaggttggaagtaaggtgttgccaaattctgtgacttttttgtctgttttatctgcctctggtcactctggactggtggaggaagggaaaaattgtttcaaattgttgagggagaagtatggtcttcaaccggatccggagcactatgcttgttacatagatatcttaggtcgagcgggtaatatagaagaggtatggtatgcatatcacaatatggttgtgcaaggtactaggcctactgcaggagtatgggtagcattgttgaatgcttgcagtcttaatcaggatgttgaaagaagtgaattggctgcaaagcatctcttgcagttggaacccaataaagctagcaatattgtgcttgtatcaaatttttatgcagccattgacaggtgggattgtgtggaagagctgagaagcatcatgaggaccaaagggttggccaaggaagctgggaatagctggatcaatgttccaggcttcaatcgacatgccatatcactatctgcttga

SEQ ID NO: 25466 - DNA, 1773 bp, Glycine max
  Peptide Sequence Number=SeqID_142244
atgaaaatctgcaccaccttttgtgtgtcactggccacggttttggtgatgatgagcaacatcgtcatggcagtggctgagactcacattcccaccaccctggatggcccatttgacccggtgacccgacggttcgacccgtcactgcgacggggcagtgatgacttgcctatgactcatccaaggctcagaaagaatgtcacttcaaacttccctgaacagattgctcttgcaatttcttcaccaacttccatgtgggtttcttgggttactggggatgcacagattggcctcaacgtgaccccagtagatcctgcatctgttggaagtgaggtgtggtatgggaaaaagagtggcaagtacacaagtgttgggaaaggtgattctgttgtttacagtcagttgtatcccttcgaaggcctatggaattacacctctggcatcattcaccatgtgaaactcaaagaacattgtgatgttgtctattggagatataaggttgacttgatggttgggaaggggagcttaagggtgaagggagaagggggggagcgaaaggttgcgggtcttgaacctggaaccagatattattacaaatgtggggatagttctattccagccatgagccaagagcattattttgagacttttccaaaacctagtccaaataattatccagctcgaatagcagttattggagatttaggtctcacaagcaattctacatcaactattgatcatctaaattacaatgatccttcaatgattctaatggttggagatttaacatatgcgaatcagtatcttacaactggtggaaagggagcttcatgttattcatgtgcatttccagatgctcctattagagagacatatcaaccccgatgggatgggtggggaaggtttatggagcctttgacctcagaaattcctatgatggttattgaagggaatcatgagatagaacctcaagctggtggaatcacattcaaatcatacctgacacgatttgcagttcctgctgaagaaagtggctctaaaagtaacttctactactcttttgatgctgggggcatacactttatcatgttgggagcatatgttgattacaatagcactggtgcacagtttgcttggctgaagaaagatctgcaaagtgtagaccgtagtgtaaccccttggttagtagctgcatggcattctccttggtataacagttatgcttcacactatcaagaatttgagtgtatgagattggaaatggaagaacttctctttcgatacagggttgacattgtttttgatggccatgttcatgcttatgagagaatgaatagagtttttaattacacgttggatccttgtggacctgtttacataactgttggagatggtggaaatattgagaaagtagatgttgatcatgcagatgatcctggaaagtgtccttctgctggtgataacataccagaatttggaggtgtttgcaaatcaaatttttccactggtcctgccaaaggaaacttttgttggaacaaacaacctgagtggagtgcatttagagaaagcagttttggacatgggatacttgaggttaatttatccatccaatgcataattcttagtggtgcttgcttcaatattgtaaggatgtttacccaatgtttagtggtggtctgcaacttgatcaggaaatcatttgcttgctgcatttccttggtacattggtacatggaatcgattagaacgattcatccagttagatgtaaatga

SEQ ID NO: 25467 - DNA, 636 bp, Glycine max
  Peptide Sequence Number=SeqID_142245
atggttttggttcttcgtctctctgctgctactcaggatttaccaaagtctgtaatttgcaatgttcatggtgtgaatcccgaattcttgaaaattggagaaaagattgctgcagagagggagctggggcagaaagcctttacaaaaggggcatatttcctgggaaagatggtgtggggaaagggatataaggagttgatagatttattagcaaagcataaggctgaccttgatggtttcaagttggatgtatttggaaatggagaggatgctaatgaagttcagagtgcagccagaaggttggatttgaatctcaactttcagaaaggaagagatcatgcagacgattctcttcatgggacatccaaagactttgtagcaaaagtaaaagaagcattggaaaatgagccttatcctctaacacctgagcaaagatatcaactttcttgggaggctgctactcaaagatttatggaatattccgagcttgataggatcctgaacatggaaaataatggtgaaaaggaaagtgtagataagggaaagctcattgctaagtcagcatcaatgcctaatctgacagaactagtagatggaggcttagcatttgctcactattgtcttattgggaattaa

SEQ ID NO: 25468 - DNA, 1233 bp, Glycine max
  Peptide Sequence Number=SeqID_142246
atgcagatgcagatgcaacaaacgcagcagcaggccacggcgacaccattctcgacctgcactcctcctccttcctccggtggctccgcgtccgaggcaccgccaaagcaggtggctcaagcaatggacaagctcggacaggccgaacgaatcatcgccgacatccgaatcggcgccgaccgcctcctcgaagcgctcttcgtcgcggcggcgcagcctcaccaaggcaacaagcctctccaagtcttcctcaaagaagacgcatgcatgcgtcagtatcttcaagaccttcgatcgcttggtaaggagctagaagagtctggagttctcagcgaatcagttcgatcgaggaaagatttttggggcttgcatatgccactggtttgtccagatggcgctgtggttgcgtatgcgtggaaacgacaacttgcaggacaagcaggtgcttcggccgttgacaggaccaggttagctctcaaagctttcactgatcagaaaaggcgttttttcccacatcttgatgatggacttgaaactagtgaatcagcatcgaagaaatgttgtgggtctgaagaaattgcagtggatcccaaggaaggaattagttttctaaggacgctgccggatgttctgaagtccttggagaaggatgtaccaaatctgaaaatattaacttttgaacgattggactggttaaaaagagcttccacacttacctcgtcaacaaatgagaattctttggaacataactatcatggttcgaataagctaaggctaggatcagtgggaaccgtccctgcagagaaggttgcagtgatagaattgttattcccgtgtgtcttcagggctgttatatccttacatcctgctggttccatggatccagatgctgtagctttctttgctccagatgaggagtatgcagcaacagctctgcagtattttcttgggaaccaatctgaaacgtgtctgtattttcttctgctaccagacactgttttcaagaccttgcaggttccattggcactttctagaactttaaattttcctatcacttgcaaatgttcccggctacttgcaatggataaacaatcaactttattgttacctccagttcatcgtccttattggcagttttccttttctaaaattttgttgaacatatcctcaaaggaccagaattctgatactactcaggcttatcatattgactgcctctctgaggaaacataa

SEQ ID NO: 25469 - DNA, 294 bp, Glycine max
  Peptide Sequence Number=SeqID_142247
atgttatgcactaacaatgttgtgaattcaacatatgcattatggacttggcaccgaaatcaagacaattacaaagaaaatgcagttggtgaccaaatatacattgtgcgacaacctgaattgtgcatgaaagatttgaaggatccacatcaatcacttccatacaattcatccactaaatcctcttctgctataaaccatctctctcaggatgtttctataatcatatcacaaatccttggggttctctttatatatggtctactttctcaggagataaggattcatgcgtaa

SEQ ID NO: 25470 - DNA, 1212 bp, Glycine max
  Peptide Sequence Number=SeqID_142248
atggaatttcctaaaatgaaatccggcaatgtaaaattccattttcctaaaacagttcccggaacttattccgtggatgactacggaagatttatagaaggttttgatgatgaattgaatactgaaaaacacaaagcggtattttctccgtctggaactgatattgaagctggaaaagtatatttaatcaatacccatgggtttataggatatatagatgatatgcaggatgttccttaccagttggtcattcagaagcccgctgatttctatggaaccactgccctcgtagatcaggataaatcagaagctacagacacttttacgttggctaactatgcaaaagtgacagattcaccgttaatgtacaccaaaccggactatattacttttaatgcaggcggaatggatctcgttttaggcgtttattccccgacaggaaagtataaagcagctgactttaaaaccaaccttgaaaaaatggtcgttgcccaaaagaaattcctgggtgatatgaataccaataaaaagtatgcgatcatgctttacctttcaggtggagaaggaccccagattaaaggtttcggggcattggaacaccacgagtctacaagtgttgtattaccggaggccatgcctaaagaagctatcgatcaaaccattaccgatgttgtttcacacgaattcttccatacggtaaacccactgaaaactcactctgaagaaattcattacttcaattatgcagatcctaaaatgtctcaacatctatggatgtatgagggaggaacagagtatttcgcaaatttattccaaatccaggaaggattgatcaacaaggatgaattcctgaagagaataggtgaaaaaatcaccaattctaagaactatgacgacacaatgccgtttaccgtaatgagtaaaaatgttcttgtagagccttacaaggatcagtacagaaatgtttacgaaaagggagccttactggcgatgtgtatggatattgagcttagaaagttatccaacggtgagatggggtatcgtgatatgatcagaaaattatcacagagatttggtgaaaacaaaccgtttaaggacgacaaactgatcgatgaactcgtaactgttaccggctacccgcaagttaaagatttttacaacaaatatattgcaggaaatcagccaacaccttatgctgactatttaaaccag

SEQ ID NO: 25471 - DNA, 291 bp, Glycine max
  Peptide Sequence Number=SeqID_142249
atggcttccagtgaccacacaattttgcatgatagagttcatattcctaccaataagagtttattggagatttcatctcaagatgccttgctggcccaaaataagttgttgtccaagcaacttgaagctttaactgaaacactaagttgcacactttgtggtggagctcatgggtcaggctcgtgtattcccactgaagaaacatctcatgaagttaattacatgggaaaccagcctagacaaaattttaatgtaggtggattttctggatttcaacatggccaaccttag

SEQ ID NO: 25472 - DNA, 321 bp, Glycine max
  Peptide Sequence Number=SeqID_142250
atggaggtcatgaaggatcagatgacctccatgatggaggccatgttaagtatgaaacaaatgatggagaacaatgcggctgcagttgctaccaccagcgttgccgctgaggtggatctgacgcacccatctgccataaaccaagccagccaaccgatcccggacatgtggtatgcctcagcccaatgccgtgggggctccataacaccgcccactgcagcctctgcacttctcagtagggaaactgcctctggccatggaaggaagggagaagttagatctcatcgaggagaggctaagggccatctaagggattggtga

SEQ ID NO: 25473 - DNA, 495 bp, Glycine max
  Peptide Sequence Number=SeqID_142251
atgggaggtgttgcaaaaaaaaaaagggacaaggaattcagaggcagtaacaatgggcccatcggtggctaccgtgagtggttgaaagcccacgtgcaaggtttggattggctcccaagtctgagcgccactaaaagggatgaagatgaggcaccggaggaagacgaaggggtgcaggcctttaggacagaactcaagcaagctcaatcttttttggagccccatgaattgcgttttcgttccatgtgtcctccaccttcgagtttggagccatgcgtagtgatttgcttagtgcaactctccattctcaatctttttcggagccccatgaattgcgttttcgttcatgtgtcctccaccttcgagtttggagcaatgcatagtgatttcttagtgcaattctccattctcaatctttttcggagccccatgaattgcgttttcgttcatgtgtcctccacccacgagtttggagcatgcgtagtgattgcttag

SEQ ID NO: 25474 - DNA, 837 bp, Glycine max
  Peptide Sequence Number=SeqID_142252
atgtttaaacctcagactaattatgaaagctctcttcgggagaggtgtgcagattttcctgcatctgctgttaatctactcgagactttactgtcgatcgattctggcaaccgagggactgcctcatctgccctaatgtctgagtatttcagcaccaagccatatgcttgtaatgcatcaagcctgccgaagtatcctcctagcaaagaaatggatgtaaaaaatattgaagattcatccaagaaaaaaactggaggtaaaatgagagaggttgcaacatcaagaaggcagcaaagacgagtcagtaaaattttgcaagatccaaacaattttggcaaatcaacttcaaaagaggacatgcagaacatttctcaaaatgctcgtagagatgatggtaaatcacatcttactaagggaaaaggaggagccatgcacaaagattatacaaagcctcatatggatgctatgtctgagacctcccaaatgaatgttgctaatggtaatggctatagtgtgggatctaataatacctttacatgggtaaaaaggagaaagcaagatgcttcatcaactctatcagatggatcaagaagcaaaattagtgcacttgatccaaactttgcaaaaggaacatatgacttaaccacacaaagggtgtccatggattttgatcccgcagaactgatgaatgctcagttacatgtcacgtggaggatagccgagatcatggatatatggtggtcttggatcatggcgaccgagggcgtgctgttcgtaaatcaagatttggaagagacaacagatgaggcaaagattgcaggagtggtgcaatgctaa

SEQ ID NO: 25475 - DNA, 1260 bp, Glycine max
  Peptide Sequence Number=SeqID_142253
atggcaaggaagagaaaggttgttgaagtggtggaagagggagaactatgtgagggaaccttgggttgggatgagatgatgaaacaagctgcagcacttggaggggtgcaaagagcaaggaagaggtttgttggtgtaaggcaaaggccatcaggtagatgggtggctgagatcaaagacaccattcagaagataagagtgtggttgggaacttttgacactgctgaggaagctgcaagagcctatgatgaggctgcttgcttgcttcgcggtgccaacacgaggactaacttctggccttgctctcaatcctccacaagtccagctctttcctcaaagataaccaatctcctccttcaaaggcttaaagaaagaaacaacaacaacaacaacaacgcttgttcctcgtcctcgtcctcgtccacctcacttctcatcaaccaccaacaaatgcaacaccaccaacaagttgatgcatatggagaaggttcaacacaattctcaattgaccaattcactgatttcctcaatgaccctgaagattatagcacaagcaacaatgacttcatcaacaacactgcacaaattgactacattactagtagctttgagtcatgcttaactaaaaaagatggtgggacaaaaatggatatgcaattgcaatacaaatcaagcaatgtgacaccacagacttcaagcaatgacagcaattcaggagtggaggacagtgaagaagaaggaaatgatttgggtgtgcaaagtactaatttggatgtccatgattttaggtttctggacaacattgctccacctagttactattctccctttgagatggctgaagagatggaggaggagcctgtggagcctgagaatgagaactacgatgatgagccttcaatgcttagagctgtgatgaagagaatgacttatgagaggaagttctcagcttctctctatgccttcaatggaatacctgaatgcttgaagttgaaacttgaatccggaaacatgaagggaagaggactagctgatcaattaacaagccttcaaatggcttgtagcaaaaacaagcttgagaagaataaggaggagaaagagttcatggcaacaatggataggaaaaaggaacaagaacaccaacatacatcacctgacatggattcttcaagtgttgatggggaactgttactttggaattcacttgatcttcctcctatttgctttgttaacttacttgaaaatggttcattcaattaa

SEQ ID NO: 25476 - DNA, 927 bp, Glycine max
  Peptide Sequence Number=SeqID_142254
atgggttgcataagctccaagaatgcggttgccggagcttgttctccgtctcctgcggtgctgaacatcgcggagggacattccgggttgacggttctggaatcgaaaacagggtcagagaatgagaggaacaacaagaagttgaagaagaacaattcaaagagtagtagtgggggtttcagcttcaggcttgggttggctccaaagcatgtggaggctgaacagaatgctgctggttggcctccttggctcacagctactgcagctgaagccattcaaggatggatccctctcaaagctgattcttttcaaaagttggaaaagattggacaaggtacatatagcagtgtgttccgagcacgtgaagttgaaactgggaagatgtttgctttgaagaaggtgcgctttgacaatttccaacctgagagcatcaggttcatggcaagagaaataacaatccttcgtaggcttgatcacccaaatatcatgaaattggaaggcataatcacttctcgcctctcaaatagcatataccttgtgtttgaatacatggagcatgatcttgctggcctagtatcacgtcctgatattgtgttctccgaatcacagataaaatgttacatgagacagctattaagtggacttgagcattgtcatatgcgtggcatcatgcacagagacatcaaagtatcaaatatcttgttgaacaatgaaggtgttctcaagataggagattttggattagcaaatacaattaacacaaatgggaagcatcatttgacaagtcgcgttgtgactttgtggtatcgccctcctgagctcttgatgggatcaaccaactatggagtgtctgtggatctgtggagtgttggctgtgtatttgcagaactttttcttgggaagcctatccttaaggggagaactgag

SEQ ID NO: 25477 - DNA, 522 bp, Glycine max
  Peptide Sequence Number=SeqID_142255
atgactttagagctgctgaaagtttacgttccaaagtatgagactggaggagagttttggcctacagtgcacagctccacaattttttcattgatactgatgcatataatagccattggtctttttggtttgaagaagcttcctctagcatccatattgattcttcctcttccaattctcacacttctattcaatgagtattgccagaaacggttcttccctatattcaagaattattctgctgagaatgcagataagttggttccagacgtgggtgaatatcagaacaattgtttgattaagaaggacagagcagaccaaaacgagcataatatgtctgaattttatgacaagttggccaatgcatacaatgatccagctctgatgcgagtgaaatattctgaaagaattgataatgtgtttgtaacgagtgtggaaacttgtaacattagtataagtcattgcaaggccttgtttgatttgctagcagaagtttttcaagttccaacttcattagcttag

SEQ ID NO: 25478 - DNA, 414 bp, Glycine max
  Peptide Sequence Number=SeqID_142256
ggagcgtgagatcagaattggcgaaggtacctgcggtggccggagtggcgtcggaggttcgagaaagcgcgggaaaattgggcggagaatggtggcgaaggttccggaagaggagaggggtcgtttagtttgggggagggatcaaaacgacaaggcaggaaaaagggaaattagcggacagcgaatggcgaatgatgagagcgtatattcgcttcgcgttggcacacctcgcgatgaagggcgtgcacgactcaatcctcgcatagtcgttaaagaagctagaggagtggacgatgcaggcctcattgacatgttgcttctaaatcactatgtgttcttattactccttcatgatgtcaatttcatgggaacattggttctcatcaatgtcacattggggtttttggattttgg

SEQ ID NO: 25479 - DNA, 300 bp, Glycine max
  Peptide Sequence Number=SeqID_142257
atggcactcattacaccattaagtgccaaattcgatcactttcaacgtgcttttggatcaatacaaaattacctgccacagcttgacctaaaagtcctttatagaattaagggtgttacatcatatggtgtcggtggtaatgaaggtgaccttttttacatggcggtcgtcaagagagaggaagaggctaagggtttgaagggatgtggtggcgtgggtgagactggaattgtagccaaagatctagccaccatgggagatctagatggtaccagagacaacaacagtagtagtggttga

SEQ ID NO: 25480 - DNA, 468 bp, Glycine max
  Peptide Sequence Number=SeqID_142258
atggtgtcaactgagaggttgaataagaccagtgatagagttaaggatagtaggagaacaatgttggaaacggaagagcttggtgtctcaattcttcaagatttgcattcacaacgacaatctctattgcatgcacataacacgctccatggagtggatgataacataggcaagagcaagaaaattttgaccaacatgtcaagaaggatgaacaagaacaaatgggttattggtggcattgttttggtcctgggtgctgccatcaccaatggcgagacatcattgacagctgacgtggagacagtctcgctaatggaagaggcgagacagggtgaggtggagacagtctcgccaatgggaggggcgagacagactgatgtggatggtgtcgccagtgcttgtggcgatacatggagaagaaagaaaatattatcggttttagggggccactttagatttaatttctag

SEQ ID NO: 25481 - DNA, 339 bp, Glycine max
  Peptide Sequence Number=SeqID_142259
atgatagaagagtatgttgatgtagaaaacctcaactactatgatgaattggacagtgtttccaagttgcagaaacaacttcgcgcgtctgttggtcgaagcaaacttgcagcaaaagttgctaaaagaatcaagaattatggtagaagtggtgctgcatctggtttgatatctagtcttgcattcacagcagtgcaggggattgagctgacaaatcctcaggctcgtcatgcacaccaacttggtagcacccactttcaaagatcaagaggacatgaaaccatgtataaatacaaatttttgttcagtcccctgattattcttggtggatatgcctag

SEQ ID NO: 25482 - DNA, 216 bp, Glycine max
  Peptide Sequence Number=SeqID_142260
atgccaccgtttcgcgattcgcagcatgaatttctccgcggaagaaacgcaaaaacgcgaagcacagaaaacacgttcacgctaataatagaaggcaaagaaattgatctgaaacaattaacggaaaagaccattgacgcgtttggatctcaaaacgcaccgtcgtttcggcgaaagaaagaaagggatccaacaacaggaacagcaagatattaa

SEQ ID NO: 25483 - DNA, 1890 bp, Glycine max
  Peptide Sequence Number=SeqID_142261
atgagatggtcacacaccacacaacagcagtgtgctctcatattccgttctcttctccgacaatgcgcccgcgcctccgccgtccgccccggcgagcaactccacgccgcggccaccgtctccggcctcctcttctccccctccagcttcctccttaacgccctcctccacctctacgcctcctgccccctcccttcccacgcccgcaaactgtttgaccgaatcccccactcgcacaaggactccgtcgactacaccgccctcatccgctgctcccacccccttgatgccctccgtttctacctccaaatgcgccagcgcgccctccccctcgatggggtggccttaatttgcgccctcggcgcgtgttccaagcttggggacagcaacctcgtgcctcaaatgcacgtgggtgtggtgaagtttgggtttttgaggcacaccaaggttttgaatggggttatggatggttatgtgaagtgtgggcttgtgggtgaggctagaagggtgttcgaggagattgaggagcctagtgttgtgtcttggactgtggtgttggaaggtgtggttaaatgtgagggtgtggagagtgggaaagtagtgtttgatgaaatgcctgagagaaatgaggttgcttggactgtattaataaaagggtatgttggaagtgggtttacaaaggaggcttttttgcttcttaaagagatggtttttggtaaccaacagggattgagtatggtagaaagggctagtcacctggaagtttgtggtaacccacgggagttgggtctagcggaaggggctagtctcccacaacatagtgaatcaagatttgaatcctcgcagggagaaatatccacattcagtgttcgagagtgtgttgaacatgattgcttccgaagaaacatacctctgcggaaccaaaaggaaaatgagaaggtttttggttgtgggtttgggtttgggttgaattcgattactttgtgttctgttttgtctgcttgttctcaatctggggatgtgagtgtgggaaggtgggttcattgttacgctgttaaggctgtggggtgggatttgggtgttatggtggggacaagtttggttgacatgtatgccaaatgtgggaggataagtgctgctttgatggtgtttaggcatatgccaaggaggaatgtggtggcatggaatgccatgctttgtgggttggccatgcatggtatggggaaggttgtggtggagatgtttgcttgcatggtggaagaggtgaagcctgatgctgtgactttcatggctttgttaagttcttgcagtcattcgggtctagttgaacagggttggcagtattttcatgatcttgagcgtgcttatgggatcaggccagaaattgagcactatgcttgcatggtggatcttcttggtcgagctggacgtttggaagaagctgaggatttggtgaagaagttgccaattcctccaaatgaagttgttctggggtcccttttgggtgcttgttatgcacatggtaagttgaggctgggggagaagattatgagagagttggttcagatggatcccctcaacacagaatatcatatcctgctttcaaacatgtatgcattgtgtggaaaagcagacaaggcaaattcccttaggaaggttcttaagaataggggtatcagaaaggtgccaggaatgagctcaatatatgtagacggccaacttcatcggttcatcgctggggataagtcacacccaagaactgcagatatttacatgaagcttgatgacatgatttgcaagctgaggttggctggctatgttcccaacacgaattgtcaggttctgtttggttgttccaatggcgatgattgcatggaagcatttgaggag

SEQ ID NO: 25484 - DNA, 750 bp, Glycine max
  Peptide Sequence Number=SeqID_142262
atggacttggggtttcttggtaaaatcccttggtttaatgctcaattgaacacagattcggggagtaattcagttcctatcgatacattcactgaacaacctaaacaagaacttggcaatgattccaaattgccctttctttcattgtttccttgggtgaatcgtgctggagacaaatttcaaaggccatctactatcaacaaagagttaaaaaggcaagcacgccgcaggaatggtgtaggaaaagatggtgaggttaaccctttgcgcttccggccgtatgtgtgtaaggttccatggcatacaggggttagagcatttctttctcagttgttccctcgatatggacattactgtggaccaaactggtcaagcgggaaagacggaggatctcttgtttgggataggcgaccgattgattggttggatttctgctgttactgccatgatatagggtatgatactcacgatcaagcgaagctgctgaaggccgacttagcatttctcgaatgtttggaaaagcaccatgggagtactaaaggagaccctcatgttgctcctatttataagacaatgtgtcttaatggtctgaggaattttctgataccatacagaaggaatattgtgaatctacaacagtttgggcaacctatgattcagtttggatggctaagcaatttgagatggggaagttggaactttcagaaaactcatagattgagctcagtgggaggaagtactgtgtcatag

SEQ ID NO: 25485 - DNA, 1275 bp, Glycine max
  Peptide Sequence Number=SeqID_142263
atggggtgcacttactctgtgtataggaagaaaaaatcaagctttcctgaagtggtggtctttgttccatcaacaagaattccggttcaatctgatctccaaagggtgcttaagggagtaattccaagggatcttgctgataaattggctgcactaaggaatcagatagtgttgattgcagaggatactggtgggtcagctgtaactgaattgcagcgagctttgaatgaatatttgtccgttctgataggacttactaagaaagagtatggtctagaaggagtaatagatttcaagtggaaaaatatagaagatgggagacaattctttaacatggtaaagtccaattggcaggatagcagtatatcaaatacctggtttgaggtgctatcttcagttcaccttatgtctatgctgacactctcagaggctgactcactgatgattccaaaggacccctcaggctctggattcagggttgtatcttcagatagcaagagggaagcaattgatttgttactcaaggcatcaggatacctggagttctgtgtaagggatgttcttactcggatacctgctgaaaccaagaaaactttcccccacgacttgcaggagggtgtattggaggctattgctattcaaacactaggccagggaactgagattcaacttggtcttgcggtggaaagtcagaaggcaactttgtctgtgaagaggaggttggcatgtgagcagctgatttactttagtcaggcgtatcactgcttgtcaggatgcgacatcaaccaagggcttggaaggaagcatattcgatttatcaaatggaagttccttgaatccaaggctgcagcctactactaccatggactgatccttgacaagggtagtgaaccaagcagccacattggtgctgtgtcttgttttcttgccgcagaagaacttctggctgaaagcaagaaggcatgcttaagcttttgtcttgcacctccagtgacaagggctcctccagtctggggtgctatgaaattcttacaccagaaaattcctgaagttgcatcaaggaagtcccagatgtatggctacctctgggagaaagagaaaggacttcaatcattgccagatcttcctgagttccaattatcattacgtccagatgactatgaactgcctgaaattgatcctgcatgggatagtaaaaactggaaatctctagggcagccattgaaggagcaccttagagatagtgatgagactgaagagaatccaactgattga

SEQ ID NO: 25486 - DNA, 159 bp, Glycine max
  Peptide Sequence Number=SeqID_142264
atggatgatagacttaacaagaaacactctgcccgtgaaagaaagaagtttacctttccaagtgaagataatgacgtcacctacatacaagacatgagaaggggtgttgaagtgtcttgggctagccatataggaaagaaccctttgaaaccaagttag

SEQ ID NO: 25487 - DNA, 300 bp, Glycine max
  Peptide Sequence Number=SeqID_142265
atgagtaattaccagagagcaccccaagatccctattatcctcctccaggctatgcccctccttatcccccacaacagggttacccgccaccgggttacccgtcagcgccgccgcagcctccgccggggtactcgccgtacccgccgccgccgcagtacgaaggttaccaaggctatttcaatcaagggtatcctcctccacctcctcccaattaccactgccaccacgttcagcatgataaccccggttttacttccttcttccaaggctggtacatttttcttcttccttttttttaa

SEQ ID NO: 25488 - DNA, 672 bp, Glycine max
  Peptide Sequence Number=SeqID_142266
atggcggatccaatcgcgaaggctctgatcgcgtttgcgctcttagcttccctcttgctgtgttcgcacgcttcctccgacgttcccttcatcgttgctcacaagaaggcctccctcaacagactcaagtccggcgccgaaagggtctccgtcaccatcgacatcttcaaccaaggaacctcgacggcctatgatgtaagcttatcagacgatagctggccaagtgatgcttttgatgtaatcagcggtagcacttcaaagtcatgggaaaggcttgatgctggtggcatcctttctcacacatttgagctggaggcaaaatcaaagggagtatttgccggtgaaccagctgtcataaagttccgtgttcccacaaagtctgctttgcaggaggcatattcaactcccatattgcctttggacgttctttctgatagacctcctgagaagaagtttgaatggttacatgaatcagtatcaattgcttatgttgactggcatgttactttttgttttcatgtattctacttggttggaccgacatctcaggctaagaggttgctggctaagtatggatctctaatctcagtgatctccatcatggtcctgttcgtatacttggtagcttcaccatcaaaatccagtgcaaagggaagcaagaagaagcgttaa

SEQ ID NO: 25489 - DNA, 162 bp, Glycine max
  Peptide Sequence Number=SeqID_142267
atggcttctccaattcctggtatggtaaagaaccacataaacagagaagaccaattaccattctcaacaactgtgacggtttcagatggtggcgccggtggtgagggtggctgccgtcgagtgactgagggagtcggggtttcctttcaaatgaaatggtga

SEQ ID NO: 25490 - DNA, 1582 bp, Glycine max
  Peptide Sequence Number=SeqID_142268
atgtcactctttggagaattcatggaagactttgttgatgaatccaaatttatagactatttcaaggctatctggcatccaagaataggagcatggatcaatgcacttcaaactcttccacttgttagccaagaatcttgtgcagcaatggaattttaccacaaccaactgaagatcaggttgttgaatgagaaaaacatcaaaaaagatgattttgcacgatactggaaaaatgaatggatgagtggtttgacatcatggcacaaagcactgaagattccagatactgatgtcttaatggaagatggatgtgctaaggtcactgatcaagatgatcgagataaagcttttgttgtctggaatactggttcaatgttgagcatttgtaattgtagttgggcacaagatggcaacctttgtgagcatatcctgaaagttctaagtatctgccgaaagagggggtccattttaccatctgttgctttatttcagtatcaccaggcactaaataacatgctgcattgccctcctttggattctttaatttgtgatcacgccatgtcattggcagtttcagttcagaagcagttaaatactctacttgataaagaaagtgtccagactgttgtggattcttacgggaaatggatcgttattgatattccactggaaaacttcagggtaggctcagctaacagggatcaggacacggttagtaagaagcgtgtcatcaatggtgttttatctgaggacagtgatggctgtgaggacagaaatgattcaagtgatgcccttggatgtgcaaatgcaatgactgatatcgctgatcaagttgtggaccgcggcattgcaagaaatggcaaaccgttgagtgctggagaagacagtttgcctgctgacatggatgttgatccatcatcaacttgtgttaaccctcctaggttgcaccgtgttgatgatattgtttcaagcgatgcattcccagagaacaaagagaggggcttagctaccacaagatacgagatttcaacttctgaaaatggtgctttgtctaatgataagattaaagaaactattttagatgaaggcggcagagattgtgctgtggatgtggatcccccaactttagataccctttcatcaacatcagaggatgtgaagcattgtgaaacagaaacacatcaaaatggtgtcaatgaggttcccagagtcatttcttgcactaaagatgctgatagccacttgagccccccatcaacagttaaacctgctaagccacttgcacttgatatgggtaaaaattcagtccggggaagggctaaggagataagaggatggacatctgataagcataagcataagttacacatcatcaaggtgtacacccgcaaacagcgagcaagagaagcaataaccatggaccaccagcagcaaggcgcacaacacccaagggggtgcaaggtcagaagatgtgaatcaaggggacatgacccttgggaacagtcacaaccaaccattatgatccgcctaaggggtgcaaggtcaggagatgcgaatcaagggggcatgacccttgggaaca

SEQ ID NO: 25491 - DNA, 948 bp, Glycine max
  Peptide Sequence Number=SeqID_142269
atggccagatgggatgcaatcctatctcttccagtacaaaatcctcccacattggaaatttctttagctgagctagtgtggtcaaaagtggaaggttggcatgataaattagatagagtagctctaatcccatatgctagagttgatgattttattttaataccatctcaatgtaggtattggtgttcctttggtcctgatgaccatagaaaaggtggcatcgtccgaccaagtcatactacatatgttccaaagaagaaaaatgcagggtttgtcatgccatggtacacaggacaaaaggctgctggaacacgtgctatgtttgccccatatatctcagaagatctcggactacgggttttatctcttctatatgttggagtctctgtggaaactattatgcagcgactcaatgaatcagttgagagacaaggtggtccatgtaaccatgatgaccttctgactcaccgttatgttcaacgacaagagagggcgatccgccattctacatatgagctagatgatgatgatgctgttagtatcagcatgtgggttgaaagccaccaaaatcaggtattcttctatgaagatttctctgattcagatccatatactcttggcattcaaactgagtggcaattgctccaaatgattagatttggaaactgtggtctgcttgcctcagattcaagatttgaaactaaaagcaagctcattggtaatgtcattcagtaccccattcatagtcttctagtgttctactcagacaagaaggccattccagtggcttggataatagcaccaaagttttcaagtttggatgcacatcgatggatgagggctctttacaatagagttcacgccaaagatcctacgtcgaagttggcttgcttcatagtagatgatccatcgtatgatgttctagcaatcagacttcagatgatctag

SEQ ID NO: 25492 - DNA, 1218 bp, Glycine max
  Peptide Sequence Number=SeqID_142270
atgggagggatgttgacgattgagagtaaagcaggacaggacagaattagcgaattaccggacgatgttgtgtaccacatcctttcgttccttacaatcaaggaagccattgctacatccttgttatctacgaggtggagatttctatggaccatgcttccttctcttcacatcgactgctccaaaccaatcatgaaactctaccatagtgtcgatgttttcttgggtctatttagaacacaaaagatctcaaggtttcatctcagatgtaataatgattgttgtctcagttacgcggaagaatgggtcaacgcagttgtgtccagaaaagttgaacatggcctctttcctttctctattccttatgatgttcatctccctaatctccagatttttcacctgcacgtaaatgcattattgagcttccccagtattaacaagcttatatctggatctccagctcttgaactgtttgatctgaagcagaactggtgggagagtcagttgaagattttgcttaagcataactctcaagttatccaagtattccaccacagctctttttatggtcttgttatacaagatgatcgtgattatgattttatctcaaactgtatgtacactcatcgttggcctaacattcttaaagccaaggtttgtttgacagtgcatcactgcgctaagaatctttatgcgaaccaaattgtttctaacattctccaaggactgtgtaatgttgaatttctgtcattgggtgattttagggaagagatggacccttctattcttgatcttccaaattttgagaatttagttgatttaaggctttttcttaaaaatgctgactccttatttctggaacttcctgccaagtgtcctaagcttgaagttcttgaagttaatatcatggatgaccgctacggtataaatcagagatgtcgatatcatattactggaggagccaccttggcctccgggtttcaaagttggttaaacttctcatcaatcatctcaaacactccagttgtggcattatcaactggatggttcaataataaaaagaggtgtcatcacaacatcaccatctttggaaatggaagaagggtccatgccatggtggttgatgagtgtgattccacaagagggtgtgatgctgaacatgatttccagcctccatgccctaacaatgttgttgatgcctttaaagctgttttgtaa

SEQ ID NO: 25493 - DNA, 3009 bp, Glycine max
  Peptide Sequence Number=SeqID_142271
atgagcaacctcaagctaggtgtggaagttgtgggtgctcatgaccttatgcccaaagatggacagggctcatgtagtacttatgtggaacttcactttgatggttggaaatttcggactacaactaaagagaaagatctgaatcctgtttggaatgagaaattttacttcaatgttactgatccaagcaaattgccgaatctcactcttgatgcctgtatctaccattatagcaagagaagtaattccaaaattttcctgggtaaggtccacctcactgaaccctcatttgtcccatatgctgatgctgttgttttgcactaccctctggaaaagaaaaatgttttttcccgcataaaaggagaacttggtttgaaggtatatgtcactgatgacccttcagtaaaatcctcaaaccctattcatgatgtggaaccctctgtggacaccgtccaacactcaaccccagatcaatcaccagtttcattcactaattcaatcctgaacgtcttttctcggaagaaaaatgagacaaagcacacatttcatacccttccaaattcaaatgaagaaaaacagcataaatcttctccttcagctgctgcaaagacaaataaagactctgggatgcatgagtctaaatctggactgcctcctccaaaagtttttcatgcatatccaggttctttctctccaatggattatgcactcaaagagacaagcccttttcttggagggggacaagtagttggtgggcgagttattcgcgggtacaggccatccagctcctatgaccttgttgaaccaatgcaatacctattcgtacgagttgtaagagctcgtttgactgggagcattgatccatatgtggaggtaaaggttggaaatttcaaaggaattaccaaacactacgagaaaacacaagatcctgaatggaatcaagtgtttgcctttgcaagggaaaatcagcagtcaactttgcttgaagttgtggtcaaagacaagaatatgttacttgatgaaattattggcactgtgaagtttgatctccatgatgttcctagacgtgttccacctaatagtccattggctcctgaatggtataggattgacaagggtaaggacaagaaaaaaggggagttgatgcttgctgtatggtttggcacacaagctgatgaagcttttcctgatgcttggcattctgatgctctctcctctggtgatatatcctcgtctgcatatgctcatatgagatcaaaagtttaccattcaccaagattatggtatgtacgggttaaagtgattgaggctcaggacttacatgtgtcagagaattcccaaatccatgatgcctatgttaagctacagatcggtaaccagattttgaagacaagacctgttcaatcaaggaccatgattctgcgttgggatcaagagctgatgtttgttgctgctgaaccctttgaggaacctctgattgtttcagtggaaaatcgagttggtcccaacaaagacgagactattggagctgttattattcctgtagaccaaactgacaagcgagctgatgatagacttatccacactaggtggtatcaccttgaagaatccatatcatctgtgatggatggggaacaaggaaaaaaggagaaagataaattttttagtagaattcacctgagtgtctgtcttgatggtggttaccatgtttttgatgggtcaacttattatagtagtgatctcagaccaacatcaaagcagctctggaagaagccaattggtcttttagaaattggcattctaagtgttgatggacttcatccaacgaaaaccagggatggaagagggacaacagatacatactgtgtggcaaaatatgggcataagtgggttcgcactcgaaccgttagtgacagtcttagtccaaaatacaatgagcagtacacttgggacgtttatgatccagctacagttctcactgtgggggtgtttgataatggacaacttcataattcggatggtaacaaagatctaaaaataggtaaagttcggattcggatctcgaccctggaagctggccgtgtttacacaaatgcatacccattaccagtgctacatccttcaggtgtcaagaagatgggtgagctgcacttggccattagattctcctgttcctcaatggttgatttgatgcagcagtatttcaagcctcacttgccaaaaatgcactataaaaggccacttaacttaatggaacaggaaaagctgcgacatcaagcggtcaatgttgttgcttctcgactaagtagggcggaacccccacttagaaaggaggtagttgaatacatgtgtgacacagattctcatctttggagtatgaggcggagcaaggcaaacttctaccgtctgatgacagtgttttctggaattctctctgttgtgcgatggttaggggaagtttccacatggaagcatcctataacaacagtgctggtgcacattctttttctgatgcttgtatgtttccctgaacttattctgccaactgtatttctatacatgtttgtcatcagcatgtggaattggaggttccggccgaggtgccctcctcacatgaacaccagactctcctatgcagaaggggtgaccccagatgagcttgatgaggaatttgacacattccccagctcaaagagccctgacattctacgttggaggtacgaccggttaagaactgtggctgggaggattcagagtgttgtaggagatttagctactcaaggagagaggatccaagctcttgtgaattggcgtgatcctcgtgcctccgccatgttcatggtattctgctttgtggctgctatagtgttgtatgtcacacccttccaactgcctattcttctgactggattttacttgatgaggcaccccatgcttcggagcaaggtgccgcctgctccggtgaatttcttccgtaggttgccttctctcacagacagcatgctgtaa

SEQ ID NO: 25494 - DNA, 105 bp, Glycine max
  Peptide Sequence Number=SeqID_142272
atggcacaacccaacaccgctacaactactgaacaatacgaaaccgacattctacaatcttttcaagtgaagtcccaaagatcaaaatttcagctgaaagtctga

SEQ ID NO: 25495 - DNA, 666 bp, Glycine max
  Peptide Sequence Number=SeqID_142273
atgttgtaccctgtaagaatgtttcagcttggcattcgagacaagtctgaggctgctatagttattaaaatgttttttcaaatggttaagactcagtttggagccactattaagtttgataatgcaaaagagcttgctctgacggaatttctagcagaacaaggaactcttcaacaattttcttgtgtggagagacctcaacaacattcagtggcggaaagaaaacatcaacatctattgaatgtggctaaggccttattttttagtccaaattgccaatacaattttggggagaattctccttatcaagtgctttttggttccaagctagattatcactctttaaaagcctttggctacctggcatatgcaacaacattgccatctactaggaacaagttcactccttgggttattccattagtctttgttggttacccaagaggttatcagcgttacaagttgtataatctggaaactaaacaatgcttagtttctagagatgtggtttttcatgaaacaaattttcctttccaggcagtaatacctactcaagatatttcacattttgttgatgacatggttattcctttacctgttgctgacaattcgtcctcagatcctcctgcttcagatgcgatgaataccaacaacaaccattgttga

SEQ ID NO: 25496 - DNA, 387 bp, Glycine max
  Peptide Sequence Number=SeqID_142274
atggctagtggtagtttgaagaacatgttgagtgaagcaatcaataaaggagtggtggaatcacgagccaggatcttcggccaccaattgaaccccactggccagcaaactcctcacaagcttctccgcatgaagctctttggtgaaaaagtcgctcagtggtaccctcacgacatcaagaaagacgatcctcttgtcatggcccgtcaagaacaagatttagggattgaatgcagtggtatggtgtggatggcaatagcaatgttggttgctctgcacttgctaaccttcctctacaagttagcagtgttgttaaatggtggcgctatggctgccatggtggaatggtgtggcagttttttgccatctgccataggaaatttgtga

SEQ ID NO: 25497 - DNA, 105 bp, Glycine max
  Peptide Sequence Number=SeqID_142275
ggtgcagggcaagcagtagcagttagagtaacagcagatcgttgtgctttctacaattgcaggttccttggatggcaggttgaattgctgaaaagaattcgatga

SEQ ID NO: 25498 - DNA, 384 bp, Glycine max
  Peptide Sequence Number=SeqID_142276
atggttcttgagaatattacctttgagaattcttctcctcaggtgtgcagagacatcttttgtaataactgtgtcacaagatggaaccgaacagtgccgaacggtgcaggaagccatagatgctgtgccactcggcaacactcgccggacggtgattctggtgtccccaggaacctaccggcagccaagactaagaacttcatcaccctcattggcctgcgccctgaggacactcttctcacttggaacaacactgccaccttaatccaccaccaccaggatgctaaggtgatagggactggaatctttggttgtggcaccatcattgtggaagggggggactttattgctgagaatattacctttgagaattcttcccctcag

SEQ ID NO: 25499 - DNA, 414 bp, Glycine max
  Peptide Sequence Number=SeqID_142277
atggagtcatggaagctaggaagggcacttgaaggttgcaaggaatttgaggggtttgttcatgtaaatttgggaaagcaagaggagttgggtgttggggaagaggtatttgagaaacttgatggtggcaaccactgtagaggcgacaatgactattgcgatgggaaagatgaggaatgttgtggtcagtacaacgacaatgaccgtggcaacgattattattgtagtggtgacgaatgttgttgtgtgagtaagtatgggtatgataatggaaaacttgcaattagagctcaacatgcatataagcctgcgggtgaaacccgcaagttgcaaaacctacctcacaaaactcacattttaaacgggttcaattctagcaagctggcaccaacctcacatggtttgcaagtttag

SEQ ID NO: 25500 - DNA, 261 bp, Glycine max
  Peptide Sequence Number=SeqID_142278
atgccatatattcttgggagtaaaaaacaagtcccggtgggtagtgagggtgacccaccatcacatggcaaggatgagatcctcaatggaatggtccacaacacattagtgcaagttgagaatttaacaaacgaggaagcaaaacgtacacataaggaaacagaagggaaacaaaaccatggagaaaaggatgttacaaatatcttctgcgcactgagggatgtaaaatctcccacaccaagaaggggaacacagacataa

SEQ ID NO: 25501 - DNA, 264 bp, Glycine max
  Peptide Sequence Number=SeqID_142279
atggcggcaacgttcgatttggttcgttccctcgcacttctcactcttgcatttgtgtgtagcgtcgcgaattcgatgcggttcgagcttcaatcgggtaacaccaagtgcatttcagaagacattaagaccaacgcgatgagtgtgggaaagtacagtgttgttaatccccgagaagggtacccacttcccgattcccacaggatcgttgtcaagacaaatgcagctaatacgaccacaattgcggtcgcattgtggttgtag

SEQ ID NO: 25502 - DNA, 192 bp, Glycine max
  Peptide Sequence Number=SeqID_142280
atggactttaagaagtcaaggcaaaagttgcagttttgcatgttagctctcaagcaagccatagaagggaaaagtaacatcctaccatatgttggatatcaattgcaaaagatcaactatgatgtcttgatggtatcagaagttgggttaaaatgcgggatgcaacaagtgaggaaatatttatttgcttaa

SEQ ID NO: 25503 - DNA, 387 bp, Glycine max
  Peptide Sequence Number=SeqID_142281
atgatggttggggtcccagagaaggaaaaaacaggtccagaggaagccatttcaggtcccaaacaaaaaaaccctaacgcaaaagagggagaacacataagggctgacaaaaaagcttatcggaagcgagagctgccgggaccagacaagtcagcttctgacggcgagacggcggcgagtgggcttcacgcgccagaaatcgcgcgagataagggcagcgcgtggaagctccattggcagcgcgactaccaggggtgggtcgcacttttcgaggcgaacctaaccctggtctcgccagaaaaaatggccggagatgacagcggccgacggcggcagacggcggacaaaacccgctctaatgccaacttgaagactgaggtgagttga

SEQ ID NO: 25504 - DNA, 303 bp, Glycine max
  Peptide Sequence Number=SeqID_142282
atgaagaaaaaaatagggttagggttttttgttgatagggctgtgaaggtgggggctttgaaagccgccgaggccgaggccccggcttccccctcaaaagaagacagtgagagatctattgaaaacggagagaaccctctcttgcttcccgaaaagactctgttactatatttttggagtttaggacgattctgcttcataattgcaattatcggcgtcgagttgccgcgtggcttctgcactgtgggacctcctccttcacccttctctttcgagaggcagtatatatcgtgcaatctgtaa

SEQ ID NO: 25505 - DNA, 291 bp, Glycine max
  Peptide Sequence Number=SeqID_142283
atgcctttgagggagggctttactttgcctatgggatgctttgtgctcaaaccatcgaatagtaaatattgctgtctactgcagtggcatttgcaagacctttcttccttcaggaagccaaactattggacatgcattgcgcatgctgtgacaacaacatctgagcgtgctggcctttctgcatcaaaagtttcaaatggcaacttaaggaaggatgatctcaatgagaaccccataatgaaaaataaaacacttgtttctaatgaaaacagtaattgcaatctttattaa

SEQ ID NO: 25506 - DNA, 586 bp, Glycine max
  Peptide Sequence Number=SeqID_142284
atggtgattgataataatatgaaggcaactaaatcatgtagccataatgagcgagatggtgttgttatggaaattaaggagcctgatggagaagtagggtacccagatcaagaacaagttgagggtgatctgaaagatatcaagagggaacttgaatttttacaaggacaagaggatggagacccattaccaagatacaaaagcttgagtgagcatatggtcagcatgctggttaaggaagaagtgtattggaagcaaagggagggagagatggtagaagagcaagctagaatatgcaagctgatttcagaagagcaatatgcttttatagttgggagattcattggtgataatgttttgatggcctcaaagattaaccaccacatgaggaatatgaggagaggtaaaactagtgatatggctcttaagatggaaattagtaaggcatatgataaagttgattgggggtatctaagggctataatggagaggatggggtttgacaagcatgggtcaaccaattggataatgcgcgccttaatccataaagttgagggtgatgaaactctacatggcatattcatag

SEQ ID NO: 25507 - DNA, 2721 bp, Glycine max
  Peptide Sequence Number=SeqID_142285
atgggagctgtttctggagaagagttagttaaatgggagaagatgggaggagtgggaggccatgaggagaagattctggtgttagtgaggctgagacctttgagtgagaaggaaattgatgtgaatgaagcagcagattgggaatgcatcaatgacactaccatcttataccggaacacccttcgggaaggttcctcattcccaagtgcctacacctttgacagagtttttcggggtgactgttccacaaagcaggtatatgaggaaggggccaaagaaattgctctttcagttgttggcggaataaactcatgtatttttgcctacgggcaaacgagtagtggaaagacatacacaatgattggaataactgaatatgctgtagcagatatttttgactatataaataagttctcagcaattgaaatttacaacgaaattattagagacctcctgatcactaagaacacatcacttaggctgcgtgatgatcctgagagaggaccaattgtagagaaacttacagaggagactctacgggactgggtgcatttgaaagagctcctatcattctgtgaagcacagagacaggtaggagagacatacctcaatgacaagagttctcgatctcaccaaattatcagactgacaattgaaagttctgccagagaattcatgggtaaaagcagctcaaccactttagctgctagtgtgaattttgttgatttggcagggagtgagcgtgcatctcaggcattatcagctgggtccagattgaaagaaggctgtcatataaatcggagtttactcactcttggaacagttattcgtaaacttaggttgtccccttctttcttagcctatggtgtctaccttctttattcagcttctaatattgttagcaaacctacatctggattgtttaattcaactaagcaagacagtaagggaagacaaggacacatcaattacagagattctaagttgacgcgcatactgcagccttccttaggtggcaattctagaacagccatcatttgcactttgagccctgcgcggagccatgttgagcaaactagaaacacccttctttttgcttgttgtgcaaaacaagtgactactaaagcacaggttaatgtagtgatgtctgataaggtattggtcaagcagctgcaaaaagaggtagccagattagagagtgagttgagaactccttgtcctccttccaccaattgtgattgtgcagcaatgttgagaaagaaaaatctccagatacaaaagatggagagggagattagggagcttattgagcaacgtcatcttgctcaatctcaggttgaggatttgctgcgcatggttggaaatgatcagaaatctagaaaagaaaggatggacacctgggaagatgatgattcaatatcagagtcatcaagcacttatccttctgatttacgcattagagaattcaacaatcctcactacaacaatgaaaacagtgaaagtagtcctgataaacaccctgatgaatgctgcaaagaaattcaaagtgttgaattggaggaatcaagtagagatgaccttgaatatgctgatctatcagtaagtaacaacggggtgttggcattaacattgtatggagaggaaaatgtaataagccaggagataccgacccctgtgaatgaagatagggaagagaaacagaaccaattaacatatggtgtgttggagcagagactcgatgattcacaattgagtaatgattctcctatgactatgtcagagacagtgccaaattgtaggaattttaaattactaaggagctggagttgtagggaatattacacaagtagttctcctgagaaagcgggagtaatggagaggactccggccagtagttttgaaaaatgcttccctggaagaccagatgaattgcagagaaagttccttccattaacttatggttcttccacaaaattgtcaatgaatggctctccatcttctgttggaagcccctctatggatgagttaagaaccaacagcatgagatcaaatgctaatgaagatgttactagcctccaaacttttgttgctgggatgaaggaaatggcaaaacttgagtatgagaagcagcttgttgatgatgatcaggatcagcaagcagagacaacaacttttagatttgaaaagaatatgaaagatgtaggtgtgggttcaatgttagaggcacctgaatctcctgtggaatggcctctgcaattcaagcagcagcaaagagaaatagtggaactgtggcaagcctgcaaggtatcattgttccacaggacttacttctttcttttattcaggggtgatccaactgactccatatacatggaggtggagtttagaagattatctttcctcaaagaaacatttgccagtggaaatcagtccatgaacgcttcaagcgcgaagggtgttcagcgggagagagaggtgctggtcaagcttatgcagagaaggctatccgaggaagagaggaagaatctcttcagcaagtggggcattgaattggattcaaagcgccggaggaagcagctggcgaatcgcatatggagcagcaccgatatgaatcacatcgtggagagtgctgcggttgttgcaaagttattgagctttacagggctgaaggagatgtttggccttagcttctcaccacatacctgggcgtctcttttttag

SEQ ID NO: 25508 - DNA, 615 bp, Glycine max
  Peptide Sequence Number=SeqID_142286
atggtgacatacaacaacaaaaagtattacttagatgttatagaaacaaagcctgctaatgctataagcatcatcgagacagactgtgaggtggactttgctccttccttggattacaaggttactactgcaagcaaaacactagacaaaggcaagttcaacccattttttgggactgggagacgcttagatggaaactcaattcctcctgtttattcttcacggccttctgatgttccaaatgtcaattcattgtcttttacaaattctagttcaccaaatttcgctcgtccatctcagggaaagctagagaaagatgattatttgctaagacttggtagtgctgataacaattctggtagtggcaataggaatgccttaggccgtgcaaaggagaaggtagagtatggctgtgaatggtgcgagcgtgatgctgcggtgcagcgtggctgcgaggtgtgtgggcgcggggacaagaagacgaagaaaggaaagaggttcaagggatcgtacggtaacgctaggccgaagaaagagaagatgatagagcgcatcaaggacaaggtcgaagttcccaggtccactccttggcctctccctttcaagctcatctga

SEQ ID NO: 25509 - DNA, 568 bp, Glycine max
  misc_feature (496)..(496): n is a, c, g, or t
  Peptide Sequence Number=SeqID_142287
gatgaagctcaacatccctcgcttcgatgggaccaacatgacgtcttggattttcaagatattgcaatttttcgactatcatgcaaccccagatgatgaacgcttacaaattgcttccttctacctcgacggtgccgccttaagttggtttcaatggatgcatcgaaataaccaactcaccacttgggctgattttctcaatgctctggaaatgcgatttgctccatcattctacaacgatccacgaggggcccttttcaatttgccttctccgttcctccttagctgttttgtattgggactgatgccatacatccaccgtgaggtccaggcgctacaacccttgcccctagttcaggtagtggcactcgcaaagctacaagaagacaaaatcaatgacgccaaacggccatctcatcctcgacaccccagtttcccctttgtcgcccctcctattactttggtaccaccccctccacctctacttccatgccancacaaaccacttttaaaacgctcactgcatccgaaatggccaaccgccgtggaaagggcttgtgttacaact

SEQ ID NO: 25510 - DNA, 313 bp, Glycine max
  Peptide Sequence Number=SeqID_142288
atgagtgcgaaaagcagtttttgggatgtccattggcgacattctaatttggtgaaatccctgggcaaggtccaacctcgagaaccattgagcattatgcaaatcatccaggagttcatcaatagttggaagaggaaacctgtccttgactgtgacggtgttgagggctttgtaatccatgcaaaaacgccatgtgccatctttcttttaaacaagcaagaccagagaagagttgagaattgggtagaagatgaatctaaaggttatgtaattgtgtcgggggtaaggatgtgggcggttggaaaattggctg

SEQ ID NO: 25511 - DNA, 240 bp, Glycine max
  Peptide Sequence Number=SeqID_142289
atggaaaaatctcttttggaaatgaaaaagcaaggagtttttgaggaacgtcgagaacttttgaagggtgttagtggtgtctttaggccaagagtactaacagctctgatgggtgctattcaaggagttcctaagatcaaagaaggttataatcctgcaacctggatgttggaagttacatcagcaggcatagaagcatctcttaaggtcaacttcaccaatgtgtacagaaactcataa

SEQ ID NO: 25512 - DNA, 663 bp, Glycine max
  Peptide Sequence Number=SeqID_142290
gaccagagacagacctggcgcgccaattcggctcttggtgacggctggacctacaagctcgacctcaccggcggctactacgacgccggcgacaacatcaaattcgggtttccgatggcattcaccaccacaatgctgtcctggagcgtcatcgaattcggagacatgatgcctcccaatgaacaccgaaacgcgctgctcgcaatccgttgggctaccgattatttgctcaaaaccgtttctcagccaaaccgcattttcgttcagaatgcgaaatttcatttattttccatttggattcctaatccagacgaatacatcaccgacgcgccaaggatggcagtgggtgatccaatctctgaccacaattgttgggaaaggcctgaggacatggacacaaacaggacagtgtatgctgttgatgctccaaacccagcttcagatgtagctggtgaaactgctgcggcactagctgctgcatcaatggcttttcgttcatcggatccttcttattcagagactttgctacgaaatgctgctaaggcctttcaatttgcagatacctataggggtgcctacagtgacaatgctaatgttaggagtggtgtttgcccatattattgtgacttcgatggttatcaggggattgctttttgcttttag

SEQ ID NO: 25513 - DNA, 3296 bp, Glycine max
  Peptide Sequence Number=SeqID_142291
atgaaccacatcatccctaggagaccagggcctggacaaatagattttgatgacagaaacagctgggagtatctcttcaaggactattacatagatataaaagaaaaactatctctcacatttgatgaactcactcaagctaaaaacccttggaagggatctgatatgcttcattctaaagaagaatcaccggatgaaatttttgatgccactaatgacagaggatcagattcagatagctcctatgagaatgcagatttgagtcgttctaaaagaaaaaaggccaagaaacgggggaagtcccgttccaaaggagatgacagctcagagtgggcttcaacagagcttttggagtttgttatgcacatgagaaatggagacaaatctgttttatctcagtttgatgtgcatactcttttgctagagtatattaaaagaaataagcttcgagatcctcgccgaaaaagtcagattatttgtgatgcaagacttcaaaatctgtttggaaaaccaaaagtgggacattttgaaacgttaaagcttcttgaatcccatttccttctaaaagatgattctcaggctgaagatctgcagggaagtgttgttgacactgaaatgagtcatttggaaggtgatggcaatcccaattcacatacgaaagctggcaaagataagagacgaaaaaatcgtaaaaagggtgatgagagaggacttcaaactaatgttgatgattatgcagccattgataaccataatattaatttaatttatctaagacgtaacttggtggaagatcttcttgaagatacagagaagttccatgataaagttgttggttcttttgtgagaataagaatttctggtagtggtcagaaacaggatttgtataggctggttcaggttgtaggtacatgcaaagcagcagagccatataaagttggtaaaaggatgacagaaatcttgctagaaatcttaaatttaaacaagacagagattgtttcaattgatattatctcaaatcaggagttcacagaggatgaatgcaagcgtctccgccaaagcataaagtgtggcctcataaatcggctaactgtgggtgacattcaggacaaagcattggtgcttcaggaagctagagtaaaagatcttttgaaaacacctgaagaacgtcaacgcaggttggaggaaattccagaaatacacgtggatccaaacatggatccaagttatgagtctgaagaagatgcaaatgaagtggatgataaaagacaagaaaactacatgagaccaagagggtctactgcatttggaaggagggggagagatattgtttctcctagaagtggttctatttcaaatgattcttggagtggaacaaggaattattctaatgtgaatcatgaactcggcagaaatttgtctaataagggattttcaatcaaaggtgataatgcttctaatgctaacgaggcactaaatgatgctcaattgcatcggggaagagatcgggaatcacaactatctaatagctgggagaggcaaaagctatcttcaaccttggaaagtggcgctaaaaatacccaaccattggtagcatctgagtctttttcttctgctgtatcagaagcttctgcagcaccatcttctgccggaataactcctccagctgtgaaaataaatgaaactgaaaagatgtggcattaccaggatccatctggaaaagttcagggaccattttccatggtgcaactacacaaatggagtaacacaggatactttcctgctgatttgaggatttggagaaccactgagaagcaagatgattctatactcctaacagatgccttggcagggaatttttctaaggaaccatcaatagtggataaagctcaatcggtgtatgatttacattacccatcctcatactctaggaagtctccacaacaaggtatagaagttcaagctggagaaagactgtcattagatcaaaattgtggatcttggaattcacatagtactctgggttctccgggacaaacaacaggaggaagttggagatctaaagataatatgaattctttagctaatagaacttctccattggcagttgaggtccccaagaaccctgcaaatggctggggttctgatgctggtgttaggaatgaagcaacaaatcttccttcacctactccccagactactcctggtgggactaaggggctggcttttgaaaataaatggtcaccaacacctgtccagttgcctgggtctctcgtaggaaattcattcccaggcagtcacagagttttgcaggcctctgtggtagtgcacccagagcatgctgtacaaaatgctgaaaaaggctcaagttcacaacctggtattagttcagcttctacggataataacaagttacatccacaagcaacagcagtggcacctgttgtggcttcaggggttgacatcaaaatgacaggtgcaaatatgcaaaaccaggttgtgagtagccacaactctcatgctgaaactcaagggtggggttctgctggggttccaaagccagaaccactggcctggggaggtgcatcatctcaaaggatagaaccaaataatcctgctaccatgcctgcccagccagcttcccatgccccctggggtgatgcttcgtctgtgcagaacactgcctcttttaacactggaaatccaattgcgagtttacccacacctggatttctgggcatgactgcacctgagccttggagaccaccagcttcaagtagtcagtcaaacaccacagctccatctccagctcaacccaatatgccttggggcatgggcatgccaggaaatcagaatatgaactggggtggggttgtacctgccaacatgaatgtaaactggatgcctgcgcaggtgccagcacctggaaattcaaatccaggatgggctgctcctagtcaggggctgcctcctagtcaggggctgcctcccgtgaatgcaggtggctgggttggacctggtcaaggccgttcccatgtaaatgcaaatgcaggttgggttgggcctggtcagggtcttgcacctggaaatgccaatcctggttgggctgccccgactgggaatccaggcatgtggggaagtgagcaaagtcataatggagacaggttccccaaccaaggggatcgtagagattctggttatggtggtaaatcttggaacaggcaatcatcatttggcagcggaggcagaggaggttcttccaggcctccttttgggggacaaagaggagtctgcaa

SEQ ID NO: 25514 - DNA, 258 bp, Glycine max
  Peptide Sequence Number=SeqID_142292
atgagcaatgcaaagcccgtgagtactccactggcaaaacactttaggctttctgtagatcaatatttgaagacagattctgagttggagcacatgtcaaaggttctctatgccaattcagttggttgcttgatgtatgctatggccatctataagagtagagacatatcttgttgtagaccttctgtcatccaaatcaccaaccagaatccatatatcctgcaaatgaaggatcaccctgctaactaccaaacataa

SEQ ID NO: 25515 - DNA, 1365 bp, Glycine max
  Peptide Sequence Number=SeqID_142293
atggagaagaaaagcataacaagcagagcacattgtttagtgctagcatttccaggtcaaggccatatcaatcccatgcttcaattctccaagctattggagcgtcaaggggtgagaataacacttgttactactcgtttctattccaagaatttgcaaaacgtgcctccttccattgctcttgaaaccatttctgatgggtttgatgaagttgggccccaagaggctgggagccccaaggcctatatagatcgcttgtgccaagttggatcagaaacctttcatgagcttcttgagaaacttggcaaatcaagaaaccatgttgattgtgttatttatgattcattcttcccttgggcactagatgttaccaagagatttgggatacttggagcttcttatctcactcaaaatatgaccgtcaataatatatactatcatgttcacttgggaacgttgcaagctccactcaaagagcatgagatttcccttcccaagttgcctaaacttcaacacgaggacatgccttcttttttcttcacatatgaagaagatccatctatgcttgatttttttgtggttcagttctccaatatcgacaaagctgattggatcctatgcaatacatactatgagctggacaaagagattgtagattggatcatggagatttggccaaaatttaggtccataggaccaaacataccatctttattcttagataagcgatatgaaaatgaccaagattatggggtcacagaattcaagagggatgaatgcatcgaatggctagatgataagccaaaagggtctgttgtttatgtatcgttcgggagtatagctacctttggtgacgagcaaatggaagagctagcttgttgtttgaaagagtccttgggctactttttgtgggtggttagagcctctgaagagactaaacttcctaaaggttttgagaaaaaaacaaagaaaggcttggtagtgacatggtgctcccaactaaaagttcttgctcatgaggctataggatgctttgtgacacattgtggttggaattccactttagaaactttatgcttaggagtcccgataattgcaataccattttggtcagatcaaagcacaaatgcaaagcttatggcggatgtttggaagatcggaattagagctcctattgacgacaacaaggttgtgcgtcgagaagcactaaagcactgcataagggaaataatggagaatgaaaaaggcaaagagatgaaaagtaatgccattcgatggaagaccttggctgtaaaagctgttagtgatgatggtagttctcataaaaatattctagaatttacaaataacttgtttcatccataa

SEQ ID NO: 25516 - DNA, 750 bp, Glycine max
  Peptide Sequence Number=SeqID_142294
atggcagaatcgggtaaggtggagatagttggtaaacctgtccaagacttggtgttgaattctgaaaatcagccaaaaaactatatctacaaggaaggtggtggaggatttcgtgatgcacaggatgatgacattccggtgatccaccttcatcgcctctcatctccatctacagcacagcaagagcttgctaaactccaccatgcactcaattcatggggctgctttcaggaatattgtcctacagtataccgaaagtataaggctgaaactgaagtaattattaaggccatgacaaattcactgaacttggaagaggattgcttcctaaatgaatgtggagagagagatgttatgtttctgagattcaactactaccctccatgtccaatgcctgatcatgttctcggcctgaagccacatgcggatggatccaccattacttttctgttgcaagataaactagtacaaggcttgcaaggcctcaaatatgatcagtggtttaaagttccaatcatccttgatgctctcgtcattaatgttggtgatcaaacagagatactgagcaatggaatttttcggagtccaatacacagggcagtgataaattcagaaaaggaaaggctcacagtggcaatattctgcctcgcggattcagaaaaagagattaaaccggtgaaaaattattctgagatctatttccagtattatcaccaaggaaaaagaccaattgaagcttcaaagatttaa

SEQ ID NO: 25517 - DNA, 561 bp, Glycine max
  Peptide Sequence Number=SeqID_142295
atggataaagtcaaggaggtgccaatagaaaaaaggtcgaaaaacaagattactttgaattacgcaagaaaaacgcaagtgcaggccaagttatcgggccgaagatggaccattgagggatttcccaatccctattccatggacgtcgaaaacgaggaagctccactccaacaacactctgattcacaatgccacaccgacctgccaaatctcccctacgcctctgccgttgaccttgaagaggcggcggcaacgacgacggaggctgtggcggttgaacccgatgcgctggcggtgtccgacgatggcgccgaaacgcaagtgacggacgtagcgggtgacgagatgattgaggagaaggcgaacgaaggaattgatgtggatgacgtggctttggagacggatatggtggaagaggaaccgaatttggcaattgatgccgaagacgacgaaattgaggacaggaacacaaatgaagacgctttgatggaagacgaacaacaacaagaagaagaggacgtagagcaagaaggagagggggaggaagaagaacagcaacaa

SEQ ID NO: 25518 - DNA, 477 bp, Glycine max
  Peptide Sequence Number=SeqID_142296
atgcctgttaattgctcgattatgtcagaattaaccattgacgagcacagagagtggagggaaatgacaaacatgatgcagaatgtcgcggcttcactagaggcttttttccagaccgttcacatcagggaccagattttcggtgaagttagtaaggtatatgctgtcaagtggaatgacgtactggacggttctattaccttcaaggtttatctcactgagcagaaagttacctgtagcagtctggacgttccaagtagcatgtattattttcttaaagacaaaggctggacgcatttgcacttggaggacgttgctgaatgtcgactcgtgttcaatcattttaggaagacacttaaaattggagtcggatggaaacatttatgcgagaccttgtcattgaccgttgacatgggaatagtttttgaattcattgatcccaatgttaatcgtgtgctctattgggcgtatttatga

SEQ ID NO: 25519 - DNA, 1313 bp, Glycine max
  Peptide Sequence Number=SeqID_142297
atggatggatccgcatgtgtgagaaaaggcttatggagtgaagtggaagatacccttctcaggacctgtgtgcgacaatatggtgaaggacaatggcacttagtccctacaagagcaggcttgaacaggtgccgcaagagctgcagattgcggtggttgaattatctaaagccaaatatcaagaggggagagttcactgaggacgaagttgatttgatgcaaagattgcataatcttttgggaaacagatggtccttgattgctggaagacttccaggaagaactccaaatgatgtgaaaaactactggaacacctacattcgaaggaaggtatcatcatctcacaaggtggtgatcaatgaaaagcaaaagaaaacaacagtgaagcctcatgtggtgataaagcctaaggctcgaactttctcaagaccttcaccctccgggttgagagggagtagtgttcttagagaagaaggtggtgagagtggggccaaacactgctcaactcatcatcaagcatgtgcagcttcatcagagtacattaataattggagtactgatcagtggtggaaaactatgatgcacgacaagggggacaacttagacaacaaccaatgcttgttgggctaccaggatgaggttgggaagctcgtgaaagacaataattgtgatgagaatcttgcttccttgacaacacaagaaggagagtttcttatagaagggcaaaattggattagtaatcaaaatagtcatcaacagagtacttctgctagtcatatgcccagtcctattgttgttcctactggtgctagtggtgctgctagtcctggtgttgctgctgctaatcctgaagtaggaactgaaggactactgactgaaaaacgcgcatctcctcttttgattgacgcagctcctccctcaaacgggtacatcctttgtggtacaagtagagggtacatctacttgggtttgactgagaacaagagagggtacatctcttgtggatcagttctagtggaggatacatccactaggttgtccaaagagaacaagggagggtacatcccttatggatctttgcttgtaaaaggatttttacaaggtgtggatgtaggtacaggggacggtccacgtgcatcaacggaggatggagatggtgtggatgcaggaggcctaactaggatagaaaccgaagacggggatgggattaatgatgtcagactatctcgaggtggtaatagtctaatcatgtatcgtcttttctttgcagttgtccctttcccattggagtcatttgacgggggtcggggagg

SEQ ID NO: 25520 - DNA, 981 bp, Glycine max
  Peptide Sequence Number=SeqID_142298
atgtcagacacacctcctatcagtccaaagaaatcgtccagctctcctaagcatgatgctggttctatcactgtcaccacagaccctaccttgaatccttccagtccttattttattctcccaagtgagggtccttcttctgtctccattacgccggttcttgacgggaccaacattcctgagctccaggatgaaatttacggcatgtctcaaaacaattgcaccgtctttgagttttatactgcgttgaaaaccatgtgggaggagcttgacaactatcgtccctttccggtctgtacctgcgacgctaagaaataccatcagcaggacttcatcattcgcttattgaaagggcttgatgaccgttttttcgttgtccgctcgcagattcttctcatggatccgcttccagccatcaaccgtgtcttctcgatggtggttcagcaggaacgacaacttcgcattccttcctctgcttcactagagcctaactccttcgtgaatgttgctgccaattcattccaaggtaagggttgtggcagttatggcgctacctcaaccgttaaaggcgctatctcctccaagaagtgtgcgtactgtcatcgcgccgggcataccgccgatgtttgctggggaaagcacggttacccaccgggacatccacactaccccggacgccctagtttcaacaatcgtaactcctcttcttccacaaacaacgttgtcgtcgatgaagtggtggaaggcggttgctctgactctggcacctcctcttccaaccctatcaatttaacccaggcccaatatcaatctcttatggcactcatccaacctatgcagctgaaatcaacttctaatagcactgggccccattctccacaccaggccaaccttctccatgccatcccaaatggcccaaaacgtgtctctgagtctactagtggtagtcattttgttttctgcaccacccactacacataa

SEQ ID NO: 25521 - DNA, 1446 bp, Glycine max
  Peptide Sequence Number=SeqID_142299
tctttgcaaaacaagggattttggatggtaaagggttctggacacattaatgacagagatacagtatttgataatcccaccaaaattgaaccaaaacgacctcatcaatggtttgttgatgctgctgaagtagatttttttccaaacaagaaacaagccgtagaagatgcagatgaaaaatctagtcctggattttcaaatgtaaatattcctccctgggagaacaatcccaattttcattcagtcccaaaccaatttattggccggttatttgggtctgaaaccaggcctgtcaatttcactgaaaagaatacttatgttttggctgatgattctaatgtgagatcaaagatggtcaccaatcaatatggagatgaagcatcttttggtttgtctatatctcattctattgaagattctgaagcatgtgtaaattttggtggaataaaaaaagtcaaagtaaatcaggttaaggaagttgatgtacaggctctggagggacataattttggtaggcagagtaatggtgatctacatcaggcctataacagggaagttgagacaaggtctgcatcaatagggcaagcctttgacaaggatcgtgatgccactttaatgggactcacctacagcagaggggatgcacatgtcagatcatttggtgcctcctttgtcaaaggtgatgactcaatcgtatcgattagtgaatcctataataaagaggacacaaatataatttcttttggtgggttcccagatgaaagggatattatctctgtgggtaggcctgctgcagagtatgatcaattatataatcaatcttcagttcatgtgtcaacaacagcccacgagaaagagttggatgtgtcaagttctgatgcagttgcaagtacacttcaggtagcaaaagttaagtctgaaactgtatccaagaataaacaagagctcaaaacagcaaagaaagaagctccaaacagcttcccttctaatgtcagaagcttgatatctactggtattcttgatggagttcctgtgaagtatgtctcagtgtcacgtgaggttctgaatgcttacgagtttgagagacatgctggctgcaaaacaaaacatccaaacaatcacatttattttgagaatgggaagactatttatcaaatagtacaggaattgaggagtacccccgaaagtttgttgtttgatacaattcaaacagtttttggtgcaccaattaatcagaaagcatttcgcaactggaaaggtaatgaaatccttctgtccactgcacacatgaacacatttacgtttgtttggtatgtcacttatccaatttttttatctcctgtcaactttatccagaatcatttcaagcagcaacacgggagcttcaacgcatttatggaaaggaagaacttaacctataagtcccaaccctttgtgaaaacgtaa

SEQ ID NO: 25522 - DNA, 324 bp, Glycine max
  Peptide Sequence Number=SeqID_142300
atgtctaggagccaccaaatcagtgtacaacttagagctcaaactttggtaaaggctgtagcaagaatcttgaacatattgaaagctactttagcattaacatacaatggaaaagaagcatgtttagatttcattgaagagaagcaagttttattaactaaaaatcggaatagcatagctggcgcaccatttcctattacccaagaccaagacaagattagtgtgctgggactatcaaagaagatcacgcaggctgctgaggtggaaagtgtaatcatgttagaaatgattggagccattgtaattcagcagcaggcaggttaa

SEQ ID NO: 25523 - DNA, 342 bp, Glycine max
  Peptide Sequence Number=SeqID_142301
atgaaacatatttttgttgccaggttggggaggtttgaaagagggtttagttttgatttgatgccatcaattgaagtagtaaacatctgggagcctcctctctcttatgctgtgcctacgtccaagggccaagcactggctgacgagtatgggatcaaattctttgaaactagtgcaaagacaaatctaaacgtggaggaagttttcttctcaatagcaagagatataaaacaaaggctggctgacactgactccaaggcagagccttcaacaatcaaaatcaaccaagaccagtcaggaggggctggacaggctgcacaaaaatcggcttgttgtggttga

SEQ ID NO: 25524 - DNA, 306 bp, Glycine max
  Peptide Sequence Number=SeqID_142302
atggacactccattcccttgccgtgtccggtgtctgacacgcgtatgtgtcagtgtccgacaccgacacgacacccatactacgttttatattttggacattataggtgttcacgtgtccgtgtccgtgtcgtgtccggtgtccgtgtcggtgcttcatagaatttgttcgcttcatgaaccagaagaaaacacagatacgactcaggctatttcttgcaagcatgtgcatggaattgaggaagattgcagtaaggaggcgataagatttctggtggtggctacttgtaaggaccctaacacttaa

SEQ ID NO: 25525 - DNA, 114 bp, Glycine max
  Peptide Sequence Number=SeqID_142303
atggagcaatatataacatcgcattcctcaagaagtgtcaacatgagaaatttaaggaatgagggacagaagaatttcctcacggctgcatggtgtgaaaggaaaagttcataa

SEQ ID NO: 25526 - DNA, 124 bp, Glycine max
  Peptide Sequence Number=SeqID_142304
atggcagatacaacttctgaggaatctgaattagatcaagaagatgaggtaaacttcaatgacattgagtctcttagaaagggggagtctaagggttgtgacaagagtggccatgagaatactc

SEQ ID NO: 25527 - DNA, 270 bp, Glycine max
  Peptide Sequence Number=SeqID_142305
atgtcaaatcataaaagcactgagtcagcactgaagaaccttgaggtccagatgggacaactggtcaagcagatagctgacaagtcatccaacagttttgtggcaaatacagaacaaaatcccaagaaggaatgcaaagctgtgacgacaaggagtaagaggtttgtggaagctaaggatgaagaaagtgtagtgcacaaggagaaagcgactaaaaagaaaggtgacggcgttagtgaggtgtataggtggcaattcagtgccacgtag

SEQ ID NO: 25528 - DNA, 216 bp, Glycine max
  Peptide Sequence Number=SeqID_142306
atggagaattggcgaacagcactaggcaatgacattcccggggctccagactcgaaggtggaggatggacaacccttcccttgtgttcaggaatcctttacaacaagagaccctcggtctcttaaccccttttcagaagtaaaaagaaaagaagaagaaatctctcttgaaagagacagattgtacaatgaagatcaatcacaattccttatttga

SEQ ID NO: 25529 - DNA, 210 bp, Glycine max
  Peptide Sequence Number=SeqID_142307
atgccaagtctctatgaccgaaccacgaagctggaagagactctagctcaattcatgcaaaaaaatcctaaggaagagtgcaaagctatgataactagaagcagaatagcgattcaagctgaggaaagtagagctgatcagaagatggagggatttgaacttgaagaagttgtggaggaagcggaaggtgataaagaagaagagacacta

SEQ ID NO: 25530 - DNA, 207 bp, Glycine max
  Peptide Sequence Number=SeqID_142308
atgtctccttcacctctaggatctcataatcactcacaaactcatctcaagctctcaaaccagctcttgcttcaagctctggcaataggtggccttattcgtgctcgtgtgcttagcgtacttatggactgcttagcgcacattagtgaattttggcttagcgcgtgcctttcttgcttagcagatgaactgaagcggtgcgcttag

SEQ ID NO: 25531 - DNA, 231 bp, Glycine max
  Peptide Sequence Number=SeqID_142309
atgagcaaaatcaagcatgtaaaattgaagttcaggaagacaaacactagtgctagcttagaggtgaaaattggagatgataccattccactagtctcaaagaaagagaagaaaaagaagcccttgctgcagaaggggggtggacagttgttgtacaccataagggtagaaagaaaactactgactctgagagtggaattgctgtgggctctgttgctcaagctgctgtag

SEQ ID NO: 25532 - DNA, 597 bp, Glycine max
  Peptide Sequence Number=SeqID_142310
tggtcctagatgtagggaagaatttctccaagaacaccctcttaaggtcataccagctggtgatggacctgggagcaagactaccaggcttttcgtcttacagacagcaaaaaagaatgtttatacggataacaactcgggtaattccgctcgtcaacatgactcaaatgtcagtatgacagatcttgtgagtgcagaagatgacgcaaatctccacgtgtcaacaggcttttcggccgcgattgacacagcaaagaagaatgtttatacggataaccactcgggtatttccgcccgtcaacgtgactcaaatgtcagtatgacagatcttgtgagcgcggaagttgacacagcaaaaaagaatgtttatacggataacaactcgggtaattccacccgtcaacgtgactcaaatgtcagtatgacagatcttgtgagcgcggaagataacgtaaatctccgcgtgtcaacgggcttgtcggccgcgattgacgatgggcgcagaagacgacatcttgtgagcgcggaagatgacgtaaatctccgcgtgtcaacgggcttgtcggccgcgattgacgatagggcgcagaagacgac

SEQ ID NO: 25533 - DNA, 461 bp, Glycine max
  Peptide Sequence Number=SeqID_142311
ctgccttttggtggactcttggtgatagtgtcgggcgaagaggatatgttggtaagctgcccctcctcggcaccatatgtagaggcaccggaggaatcattggaaacagctttccaatccttcgaggtgccctgatggtggcgtgggtaatgctcaggcacggttatgagcctggaatgggtcttagcaaggatagccacgggaatgccgatgtgattgacattaggggtaacccgcacaaatatgggttggggtatgagcccgggaaacctggaagaaggaatgcaccgtcaagactccgggcagatagggcatggcccggtcatgaagaggtggcggcaataagagaagaggctccacaagatccgctgagtttcgtgcgaccgtgccatcccaatttccaactggggaactggcacgtgacgagccagtcggaagtctataccgctgattcaatgtaa

SEQ ID NO: 25534 - DNA, 180 bp, Glycine max
  Peptide Sequence Number=SeqID_142312
cgtgttagctgctcaacagtgagtgactcttctttcttgggagatcccattgttcctttctccgagggcaaggatgaaaattcacatcctgggtcaaggtttatgggtgttggtttggccagcaactcagggataaggggaatgtcccacattatttccatgacacgcatgcaacaatga

SEQ ID NO: 25535 - DNA, 242 bp, Glycine max
  Peptide Sequence Number=SeqID_142313
gaagaagaaaggcttgtaatggagatgatatgtctgagtctttcttggtgcacttcattttgaacactcttctgcaggaatatgggccgtttaagatttcctacagcgcacataaggacaaatggcttatcaatgaattaatgaccatgtgtgttcaggaagaagaaaggcttgtaatggagatgagtgagagtccattgctgacaattgcttgttggaagaacaaagcaactaagtcttaa

SEQ ID NO: 25536 - DNA, 363 bp, Glycine max
  Peptide Sequence Number=SeqID_142314
atggagtggttttttcggatatcgcacccatttgtcacgcggactgaggagactgctgagccgagacatccgcctccccctcatgatgaggagttcgtcgagccacccatccccgaggtttcagtcgcatctgatctccctacggattcagtgataagcataacttatgttgactgccaaggatgtcaagggatggctgaggatttaggagcgattgctgaggatttggagcgggtcatcaacctcaggatggtcactgaaggcactgacttatatgacatcatgactcgttgtttgaggagagctagaggtgacgccgcagatggaagtcttaggccgcgccagagatgccgcatagattag

SEQ ID NO: 25537 - DNA, 2239 bp, Glycine max
  Peptide Sequence Number=SeqID_142315
atgaaagccacctatgaagagtggcgcagcgcgcagagtgctttagccgctgagggcgtggcgcagaaccagcgtgccttccacaccatgatgtggctgctggcgattgttgccgtgatggtgatcgcggtaatcgtcgcctgctggtttggcctgcgcacggtgctgattcagccgctgcatcagttgctcggtcacattcgccatatcgccgcaggcgatctgacgcagaccatcaccgttgaagggcgtaacgaaatgagccagctggccagcagtctgcatgagatgcagcagtcgctggtgcacaccgtcggcaacgtacgcgacggttcggacgccatctttaccggcgccagcgaaatttccgccggcaacaacgatctctcggcgcgtaccgagcagcaggcggcgtcgctggagcagaccgcggccagcatggaacagctcaccgccacggtgaagcagaacgctgagaacgcccggcaggcttcgcagctggcgctcagcgcgtcggagaccgcacgcaaaggtggcgacgtggttgaaggcgtggtgcgcaccatgcatgacatcgccggcagttcgaagaagatcgcagatatcaccagcgtgatcgacggcattgccttccagaccaacatcctggcgcttaacgcggcggtcgaagcggcgcgcgccggtgagcagggccgtggttttgccgtggtagcgggcgaggtgcgtaacctggcgcagcgcagcgcgcaggcggcgaaggagatcaaaggactgattgacgattcggtcagccgggttaacgccggttcgcagctggtcggcaccgcaggtgacaccatgcaggatatcgtcggagcggtgacgcgcgtgactgacatcatgggcgaaatcgcttcggcctcggatgagcagagccgtggcatcgaccaggtgggccaggcggtgaccgagatggaccgcgtcacgcagcagaacgcctcgctggtagaagagtcggccgccgctgcggcctcgctggaggagcaggccagccgcctgagccagtcggtggcggtgttccgcattccgcgcgcgtcggcagcggtcgtcgtgcgttccccggtggccacgacaccgccggcggtgcgcaaagccgctgcggccccgcgggagagggtcgcgtggcgggcccttcaccggtttgctgctggtcttacccctttcacctcacataaagatccgcgcctgcgcgccgataacaccagcgatccgccaattaatgaggtgtttatgtttagtcgtgttcgagtggtatccggcctgctgtgcgtgctggcgttatttgccttactgcagctgttttccggaggaatgtttttttcaacggtgaaagccgataaagataattttgcgtacaaccaacgtcttagcaccctgcagcgggcgatgggcacctcatgggtttcgctggtacaggcgcgtaacacactgaaccgtgccggtatccgctatctgctggacagtcagcaggccggctccggtgccacggtaaaagatctggtggcgctggccaatacggagctgaaaaccgccgatcagagctttgccgagttcaacgctaacctgtcggaaaagggcaaaagcgcagagaacgtgctgacgctgcaggccaactacaacgcgtttcgcggggcgctggccgagctgattgattttctcagtgccggtaactttaaaggctttgtcgatcagccaacgcagggttttcaggacaaatttgaaaaggattacaacgcctggctcgcctacaacattgtgctggcaaaacagggcattgacgccaacgagagcgcttaccaacacgcgattatgctggtggtcggcacgctgctggtgacgctgctggtgattgcgctggtgtggagcggcatgcgtacggcgctgatccgtccgctgcagcagagcattgagcacatccgccatattgcgcgcggcgatctgacgcagccggtcgatctcagcgtacgcaacgaaatgggcgacctgctcagttcgctgcagcacatgcagcaggagctggcgcgcaccgtacgcatcgtgcgcgacggttctgacgccatctacaccggcgccagcgaaatcgccatgggcaacaacgatctctcttcgcgtaccgaacagcaggccgcatcgctggagcagaccgcggccagcatggagcagttgaccgccaccgtgaagcagaacgcggaaaacgccc

SEQ ID NO: 25538 - DNA, 831 bp, Glycine max
  Peptide Sequence Number=SeqID_142316
atggaggtggaaaccttagaggatcgtatcacttgggagttaggatataacgtccgcactaagttcctcggagacgacatggttcttctccctgggatgtccgatgacaaagctaaactcctcattcaatcagagacggaaagcgatgattctctcttttactcactggagaagtggacgccgaaatgtagacccaataacagggttgtttggctccagctgtggggatttccgatacaggtgtgggaaatgaaaaatctcaggagggctgtagctgctattggggatgtcatcgagtcagacgattacacagaggaccgccgacgattggaccgggctcgagtattggtgctgacaccgcttccgccgttgataaggtcagaggtcatcgtccgtgtgggggagcttgagtatcgggtatggattgtggaagagacagggttcgaaggtgggtcgaaccggaaaggaagctcgccgtccgatgggtggtcggagatgataacatcggacgacggtggggaggttggcgatgttcttgacgacactaataccaatttctccttctcgtcggagctgcccaacccagaaattgtctccgtctcgtaccccaacgggcagaaggagggactgatgtgcgctgttgtgatcttagaccccctgggtaatatccaggcagacgttacacccaaagaaaagtcaaaaggcactgtagaaggtatgctgggctctagctttggtaagctcaacctaggggacagcttcgcaggaacagaagaggaagctgctaacaccaaagaggtaacctgctataataccctacaggatgattaa

SEQ ID NO: 25539 - DNA, 570 bp, Glycine max
  Peptide Sequence Number=SeqID_142317
atgggtcattcggcgccttttggtcatccagaggcggcgagcctgatgacatgcagagacaaattatggtcattctgcacactttttcgccatccggagacgatcatgtccgatggcacacaaagacaaattatggtcattctgcgccttttttcatccagaggcggcgagcccgatgacatttggagacaaattatggtcattccgcacaagttttcgccatccggagatgatcgtgtccgatggcacgcagagacaaattatggtcattctacaccattttgtgatccagaggcagtgagcccgatgacatgcagagacaaattatggttattccacacaccttttcgccatccagagatgattgtgtccgatgacacgcagatacaaattatggtcattctgcgccttttgtcatccagaggcggcgagcccaatgacatgcggagaaaccatatggggcagcaagtcgagtggtgggcggagataccttatggtcatccgtgcctttcgtcaaccgagaggaacgagttcagcagtatcaggatgatgttggtcattcggtgctga

SEQ ID NO: 25540 - DNA, 562 bp, Glycine max
  Peptide Sequence Number=SeqID_142318
ttgttatactggtcccaacccgagaattggcattgtagacttctcaagtgtgcaaagagcttggaaagcacttgaaaattcaagttatggaagaatattagatcttgccaagaaaggtgtttgtattctgaaagattgtgctatgcttgttatggatgaggccgataagcttatgtccccagagtttcaaccttctatagagcagctgattcattttcttcctacaactcgtcaaatcttgatgtttttagcaacatttcctgttactgtaaaggatttcaaggataggtatcttcgaaaaccttatgtattcgtggaagagagacagaaagtccactgtctaaatactcttttttctaagctgcaaataacccagtctatcatcttctgcaattcagtaaatcgggttgaactccttgccaagaaaatcacagaacttgggtattcatgtatctacattcatgcaaagatgttgcaagaccatcgtaacagagtgtttcatgacttccgcaatggcgcatgtcgaaatcttgtttgtactggtacactgctgacactttag

SEQ ID NO: 25541 - DNA, 632 bp, Glycine max
  Peptide Sequence Number=SeqID_142319
atgaggggcgaagacatttatagtatccaagatgatgctactacttcaccttcctctagtgaaagtgaaaaggcaaaaggggaagaatctagtgaagaaatctacccgcaagaagaaggacaaccattagtggttaaagagaagtgtaaggaggtaagtgtctcctccaagagtttagctaagaaggaaactcattttacaataaagacaaacattaaagaaactttccctcttagaaaacctccacattttctcttttgtaaaaaggcacttgctagcattgccacacctcttgggcttgagtttattcctcaagtaaagaagttgttggatgagggtttggttcgcaagagcttaaatccttgtgctttgttggtgcccaaaataggtattattaggtaccaagtccctaaaataggtggtatgatgaatgttttgagtggtgcaaccctcttttgtaaaatcactcgtacacctaacatcttcatggtgtgtgtacatagggacccattaggtagtgatcaaggggttcccatgaaccctaagagaataaaggtcattcctgagtggcccactccaccaagtataagaaaaatttggggcttccatgacttaacaaacttttacaaaag

SEQ ID NO: 25542 - DNA, 312 bp, Glycine max
  Peptide Sequence Number=SeqID_142320
atggccccgaggaaacttgcctcaaagagatccaggaaggataaagcggccgaaggaactagttccgctcccgagtatgacagtcaccgctttaggagcgctgaacaccagcaacgcttcgaggccatcaagggatggtcatttctccgggagcgacgcgtccagctcagggacgatgagtataccgatttccaggaagagatagttcgccggcgatgctatcagccagttcctgggataccctttagtgctggaagagagtcaggagtgcgagtatcgccagagaaggaaccggtccgatgggttcaatga

SEQ ID NO: 25543 - DNA, 258 bp, Glycine max
  Peptide Sequence Number=SeqID_142321
atgggagcaagttggcatatgtcaccggaatttggggtggtcttcgtcatcggaagtgcggtagacaggctttgtggttctttagggatggcctttgtggttaactgggtggtgggtaaggaggtggtttgttattgcctgagtaatgtcattgttgggtttggtgggaaacttggccgtataggaatggcagtcacagcatgggtttctccctcatcatcaccctctctatttgccccagttttctcactcgtctaa

SEQ ID NO: 25544 - DNA, 393 bp, Glycine max
  Peptide Sequence Number=SeqID_142322
atggtagtcgtaatcccaacaaagattcctcgacctccattttttcgagaatacaactcggatccaacatgtgcttatcatgaaggagttccagggcattccgttgagcattgtatgaccctgaaacgtaagatgcaaagtattgattcaaggagttttgatgataacaaagatgatgacaaaaagctcaaaattcaagatcacttcatgataacaaagatgatgacattcaagaatgagttcaagattgagtcaagaacacttcaaagatcaagaggaaatttgatttcaagaatcaagaatcaatattcaagattcaagaataatcaagatcaagattcaagactcaaagattcaagaatcaagataagacttaatcaagataagtattaa

SEQ ID NO: 25545 - DNA, 297 bp, Glycine max
  Peptide Sequence Number=SeqID_142323
atggcaaatcaagaggagtgggtcccatttatggacgtattagcattgctaatctttggggttgtcctctttccaaacatggaggggttggtggacctagccgcaattgatgctttccttgcatatcaccacagcaaagagagcccggtggtagctatcttggtggacttatttgacacatttgaccgaaggtgcgagaagagtagtgcacggatcatctgctgtttacccgctctttgtgtatggttggttttgcacctattccaacaagacataaggcatccatgtccgctctga

SEQ ID NO: 25546 - DNA, 567 bp, Glycine max
  Peptide Sequence Number=SeqID_142324
atgaggggagcaccaacggaagaaaccctttctcctttccttgtgagagatttcggtgcgcaaagtttcaagattatacgaagggtccataaggcgtgggaaggcccgttaaggaaagataaagaacttaggggcatccgtaatggcatcattagtggttatcatgaatggctgaaaacatctggagagagtgtgccgggttacgagaagaaaatgcagctaccgcaagagccccttgaacaagaaaccaagagggctcgcaaggaagagcatggctgtgacaaatttcgtggagctttgtggggcagcaacaagaccaatatgctagccatcgtcagcaagtaccaagaagaactaaatctagccacggcccacgagcataaagtggcggacgagtatgcccaagtgtacgcggaaaaggaggctagaggaagggtgatcaactcgttacatcaagaggcaataatgtggatggatcgatttgctcttaccttgaacgggagtcaagaacttccccgattactagccaaggccaaagcaatggcggacacctactccaccccctga

SEQ ID NO: 25547 - DNA, 225 bp, Glycine max
  Peptide Sequence Number=SeqID_142325
atggtaaatacaggaatgatgcacagacgagctggttacttcacccctaagctatttgggggcccaggcgagcgagaggctagcctgggcaagccagggtttagaaaaaggcttaaaatgacccttttgccctcccttttggattttgatgatgccaaaagattgaagcaattcaaagttgattcaagtcatgatcaagagatcaagagaaacgattcacaatag

SEQ ID NO: 25548 - DNA, 934 bp, Glycine max
  Peptide Sequence Number=SeqID_142326
cgactttagagggctacaagccctggccttcagaaggctacatgccctcgcctttaggggactatgcgtccttaccttcagagggctacacgccctcccctttagaggactacacgtcctcgccttcagagggctacatgccttcgcctttagaggactacacgtccttgccttcagaggactacacgtcctcgcctttagagggctacatgccctccccttcataggactacacgtcctcgccttcagagggctacatgccctccccttcagtggactacatgtcctcgccttcagagggctacacgccctcgccttcagaggactacacgtccttgcctttagagggctacacgccctccccttcagaggaccacacgtcctcaccttaagagggctacactccctcacctttagtgggctacacgcctttcccttcagaggacaacacgtcctcgccatcagagggctgcacgtcctcgccatcagaggactacacgtcctcaccatcaaagggctgcatgccctcgccatcaaaggactacacatcctcgctatcagagggctacacgccctcgccatcagaggactacacgtcctcgccatcagagggctgcacgccctcaccttcagaggactacacgtccttatctttagagtgctacacgcccttgccttcagaggactacacgtcctcgccctcaaagggccacacgccctctccttcagagggctgcacaccctcgcctttagagggctacttgccctcgccttcagaggactacacgtccttgcctttagagggctctacgtcctcacttttagtgggctccacatccacaccttaagagaatttaaaggggccagttgtttcgttttatcatttcctgggccaccccttgatcctagaggtggaccaactgtgcgagcataa

SEQ ID NO: 25549 - DNA, 609 bp, Glycine max
  Peptide Sequence Number=SeqID_142327
atgaacaaacctgaacaagtttgggcccaaactaggcattggatggctgatgacattgtctataattataaaaaatcatcaacaagtccagcattacagcttgatgatatgactcttcaaaatctggtcttgcttgaaattgaacaactattgcaagcaaatcaaagatcacttacagactatccttcaatgtcatatccagaagatgtgaatttcccaacctatctagacaatagccttatattagctgaactcaattacaacaatcaagaactcagatcagagtttgaacatctattttctcatatgacagacgaacaagcatcaatttataaccagattgttgaagctgttaataaagatgaaggcggtatattttttctctatggatatggaggtacagaaaaaacatacatttggaaaaaactcgcaagttcactaagaactgacaataaaattgtaattatggttgcttctagcggcataacttctctattattgcctgggggtagaactgcacattcaaaattcaaaattccagttctagtttttgaagactcaacttgcaatatccatcaaggaactcaattagctaaactattaaattaa

SEQ ID NO: 25550 - DNA, 504 bp, Glycine max
  Peptide Sequence Number=SeqID_142328
atgggatttactcaggttgaaggcttggcaaaacatttacggtgtgttgggatcgatgctgcagttccttattcaaagaagcctgaaccaaggatgttgatagagcaagcacaaaaagagaaacgagtgattttgacgtgggatgcaaagttgcttagacatgattatctgacacaaaaccaaatctatagagtgaagagtcttctaaaaaatgaacagctacttgaggttattgaagcttttcagataaaaattaatgaggataagctaatgtcaaggtgcacaaaatgcaatgggacatttattcagaagccactgacaactgaagaggctattgaagctgcgaagggctttcaaagaattccaaattgcttatttaacaagaatttagagttttggcagtgcatggattgtcaccaactttattgggagaacgaattttcaatgagaattaagaatgtcagatttcagtcctatcatcaggacatgctagtggaaggataa

SEQ ID NO: 25551 - DNA, 310 bp, Glycine max
  Peptide Sequence Number=SeqID_142329
atgccatatccagaggatgtgaattgtccagcctatctagacaatagccttatattagctgaactgaattacaacaatcaagaacttagatcagagtttgaacatgtattttctcacttgacagtttcggtttttgaagactcaacttgcaatatccatcaaggaactcaattagctgaactattaaatcagacaagtctgatcatttgggatgaagcacccatggctcacaaattcagttttgaggcacttgatcacagtcttagagatatcatcaaacacaactcaaaggacaataaaatctttggag

SEQ ID NO: 25552 - DNA, 603 bp, Glycine max
  Peptide Sequence Number=SeqID_142330
atgcgcgaattctccgtcacctcctccctctcctctctctcccaattctcttcccaaatccaaaacccaaactcaatttcctccgaatcctctcttttccctccttgcatcttcctcctcctcgcctccccctcctcctccgaccaccaccactcccatgtccacacgcacgagtaccgcgcctttcagttccgccccgcctccctctccttcgagccccgctccctcgacgtcatcaacatcggcccggccttccgcggccactacggcgcctttgcccccaattccaacctcccgccgctcgactgtgggccccacgactcccccatgataagcgacggcggcgacgagactatgggaaaaatgaagcaggccgccaaggaccagagggagctcgaccaatgtgcggaggggttcgaggttgggaggctaggcagaatgatggggtctgaggccaagaactacacggagggtttggaggaattgtatcagaagatgcttgtgaagattgagaacttgtctggcttggtggagaagagttctgctatggttattgagcagggtaacttagttgacttttacaataactgctttaatagttaa

SEQ ID NO: 25553 - DNA, 1908 bp, Glycine max
  Peptide Sequence Number=SeqID_142331
atgtctggtcatattggtaatgctatatcctcgatgggcaggtggagaatgaaacttgaagttcgtagagctgaggttgctgagatgcttccccttgctaggcttctttctcgaagtatggatcctgctgttcagtcaagatctaaggttgtatcactatcattatttatgtcttgggaggttcctgtcattaggattcctccatcgaatgatgacatgtccgttaagaaaacttatgcatgttgctacaccacttgtgtgcaggatttcttcatgcaaagtttgcagtcagtaggattatataccgaaagccttcaacaattgcttgagacagtgagggggcttcatgctccatcaaatgatgttgttcttgaagacttaagtctgcctggtttatctgaactcaaaggtcactggcatggatctcttgacgctagtggtgggggaaatggagacaccctggcagaatttgactttcatggggaggactgggaatggggagactacaaaactcagcgtgtgttggcagttggtgcttacagtaatgatgatggtatgtacctggagagaatttttatccagaaggataatgccaccatccatgcagatggaacattgctaggacctaaaaccaacctccattttgcggtattaaattttcctgttagtctggtcccaactgtagtccagatcattgaatctacagcaatggatgttgtccattctctgcgacagttgttggcacccattaagggtatattgcatatggaaggagatcttagaggaagtttagcaaaaccagaatgtgatgtgcaagtaaggctcctggatggttccgttggtggtgttgatcttggaagagccgaagttgttgcttctctaacctcaaccagtcgttttctattcaatgcaaaatttgagcctacaacccaaaatggtcatgtactcattcagggtagcattcctgttgcatttgtgcaaaataacacgttacaggaggatgtagaattagataagagtcaggttacttgggttcctgattgggtgaaggagaagaatagagggaccgttgatgatgccagcgacaaaaaagtttctagagatagaaacgaagaaggttggaatactcaattagcagaaagccttaaaggtttaaattggcaaattttagatgatggagaagtcaggattgatgctgatataaaagatgggggaatgacattggttacagctttatctcctcatgtgaattggcttcatggcaatgcggatttgaagctagaggtcagaggtacagttgatcaaccagtacttaatggacacgcatctttccacagggcatctatttcttcaccagtgctccaaaaaccactaaccaactttggtggaaatgttcatgtgcaatcaaacaggttatgcatcacctcactggagagtagggtaagcagaaaaggaaagcttcttgtaaaagggaacctgccactcagaactagtgaagcagccccagatgacaagattgaattgaagtgcgaagttctggaagtacgggcacaaaaagtattaagtggtcaggttgattctcagttgcaaataactggttcaatattgcaaccaaacatatctgggaatatcaaaataagtcagggagaagcatatttgcctcatgacagaggtggtactcctgcttctaatagatttccatcaaatcagtctgtgcttcctactgctggtgttagtcgcatgtttgcttcgagatatgtttcaagatttctcaactcagaatctgcttcttcaagggaaaaagtatctcaatcctctggctctgatttacctcaggaagggggttcccccaacccctattttatcatgattcctgtggatctgattccctacattgttacaccttag

SEQ ID NO: 25554 - DNA, 339 bp, Glycine max
  Peptide Sequence Number=SeqID_142332
atggcatccatcatggaagccattttctctttcaaagtcgacatgtcggctttcatctgttcctgtacttcctcttggtcacccatcatcctagatttggatctgaaagttatagctagtcaagatctgagtgacaatataaactccctaacggttcctaattatatgggccatcaagtctatcgtgtgttgacaatagtggaagagcccgtggatctcctcgggggcagagtaggtgtccgccatagctttggcctttgccagcaaacggggaagctcttgactcccgttcaaagtaagagcaaaccgatccatccacatcgttgcttcttgatgtaa

SEQ ID NO: 25555 - DNA, 524 bp, Glycine max
  Peptide Sequence Number=SeqID_142333
atggccatcaagctccaactgttggtcgttataaggtttgatataaaatggactgcacctacagcagaagggtctttcaatgatgctcgaggagacatcataatctcacatgattatattactgtgaattctgcttctgctgcatttgatctgtatatgagagttcaaacatcttatcctgatgatttccatcataaaagagaagagtataatattccaagagctattccgcttactattgatggagttgagttggatttacgtatgcgtgggtttgaattcttcagtttggtttctgcatacgctatggattccccaaggcctttgcatttgaaagcatctggaaggatcaagtttcagggaaaggttttaaaacctaatggcaatattagcgaacaaaattttgaaatgacaaggcagcatgtgcaaatgttggagaaaggaattgcagatagtctcattggcgaggtttcaatctctggtctcaaactgaatcaactgatgcttgcacctcagttgtctgg

SEQ ID NO: 25556 - DNA, 603 bp, Glycine max
  Peptide Sequence Number=SeqID_142334
atgttggattgtaattcttcccaaacaccagttgattgtggtgtaaagttagcgaaggaaggaagtgacaaggcaatttacgcaacctacaggcgtgacacagcttatggagtggggtcaattagtagatttatggatcatccaaggctttctcatttgcttgcagctaagaggatattaagatatgtgaagggctctttggactatagattgttttcaaaccatcgcagaaatgttattgatgaagtatttggctactctgactcaaattggtatggtgataaaagtgacagaaagagtacagcagggtatgtgttcatgatgtgtggagcacctatttcatggtgttttaaggaggagccagtggtggcattgttctcatgtgagactgaatacattgcagcctcaatgggagcttgtcaagccttgcggcttaagaacttgatgtcacaattgaagattaaaagagaagagcctatgaagaagctaatagacaataagtcagctataagcttggctaaacaccctgttgttcatggaaggagcaaacatattgaaacaagattccacttcctaagagatctaaagggaagctacagttga

SEQ ID NO: 25557 - DNA, 639 bp, Glycine max
  Peptide Sequence Number=SeqID_142335
atggcagcgccatggtggatggcggtggctgttttccaacaaaccaccatggattatggtggtggcgtggtgggcttcaaaattggcaataccaatgaactagctggatcagtaactgctctatttaattgtcaaggcccactggatactcctgtatttgttggcactggaatggtttctaggacattctcttatttacagactgagagcactgcatctgtagcatctgaagcacttgctacgagtaaggaagctggagcgctggcagcatttgatcgtgttccattctcatatgtatctgctaatttcactttcaacactgataactgtgttgctgatttatatggaattagggcatgccttgtagatggaggtgaaattcgtggggctgggaatgcatggatatgcccagagatacatattggtgaagtatctaagagtaccagtatcgaatatggatacttgaggcaaatgaaaggtgaagaggatgagacatcaatagatgtgaatttttctggaagtttggccatcgataacattgtgcttcgttatataccaagttcttatcatcagatgccacttaaattaggggtattaaatggagaaacaaaactttcaggatctcttttaagaccgtaa

SEQ ID NO: 25558 - DNA, 150 bp, Glycine max
  Peptide Sequence Number=SeqID_142336
atgatgcctagaatgcacaaatcaggatctgacccttatgacgtggacatggagggtgtaattgagacatctggtttctgcatttctttgcttttattctctctcgccacgttattatggataatggcaactaaggtggaggatgattaa

SEQ ID NO: 25559 - DNA, 195 bp, Glycine max
  Peptide Sequence Number=SeqID_142337
atggtcagaagtcgagacaagttgacggaagaaatcaaccaaggtacaaagggacggatgcaagtgggggatagggtgaccaccctgaccgatcgttgtcccttcccagcgctagacaagcagagaatgtcgttgcatggcagtccagtatcctttgaattcacagtatttattactattatttgttttaaataa

SEQ ID NO: 25560 - DNA, 537 bp, Glycine max
  Peptide Sequence Number=SeqID_142338
atggcgaggattcctgacaagattaggtctattgatggatcaaaagagacgcttaagcttgttgttagaatcactgatctgtggttcgttgggactcccaacaagtctgagcaagcggaaaaggtttttgttgattctgagggtgatcaaattcatgatatttgtaaatcggaccacctcaagtcttggaaggttgatttgaaagagaattgcacttatgttatgcataatttcaaagttgtcaagaatgatggtcaatttagagtgtgcgaacataatggtgaaattttgtcttgcacactttgggagaattactgtattcagttcctatcctatttgaatgaacatggggatgatgggccgatggttattatattgacacatgccagaataaaagatgcgcagggtaagtatgatattctatttactgatttggatactcaaccgatgagttttgtcgttgctgttcttggcatttacaggaagttatccagcttcagtgagcaattctttcaaggcatcaaaactattgattaa

SEQ ID NO: 25561 - DNA, 791 bp, Glycine max
  Peptide Sequence Number=SeqID_142339
atgttcgtgcgatcattaacggcaaagctgaaacagaaaacgagcaagacatcgaacctcaaccatgttcccttcttgatcgatattctcaaccactctttcacgaactcttcactctctcacgttcacttcccttcagacatttcccaaacgaactccctcatcgcctcttacgttcgccgaggcgaccctgtctccgcattgaccctctttcattctctccgtcgtcgcgcgcattccgatgtcgtcgccgacgcctacaccttcacctccatcttgcgcgcttcttctctcttgcgtgtctccggacaattcgggacgcaagtccacgcccagatgctcaaaaccggcgctgattccggaaccgtggcgaaaaccgcgctgcttgacatgtactcgaaatgtgggtctttggatgaagcaacaaaggtgtttgatgaaatgcgtcacagagatgttgttgcttggaatgccctgctttcgtgttttttgaggtgtgatcgtcccgttgaggcttttggggttctgagagagatggggagggagaatgtggagcttagtgagttcactttgtgttccgcgttgaagtcttgcgcttcgttgaaggcgttggagcttgggaggcaggttcatggtttggtggtgtgtatggggcgtgacttggttgttttgagcactgctcttgttgatttttacaccagtgttgggtgtgttgatgatgctttgaaagtgttttacagtttgaagggttgttggaaggatgatatgatgtataactcgatggtttctgg

SEQ ID NO: 25562 - DNA, 703 bp, Glycine max
  Peptide Sequence Number=SeqID_142340
atgtcacgccatcacaccctagtcaataaacatgtaggcatagatgtccacgccattaatttttgtgcggttatgattcgatgtggcagggactacacttccaagatgaggtccatcatcgttttcaaatgtcgatcattcgtcacctctaaactcaattgcgatgaggccaagtcttggctacctccgatgagtatttcggagtctcgacaatggtccgatgaccttgtcggattgagatccaacctcgtcggtgccaacggagagggagaaagcggattcgatgttggaggaagaggagaaggtggagctggttttttcgatgtgctaagatttcaatgctgcaaagttgacggcggtgaacacacacatcaacaattacctcgtgcagacggtgaaggaggagtagcgacagatgaggcggtgaaattgaagacactgaagagatgttccatctcaaagatttttgagatgaaagaggatgttgaagaggagaagtcgtcgccggagatcgagatggtgttgaaacatttgtcgtttgatgctgacaaagtttcgattacggtcacaaagtttcagtggctttcgaagcggctcgaggccttaagatccaacggaatttccttcgatttgatgaaattcgatgaaggaaacttgaattcaacggatgaggagaaggaatcagagatgctttgtcttgctt

SEQ ID NO: 25563 - DNA, 258 bp, Glycine max
  Peptide Sequence Number=SeqID_142341
atggctccgaaaaagctttccacgaagaggtctaggagagacgccgcggcggaagggtccaatgccacccccgagtttgatagccaccatttccggagcgccgagcaccagcagcgcttcgaggccatcaaaggatggtcgttccacagaaataggcgcgtccagctcagggaggatgagtatacagattttcaggaggagatagctcgcagacattggatgtcgctggtgactcccatggctaagtttgaccttgag

SEQ ID NO: 25564 - DNA, 213 bp, Glycine max
  Peptide Sequence Number=SeqID_142342
atggatctggagatcccacggtcatgtggctccacatgccaccggactcttgggtcacgcatttcgtttctaaacgaccatttagaggaaacactgggtccatcaaagataggagaaaatcactcaaagtgtttcaatctcacacagtgtgtggcgagaaagtcgctagcgcacaggattttgttggaaatcaaagggagaggaccactgtag

SEQ ID NO: 25565 - DNA, 145 bp, Glycine max
  Peptide Sequence Number=SeqID_142343
tgccagatgaggctattagactcagccagttttcattttccttggcaggagaagccaagaggtggctctacttatttaaggggaaggctgcaatctcttcatttcatcagttccctaacgagtccttgagtgaagcgttggagag

SEQ ID NO: 25566 - DNA, 252 bp, Glycine max
  Peptide Sequence Number=SeqID_142344
atgtcaggatttacatgcgattctcctcaaatttcagccagcccgcatcaattagaccttgcaccttacgcttcaggcccctacaatgctcaatggaatgccccagggcttctccatgacaagcacacgttgcgttcgagtcgtattctcggagaaatagaggttgatgaaccttggttagggttatggctaccattgaattatcaagtggtgtttgtcattggaagtgcggtaggtaggctttgtggttga

SEQ ID NO: 25567 - DNA, 783 bp, Glycine max
  Peptide Sequence Number=SeqID_142345
atggcctccaggaaatgtaagagcattggggcaaggccaactgctcaatatgatactagacggttccattcgcttgatgcttggaaccgttatacagataatgtcttggggaagaatattttgccagaaagaaaggttgaggtataccacacggagtttgacaacttcaagacaaagttggagaggcgtaatcttcacaaacgcctcaccaacttggctgatgggactattgatcttgctttggtgaaggaattttatgctaatctctatagctctgaggtcctagaggagggggagtcattacccacctactctaggtactgcaggttgcccacaaactacagagagattgaggctgctctttgcataccagggagggggttcatcttgaacgctgagggccatcctgggaggattctcaagaaagatttgactacattagcccaggtgtggagtgttctcttatactccaacctggcccccacatctcacacctctgacctgatagtggatagagctaggctgatctttggcttaatctctcacatggagatgaacataggagcgctcatttctggccagatgacttctatagcccagtctaactcttctagacttgggtttcctactctgatcaccgccctatgtcgagccagaggggttgtctttgacagcctcacttttgagcgcctgagcccggtcattaatttggcctacatcaggaagaactgttggaatcctgatgatctgacagtttctattcgaggggctaggagggcgagg

SEQ ID NO: 25568 - DNA, 330 bp, Glycine max
  Peptide Sequence Number=SeqID_142346
gttacaagcactggaatatctcaacctctatcaggaagtgttgatggcatcatcgaccctccatcccccgtcagacgccacgtgaagtggaagatggcccgcaccaagaaaacaggggagatgacgattgaggctgcaaaggaaatcgttgagaagatcgcaagtcattttcaactaaccattagaattatatttctttattttgtgaatgccatgcgtcacaaggatccttcgtcccccatcgacgttaggatgttctcactactgctattggatgtccagagcaccctggacgtgtccgtgctgctggagccagtgtcgctatcatga

SEQ ID NO: 25569 - DNA, 288 bp, Glycine max
  Peptide Sequence Number=SeqID_142347
atgccgatgttggatcaatttcatccatgcattcatgatttcattgaaaacattgttgatgtcaaagctgatggtatggttgaagattcatggtctttggttcacaaccatttgcttaaagaacttgcaaaatggcctaatgagtatatgaacctagtttgtggcaaagacgatgttcactctcccttatggttcctttttctccaattttcaacaaatatattcaagggaaatgaaacaccggaaagcgcaccgagtcgtcaagtatttaaaattaaaacggaatga

SEQ ID NO: 25570 - DNA, 479 bp, Glycine max
  Peptide Sequence Number=SeqID_142348
cgctcttgcgccgaagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggaccgggcgactgtttccaaaaacacaggtctccgcaaagtcgtaagcccatgtatgggggctgacgcctgcccagtgccggaag

SEQ ID NO: 25571 - DNA, 213 bp, Glycine max
  Peptide Sequence Number=SeqID_142349
atgaggaaaatgcaaggatcacgcataagcaaacatgaaaacaaaaggtatgcagtgtgtagaacaaaagatgcgcaaaagcataacacggggatgcacataggacatttaggactacatgcatggcagtgtttaaaatggcacgcagcgtgtttgctccgtgcccctatttggggacctataggatccatatctcacatggctgttttctag

SEQ ID NO: 25572 - DNA, 490 bp, Glycine max
  Peptide Sequence Number=SeqID_142350
gctttggtcttggaatcataataataccaactgttgccactggtatggagtcctctgccacaacgtcacttcccatcttcttcagcttcacctcaacactacgttttctgctgctttctatgatggctactatcacttcgatgaggaagcttatgagaaatcccagtttggtggagagataagtccttgtttggctgatttaaagcatttgaatcacttgaacttgagcggcaattatttccttggagcaggtatggcaattccttctttccttgggacaatgacttccttgactcacctcgacctctctcttactggattcatggggaagattccatctcagatagggaatctctccaatttggtctatcttgacctcggaggttattctgtcgagcctatgttagctgaaaataaattcttgctccttgtatttcccatggactcacaagacttgcagttcagagttcacgactttcaggccatctga

SEQ ID NO: 25573 - DNA, 1145 bp, Glycine max
  Peptide Sequence Number=SeqID_142351
tctccttgaacaacatgccattgaagctatttgagttccacttgaacatatttcgccatttcaaggaccatttctttaaggtcctggctactaatgtcgtggttgatggcttgccattgatgttcaatcgagattggggagccccgcttccagttctagtggatctattgacccttgtggagagggtcaacaaggccatcttggagcagttgtcagccatgttggatgcgtggggcattttatctcttcctttggtggatgatctttatgctgccttggatgataaagtgccaaaccttgtgctcttttgtattatgggtgacttcgctaggaggccactagtgaagatggttttacctgctggtgggactataccatcgtctactgttgttcctcctgctagagaagggggtcaacctgttgtcaaggatggccctgttgctgaagttgctgaggtcacccccagcattccttcctctattttggctaagaggaagcaagatgggttgacgcctccattggtcgtcaaagtttctgctcttgttgctaccgctattgttgttcctgcttctccaccttcttctgttgtgcttgttcaggaggttgctcctgctgtggaagttagtgtaccgaccactttggctggtccaaacgtggctcctatgtccaccatcactgcacccttggtaagtgcttgtgtgattaccacgagtgatcccgagatgccgcctcctccttctttaactcctcgagttcccccctcggccgtgttggcattagcatcaccttccacctcttctcacccccatgtttctttggatcacatctacacctcgaagaagtttggcaattatggaggagaatggacagcgacactaggaggctctgagcaacgtggcatccttggaggcggaggttgccaagtggaaggcccgattgaaggagtcagaaaccaactggaggagttcgagctacaggcattcaaggaaagggaggccaacaaggagcttgaagaggagccgctgatgcaggccgggttcttcgtcaaggaccttgacttgggtctttttgacctattcaaggatggtgttctgcttgagaatgaagatattgctactgaggagaatgctattgaggaggagtag

SEQ ID NO: 25574 - DNA, 363 bp, Glycine max
  Peptide Sequence Number=SeqID_142352
atggaagggttggaggcagatttgggatcaatgttgagaaagacttttctaacaaaaagagaactcagcaatatgctttttaggcagaaggagccgccgtcacctaaatgtcctgcaggggctggccgtggtacaggacactgtcctggagagttccgcatctggagcgcttttgctgctgtcctttaccatcaagcttatcgataccgtcgacctcgagggggggcccggtaccagcttttgttccctttagtgagggttaatttcgagcttggcgtaatcatggtcatagctgtttcctatgtgaaattgttatccgctcacaattccacacaacatacgagccggaagcataaagtgtaa

SEQ ID NO: 25575 - DNA, 614 bp, Glycine max
  Peptide Sequence Number=SeqID_142353
attgagatccagcacgatcgcgtcgaactcgtgcaccacggccaggtgcagaccggtaaccccgtcagccgcgaagtccacggtgtggccccggtcctccaggtagtcgcccagacgttgggcctgctgcaactggttatcgctctcttctctcttgcgattccgttcggccaccgtcatgcaactcgtctgtggccggttggaacccacaatccgcatgctcgccgcatccgggaagcgttccgaagccgatcgcaggcgtcccagcacctcgcgcacgcggctgcgctcatcgggtttgagctccgaataggtcttgccatcattgatatcagtctcgatccgctcgacttctgccagcaggggcttgcccggccggatcaccgcggccttatcgttgcccgcccatgcaacggaagacagagcggcgcaggaaagcaggcacgtcaagagcaatccatgaaaccgggagctggccctcacgggcggtggatcgccataaaaaagacccaggcggtgccccgcctgggtctgaagtcgtatcccgataccgatcctgctgagaggcagagctgcggttcgctgaaggctacgccggcgccgattaaaggcgt

SEQ ID NO: 25576 - DNA, 534 bp, Glycine max
  Peptide Sequence Number=SeqID_142354
atggacatgaatgtggggtacctcatctcccaccagatctccctcactgctcagcatgacacatccagacttggattcccggccttgattacagctttatgtaaggctaggggagttcagtcagattcgaggtccctggagagcttgagtcctgccattaatttggattatattatgaagaactgttggaatcttgatgatccaacagtaactttcagaggacccaggaaggccagagggaatagatctgaggcccttttcacttcagcatcatcagaggcaccaacaccttcttcttctacacttcctccctcttcctccacagagatcccagtgattcctccatcaccttcacagattccacttccagctccagtctctgcaggtattttcactcctcaaatgcttcactccatgcttcagagcattcatagggggcagtccatcatgtcataccctaatttcatccggggattattacttgatgatatgcaacctttgattggccgctttgagatacttggcaccctttga

SEQ ID NO: 25577 - DNA, 944 bp, Glycine max
  Peptide Sequence Number=SeqID_142355
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacgggctggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatctcccaggtgaatttctccacccgggagcagtacaggcaaccaaaggctgggaccccagggtcctgcgaggtcctaaggttattaatcccccacccttgtcccagagctgtggcatggggcttcagcccaggggacacggacaacaggcacaacagcactcaccatacagggactgaggcaggcttatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 25578 - DNA, 150 bp, Glycine max
  Peptide Sequence Number=SeqID_142356
atgtgcactagaagttggttgtggagtgctgaaaatactggttctatgagctataaagttgttgctgaatgtgctactataatgaatgaaatggtttcagatgatgaaggtggaatgatgggtgctggtgtcactaatttggaggaatga

SEQ ID NO: 25579 - DNA, 417 bp, Glycine max
  Peptide Sequence Number=SeqID_142357
atgggtgaagtagacgcggtgcaagagtggataaaggccgacatagaggccctaaaagagcaaatggccacaatgatggaggccatgatgagcatgaagaagacaatggaggtcaatgtggctgcagttgctgctaccagcgccgttgttgaggtggacccaactcccccatctggcctcaaccaaataaatcatccaacctcggatatggtaggtcagggaggcaaggagtggggaagtacgggcgactcccattttgtgcaagttcaaaacaagcatgccttcccgccatatagcttgcctcccatctacacaccacccaatctggtgcacactctcgatgagaatgtcaataactccaatcccacactcatcgagagccaacaacctcaatctgatcatgcacatgtgatgtaa

SEQ ID NO: 25580 - DNA, 233 bp, Glycine max
  Peptide Sequence Number=SeqID_142358
atgtcgggagtcgaaaggaagcgtcaatgcgcaatccgtaaagttccgatgttccaacagaaggcagtgccttctggtggaaagcaacccagcccgcctggaaaattccaagccaaaggcgctttccgtaacgcttctgagacgtttttcatggggcgatttcgtggaaagattttccatttgttcttcatcgttcttcgttcgttcttcgtcgttcttcagtcttcaacccg

SEQ ID NO: 25581 - DNA, 417 bp, Glycine max
  Peptide Sequence Number=SeqID_142359
atgaacttaatcattgttatcaaaaggaaagaacatgctttatggcaccattaccgaacccatgctagagctagattaatgggtgacgtagaggaggtgcaaaagcagatgaaggtcgacatggaggccatgaaagagcaaatgaccacaatgatggaggccatgatgagcatgaagaagataatggaagccaatgcggttgcagttgccgctatcagcgctgttgctaaggtgaacccgatgcccccatctgacctcaaccaaatgaatcatccaacctcagctatggtaggcaaagatttgggaagtacgagcggccaatattatgtgcaaattcaaaacaagcatgccttcccaccatatggcttgcctcccaactatacaccacccaatgtggcatacactcctagtgaggat

SEQ ID NO: 25582 - DNA, 312 bp, Glycine max
  Peptide Sequence Number=SeqID_142360
atgatgtggtatgatgaaaggataaataaagacaaacaaacaagcaaaccaaggatgcatgatatgcttgatgaacatattatcattgcaatcaaagacatgcttgatcatcacaatcaatatgctcaaaggtttcgaatggcaagggacaaattgcattctgctgcagttccagacctgaagatgaaactcattagtcaacgacaaacagacggaaggttgtataacttaccaactaccactaaagttgctgccttgattgttggtgatgaacactcaactgataaaagagatattataatagaaaaataa

SEQ ID NO: 25583 - DNA, 654 bp, Glycine max
  Peptide Sequence Number=SeqID_142361
atggttcgagagaaaataagagtatctactcggacactacaatggaaatgtgttgaatcaagaatagacagtaaacgtctttattatggacgctttattctgtctccacttatgaaaggtcaagccgatacaataggcattgcaatgcgaagagttttactcggagaaatagagggaacatgtattgaagaatcagtacatgaaattttaatgaatttgaaagaaattgtattgagaagtaatctgtatggaactcgggacgcgtctatttgtttcaaaggtcctggatatgtaaccgctcaagacatcattttaccaccctctgtggaaatcgttgataatacacaacatatagccaacgtaacagaacccgttaatttgtgtattgaattaaaaattgagaggaatcgtgggtatcgtataaaaacactaaaaaactttcaagatggaagttatcctatagatgccacatttatgcctgttcgaaatgtaaatcatagtattcattcttatgtgaatgggaatgaaaaacaagagatactctttctcgaaatatggacaaatggaagtttaactcctaaggaagcgctttatgaagcctcccggaatttgattgatttatttattcccttttttacacgcagaagaagataa

SEQ ID NO: 25584 - DNA, 147 bp, Glycine max
  Peptide Sequence Number=SeqID_142362
atggtggtgactccacgcatctttcctcctttggaaagcgcacccgtgagcctcgcctcgctcgcccgcaaaagggcatcacccacgggtttgagtaaaaaaggggccctatacccgggttcatgggaatctaaggactgggggtga

SEQ ID NO: 25585 - DNA, 306 bp, Glycine max
  Peptide Sequence Number=SeqID_142363
atgctttacggtgctcttaccgaacctgtgctagagctagaagtagaggaggcacaagagcagatgaaggccgacatggaagagaaaatggccacaatgatggaggccatgatgagcataaagaagataaatggagatatggtgggcaaggatttgggagataatgacggccccatgatgtgcaaaattcaaaacgagcatgccttcccgccttatggcttgcctcccgactatacgccacccaatgtggcatacactcccaataagaatgtcaataactctacttccatactcattgagagctaa

SEQ ID NO: 25586 - DNA, 699 bp, Glycine max
  Peptide Sequence Number=SeqID_142364
atgactgatgatgtccctgagcagtctacggaggcacttgagatgcgtgcggacgcacagggtgctaatagtggtgaggggtcagatggtgatgatgctgcagagggattccctggtggtccacgtgacccgtcagtgctcacatcatttgccgagcatgttgcacatgcctgtgtggagtggacagggcctggtggctgcacaagcttaagtccactgataattgtcagttatactggcgatccttggacttatatccgcatttgtggagagtttccacgctctttctacggaggaggccagatttttgcttacggagttgctggaagtgtctgccgaggagaccagagccgagacagcactcacacgtggagcatatatgtcaagcccggcggtggattgtcgcagctcgcgcttatctgctgcaccttgtcggttgcactttttgctaataagagtgcaacatacgtgcatgtggtccaccttgacgctttccgggacctcgctcatagtggtggttacgcttggggggttgtcgcgctggttcatatgtatgaccagttagatgaggcttgtaggaccaccacccgacaacttgcggggtacttgacgctacttcagatctatgagcacttccttagtgtgcaccagtgcgtgactgatgatacataccaggaggacgtccccacgtgcttcccg

SEQ ID NO: 25587 - DNA, 171 bp, Glycine max
  Peptide Sequence Number=SeqID_142365
atgaagcatagctccaaactcgaaggtggaggatacatgaacaacgctaggtggggtgggatatcgccagtcgagaacgaccttgaatggcaatctgaagggaagagacaccaaaaatgggttttcctttgccggcaatcccttaccttgctgaaaatttatctggtctga

SEQ ID NO: 25588 - DNA, 276 bp, Glycine max
  Peptide Sequence Number=SeqID_142366
atgatattgcacgagattagaaggcctaactctctaaaaacagtccccagtggagtcgccaactttcgcaacctacccttcaacaggagggcgacgcagggctcacaggtgcgtcttccaagaaagaaaaatgcgcggagtcgccactattcaaggaaaacatcggaaaaatcggaaaggtgtggtctacgaactttaagtgtgaaagattcgggagttgtttttacgcacgggaaaggtattagcaccccaagcgtccgtcacaaagaacggtag

SEQ ID NO: 25589 - DNA, 390 bp, Glycine max
  Peptide Sequence Number=SeqID_142367
atgtcaaaggtcaaaaatacccctggccttaatttaaaggattttggtgcacccaacaccattttacgctttccgtacaccagcactgtgagcttccatttgcgctgctgctattcttcttcccttccctctgtgtcattttcattgggctttgatcgttgttctcttctgtcggcattgtggacgtgcattgaaagggatgctccaccgtcgagagagaagaccggtagactctgtagtaaggagagtagaccagatggagagaagacaaacaattcgaggcagaggaagacccaaaaagactataagagaggaaataggtttaggcatacagatgaagtaggaagtaggtttgtacatacggatcaaggtgatccctatgaggtttaa

SEQ ID NO: 25590 - DNA, 408 bp, Glycine max
  Peptide Sequence Number=SeqID_142368
atggattactatgatgattccataaatgatagtgttgatatggtggatgaaataaacaatgaagaaaatgaagagataccacctgaggacaatttcaaggtttctaagaatgctttaacaaaatttatagaaagcataaagtatgttaaaggtccagagggaaaaatgaatgcctttaaagcttgtgttgttaaagtgggtggtgttgatacaaaggttggtttgtgtttgaatgttcctactaggtggaactccacatttgtgatgcttcaaagagcacttgcacataccgacgcacgcttagcgccattctcgcgcttagcgcaagtaagtgaaatttggcttagcgtcattctcgcactaagcgcagaagagacaatcttgtcgctgaacgagctgagcgtgtga

SEQ ID NO: 25591 - DNA, 123 bp, Glycine max
  Peptide Sequence Number=SeqID_142369
atggaggtcatggcgacgtggtgtagtgcgagagaggagaggagtgactgcgtaaaggttaaaatacttgtggggtctgctagtaaaactcatttaactcacgagttaagcgggacaagctaa

SEQ ID NO: 25592 - DNA, 210 bp, Glycine max
  Peptide Sequence Number=SeqID_142370
atggcttccggggcatccgtaaaatttccgaaaatcttggaacgaaaagggggtgaacttagtaatttggagggtgcatcaggaaacttcttgaggaagctacttgctcgcctgggcgagcgaggcaacaacctcgaccccattttggctataaataggggaaggaggctgctccaatggatcctgaacttcctaggctatgcattttag

SEQ ID NO: 25593 - DNA, 320 bp, Glycine max
  Peptide Sequence Number=SeqID_142371
atggtggttgtggcttacaatgcggaggtcgatcgtggcatgggttgctcgacccagctagaccacaatcctggatcgcactgcattgatggactaggggaggatgtgcatgcaaatctaggttttggggtggcaaattgtgcggtgcgatgttgttggcctgagatgtctcgtgcacatggatctgactatagagggaggttgcgcgcgaaatgggtgaaggtggtggtggtgcacgttggcaacgattggtacaagggagaggttaaaggagatggtagttattggtgtttggggaaggagcaaggtcatagaataag

SEQ ID NO: 25594 - DNA, 1578 bp, Glycine max
  Peptide Sequence Number=SeqID_142372
atggcgtcggctcaggtgctgccaaactccaccgcgtcgtcgcggaagcaagagcatcttgaagctggcaagcgccggccatctgatctagagctcctagtttcatttctggccaacccatggcatgatggcactccaatggagtttccagccaacccacctactgtggaactctggaacatcatcctttggtctctgtcagttcacataggggtctacccacctactgtggaactctggaacatcatcctttggtctctgtctgttcacatagggctggaggagtttcgtaaaaagaaagctgcagagcggaccaagaaggctgcttcctctggccaagttcacaattctgatgatagcttgaataaaaaacaatcttctgaagttgaaaatgtacgtgttaatgagtcagatggagttaccacgtctgatgctgtcgggggatctgttactgacacttcaactttggggatgaggaatgataagaacctgaatttgtttagccaaagtagtaatcaagggtctttggctggtagtacgtttcttacaagaaatgatcttaatatgtcatctacaagtctgggggaagcacattccaatattgatgaaggtaagagatataatgcttcttctgttaccgcatctgctgattttagtcaaaacaatgagagaaataaggtgaatgatatatatggaattcatgctgttggtgttgatgggattccatatgtgacaacaaaccaccaaagcgttcctctatgctcgcaagaaagtcaagagtttgataatcatgcgacatctagtcttcatggggtgaatgacaaccaatcaaacaagagtaacagttctttgaaggattatgcagttactgataatttctcttcgtattttccttcaaaaatcacccctcagaactctgttgatactccactgcaaatcaagccaacgaattctagcacttttgatagtggctactcacatagtttgctttctggaggtttcagtgattctttcagttccaagtttagagagactgttactagctctgataataatttgcctagtcttcatggtgcaactatgccaaaatatgattccacaggttatgaagcaagaaattcttctaatcatacaccaatacattcattgccaacggaatctagttctcggaggtcacgtccatcttttctcgattctcttaatgtcaccagaccttctttggggtctccatttcatcaatcggagcaagattccttgatgtccaattatttagaatcaagcagcaatgatatatcaggatctgcttatttccataagccgtctgaagagactaaaattatgccacttttctccaattttacaactgcaaatgttcatagttcacttgagccgttaacaaccccttcagttgttgataatgacaatcaaggtgctctgataacaagcactagggaaagtggcatggagaagaagcacgattattactcatcttcacaaaatgaagacttcactgctttagaacaggtgatttctgctagttatggtcatgacattactttcttgatgcctgttatatga

SEQ ID NO: 25595 - DNA, 660 bp, Glycine max
  Peptide Sequence Number=SeqID_142373
atgttgctttctaagctgcgaaaggcttcaggaattggaaagtctattgagaatcaaacaagtaaaagggatgtttctacatctacggaggatttagcaagcgaagatcctgcttctaactcttccaacccagaaatcaatgataatgctgctgaggcctctagtttgtcctcagttactgaaactagacactcatcttttggagtttctcctgtgaatattcctcacgatcagatgagaatgattgagaacattaatgcacttatttctgagctggcattggagaaagaagaattgataaaagccttgacatctgaatcatctgagtgttctaggatgaaggaaatcaacatggagttgtcccgaaagcttgaggtccagacacaaagattagagcttttgactgctcaaagcatggtcaatgaaaatatttctgcaaagcaaccagattctcgtgctatgtatgagaacacctcatatgcagatgagggtgatgagggtgttgggatggattatgaagctctttcctggtggaccttcaagacggagaaccagcaaacttctttgattggatttacattagacttgtatttgttgtcaccaaagtcttactcaactgttaggaaggatcatgaagctgttccccagtatgccactaag

SEQ ID NO: 25596 - DNA, 696 bp, Glycine max
  Peptide Sequence Number=SeqID_142374
gattctgaccttaatgtgcggaagccagttgaacatagtagtgatgcaaagcttgcgggtgaatccgatccattaggagagttgatgaagatattgttttatgtgtaccagaatccagtggaagtgtcgtgggaggcgaaccaatttggacttcatgatattggggcaaaattttacatcacacatgcagatctagcggaaataatatcaggtgacaagtgtttaaacatagcgatactacaattgtggaccatatttatgaatgagtgcggtagaagcaaagctgatcagtcactatatggtttgctagagcctcaatctatacaaaatgctaaggaaagacgtcaacaatgccaacaatacattgaaacatgggtcaaggaatcacaaaggcagttgtatttaggagcttacttgcatcaggcacattggcaactatttgttctccacccaagggaaaacacggtcgtttggttttgttctctgaggaagaagcatgatattaacatcaaaggcgcaattaacagtgcaatgaagacaacaaccagttcttttgaaggcatgtctaatcaaggtgcacctcggtgggttgaacccaagagtaatgtgcaaagtgtagggtttgagtgtggatattatgtcatgcactggatgtggtgcatcgtgactgccggtttgaaggatggctggcacaag

SEQ ID NO: 25597 - DNA, 507 bp, Glycine max
  Peptide Sequence Number=SeqID_142375
atggcagaaccattgaaggagagaaagggatcatcctccaccgccactgctgctgcccatcgccgccacgaaccatccgaagcacccatagcacctattcatccctctttgtcatctccaagatcatccacgttgttttcatccgatgatcagcgtctacgatacctttctcaattttcttctaggatcatcttagaccctaagtacctagacgtagatttctttaatgatgaaacgtttgattgctatcaagcgtttcaaaattctggcctggttgatttcatgtccttaaaattgccacattatcctgaacatgtaaaggtcttctactgcaatttaaaaattcaggatgacattatttcttctgaggtgcatggtattcctatgatcattgatcagtcatttcatgatgctcgccgtatggtctgcaatgaccagacagaaatgatcggtagattgctggccgggtcattaacatttgataatcgcatcatgcactatataatt

SEQ ID NO: 25598 - DNA, 759 bp, Glycine max
  Peptide Sequence Number=SeqID_142376
acctggaccattgcggtgcgcggcgatgtcgcgcagcagaataacctgcaatccctcgacgatctcagcgcttacctgaaaaaaggcggcacctttaagctggcggcgtcggcggagttcatcgagcgcagcgatgcgctgccggcgtttgagaaagcctacaacttcaagctgggccagtcacagctgctgtcgctggccggcggggacaccgctgttaccatcaaagcggctgcccagcaaacgtccggcgtcaatgcggcgatggcctacggtaccgacggcccggtcgcggcgctcggcctgcaaaccctgagcgacccgaagggcgtacagccgatttacgcgcccgcgccggtgatccgcgccagcgtgctgcaacagtacccgcagattgccgactggctgcagccggtattcagcaagctggatgagaaaaccctgcagcagctcaacgcgcaaatcgccgttgacggtcaggacgccagccaggtggcgcagcacggtgctgtcacggataaaccgaccgcgccagcagccggtgctgctggtgctgacgttgctgatcacgctggcgctgggagcgctaccgctgctgagctatgcggccaaccggctggtctccggacagccgctgatgctttggcaggtaacggcaggctggctgctgctgctgccgctgttatggctatggctgggattgtggtggccgccacgtcgcggcgcggcgctggcgcagctgctgggcgcggagctact

SEQ ID NO: 25599 - DNA, 462 bp, Glycine max
  Peptide Sequence Number=SeqID_142377
atgacgtttctacttagcaacattctgcccagcgaccgtaatgctgatctccccctgcggaagtatcagttggggtcgcacccacaagacacccagtggacccggagaagtccaacagggccctggggtttccaactctggttacgggcctctatcagtcctacagggtgcccgttcccccaacaagggatcacgcccgcaagacacccagtggacctggagaagtccaacagggtcctggggtttccagctctgattacgagcctctgtcagttttacggagtgcctgtcacccccaacaagttcattaggccccgcattaaccgggcattaaccaatggaaaaacacgcatagacgaattttgcaccctttatcattcagaaacaacaagttgggtggtaaacgcgcagagacagattctgcgccctttatcattcaagagcagcaatctgagtggataa

SEQ ID NO: 25600 - DNA, 588 bp, Glycine max
  Peptide Sequence Number=SeqID_142378
atgcgtcaaaggccgacaacatttgcacgtaggcaacaagcaattgtagctattgctgaggatgttgagcatgtggaacatccagctaacaaggttcatgaacagcctcaggagttagttactgatgatgaacgttctgagttgaagttgttctctcatgggaggaagagaggtagcacaagaaaactagtagtttccatctttcagttggagagtgttggatctatgagcattttcttactatttcttcgtgtgttgttgatgaggattatcatgaaaggaaatcatgcttgccgatggaagtatgagaaagcattattggtgtcgacgtatcgtaagcggatggatagattaatgtcagatgtttgtgcaacagactacatcgagctattctacatgatatctcaccctttcatgagtccaaaacaacctgaggatcctcttagacatccacctgtggtgcatgatgagacatttattttaccaaatcctcctcagcagcccatcgacgcagcaactatgccaaaaccacatgcacctacacctgcacttgctaatgtaggcatgccacaacatgcaatagtataa

SEQ ID NO: 25601 - DNA, 612 bp, Glycine max
  Peptide Sequence Number=SeqID_142379
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctggggtttgttggtgatttggaggggagggacgaatcaaagcgacaagggctgaatctcagtggatcgtggcagcaagccactctgccacttacataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 25602 - DNA, 324 bp, Glycine max
  Peptide Sequence Number=SeqID_142380
atgcacacacgaagtttcacaaatccacaattccttagaataggcctaactcacaaaaagtcgccagtggagtcgccaactgtcgcaacgtgccctttcgcggtcgagcgagggaaaggctcacgggtgcgctttccaaaggaggaaagatgcgcggagtcgccaccaacgtttatttgtggaaaacgtcgggaaaaccgaaggaaaccggtcaaaatgaaaattctaagttcgggagttgtatttacgcttgaggaaggtcgacaaaagcggggcttttgctcctacgtaccctccatcaaagaggaaatcagacctacgtag

SEQ ID NO: 25603 - DNA, 171 bp, Glycine max
  Peptide Sequence Number=SeqID_142381
atgccacgaagacatgaacttgctggggggaacgggcgccctgtagggccgacagaggcccgtaaccagagctggaaaccccagggccctgttggacttcttcaagtccactgggtgtctttgtggggggagattggcattgcggtcgctgggcagaatgttgctaagtag

SEQ ID NO: 25604 - DNA, 132 bp, Glycine max
  Peptide Sequence Number=SeqID_142382
atggagaaagaagaatttaaaccaacttttatgctaaaaattataaaatgcaaacctaaattacaaaaccttgatccctcgtcagaccaaatcaatccaagcttcgtcttcagatccctcttgttggactag

SEQ ID NO: 25605 - DNA, 267 bp, Glycine max
  Peptide Sequence Number=SeqID_142383
atggagccatatatccctcaagtcccaatggcaccagtagtagcaccgacatatgccccttctaatgtggagcagcctagacatgcagtggatgcttgccacgcgatcgctgaaaggttggagcatctgctcaacctaaggatagtcacggcagacacagtgatacacgagatcatgaaagactgcattaggattgttaggggtgtcacaccagatggcaatgtgtatgtgaggtctcgacgaagacggtgcacggatcaaccatag

SEQ ID NO: 25606 - DNA, 441 bp, Glycine max
  Peptide Sequence Number=SeqID_142384
atgagtgcaaaggctccccgtaagagaaaagccatagcttcattgtcccaggctagttatgactcatccagatttgtatcaagggatgcctgggactgttacgtagataacatccttgaccggaatattcttccagagaggaatgtgaagctatacattactgagtttgatgaattcataagagaagtcaagaggaggaattggcacagggagctcactaatttttttgaaggaagcatagatgtggcagttgttaaaaaattctatgcaaacctatattaccctgaggacaaagcaccaaagcaagttagggttcaagggcacctgattaagttcgatgcggactccctcaacaccttcttgaagactctagtggtcttggagcaaggggagagcttaccttcttactctaggttctacaggttgaggccagacccttaa

SEQ ID NO: 25607 - DNA, 384 bp, Glycine max
  Peptide Sequence Number=SeqID_142385
atgaaggggcttgttattcatgtgcctataccaatagttaatgaggagaataaggatgggaaggtgaaggagtatgtgtccacaagagttggtctcaaacgagtatgcctgctgattgatacaaagtggggtatgaaaccaagagatcttgaactaattgaattaatggaaagatcaaaaactaaatatcagattgtattaactaagacagatatggtttttccaattgatgtggcaagacgtgccatgcaaattgaagagaacctcttccagaacaaatctgtagttaagcctgtgatgatggtaagctcaaactctggagcaggaattcgaagcctgagaacggccctagccaacataactcgatttgccagaagattgtag

SEQ ID NO: 25608 - DNA, 417 bp, Glycine max
  Peptide Sequence Number=SeqID_142386
gattatcatgcaaccgggtcgggttcgtttttcgggccgaaggacgagagggttggtgacgcgggagccgccggagagggttttggaggcggcggaggatgcgggggcggcggcggggatggcggtgcggtggaagaaggagtgtggggtggagttggaagggatgaatgggaggtttgggattggggtggaggtttaccggctcacggcggagctcgcggtggtggagtgaggggtgtgtgggaggagaggttgaagcctttgttgcttgggggtgcaaccacgtcgtatagtagtgaggaggaacaacaacaacaacatcaagaagaagaagaacaacaagaacttgagtcgcaggttgccgatggatggaagttggaagggattgtgagagaggaagttgctgcggggaattga

SEQ ID NO: 25609 - DNA, 183 bp, Glycine max
  Peptide Sequence Number=SeqID_142387
atggcgggccatgatgtgaggaatccattcctcgacatccactggggtcccctgataatcgaagaactgacaaattttgaagatccatcctatgggatcctgaccgtcgaagcgtggtacctcaagcttcatacaagcgtgaagtggcacagtgcatgcaattggcgtaaatcaagcaaatga

SEQ ID NO: 25610 - DNA, 246 bp, Glycine max
  Peptide Sequence Number=SeqID_142388
atgaaatatgaggggagaattgaacatgacatggtgtttgaaggcaaaacaaaagtttctctagattgggaaaggaggttcctaggtggaccggggtcatccccaccacaatgcacctctaaatgtggcaaatgtacaccctgcaggccggtccatgtgacagtgccgccgggtactccggtgaccgcagagtactaccctgaagcatggaggtgcaagtgtggaaacaagctgagcatgccttga

SEQ ID NO: 25611 - DNA, 240 bp, Glycine max
  Peptide Sequence Number=SeqID_142389
atgaaggaaggaagggaaagtaggttacagtgggagtataatccattaaggaagcgaggaaatcagaaagggcagaatcgtcatcgttccttccttcactcgattgcgggttctgagagtgtgagaagaaattcgaagcggagagaggaaagagtatcgcagattgttgcagcgatgccaaatagcgattacggtgtagagagattttctcacccgcacctcgtcacgatcaaaggatga

SEQ ID NO: 25612 - DNA, 324 bp, Glycine max
  Peptide Sequence Number=SeqID_142390
atgcctatctttttgctctctctctgcggtaagtctttgcctgagttgagtttttggctgttaatgtggtggactagattggtagctgttgccactcagaagtttgttgctgaagttgcaggagatgcacttcagcactgcaaagcaagacaagcaacaattccaaaagacaaaagggacaagcagcagaaggataagcgcctagttttgacaatggaagacctttcaaaggcattgcgtgagtatggcgtgaatttaaagcatcaagaatattttgctgatagcccttctaccggaatggatcctgctacccgagaagaatga

SEQ ID NO: 25613 - DNA, 1116 bp, Glycine max
  Peptide Sequence Number=SeqID_142391
atgggtaataacaggttcagattgtcagatatgatgccaaatgcatggttctataagctcaaagatatgagcaaatcaaggaagagaaatggccctcatgttatgaagaacaaagtagcctcaccaacaacatcacaaaggtcacagccaagatactctcattatttctccattgaaccaaacatagctgataacacattcactgattcaccaagaaggtcatccaagagaagggctgggagaaaaaccatttataagccttctccaacagttgtgtcttcacccgtcatcgaaagttttggttgtcattccacaaacaattggattaagccaaatcaacttcagtctccagactattatctctcctccatagagatttcttcttctgaatcaaacctcaatgatgaatatgtttcatctgagtctgagtgtgataagttcactattcctgacctgcttaatggggtagcctctgaatgcagttgtagagttagctcttccaccaatgacatcatcattgacatgaaaaatgaacccttcaatggaaattctgaaaaccttgatggctttgacacaatttcacaattgggccttgctccaatattaacaaagccagtgaagtttgatgataaggtcattgaaaccactgagttgagaagatcagctaaatttgatgagctgaagtctcatcagtctctatctgtcatagttagcaaagaggaatgtagtagaactaagagagaaagaaaaacaagtccagtagctagagtttcctctgctaattctccaggtataaaacttagagtcaattctccaaaactcgcaagcaagaaagttcaagcctatgcaaggaggagtgtgtcatccagagcatgcaaggcctcaatgaattcaggctttccagagggatttgcagttgttaagtcctcacttgatccacaaagagacttcagggagtcaatggtggagatgattgtggagaacaatatccacgcatcgaaagatttggagaacttgcttgcctgctatctctcactgaattcaagggaataccatgatcttattgtcaaagcatttgagcaaatttggtatgacatggctcaactcagaatgtaa

SEQ ID NO: 25614 - DNA, 1752 bp, Glycine max
  Peptide Sequence Number=SeqID_142392
atggttggagatattctaggaaaaggggcaatgaagacagtgtataaagcaattgatgaggtacttggaatagaagtagcatggagccaggtcaaactcaacgaggcacttcgcaaaccagaagacttggagcggctttatttagaggttcatctcctcagcactctcaagcaccaatccatcatgagattctacacgtcttggattgatgttgacaacaagaccttcaatttcattacagaaatgtttacttcagggacactgagagaatacaggaagaaatacaagcacataggcctacaagcaataaagagttggactcgcctaatcttacagggtcttgtttatctacatgaacatgatcctccagtaattcatagggacctcaaatgtgataacatttttgtcaatggccatcttggacaagtgaaaattggtgacctgggtctagcagcaattctccatggttcccaaccagctcacagtgttataggcaccccagagttcatggcaccagaattatatgaagaagaatacaatgaacttgttgatgtgtactcatttggcatgtgtgttctggaaatgcttacatctgattatccatatagtgaatgtgctaaccctgcacagatatacaagaaagtgacatcggggaagctaccggcatcatttttcaggattgaagacacagaagcacaaaggtttattggcaagtgtctaataactgcagcaaagagaccatcagctaaagaattgttgaatgatccatttcttttgtctgatgatgcatcatccatgacaaagatcggaattcagaaaccctttttaaattacaatgaaatggaaaagcttcaattggatgatgtttcacctaggactgaaatgtcaataactgggaagctaaatccagaacatgatactatctttctcaaagtgcaaatttccgacaaggatggttcttgtaggaatgtatactttccttttgacatatacacagacactcccattaatgttgcaatggagatggtgaaggaattggagatcacagatttgaagccttctgatattgcaaatatgattgaaggagagatatctgtgctgctgccaaataagaggaatagtaactgttcagttatcacgatgacgacgacaacgaatcatcatttccactctgcctcttctcgttcatcatcccaaggatcaatatcaggctcagacagtagagctgatgacttattgaatggagattattggctccatggtgatgtacttgatgatgccagttcaatatgctcctcacatgggacatattccaactcaaacttttgttcagtggatgagcaggaggaaaaccataaggcttctacaagaaaagataaacatctcatcataaagagtcacatgtgcacaagattttcccctaatgaagaccccatcactttgaaccagtgcaaagttttggcaggaccacaagcaccttctactagcaaaaacaagaggatgatggacaatcgtagactaacaaggaacaagtcattgattgatacaaggagccagctactacacagatcactggttgaggaggtgaacaaaagaaggctattcaacacagttggagccgtggaaaatattggatttgtgacaccttatgaggttaccaacaaaaagtcacatccagcatgcggtgcttttgatgtgaactcttctagaagtagcaagagagaaaactttaatagagagaaatttttttag

SEQ ID NO: 25615 - DNA, 348 bp, Glycine max
  Peptide Sequence Number=SeqID_142393
atggaagcattatatcctctggccattgtggtgaagatcagtgtaggcaatgtggatggtcctaatttgtatgaggtctccttggagaccaaattcaatattttgttaatggtggttcctgttagcaactatagcagcacaagtggtagtggttgttttccttgctcttggggttgtatggaagcatgcagagtgaaggatgctaaaaatccaactggagattatggggaaggaattatttcttcaccactacatctcaatggtaatatgttgctttcatttcaagttttgagggacactactgagaactttaatgaagaaaacatattgggaaaatgtgatttttga

SEQ ID NO: 25616 - DNA, 495 bp, Glycine max
  Peptide Sequence Number=SeqID_142394
atgtggttgaaaggggtgaagacccctgtggttctgtctagaaatcgcgatgaacgcgctaagcgtgcctgtgcgcttagcctgttcatcgcaactgttaaaattttggatttccagatgaacgcgctaagcagaccatgtcgcactaagcgcatggcatctaagaagaggaaagctccttctacacctacccaggccagatttgatagatccaggttcacatcccaagaggctagggagagatatacagacattgttgtgcctcgcaagctactaccagagaggaatgtggtagtttattacacagagtttgatgagttcaaggaggaactcgagaggagacattgggatgagaagatgactgatttttctgacagtagcatatacattgctattgtaaaggagttttacgccaacctctatgaccccgaggataaatcacctaagcaggtgagggtgagaggtcatttagtgaagtttgatgaggatacctga

SEQ ID NO: 25617 - DNA, 225 bp, Glycine max
  Peptide Sequence Number=SeqID_142395
atgaccaaacttggtctctgcttgtcatcgggcccgccgcctctggatgacaaaagggtgcgaataaccataagaatgaccaaacttggtctctgcttgtcatcgggcccgccgcctctggatgacaaaagggtgcgaataaccataaggtatctccgcgtatcatgggtgcagaatgaccaaacttggtctctgcttgtcatcgggcccgccgcctctggatga

SEQ ID NO: 25618 - DNA, 618 bp, Glycine max
  Peptide Sequence Number=SeqID_142396
atgtctcttctattacgaagaccacctggtcgcgaagcttatccaggggatgttttttatttacattcacgtcttttggaaagagccgctaaattaagttctcagttaggcgaaggaaatggccaaatattcttatctgccgatctattcaatgctggaatcagacccgctattaatgtaggtatttccgtttccagagttggatcggcggctcaaattaaagccatgaaacaagtagctggtaaattaaaattggaattagcacaattcgcagaattagaagcttttgcccaattcgcttctgatctcgataaagctactcaaaatcaattagcaagaggtcaacgattgcgcgagttgcttaaacaatcccaatcagctcctcttaccgtggaagaacagataataactatttatactggaacgaatggttatcttgattcattagaaattggacaggtaaggaaatttcttgttgagttacgtgcttacttaaacacgaataaacctcaattcaaagaaatcatatcttctaccaagacattcactggggaagcagaagtccttttgaaggaagctattcaagaacagatggaactctttttactacaggaacag

SEQ ID NO: 25619 - DNA, 247 bp, Glycine max
  Peptide Sequence Number=SeqID_142397
ctgttataaaacgtatttggccactggtaatcgattaccagaaatcgattacatcctctgccaattgcatctacatggagaaactaagaggttgcttcattcattcaaaggcaacagtcttaagacatgggaagaagttgtggagaaatttctaaagaaatattttcctgagtctaagcctgcggaaggcaaagctgccatctcttcttttcaccaattttcagatgaatctcggagtgaggcctaa

SEQ ID NO: 25620 - DNA, 213 bp, Glycine max
  Peptide Sequence Number=SeqID_142398
atggtgaatgacattttcacactatctaggcacaaggaaaacatggtgcagcccaaagcaagcgctggccttaaggggaaacctcaccaacatgctctcactcaccatgccttcttgtatttcaacaaacaaaagcttgggccccctaggcctaagtcatgttttggcatttatcctaattcttgcaagctgtccgcatccaaaaaatggtaa

SEQ ID NO: 25621 - DNA, 228 bp, Glycine max
  Peptide Sequence Number=SeqID_142399
atgtcaggacatcgtgtccgacatcgtggatcctgcagcttcacttctgcacttgacttttatcttgcattgtatagcaactccagtattctcgggcaggatcaactccagtattctcgggcaggatgtcaggacattgtatccgacatcgtggatcctgcaacttcaattcttcatttgacattttatcttgccttgtgcattgtgcagcccgatcttattccttga

SEQ ID NO: 25622 - DNA, 217 bp, Glycine max
  Peptide Sequence Number=SeqID_142400
ctagaagcagatagcagccatagggataggtattcaatcgcttgctttaaaaggtatgagattgctcgcagaggactaaggtcgacagatagggataggccagcaaatgcaatgagaaagtcttcttcttttcttgctcaggacttgtcttggaagacgcctgattggattccatcctctattctctacccgatctctatgagagctttgaagtcgg

SEQ ID NO: 25623 - DNA, 336 bp, Glycine max
  Peptide Sequence Number=SeqID_142401
atgatcatgagaggtcaagacatttatagtagtcaagaagagactacttcttgcccttcctctagtggaagtgaagatgaagtaagggatgaagagtctagtgaggaagtctacccccatgaagaaggtgacctcttaatgtttagaaggctccttggagcactccttcttaaacaatctttctaccttctcctatcaagggaaacttcccttagcaccgccttacctcttgaacttgaggttattcctcaagtaaaggagttgtttgatgagggtttggttcgcaagagcttaaatccttgtgctttgtttgtgcctaaaatagggactcattag

SEQ ID NO: 25624 - DNA, 672 bp, Glycine max
  Peptide Sequence Number=SeqID_142402
atgcgtagtgattgcttagtgcaattctccattctcaacccttttttggtgctcatgaattgcgttttcgttcatgcgtcctccattttcgagtttggagccatgcgtagtgattgcttagtgcaattatccattctcaatctttttcggagtcccatgaattgcgttttcgttcaagcgtcctccacccacgactttggagccatgcgtagtgattgcttactgcaattctccattctcaacctttttcggagccccatgaattgcgttttcgttcatgggtcctccaccttcgagtttggagccatgcgtagtgatttcttagtgcaattcttcatactcagtctttttcggagccccatgaattgcgttttcattcatgcatcctccacccacgagtttggagccatgcgtagtgattgcttagtgcaattctccattctcaacccttttttggagcccatgaattgcgttttcgttcatgcgtcctccaccttcgagtttggagccatgcgtagtgattgcttagtgcaattctccattctccacccttttttggagcctatgatttgcgttttcattcatgcgtcctccacccacgagtttggagccatgcgtagtgattgcttagtgcaattctccattctcaatcttttttcggacgccccatga

SEQ ID NO: 25625 - DNA, 702 bp, Glycine max
  Peptide Sequence Number=SeqID_142403
atggctacctcaccaaaagaaacttccgcttctggttcacccgctgtaccatcatctccgcaccaggaacaaccagaattcaacatccaacccatacaagtaattcctggtcaagcttctgtccctgagaaactggttcccagaagacaacagggagtgaagattgctgaaaaccctagccttgcaacaagtcctagggaagtagacacggagatggacaagaaaatccgcagtatggtgagtagcattttgaaagaagcctctgtgcctgaagctgatgaagatgttccaacatcttccaccccgaatgtttctatgcctgatgttgagaaagatgttccaacatcttccggcccaaatgatgaagtactctcttcccccagcaaagagagatcaacagaggaagatgatcaagccgcagaggagacccctgcaccaagggcaccagaacctgctccaggtgacctcattgacttagaagaagtcgaatctgatgaagaacccattgccaacaggttggcacctggcattgcagaaaggttacaaaagccgaaagggaaaaactcccatcaagaggtctggacgaatcaagactatggccccagaagaagagcactccagtcactcctgccacatccagaagaagcaaggttgctatctccctccaagaaaaggaaagaaatttcctcatccgagatctga

SEQ ID NO: 25626 - DNA, 898 bp, Glycine max
  Peptide Sequence Number=SeqID_142404
atgtctcaacaacaacgcgttgcattagtggccggcgcgaccggcatagttggcagccagctggtagaaactttgcatcaacatcaatggcaggtgattggactgtcacgccagacaacttcgcggaatgaatttccaatgataagtgtggatttactggatgcgcaacacagcgcacatgcgttagctccgctaaatcaggtcacacatattttctacagcgcatggcttaatgcggccaactggcaggagatggtggagcccaatgtgacgatgctgcgaaacctggtcactcatatcgaaaaagtcgcgccgttacgcactgtcagtttgatgcaaggatacaaagtgtatggcgcgcatttaggatcgttcaaaacgccggcgcgagaaagcgatccaggcgtgcccggcgctgaattcaatgctgagcagttacgctggctaagtgaatatcagcgcggtaaacgctggcattggcacgcattgcgcccaggcgtggtgggcagcgcggtgcccggcaatgccatgaatctggcgctgaccatcgcgctttatgcttcattatgcaaagcacaaggcttgccgttgcgctttcccggttcatggcggacgtggaacagtattgttgaccacacagatgcgacgctactggcacgggcaacgttatgggccgccgaggcgcccggcgctcaaaaccaggcgtttaatgtgaataacggcgatgtttggcgctggagcgaactgtggcccgccattgcacattggtttgaactggaaacggcacccgcagtgaagctgacatttcagcaattgttccaggattaccgcagcgtctggcgtacactggccgaacaacatacgctcattgaatccgatattttgcagcttaatgatg

SEQ ID NO: 25627 - DNA, 978 bp, Glycine max
  Peptide Sequence Number=SeqID_142405
atgaataataaactcaacgccatcaacacgtttatccgcgtggcagaagccggatctttttctgccgccgcacgacaagtcggaatgaaacaatctgcggttagccaacagattgccgcgctggaggaagatctgggcgtggtgttgctgcatcgcaccacgcgagccatggcattaaccgagcagggcgagcgttatttgcagcaaatgcggccaatgcttgccgcgatggtggaatttgaaagccaactgcgtcccacgcagcaagcgttgcagggcaacgtgcatatccagttgccgagcggtttaggccaactattcctgccgcatttgttgaggttgcagcagcacaatccggaaatgcatctgaatatctcgctcgacgatcgcattgcggagctcgtgagtgaaagggtggatatcgccttgcgcctgagtgaaacgccgccagaactttttccggcgcgtttactggcgcgtattcaaacaccgctgtttgcggcacctgagcgggtgcaccagcagccaattacctcaccagaagagttggcttttaatccgcatgtgcgtttcagcgccatagcccacgatgcgccgctaaagctgattagcgatgatgcaacgctagcgattaaggtgaacacggtttttcgcgctaataacagcgaaggattattacaggctctgcaagctaatatcggtataggcggcatgcaattaccgttggttacagaagccataaaagcggggacgctggtgcggatcctgcctgaatatcgcctgcctgaccgatttctttatgccgttttccctgatgctcgctttatacccttgcgagtcagacgcatcgttgaactgattgaacagctgtttcaacctgccgccggtaaagtcgcattaaccgtaacagcaaaagccggggccaccttcggcttcccggcaagccgggtcgtcgagccctatgtcgctaagcggtaa

SEQ ID NO: 25628 - DNA, 1398 bp, Glycine max
  Peptide Sequence Number=SeqID_142406
atgatccccggtattttccggcaggtgtgcagcaacggcctggtgtgctggaaatcattcggtgaaatcagcgtgccgcataaaggcgatatcgtgtcgcaggttattgagggcgcttatgaagtactgggcgtattcgacaaggtcgaaaataacatcgacatcatgaaagggattcaggttaacaatgaagaacgccgcctgctgggtcagctggcgctggaatataagtatgatggaaaagagccgccggtaacagccgagcggattattcagccgcgcgcctggtatgacaaaggcaccgacttatggaccgcgtttaatatcgtgcaggaaaacctgatcaagggcggcgtcaccggcagaacggcgaagggaaaaagaaccaccacgcgcccggtaacgggcgctgtggaaaatggcggaagagttcgcaaaactgaagtcataatgtttaaccccggttgccggggttattttgatgcggtgctgacgtccgcgcttagaaagcttcggactggggccggtgttatacatcccgacgctgtcccagttcctgccgtactgcctgaagttgcgcgcctcgatccacgcgccggtgtaaatgcagatgcacggatccttaagcaacctttcccgcgtaatatcaaatcgtttcagctgattaaagtgagagctgttaatctgcatattacagacgtcgcgcggatcaatgccgaaatcctgaccagctttggtgaaacacatttccggcgcggcctgcacgctgaatacagcggcaagcccgaaagctgcaaaccatttcattcttattgtctcacgtacatgcgcataaagcgccaggcgggaaacgacgacacaatggtgtcgcaagctacgatagtgtatcgtcgtgtcacactctacgacatgatggtgtcggtaacgactacctgtataaatcagaattccagagcaaagtgcacactcagtgctggagaaaagataatgggcagaatgggcatttacgtcaaagataaaattgagaaggaaatcagggatatttatcttctggacattcaaaacggggccagcccggccgaagtcagcctttcatcaacgtgcaatgaattattacggcttggtctgattatgcataaagccaaaaacaaagaagacaccttcaatcagaaagaatttaaccgcgaactcatcagaaaagtcagcggcagtaaagaaggcattatgatattactgaccatgatgacagaactgtatgttagcgcaacaggaggaggcggaaccgagcgcatagatacgctgctgagccagtacctggccgaaattgacagttctgaaaacgacgctgataaccggcattttgtccggcatgaagagagcggtcatgctgacgcctga

SEQ ID NO: 25629 - DNA, 252 bp, Glycine max
  Peptide Sequence Number=SeqID_142407
atgctaggattcataagcgattctcctcaaatttcagccagcccgcatcaattagactttgcaccttacgcttcagggccctacaatgctcaatggaatgccccggggttcctccatgatatgcacttgttgcgttcgagtcgtatcctcaaaaaaatggaggttgaggaaccttggttggggttatggctaccattgaattatcgagtagatatgggagcaagtcagcataggacaccagaatgggggtga

SEQ ID NO: 25630 - DNA, 375 bp, Glycine max
  Peptide Sequence Number=SeqID_142408
atggaggagagggggatacacaaagagaatcacagtgagggagatacgtctactagtaagacgagggagaaaagaggggaagaaagtgtggtggaactgaaggatgaagattgggagaagaggaatagacagggtaaaagatacggttttgtgcggtttgccggagagaaaagctcgacccttcttgaaaaagaacttggcagtatttgtattggcaatcgaaaaattcatgtcaatatcccaaggttcaatcgtagggacgatccttctcatcgggtagctttgcctgaggaagaaaagataggcaccaaatcgaaaaagaaaaaggattttgtagttgtgagaaaacaagttatatggaggaaaaagcagtag

SEQ ID NO: 25631 - DNA, 156 bp, Glycine max
  Peptide Sequence Number=SeqID_142409
atggtcagatggagaacatacaacttcaagagacttgtgacgatgcttgagtgcgacgaagacgatgctcgagtgcgacgaacacgatgctcagatgcagacagggacgatttcgctagacggagattagaagaagaagagagcacgaaagcttag

SEQ ID NO: 25632 - DNA, 627 bp, Glycine max
  Peptide Sequence Number=SeqID_142410
atgtggcattgggagggtgttacacttgatgatgagtggaagtttgatttttctgtgtttgatgcttgccggatggtttgcaccaaccaagcagatatgatcggaaggcttcttgtcggttcattggcattcgaatgctgcatcatgcactacttgattgtgtgcatcctactccctagttcttccaaccttgcacaggtttctgaggaagatttgataattatgtgggttttcttaaccggtcgtcaaatcgactgggcccatcttgtgagatatcacatgcataaggcattgcaatcaaatgctccactcccatatccccatctgattactttgtttctacaacattttaatgtccctcttaactctaagccctttgtcaaagtcaagagatccttttctatcagtgcaaatgtagtctcttccttcggataccgcaaagagagggatgactcttgggtaaagaaggatgctccagtactggctgttgaagaccgctctccctcactacattctcagagagatgactcttcatctcttatgcacaacattcttgacaggtttgatggacttcaaacttatgttggtgagaggtttgactccttggaacgtcaagtggactcatga

SEQ ID NO: 25633 - DNA, 228 bp, Glycine max
  Peptide Sequence Number=SeqID_142411
atggaaggtaaaggaaatttaaagcaagctagacggttcctatgtgaaggcttggatgatttggaggtcccaactggctattcacttagtctacacgtgtttcactcaaaatttggtgagacattggttgcttcaaatccaatggtgctcctaggatggttaacctctaagactcaaaaatcttccttcaagcaatgcaccaatttcctcttccaatccttattgtag

SEQ ID NO: 25634 - DNA, 162 bp, Glycine max
  misc_feature (146)..(146): n is a, c, g, or t
  Peptide Sequence Number=SeqID_142412
atggcctccatcattgcggccatttgctctttcatggcctccatgtcggcctccatctactcttgtacctcctccgctttacccattaatctagctctagcacagaaatgggtttatgatcctaacatggttggctcatggtaccntaacacatgcaactaa

SEQ ID NO: 25635 - DNA, 672 bp, Glycine max
  Peptide Sequence Number=SeqID_142413
ggacttgcactacctctggagcctgaggttggtccctcagctgctcatgttagcacaaaggggagttgtgttgatccctcagcgatcaatccaaacactggaagagtttatgagggatccacaaccgttcataacatccttttgttgcatgatcaagtgaaggttggtgttgagcaggttaaagatgcagatgctccggttcctgtacccactgacgaggaagttgtgtctctagcaaaacctgcagataggccgaattctgaggttatgtgggatgcttccctgttcgggttgtttaattcaaacttccctttgtacataaagcatgaagatttgtctaaaatagcccacggtggtcaatgtctcagcatctctgttatacaattgtggatttttgcacaatggcaaatggtcgtcattttgcctaaggaaaatcttgttgtctggttttgttccttgcatcataggccagacaactatttgaaaggaataattaacatgtcagtgttctttttcaatacatttgcattaccattagtcagcaacatcaatattttaatgtgtcttgtattcaacagtgctttgaaagaagttgacgctactccacaacctaaatccaaggttgttgtaggtgctaggtggattgttgttaaattaacgttgaatatctaa

SEQ ID NO: 25636 - DNA, 579 bp, Glycine max
  Peptide Sequence Number=SeqID_142414
atggttgacaacacacgcatgaaggagcttacaggggatgtcaaaaggatcctggagatgatggaaaaccgcaataaagaatatgctgctcggtttgagaccttagaaacaacactggagatgacactcaaggataaacttgagatcctgggagttaggaatgttaagattgattttcccatattagatggatcagatgttttacaatggatattcaaggctgaacagttttttaactatcataaaacaccgggtgagcaacgattaattattgcttcaattcacttggataaagaggttgtgccctgctaccaaatgatgactcgtgaaaattcattcaaaacatggattgcttttacgcgagccttagagacagaatttggcccatcaccgtatgaatgtcctagatctcagttgtttaaactcgctcaaattggttcagttcagtcatattacgtgcagttcacggctttagctaatcgagtacaaggaattacacaagaagctctattggattgctttgtgggaggattaaaacctgatatcagaagggatgtcattgcacaatcacctacatga

SEQ ID NO: 25637 - DNA, 865 bp, Glycine max
  Peptide Sequence Number=SeqID_142415
gccggaacggttatccactctgactacggaggtttctgatgaacacagcactgcacgcgccccagccggcgcaaatcctggacgcgactatgacggcggcgtatgggagttcgcgcaactgcccggcggcggcggctttatgaagccggaaggggaggcgcgctggcacttttcaaatccgggcaattacagcgagctggacgtaagcgcggaggcggcggggatcatcatcaccgcgctggttctcaatcaccggagctggatgtatgaccgccacgatgaggaagaactctgtgcgcactactgcgagcgccaccggcagctgatgaactacgccgacatgatgcacggcactgtaaaagagatcagcacgcgcctgactgagttgtttgatgaagaaaacccgctttcagtattgatctggacgatggatgacgtgatgaacgcagcggagtgtatggatatcacggaaagagaggccggctgggtactgtcgtttattgccgacgaaggtgatcaccgccggtacggtatcggccgggaggcggtaagggacatgctgaataacctgcgtgaagaagaacgggaggaaatgcgcgaagtaagcgtgcctgccggcgcgctggcggcggtgctgagtgtggcagaagattttatgcggttaaaagatgctcaggccgggcctggtgccggtgcccgtcactggccggtcgaaaacgaggcaatgaaaacgtcaacagcaacagcaacagcaacagccagggccaccttcggcttcccggcaagccctatgtcgctaagcggcaaagccgccaagcgccaccgaacccctgcgggtttcggccgcgagcggtttcgggctgat

SEQ ID NO: 25638 - DNA, 432 bp, Glycine max
  Peptide Sequence Number=SeqID_142416
atgggggaaaacctgtataagggattccaagttgggtcaaacaaagtggaaatcagcatccttcagtatgcggatgacactatattcttcggagaggcatccatgatgaatgtaaagacaatcaaagcaatgttgaggatctttgagctggtttcaagactcaaaattaactttgtcaaaagtagctttggtgcttttggtacgacggaccagtggaaaattaatgcagccagttatctcaattgtagcctgctgtccattccttttatttatctaggcatacttattggagcaaatccaagagcgtggcagatgtgggatcctatcctcaaaaaggttcctaaaagggtggcggacaagctagcgagcttacagagacaattcctttggggtggtgacgctgaccataacaagatagcctgggtcaaatga

SEQ ID NO: 25639 - DNA, 180 bp, Glycine max
  Peptide Sequence Number=SeqID_142417
atggttgtggaatctattctagaacacagggcaactatgggtcagggtattggagtccaagacattgaaggcaagctaattcagccacaaagtcgagatgattgggtgtggaaggcagatcctagcggccaatactcggtcaaaagcgcgtataatatgatgaagagggaagcagcatag

SEQ ID NO: 25640 - DNA, 426 bp, Glycine max
  Peptide Sequence Number=SeqID_142418
atggagccacctatgttggggggtgaagaggaatgtcacagcaatgaatctggatggaccatgtacatagggtcccccagagacgaggatgcacaacattgtgatgatgatgatcatcatcatcatagcttcctagaagaagattatgattatgaatcagcagcagcagcagcacaacattgtgatgttgaaagtgacgattccatggcttctgatgcatcttctggcccgagtaaatcaaaggagcaagtgaataagaaggacaacaagtattattgctcagaaaaaaaggtggaaaagaaaaatgagatcatggctttcaatagcaaagaaaaggctcctgcagcagttcatcagaacgatagcaaagtcaaggatttgttatggaatgctgtagagattacggataatcgactaatagcgtaa

SEQ ID NO: 25641 - DNA, 335 bp, Glycine max
  Peptide Sequence Number=SeqID_142419
atgaaattgtatcatgattcttctccaaactgcatgaaagtggcagatttaggttgctctgtaggaccacatgcacttcttgtgatatcaaatattactaacattgttgataccacatgcaccatcttgaattgtgaaccacccacattccaattttatctcattgatttatttggaaacgatttcaataccatcttcaagtcacttcctgatttctatacaagattggtggaagttggggaaggattgagtggtgaagagaagagagaagttaagtcagagatactgaggattatgaaggaagcttctcacagtctgaagcagagtttgccact

SEQ ID NO: 25642 - DNA, 216 bp, Glycine max
  Peptide Sequence Number=SeqID_142420
atgttgattgttcggatgctttcaatacttctccaggtgttttggtaccccgagatgatgatttgcggtgggctcgatcagttgctcatgaaaacggacagattcgaggaattaaagaggtccctacttgttgatgggttatccatggtttatttaaaagattgttgtcctttaccgcctctagcattgttatggtctggggattgtcatccttag

SEQ ID NO: 25643 - DNA, 1044 bp, Glycine max
  Peptide Sequence Number=SeqID_142421
atgtctcgcaaagaaaatctgatatctgagttacacaccagaaaaggaacatggaaaatagttgtgcgtatcactgatctttggcaagctcgaaagcaaaatagtaaacaaacaattgagatggtgttgatggaccaaacgggttcaaaaattggagctactctctggcaagaactcttcactgaattacgggacaagttacagtgtggttcttcgtatttgattcagaatctgaggattgttgacaaccaatctgaatacagagtcagcccagctccatatttggtttatttcctaaaaactacatctgtcaaggaaatccactgtccagaaattccttctaatatttatctcataactccttttactgatataatctttggcctcgcacaacgccatactttagtggatattgttggtgtggttgctgatctaatcgatgttaagacagttaatcccccttacaggatgacagtcaggctcagggataacagtaactgcgacattctaataactgtttgggaggactatgctattcagctacatgatgctattgacaaaaaccttctgcttcaggaaccattggttgttatgttgaccttaggtaaaatcaaggatgctacagagatacacgaattttgtcaaagtttgcctgtgccattttattctagtgggatgatcaatgataaagatgattctcagtcccaatctagccagagtaatgtggtggaaaaatttctgcagaatgctcaagtggtcagtataggtgaaatcaacaatctcagacagggttgttactgcttaactgttggaacagttgacgaaatcattattgatgctccatggagttatgacagttgtcctaactgtaaaacgacatttgatccatcaaaaggtggctccgcttgtcgttcttgccataccagtgtggtcgatacagtaccacggatgaagcataatggggacaaaggaaattccttctctaggatgcaacatgtatcaagctgtttggtaaaactgttggagaatgtcgagatgagttga

SEQ ID NO: 25644 - DNA, 608 bp, Glycine max
  Peptide Sequence Number=SeqID_142422
atgaagcgaaaatacatgatgttgtctatgatgatatcgagcccaagacagccaagaaatgacattgatgtttatctaagtcaattgattgaagacctgacaaagttatgggataatggggttttagtgtttgatgtgttttgcaaggagacttttcaaatgcgtgcaatgcttttttgtaccattaatgactttccagcatatgggaatctgagtggttacagtgttaagggtcaccataaaaatgtatgtgatagtgtcattgggacgctccttaacattcaaggcaagacgaaatatggtctggatacccgtcaagatctagctgacatgggtatacaatcgcaattgcatccaagcaaagtcgttgatcctgttaagtttgatgacctggaaaatgaggccgcaattatactgtgccagttggagatatattgtccttctgctttctttgacatcatgattcacttaattgttcatcttgtcagagaaatcaaatgttgtggtcctgtttatttgcggtggatgtacccgattgagcaatacatgaagatcttaaaagggtataccaagaatctacatcgtccggaagcatctattgttgaaag

SEQ ID NO: 25645 - DNA, 2868 bp, Glycine max
  Peptide Sequence Number=SeqID_142423
atggcttctgtggcggcaccacctgtctcatgccagcactatcacaaactcacctttcataacagaaacacttggacacgtaaccacaacaacagcaacaacctttttcctccatttacggttccaaaatcttccctaacttctcacacaaaaacacactcacccattctccaacgccttcacaatctctgcgactccggaaacctcaacgatgccctcaacttgctccactcacacgcccaaaacggcaccgtttcctcttccgacatttcaaaagaagctattggcatcttactaagagcatgcggacaccacaaaaacatccatgttgggcgaaaagtgcacgctcttgtctccgcgtcgcataaactccgcaacgacgtcgttctcagcacccgcattatcgccatgtactccgcgtgtgggtccccttcggactctcgcggcgtcttcgacgccgcgaaggaaaaggacctgttcctctacaacgcgctcctcagcggctactcccgcaacgcgcttttccgcgacgcgatttcactgttcctcgagctgctctcggcgacggacctcgcgccggacaacttcacgctcccctgcgtggcgaaggcctgcgcgggtgtcgcggacgtggagctcggggaggcggtccacgcgctcgcgttgaaggctggtggtttctccgacgcgtttgtggggaacgcgctgatcgccatgtatgggaaatgtgggttcgtggaaagtgctgtcaaggtgtttgaaacaatgcggaatagaaacttggtttcgtggaactcggtgatgtatgcgtgttcggagaatgggggttttggagagtgttgtggtgtttttaagagactgttgatcagtgaggaagaaggtttggtgcctgatgttgcgacgatggtgacggtgattcctgcgtgtgctgcagttggggaagtgagaatgggaatggttgttcatggtttggcttttaaattggggattactgaggaagtgacggtgaataattcgctcgtggacatgtattcgaaatgcggttacttgggggaggcacgagctttgtttgatatgaatggtgggaagaatgttgtttcttggaatactataatttggggatactcgaaggaaggagattttcgtggagtgtttgagttgctgcaagagatgcagagggaagagaaggtgagagtgaatgaggtgacggtgttgaacgttctgccagcttgttcaggagagcatcagctgctgagtttgaaggaaattcatggttatgcttttaggcatggatttctgaaggatgaattggtggccaatgcttttgttgctgcctacgcaaaatgcagttccctggattgcgctgagcgtgtcttctgtggtatggaaggaaaaacagtgagctcttggaatgcactgatcggcgcccatgcacaaaatggttttcctgggaagtctttggatctgttccttgtgatgatggattctgggatggatcctgatcggtttactattggtagccttcttttagcttgtgcgcgtttgaaattcctacgttgtggcaaagagattcatggttttatgttgcgtaatggtttagaattggatgaatttattgggatatcgttgatgtcactttatattcagtgcagcagtatgttactagggaagttaatttttgataagatggaaaacaaaagtttagtatgctggaatgtgatgattactggcttttcacagaatgaacttccttgtgaggcccttgatacatttcgtcaaatgctatcgggtggaattaagcctcaagagattgctgtaacaggtgttctgggggcttgttcgcaggtgtcggcattgcggctggggaaagaagttcactcctttgcacttaaagctcatctctctgaggatgcctttgttacttgtgcattaatagacatgtatgctaaatgtggatgcatggaacaatctcagaacatttttgacagggtaaacgagaaggatgaagcagtatggaatgttataattgcaggatatgggattcatgggcatgggctgaaggctattgagctgtttgaattgatgcaaaataaaggcggcagaccagattcttttacatttctgggagtgctaattgcctgtaaccatgctggcttagtaacggaaggattaaaatatcttggtcagatgcagaatttgtatggcgtaaagccaaagttagagcattatgcatgtgtggtggatatgcttggccgagcagggcaactgactgaagctttaaagcttgtaaatgagatgccagacgaaccagattcagggatatggagttcattgctcagttcttgtaggaattatggggatttggaaattggagaggaagtttccaaaaagttattagagttggaaccaaataaagcagagaattatgtattgctgtcaaacttgtatgctggattaggaaaatgggatgaggtgagaaaggtacggcagagaatgaaggagaatggccttcataaagatgcaggctgcagttggattgaaataggaggaatggtttatagatttcttgttagtgatggatcactttcagaatcaaaaaagattcagcagacctggattaaattggagaaaaaaataagcaaaattggatataaacctgacacaagttgtgtgcttcatgaactggaagaagagggaaagattaagatacttaagagccacagcgagaagcttgcaatttcttttggtctgttaaatacggctaaagggacaacaagcgctttcatcatttcaaaaacggattgtgtacctgtggagatttctggtagttgggggactatgctagtttttaatgattattttcaatga

SEQ ID NO: 25646 - DNA, 366 bp, Glycine max
  Peptide Sequence Number=SeqID_142424
atggaggagtttgcccagggaagggtttggactggtaatgatgcagcttcacgtggtttagttgatgctattggtggtctttctcgagctattgccatagcaaaaatgaaggccgatatacctcaagacagacaggttacacttgtggagatgtctagagccaacccttctctacccgagattttgttaggcgtagggagttcccttgttgtagcagacagaacggtgaaggaactgctacagggcttgacattttcttatggagttcaagcccggatggatggaatcttgtttcagacattggaagaatatccttttggcaaccctattttgtcaataataaaagatatcatcagttccctgtag

SEQ ID NO: 25647 - DNA, 399 bp, Glycine max
  Peptide Sequence Number=SeqID_142425
atggaagagaaaagagaacgattaccagatatgtggtcagatgcacatagtcaagcacccaaggacccaaaacctcggctgcagccaatgaaggcctgtagttgtgacaggtgttcacccatgaataaagcacaccttgagacagaaggatgcaattccaatgtcacgcttgtcggagatgcatcacgcgttgtctacgtgaacttctcttacagaaaaagggcattgcgaggggtcgttgtggcaaccgataagagggtgacgcactggctgccaaacaagcccaacagtgggcatgggtacagttcacctacaaagaaagttgcgcatagacatgtctttgtgggggacattggtgaacatcatagcggaaagtggattttgaaggagagtaggtag

SEQ ID NO: 25648 - DNA, 963 bp, Glycine max
  Peptide Sequence Number=SeqID_142426
atgtcgaatctgttgtttctaccctcacctcccctcaccccctcctccattcacccctcccacacttcatcttccgcttctgcccttcaattccaatgccgattctcccttctctctcgtccccgccgccactctcccactctcactcccttccatagaagaagagacctttcccttctcgttttcggttccgattctccctccgacgcaaaaaccgaagaacaagtaaaggaaaatgaagacggcgttgatgatccgagtggtagtgtgatcgaggacgaggattatccgagcggtgaattcgacttcgaaccgattaccggatggagaagcttcctcgtcaagctcaagatgctcgtcgcgttcccttgggagcgtgttcgcaagggcagtgtcctcactatgaagcttcatggccaggtatctgatcaagtgaagagtaggttctctccaggactttctctgcctcaaatttgtgagaattttttgaaagcagcatatgatcctcgtatttctgggatctatcttcatattgatagtttaaattgcgggtggggtaaagtagaagaaattcgaaggcatatactggatttcaaaaaatcaggaaaatttgttttggcttatgtccctttatgtcaagaaaaagagtattaccttgcatctgcatgtgaagagatatacgccccacccagtgcctacttttctttatttggattgactgttcaagcctcattcctcagaggtattttagaaaacataggaattgaaccacaagtggaaaggattggaaaatacaaaagtgcaggagatcagctagctcgaagaaccatgtctgaagaaaattgtgagatgctgaccacattacttgataatatctatacaaattggttggataaagtctcttctgccaaaggaaaaacaagagaagatattgagaacttcataaatgaaggtgtttatcaa

SEQ ID NO: 25649 - DNA, 405 bp, Glycine max
  Peptide Sequence Number=SeqID_142427
atgggctgtttagctgaagcaagaccaggcacaaacaaggtcacagatttaatgaattccagccctcaacagcagcaccaacttaacacagatcatattgggcgtgggcccacacaaaaagaaagccatgcacaaccatgtggatcaaaagcacaaatagcgaatcatgaggcagattcagccaacattcagagggtagaggcaacagctttatgggatgtggcaaaagaaatgggagtcacttgtgggtcagcgcaaagggatttcgtggagaaactaatggaattggaggaaagggacaaaaaggaggcagagagattgagaaataggagaaaggttgtcgaggtgccatgggtggggagaaaatttacatggtttagactgaatgggtctgctagaagctaa

SEQ ID NO: 25650 - DNA, 399 bp, Glycine max
  Peptide Sequence Number=SeqID_142428
atgaagcttgacatcgaggacgcgacagaagacatgggaggggatgttggcagaggcagggagcggaaaatcgtgaaggtgttgctccaagtgtccctgagggaagtacacgacaacactccctttcttgggcaaggaaatcaatggacccgcgcaggcgtgccagagctcgaggcacacggtggaggaggagccagacgacggcatttcatcgtcttcggttgcgttgttgagatcgatgagaccagccatgaggagaagaatgagaaagaagagggaagaagagagagaagcaaagaagaaagagtggtgaggttgttgttcttcatgcctcctgctgctgcagctgctgcattttcagagagcgtgaccaactttggcattgccaaaagaagctga

SEQ ID NO: 25651 - DNA, 651 bp, Glycine max
  Peptide Sequence Number=SeqID_142429
atggagctcttcacattgcttccaatcgagtatattgaaccacttcctgcagggtcatcaactaagtttgcatttgaaaacttgcttgtgggtcaagctattccatcaaattttatccctgcaattgagaaaggtttcaaagaagctgccaactctggtgccttaattggacatccagttgaaaatcttcgagttgtcttgacagatggtgctgcccatgctgttgattccagtgaacttgcgtttaagttggcttctatctatgcttttagacagtgttatgcagcttccagaccggttatattagaacctgttatgcttgttgagctgaaagtaccaacagaatttcagggagctgttgctggtgacatcaacaagagaaaaggtgtgattgttggaaatgatcaggaaggagatgattctgttattactgctcatttagttatggttgacctatggagaaacaacagtagccttatcccactagatgaggtccctcttaacaatatgtttggatactctacagctcttcgctcaatgacacagggcaaaggtgaattcaccatggaatacaaggaacatttaccagtttctcatgatgtacagacgcaactgataaacacgtacaagggaaataaggaaggtgaataa

SEQ ID NO: 25652 - DNA, 1338 bp, Glycine max
  Peptide Sequence Number=SeqID_142430
atggtggacagggaggaggttgtggtggaaacaattcctgtccacatcgcatttatgagttatggcaagagatttggtcacacgaaggaccaacgccgaaccaaggccaaccaacaagctaaaactgtgactgttgttcggaattctaatatggtatcaagagcttgtactgtgagttctgtcaccttctctggcgtcaacaagttgagccagttattaagtctcattgtcttcaacgattcgtcatcaatccgcaaagtcggtcaagatttctctctgaagaagatcatgaagctggcattgagaatcatgagtatgaaatcattagagcaacaggatcaagtacttcttacgtggttgcaatcgacgctctccacgtcaattctttctcaagttctcggatctgctcattcatatgagcttaggactcagcttcaatccacgaggcttgctgaaaaatcaatgcacgagcatttgtcacagatcaaggctatcgttgactctcttgcttctgttgaagcgcttctacttgatcatgaatcgcacttgaataagttcaagcaatctctcgtggattctccttcagtgaacaatacgcacactcaaccggtgccaaacaagcaagaaccggaaagatttttcagttttcgtggcagatctagtctcggtggttgtttcggtagtggtttcaactgtaatggtggtcggcaaggcggcgccaacagtggtgctagcaatagtggtcgaggacgtgaaagctttgccaactatcagtgtcaggttaccaatgaagttctgcttcaaggtaaggttggtcctgatggtctttgcagcttctccaacattcaatttcagagtcctgtttctgcttcttctggatttgcttgtatttctagttctgataaatcttctgctacttcatgtattagttctaccaagtccaatcttccctcctcttctgaatctgtctacacttctcttgaattggtttatagtgatctatggggtccttcccatgtcacttccactaatggacttctctatcatataacatttgttgatgccttttctaggtttacttggatttatcttcttaaaagcaaagctgaatctctcactgtttttcaaaagtttaagactattgcagaattacagtttaattctaaaatagtcttcaaactgattgaggagcaaaaatcaagtagtattatatataactcagtactagaggtactgaggagaacagcatatgattacaatggcaaaactatgccaaaccccactacattagaacaaaatacccagcagttgaagaaaaaggacaacaataacccctag

SEQ ID NO: 25653 - DNA, 954 bp, Glycine max
  Peptide Sequence Number=SeqID_142431
atgacagaggcacaatctatctcatctcctatggcttccagctgcaaactcaccaaaattggctcggatctgttttctgaccccactctatacagatctgtgataggtgctttccaatacttaattatcactagacctgaattaagctattcagtcaacaaggtttgccaattcatggccaatctcttagaatctcactgggttgctgtaaaaagaatcctaaggtacttaaagggaactgttttacatggtcttcatctcagaccggctatcttgggtcaatcctattttattagagttctctgtgatgctgactgggaatctcatgttgatgacagaagattaacttctgtggctgcagtttatcttggccctcatctcatatcttggtggtcctgtaagcagcaagttgttgccagatccagcactgaggcagaatatcgtagcttagctcagatcactgcaaaaatctcatggactcagacactcttaactgaactaaaagttccattcagcactcctattgtatcctgtgacaatcaaagtgcagttgccattgctcacaatctagtcttccatgcaaaaacaaagcatatggagcttgatcttttctttgttcgtgcgaaggttttgaccaagcagcttatagttcagcatgtccaggctcttgatcaacgggcagatgcacttaccaagccactgtctcccaccagatctgcttttctgaggaccaaactaatgttgaggcttcttcaaagtctcaaccaccttgagtttgagggggggtctataaataccagactgtactacactgtgaagtggcttaatatcatttttcattctctgttgattctctcttttctctcaaaatatctttcttatgattctgttagaattataatagcagggcagtcgctaggcaaaggaaaagaaaagatgggaaatggaagctga

SEQ ID NO: 25654 - DNA, 435 bp, Glycine max
  Peptide Sequence Number=SeqID_142432
atggaattttcaatgagtcctggaattttcaatgagtccaagttcccctatgttgatatgtttgaaaattctactcctgtcagtcagtctacttcctcatccataccctttcagtttccctccattcctatagttcaatctccaaatttatcccaacctacttctactccctcccaacctactcaaactcatatctcatccacttctgtccattcccattcttctgatgctgatcactccccttctgtgtctgcacaatcatctcctattcatcagcctgctcagtctaaaatagaaatacctacctctaatccaacacagttgtctgagcataacactacagatcagtctcctcctattactgatgtttctgttccagaaaagaagcctatattcctaaattcttgtccaacagaaaccatctttgagatttaa

SEQ ID NO: 25655 - DNA, 444 bp, Glycine max
  Peptide Sequence Number=SeqID_142433
atggcacgcgtatcccggtcctcccccccgcgcctcctctactccctctgctgcaccactgcatcgcggtcaccggcgtcgtccctcatcggcggcgccttccatctccgccacttttcagccgggaacgcggcgcgcacgaagccggacaaggagccgtggtggaaggagtcaatggagcggctccgcaacatcggaatctcggcgcacatcgactccgggaagacaactctgacggagcgggttctgtactacactggtcggatccacgaaatccacgaggtcaggggcagggacggcgtcggcgccaagatggactccatggacttggagagggagaagggaatcaccattcagtctgctgccacctactgcacttggaaagattataagtttaacaaacatgcccttagacatggaggtaatgaggttttgaagaaatag

SEQ ID NO: 25656 - DNA, 819 bp, Glycine max
  Peptide Sequence Number=SeqID_142434
atggcttccaattccgattctatcttaattgttgatttttgctgttcattagcttgtaccgttgattttggtttcaaggtcggcaacagaatcataaggaagaggattcacgtgcgtgtggagcatgttatgccatcgaggtgcactgaggagttccgccttaggaaaatcaagaatgatcagctcaaggctgaggtcaaggccaagggtgagaagatcagcaccaagagacagcctcagggtcccaaacctggtttcatggtcgagggggcaacgttggagacagttacccctattccctatgatgtcgtcaatgacctcaagggagaaggaaagctaaaagggggcataaatcaagaaggagtcaaatattacaacagcctcatcaacgaactaatagctaacgctgctgaaccaatagctggctatgccttgggtcttttgcttctgcttctaggttttatgttgcctcccagtgatggtattggtgttgttgttgatgcttctgtgtttcacgagtcgtttcttgatggcggtattggtggtcactgcaaggaggttcgtgctcacaaggtgctcaaggtggtgaatttcagtccgttgggcgacgatacttatttatccgtttcaaatgttacattgggatttgatgtggacaagtatacgagcttggcttttggattttcaaagagctctctcaaaaatgtgcaggatgctcagggtactatggttatcaaagggaatttggttgttaggggattgggtgaaacacagcaagattacagttacacaagtgatggatacttctattctaggaaa

SEQ ID NO: 25657 - DNA, 1464 bp, Glycine max
  Peptide Sequence Number=SeqID_142435
atgttgcagatgtttagggactgcaacgttcatgactctctccgagaaatgcatgctagggttttgacagacggatccaccttattcatcgttttcacgacaacgacactagatctggtcgtcgccagagaatttctccagttacatatgcttgagttccaatgtggcgggtgtcgtgcgactttggaagaggtaggaagtgctccttcttttcctttttgcttcaggagttgttcgttaaccgttgaagacttttgcttcgcacaaacggcgccaatgttcggtaaggttggtggaatggcctccggcatggcggacccaggggcttccaggtggaagaatctgttgagggcatgttgccacgtgggtagagccactgtgtcggtattccacgactctcttgatatggagatggcatgtctcagtgcctggactcaagcatgtgcatcaacaactgctgtcaaaattgtgattccagctggcacatatcaaatgggtgcagttgatgtaaaaggtccttgcaaggctcctattgaggttcaagttgatggaacaattcaagcacctacaaacgtagttaaccttaagggggcagaccaatggttaaaggttcaacatgttaactctttcaccctgtcagggaaaggagtttttgatggtcaaggtccaactgcttggaaacaaaatgattgtacaacaaacaagaactgcaagatgctttgcatgaatttcggttttaatttcctcaataattcaattgtccgtgaccttacttccaaggatagcaaaaactttcatgtgaatgttttggggtgcaacaatatgacatttgatgggtttaaaattagtgccccagcagagagtcccaacaccgatgggatccacattggaagatccacagatgtgaaggttcttaatacaaacattgctactggagatgactgtatctcattgggtgatggtaacaaaaatataactgtccaaaatgtgaactgtggacctggtcatggcattagtgttggaagccttgggaggtacgataatgaagaggccgttgaaggtcttctagttaagaattgcactttgaacaatacagataacggtctgaggattaagacttggcctagcacgccattaacaattacagttactgatatgcattttgaagatattaccatggaaaatgtttcgaaccctgtgatcatagaccaagagtattgtccatggaaccagtgctccaaaaagaatccgtcaaaaatcaagataagcaaggtttccttcaaaaacattaagggcacttcaggaactaaagaaggagtgatttttatttgtagtagtgttgcaccatgtgagggtgtagagatgactgatgttgatctcacattcaatggagctgcaacaacagctaaatgtgctaacgtcaagcccgtaataacaggaaaagctcctacttgtgcagcctag

SEQ ID NO: 25658 - DNA, 137 bp, Glycine max
  Peptide Sequence Number=SeqID_142436
ggaggcattgagactaatgcagacggtattatagagaaaccatttttgtggggtaggtacgctttggaaatgtctgttgttgtttacaaggattgggttttcactgatcaagcattccccaatgatcttgtcaagag

SEQ ID NO: 25659 - DNA, 134 bp, Glycine max
  Peptide Sequence Number=SeqID_142437
gtgttgatggaggtggagaagagatagatgtagatttacttaaacaaccagacttggttgaactagacgaggatggatgcatattaggtgtgaatgagattgagagtgattttgatgatacaaatacttcttag

SEQ ID NO: 25660 - DNA, 135 bp, Glycine max
  Peptide Sequence Number=SeqID_142438
atgaggtcttgttttgaggacttggactggtttgaggacttggttgattttgttgatattggagagtcttgccaagtctatgtggtgtttgttttcatgggtgctctgagagtaaacagtaccccagacacttga

SEQ ID NO: 25661 - DNA, 300 bp, Glycine max
  Peptide Sequence Number=SeqID_142439
aaatcacttccattcaagaataaagatccaggaagctttaccattccatgctcaattgggaatctatctgtaggtaaagcattgtcggattggagagcaagcattagtcttataccactcttaatgctaagtaaagttggatatgtggagattaaacccacaaggatgacacatcaattagctaacagattaatcaaagttccatatggggtggtggaagatgtgctagtgaaggtggataaatttgttagttggatcaagaatctagaagggtgggaaataaattcctcaactttttaa

SEQ ID NO: 25662 - DNA, 387 bp, Glycine max
  Peptide Sequence Number=SeqID_142440
atggactcgtcctcctcctcgggcacgggctattgggctgcagaggccttaccccctcccgaaggagaaggatggactcctggccaagccacctggctaatgaacttgtccatactcatgataggctgcaggcctgagctctataggctctgcagcatggcaagtaaagtcttggagttgaatgcggagggtccagaagaaactagggctgaagctggagctggtaaagatgaaaccagagcagatggagctgtagtagaagtagaagaagctgaggtagggagagcagaagatggtggagccttagacctcttgcccttagccttttggggtccccgaaaagtgaccgaggggtcatcaaggttccaacagtttttcttcacataa

SEQ ID NO: 25663 - DNA, 891 bp, Glycine max
  Peptide Sequence Number=SeqID_142441
atggttgatatgtctttgaattcatctgacgatagctcaagtagcatagattctgaattggatgattatgacgatttaatgaatttagtgttagttatgaccatcatggaatgtgaacagagttttattgataaaactccatgtaggacatctatgttgaccggaaaagtgtataccagagaattcttagtaggtcatgaaacaagatgttatgagaactttcggatgaagaaagatgtatttatgaaattttgtgaaagtttaaaggaagttggtaatttatgtgatggtaagaaagtcagcatagaggaagccgttgcaatgttcttgattagaatatgtcataacttgcgtcattgggtagttactgaacggtttcaacattcattgcacacggtgaacaagtggttctggattatcctaaaagcagtttgcaagctaggcacgggcataatccatcaaataaatcaaacaagtacgcatcctcatattaggggcaatccaaaatactacctatacttcaaggattgcattggtgccattgatggaacacatgtatcttcttgggctcgtgcttctaaacaaactgcttttcatggaagaaaagtgttggtgacacaaaatgtattaactgtgtgtgattttgatatgcttttcacatttgtttattctggttgggaagggacgacaaacgattcaaaggtattcttggatgctttatctcccgaaaataatttcccaaagcctaatggagatcaattctatttggtcgactctggatttcctaacatgccaagctatcttgcccctttcagaaggaacaaatatcatttgcgcgattttcgtgaaggatgtggacgtccacgtggaaaagaagaattattcaattaa

SEQ ID NO: 25664 - DNA, 192 bp, Glycine max
  Peptide Sequence Number=SeqID_142442
atgaagaagatcctaggcctacaagctccaatggagcttacatcacaagctgttaaaggtagtcaacaagttctagactacttcatcaagcaagcgtccgctaagcacaacactcattggctaagtgcgaggaagaatctggaagaagatgagctgtacaggttcgctgagcgcactgcttcatcttactaa

SEQ ID NO: 25665 - DNA, 858 bp, Glycine max
  Peptide Sequence Number=SeqID_142443
atgggaggaaaaaatgagaagggtgaagttatggagtggtcagttgtaaacacaaagactttcattgaaaaattttatgagagagtgaaaaatgggcaattacaagggtcaatcttcaaaactaccacatgggaagaaattaacaaggacttgtttgagatgatccaaactaattatggtgtggacaagctaaagtctaagtttaatcgtttgagacaaatgcatcgtgatttttcaactttgctagcccgtaccagagtcacttgggaaatggaatccaacgaagggaatgcccctgatgaagtatgggacgaattgattaagaaaggaatacattacaagaatttcaagaaacatggttttgagtacgactatgatatcctcgagccaccaaattctgatgaggagagagccatggaagttgatttccttacaaatgggattcatattaatgtttccgatgatgagaaggatgatatcaaagggcttaggcacaaaatgaaggaaatattttcttcgggtgaacgtcatcgtaaagagggaaaaacttctaacaaagagatgttagacaaaattgtaagcatatggagtgattcaatgagccaaaggacaacaacttcaagagctagagaagagcgatataagggaaagacttctcaagcttctcaagctactaatccaataagtgatccttattcagcaaaggcatgtgtggaactgttgtacaacatgcaagatgttcccacttcagcttactttaagttgatggagaagtttacaagtcagcattggaggcaaatgttcatagtgatggatgcaaagcgaaggaagcaattgatagaatctcttactaagtag

SEQ ID NO: 25666 - DNA, 534 bp, Glycine max
  Peptide Sequence Number=SeqID_142444
atggacaaaggtcaatggatgtatgatagtataatgtctaaagaagttgatatggatgatgaaaatgaacacgaatctagtgtgaatgaagaacaacatgttgattgtttagatgcgttcaatacttctcaggtgtttactacccgagatgatgttttaccgtgggcagatgaaaacagatttgtggcggtgattatgaggtcaaacacacactgggttcatgggaaaccaatggttagagggcaaggttggatgttgaagttgatgtgtgagagtcataatcatgaattgaccaagttattagttggacatccatacgttgggcgattgactaaggatgagaagaaaattattgctgatatgacaaagtcaatgatgaaaccaagaaacattctactaacgttgaaggagcacaatgccaatagttgtacaacaatcaaacaaatatacaatgcaagaaatgcatatcgttcttccattagaagaagtgatagtgaaatgccacatctaatgaagtttcttgaacgagattag

SEQ ID NO: 25667 - DNA, 1333 bp, Glycine max
  Peptide Sequence Number=SeqID_142445
atgagggcgagccgtggtgcagcggtaaagttgtgccttggtgacttgttggtcatgagttcgaatccggaaacagcctctttgcatatgcaagggcaaggctgcgtacaatatccttcccccataccttcgcatagcgaagagcctctgggcaatgggtattcattcacttcaaactcaatggctaaagaaggtcatagaattgccataggaatcaatctgggaacaacttactcatgtgttgcagtatggcgggagcatcaccgtcgagtggagataatccacaatgatcagggcaacactaggagtgaagcaactgttggacaagctgttatggcattcaaggttgttgccggtactaatgacaaacctatgatcatccttaactacaaggaagcgtttttggagaaacatgcaaagaatgaagtggttactgtgcctgcctatttcaatgattctcagtataaagctaccatagatgctggaaaaattgcaggcctaaatattctgcggataatcaatgaacccgttgctgcggcaatcatgcatggtcttgacatgaggactaataattgtgttggagagcgaaacattttcatctttgaccttggtggtggtacttttgatgcgtctctccttactcttaagggtaagatctttaaagttaaggccacagctggaaatggtcaccttgggggagaggacattgataatagaatgctggaccattttgtaaaggagatcaaaagaaaaaaaaaagtggacattagtgggaacctgaaggtgctgaggaggttaaaaaccacgtgcgagagggcaaaaagaacactctcacatgctgttactaccaacattgaagtagatgctttatctgatgccattgacttctgttcttcgatcactcgtgcaaagtttgaggaaatcaatatggagctctttaaggagtgtatggagacagtggataagtgtcttactgattctaagatgaacaagagcagtgtacatgatgttatccttgttgtggttcttcaaggattcccaaagtgcaagagctattgcaggacttttccaacggaaaggatctgtgaaagagcatcaaccctgatgaagctactgtcaagggaagaaattaatagaatgattcaagaagcagaggaataccaagctgaagataagaaattccttaggaaggccactgcaatgaataaattgaatgattatgttaacaagatgaacaatgggttggaaaatgaaaatttaagttcaaaactctgctcagaagacaaggagaagataagttctgcaattacaaaggccacaaagttgattgatg

SEQ ID NO: 25668 - DNA, 444 bp, Glycine max
  Peptide Sequence Number=SeqID_142446
atggctgcagaagactacacttttgggccttacaagatacaccacactgaagtgttctactccaccaatctctcttacgccatggttaacctgcgtcctcttctccctgttaagcgtttcgttgatctcactgctgatgagacttctgatttatggctcactgcacaaaaagttggtaagcagcttgagagctaccataaggcttcatcacttactcttgctatccaagatgggccccaagcaggacagatggtaccgcatgttcacattcatcttatccctcggaaaagtggtgattttgagaagaatgacgagatatatgatgcaatagatgagaaggagaaggaattgaaacaaaaacttgacttggacaaggagaggaaagacagaagccttgaagatatgagtcaagaggccgatgaatacagaaagcttttcttataa

SEQ ID NO: 25669 - DNA, 126 bp, Glycine max
  Peptide Sequence Number=SeqID_142447
atggagaattggcgaaaagcgctagccaaggacattcgcggggctccagactcgaagcgttacgcaagaacttcgcggggatccagactcgaaggtggaggacacatgaacagcgctaggcaatga

SEQ ID NO: 25670 - DNA, 186 bp, Glycine max
  Peptide Sequence Number=SeqID_142448
atgaatgaagaggtccaagtacattatgccatctcaaaaatagacctaaagtgggacccacatggagcatctcagcaccgggtcaaggttatccttgcaactgataagttccatattctgctatcctcaacttatgaatctgcaaatacttggctttctgcaaaggagcaattcgtgtggccttaa

SEQ ID NO: 25671 - DNA, 168 bp, Glycine max
  Peptide Sequence Number=SeqID_142449
atgtcgacttacgtacgtctcgttgaccaaacgatcagtctcaacgtcctcgttgagagtcgctctgcgagacgtccagtagtctctgacttggtcttagaatcgtcagtttcagcccgttcccagcttgcctcgctctcaggttggcccttctacttgactaagtag

SEQ ID NO: 25672 - DNA, 927 bp, Glycine max
  Peptide Sequence Number=SeqID_142450
atggggtatgtgagatgtatttctgagcatggagtgtatgtgaagtcagggggtggtgatatagtaatactatgcctctatgttgatgatttgttggttactggaaacaatgaaactaagaaaaagtatgtttctgatgtactgaagagattcaatatgcaacactgtaatggtgctgcaacaccagcagaagcaggattatggcttgataaaaatgttgatgagccagaagttgatgctactgagtttagacaggtggttggggcactgagatatctctgcaacaccagacctgatattgctttcagtgtaggtctgattagcagagttatggacagacctagaacatctcaccttgctgctgcaaaacgaattctaagatatgtcaaagacactatggcatatggaattcttctacctagtaaatgcagagaaaatgagaaaggtctctatggtttcactgatgcagattggggtggtgataaaactgatagaaagagcactgctggctctgtatttcttcttggatcaggtcccatttcctggagttcaaagaaggaatctgttgtggcattgtcctcatgtgaagctgagtatattgcagcttcaatgggaggttgtcaggccatctggttggataatttgatgcaggaactaatgataaaaaaggaaagtgttgtggagctatttgtggacaacaaatctgcaattagcttggccaaacatccagtagcacatggcagatccaaacacatagagactcgttatcatttcttgagagatcaagtcaccaaagggagattgaagctgagctattgcagaactgatatgcaggtagcagatatcttcaccaaggcagtgaagagagaaacttttaagaagctgaggaacattctgaatgttgttgactgtaatgaatttgtttag

SEQ ID NO: 25673 - DNA, 336 bp, Glycine max
  Peptide Sequence Number=SeqID_142451
agcttcaacattcaatttcgagcgtctcgatatcttacaggactcaatcagacatccgagaaaaaagttattgtcgtttgaattagctcagagaggttcaacattcaatttcgagcgtctcgatatgttacggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 25674 - DNA, 189 bp, Glycine max
  Peptide Sequence Number=SeqID_142452
atggataccaatgacagcttgcgggtggcaagtttatggcactcaatgcatgctatctctcagcagttatcacctgtttcaggttgtttaggaattgaacttctccaagcagatacatttgatcttcattgctttcaatcactgacaggtagcagtagaatgactaggtttcaattaaatatggtttga

SEQ ID NO: 25675 - DNA, 2036 bp, Glycine max
  Peptide Sequence Number=SeqID_142453
atggctgatgaaactagaaagaggcttgggtttcttttgggtgagaagggtgttggtcctgcacccaaattggcccactcctatgagcaccagcaaaatcatagaactggagaaaagaagagaagcaacaggccgaaaaactacaacgaagctatgagagagaagatgggtgggcgacttgtggaggaagaaaaatgttggatcatacaatccaacaagttggctcgaggttctgatcacaagtctcttcactcaaaggaggaaggaggcatatgtctcaccttccccacctcatactatagtggaagctggtacccttgtgcactaggctttccattagacaaaactcacattcatgagcctttccttttatcattcacagatgtgatgtataaaaagagtaagttaccaccaggtgttatggagatatcattgttaaaaatgatcgtaaatggaatgtcctcatttttgcatttatctttttctggaaacatgaactctgaacctgtctcaaagtattaccagaaggcagaggagatacataagttgttgaagccaatcattgatgcaattgttaatcctgagttagcttctgatgaagtgcttaataagatattggaagaaattggttttgctgttaatgagttaaaggagcatgttgagaactggcacctattatctagcaaagtatactttttaagtggttttacttttggaaaaccaaaggttcaggatcctaatgattcagaagacatgatggttatgcaagttgaacccctgatatcaagaattcgcacttcagggctcaatattttccagcagctgaaggattctcagcattgtctccctgatgaattaagttctgaatatttacagctctgttcacaaaaacttaagcttttgggacatgaagaaatctccccagtcattaaggaagctattacagaacacttggaaaatgtaggacccagttcagagctcctgacaaaaatagctgatagcctgggcctaaggtctaatcaggaggttcttattgaggcagtggccctcgaaaggttgaaggagaatgctgaacaaactgaaaagactgcagaagctgaattcattgatcaaatgattgctgttgtaacgcgaatgcatgagcgtcttgttatgcttaaacaagcccagagtagcagcccagtttcaatacctgctgatttttgttgtcctctttctttggagttgatgactgatcccgtgattgtggcatcagggcaaacatatgagcgagctttcatcaagaactggattgatcttgggcttactgtttgtccaaagacacgtcagactctggttcatacccacttaatacctaattatactgtaaaagcactaattgcaaattggtgtgaatcaaacaatgtgcaactggttgatcccacaaaatccacaaatttaaatcaagcatctgtccttcatggttatatggaatctggtacaaccagggaatcacctgtttttgctcattccaggagcaaccagccatcctcacctgagtcagcacgttcttgttcttttagttcaccagctaataacttaacttctggtggaactcagcgagagggaacatcacctttgcatccccgttcaacttcagaaggctccttcagaggtatggttaatgggcaatatatggatcttgctagaatatctcctgaaggtttggatgacaggtctgctagctcagatgaaagcagtgtggattcagctagccatccatcaatgtcaccatctagaagggaatcttccagtgccttcagctctgaacaatctcaaacccatattagagctgtttctgattccagtgcactttctaatgcaaattttccccaagaaacacaagatgatgacaacaatgctcctcagctgtcaacaagtgcagggcacagtagagaagcttctggtgaattaaatccagggacagaaactggtggtactactgccgtgccatcagtgcatagagaacctgagttcccactccgattggagacaag

SEQ ID NO: 25676 - DNA, 204 bp, Glycine max
  Peptide Sequence Number=SeqID_142454
atgtcttccaaggttggccttgtgttgatgtcactcccaagtataaaacttgagttgaatgtcacaagtacaaagtatgatgtcccaaatcaattctatgtgattgatttgtgcagtgggcagatagacaaaaatcagcaaattgaaaatataaaactcaagaagtatataaatatatttacattcatcgataaactcatttaa

SEQ ID NO: 25677 - DNA, 342 bp, Glycine max
  Peptide Sequence Number=SeqID_142455
atgtttccatgtaagcaatttcagattcacagtgaatccgaggcgccggatcaggcaacacaatggggagattgggtgtggagcttggagaacgaggaagaggaggccttgggagatggttttgtgtatctatggcttcccaacaaatgtctctgctcttcaggtttgaatctgatcttgctttcctttgaatgggcatggcagcaccctgttgaatcattggcggtaaggaaggcagctgtggagtttaaatccctctcaggaattgccaacaagattaaacttgcatacacaatgctcacccttccatcctggcagaggtatggtctctatctctattga

SEQ ID NO: 25678 - DNA, 371 bp, Glycine max
  Peptide Sequence Number=SeqID_142456
gggttcgcagtacttgctttatgcctttccttctgactttcctgagcggggaaggatagcaaatggacggaccgtggggtgggcatgcctctacgatagcccaaagagaaagtcaaccattaccgaccgacttaaaggaatggacaggacgatcgatgtgaggcctaggccaagtcagtaccacgtgcaccacccagacaggacggaagctatagtcataacatcgccgaaaacaaccatcgactggcaagatactgcccgggagcagaaagagtcagggggtgaagcctacgctagcatgcctaccgcccccactctctactattggtggctaataggccccttcgcgtatcctgtcttttggttggcca

SEQ ID NO: 25679 - DNA, 471 bp, Glycine max
  Peptide Sequence Number=SeqID_142457
atgggaacaaatcaaaccggcaagaggttttaccaagtcaaggttaaaggcctagataccactagcatcaaggaattagggcggttgatggaacctctccaaatgcaagcctttcgcaagacttacggaaagatcttagagttgaccatagcagaggtatccgtagaagccattgcgtcactcacccaatactacgaccagcctttgagatgcttcacgttcggagacttccaattggtaccaaccattgaagaatttgaggaaattctaggatgtcctctcgagggaagaaaaccatacctttcctccgggtgtctcccctctttgagcagaattgcaactgtggtcaaggattcagcgagaggtgcgaaaagagtagcgcacggatcatctgttgcttacccgccctctgtgtttggttggtttcacacttgttccaacaagacacaagacatccatgtccgctcctga

SEQ ID NO: 25680 - DNA, 450 bp, Glycine max
  Peptide Sequence Number=SeqID_142458
ggttactgttgtgagggagtgtgttctaggggacatcccttttagaaaatacagatttgttggatttgcagatgttgtggttggccagtttgaacatggactattggttgatgttattggtcttgtggaggaggttgtctttcggcaagtttcaggaaaaggtagaagggtagttttcaaattaaaggacttgagccagcaattgctatcttgcactttgcgggatgattattgcttgcagtttgtgaacttcttagatgattatgaaggtgatggtccaattacagttctattaagccattgtaggatcaaggaagcgcagggatcttatcccgcatcgatcaacaattctctcaaggcttcaaagttaattattaaccagcccgtgatggatattcaagaattcaatgaacgatattttttgcttgcagagttgggcattgaggcccg

SEQ ID NO: 25681 - DNA, 387 bp, Glycine max
  Peptide Sequence Number=SeqID_142459
atgccacccaccaggcaccctctggacccggataagtctaacagggctctggggttttcggtgctgatcacgggcctctgccagttattcagggttcccgtcacccccagcaggcgtagggtgatgcacatcgggccgcaccaggggcaggtgcagatacatgagtgtctctaccggttcagcctcagtcagcaagggcagggtttcgctccttttgcatgccctactccagaacagtttggggctgaggtcacatggcccggagactggcccgaggcccaggcaggggaagagcccgcaggatcccccggtgaggcagaggaggcccgtatggatgaggatatgactgacttgcttggtttcttgggaggaagcggagccacgtga

SEQ ID NO: 25682 - DNA, 467 bp, Glycine max
  Peptide Sequence Number=SeqID_142460
ctgagcggggcgaagccagaggaaactctggtggaggcccgcagcgatactgacgtgcaaatcgttcgtctgacttgggacggtgcggctgctctgttgaggccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcac

SEQ ID NO: 25683 - DNA, 489 bp, Glycine max
  Peptide Sequence Number=SeqID_142461
atggatcaagaaaaggttcaagcagtcttgaattggccatatcctataaatctgaagcaattgagaggcttcctcggtctgactggatactacaggaaatttatcaaaggttatgtgtcaatcgcaactcctttatccaatctgttgaagaaggaaaactttcattggaatgaccacacttccatggcttttgacaatttgaaagctgcaattaccaaggcaccagtactggcattgcctgatttttccaaagcctttacattggaaactgatgcctctggtataggcattagggctgtattgagtcaggaacaacacccaatagcttttttctctaagaatctcacacctaggatgcaaagacagtcagcttatataagggagtcctatgctatcatagaagcagttgcaaaattcagacattatttacttgggcaccgatttgtgatcaaaactgaccaaagaagcctcaagtcactcactgagtaa

SEQ ID NO: 25684 - DNA, 821 bp, Glycine max
  Peptide Sequence Number=SeqID_142462
cgtgcgccgatggcccatgcggtggttggcggtctcatcagttccacgctgctgaccctgatcgtggcgcaaccttcccaaaagcagctggcctgaaaaggccggctagacatcaatctggccgggccatgggaaggcgctatcgccttcccatcattccgaatcgcgcctgtcgttacctcagcaacagaatcgtagccgggccagccagaagcaaagcgatggcaataatcggtcatgcggaaggaaggaatgcgcggcagatgcggttaccgtctctcaccgctctgacgcttctttttccccttcgggcgaaaatcgacaagaagcgacttcagttcgatatcacgaacgcgcctggccgcctcatcagggcgcacccattccagcaggcgttcaccgcgttccttgaaactggtttccgcctccgtcacctctatctggaatacatcgaccatgcagggaacgacatcgccattgtcgagcatcttgagataggtatagcggccaaccacattctttttcacccggccgcgcacgcccgcctcctcccacgcctcgattgccgccgcctcgtgcggcttcttgcgtttcatcggccagccgcgcggaatgatccagcgtccgctggtgcgggacgtgacaaggaggatttcgacatcctcgccattgccggcataacggaagcaaagcgcggcatattgttgccggaaagcgcctgtgaagagcttttccggaaccgcagcaagctgctggagcaatgtcagtgcacgagtcgggcgggttttccggcttttcttggtgggtttcatatccgttga

SEQ ID NO: 25685 - DNA, 648 bp, Glycine max
  Peptide Sequence Number=SeqID_142463
aggactacacgtccacgccttgagtgggctgcatgccctcgccttcagagggctgcacgcctttaccgtcagaggactatacatcctaaccttcagaggactgcatatcgtcaccctcagagggctacatgccctcaccttcagaggactacacgtcctcgccttaaaagggctgcacgccctctccttcagatggctacacgccctcaccatcagaggactatacgtactcacctccagaggactacacgtcctcgccttcagaggactacacgtcctcaccttcagagggcttcacgccctcgccttcagagggttacatgcccacgccgtcagaggactatatgtcctcgcatttacaggactacacgtcttcgccttcagaggactacacgtcctcaccatcatagggctacataccctagccttcagaggactacacgtcctcaccttcagagggctacacaccctcgccatcagaggactgcacgtcctccccttcgtagggctacacgccctcaccctttagaggactacacgtcctcgccttcagaggacttgccgtcctcgccttcaaagaactacacgtcctcccctttagaggactacaggtcctcgccttcagaggtctacacgtccttgccttaa

SEQ ID NO: 25686 - DNA, 300 bp, Glycine max
  Peptide Sequence Number=SeqID_142464
atgtttcgatcgcacacaaacggagaattatctctaaaaaatcttaatgaagaagttacactttcaggatgggtacaaactatccgtgataaaggatttatgatttggatagatcttcgggatcgttacggaattacacaattggttttagaccaggatcgctcttcagctcaattaatggaagaagctaaaaaactgggacgtgaatttgtgattcaggttaccggaaaagtaattgagagagtaagcaaaaatcctaatattccaaccggagaaattgaaattttagttgaaaactaa

SEQ ID NO: 25687 - DNA, 234 bp, Glycine max
  Peptide Sequence Number=SeqID_142465
accaatcgagctttcatcaagaagttctgcgtctccaggcaggcgcagggcgaaacaccacagcagcctggcgatggccggcagcgggcaacagatgcaccgccatcacctctagagttcacctctgctcatccacaaaaaggtttgagtattgcctacaccacatggccgaccaataggcgaccaagtccaaagccaaaggtagagatataccttagatgtgcgtgtatgtaa

SEQ ID NO: 25688 - DNA, 354 bp, Glycine max
  Peptide Sequence Number=SeqID_142466
atgaccaaacctggtctctgcgtgccatcggacacgactgtgtctgaatggcaaaggggtgcggataaccgtaaggtatctccgcgtatcataatgaccaaacttggtctctgcgtgccatcggacacgactgtgtctgaatggcaaaggggtgcggataaccgtaaggtatctccgcgtatcataatgaccaaacttggtctctgcgtgccatcggacacgactgtgtctgaatggcaaaggggtgcggataaccgtaaggtatctccgcgtatcataatgaccaaacttggtctctgcgtgccatcggacacgactgtgtctgaacggcaaaggggtgcggataaccgtaag

SEQ ID NO: 25689 - DNA, 174 bp, Glycine max
  Peptide Sequence Number=SeqID_142467
atggagaattggcgaacagcgctacacaataacttcgcggggctccagactccgctaggaaatgacattcatggggctccgcaaaaaggcgaggatggagaattgcacaaagcaatcactacgcatagctccaaactcgtatgtggaggacacatgaacaacgctaggcaatga

SEQ ID NO: 25690 - DNA, 795 bp, Glycine max
  Peptide Sequence Number=SeqID_142468
atgaatacattatccattaaccacctgagccttacctataaaaatggcttccaggcaattaaagacatttcattggaaataggaaatggcatgttcggtttactgggtccgaacggagccggaaaatcctctttaatgaaaaccatcgttggcctccagaaaccgagttcgggaaatattattttcaatggtattgatatttccagagagcctgattttataagacaaaacctcgggttcttaccacaggattttggagtttatcctaaagtttcagcttacgacttattgcatcacattgctatcttaaagggaataaaagacgatacctttcgaaaaagacagatttccggactgctggaaaaagctttattaggaaaccctaaaatcattattgtggacgaacctacggcaggactggatcctgaagaacgcaaccgttttaattctttactcaatgatatcagcaaggatgttattgtgatcctttctactcatcttgtagaagatgtccggaatttatgttctgagatggctattatcaataaaggaaagcttatccgaaaagggaaacccggtgacctgatttcagaattagaacataaaatctggtcaaaacggatcaacagaaatgaatgggaggattatcaggcaactcatgagatcatcagccaacagctgatcgaaagggaactgtatatcacgactttcgcagcccatcaaccaaaagatttcaatgctgttcctcctcttttggaacatgtatacttttatagcctcactcaaaaaccataa

SEQ ID NO: 25691 - DNA, 567 bp, Glycine max
  Peptide Sequence Number=SeqID_142469
atgttgactcgcttagcgagtccatgcgctaagcgagtcattcgaaactgccaacaaataaggcaattgcctcaggccggttatgatggatcaagatttgtatcacaggaagcctgggaccgttactcaaataatgtgcttgccaggaacattttgcgagaaagaaatgtcaagctacatatcaatgagtttgatgatttcagaagacaattgattcgaagaaagtggcataaacaactgaccaacttgacagagggaagcattgaggtggcaattgtgaaggaattctatgcaaatctatatgtccctgaggacaagtttcccaaacaagttagggttcgatggcacttgataaaatttgatgctgattccttcaacacctttttagagactctagtggtcatggagcaaggggagagcttgccctcttactccaggtttgctagactgaggcatgatcctcaggagcttgcagctcggttgtgtatccttgggaggggatttgttcttaatgccgagggtctgtcgtggaagctcttgatgaaagatcttaccactctggcctaa

SEQ ID NO: 25692 - DNA, 225 bp, Glycine max
  Peptide Sequence Number=SeqID_142470
atggttgaaactagccaaataaacactaaaagaggtgtgaaagataaggctcccaacacacttccaatgaaaggcctttttgttacaaaacttgaaagcaatgaagctcttaaggtggttggccccttgcttctggactcaaattcttcaagggatggcaccaatcctccttccaattccctatatggcaacccacaaacaaggaaacaaagagacaagcaataa

SEQ ID NO: 25693 - DNA, 926 bp, Glycine max
  Peptide Sequence Number=SeqID_142471
ggttctatccctcattagctagaatttcaaagatagtccaaatctcagcgcaggaattagaccatggaaagcaagtcagaaatggggtggttggaataccgagaaaatgttcggaggcaaaagcaagaaccttggcaggtagaggtgaatgggccccgttcatagacattctcgcactgttgatctttggaggagtcctctttccaaatgtggatgggttggtggatctagcaacgatcaacgcttttctcgcctatcatgaccacaaggaaagcccggttgtcgctatgctagccgacctatatgacaccttcgaccaaagatgtgagaagagcagtacgaggattgtttgctgtactccaactctttatgcatggttggtttcgcacctttttcgccaagaggagcgtctgtcaactggttccctcgatggaaagaaggaagaaccgggaggggcaccgctagaggaagagctcgcgcctgtcatttcacgaggtttcaataagaccaacgtggagacacttcagaaggtccacaaggcatggaggtggtgcaaaagaaggacaaagaactcaggggcagtaacaatgggcccatcggtggctaccgaaggtggtgaaagcccacgtgcaaggttggattggctcccgagtttgagaaccgctaaaagggaggaagttgaggcaccggagaatgccgaactaagagatataaatatagctaccaccaaggccttggaacaagagaccaagagggctcgtagggaagagcacggccggaacaagttccgaggggctctgtgcggcaacaacagcgagcttaagctctggagagaggaaagagaccaatcacgagtacatagcatggtcttaaaggaggagttaactgcttgctcaagatccaagaagagtttggcccaacactag

SEQ ID NO: 25694 - DNA, 216 bp, Glycine max
  Peptide Sequence Number=SeqID_142472
atggttggagcattctcgcaaaacatcgtgaccctgactggtctccctatgatcttacttagtgagagtgacctgacaaaccccttgtgtggtgtgtcttgttatgtactcctaagcgtcccagggtggtttttcactgacatgatgaataggtggatgactatgaagaacctcatgctagaggacacgggaacaccacgctctgataggatgtga

SEQ ID NO: 25695 - DNA, 234 bp, Glycine max
  Peptide Sequence Number=SeqID_142473
atggctttgtgttcagtttttctcaatcttcatcttctgctttcggtttgtttgaccatagaagcattaggtgtggcaaagccttcagtagctagttaccttagccaggagatactagcagagcaaaaagctgatagagtgcatagattacctgcgcagcctccggtcaagttccacaatatggtggttatatcacttgtctatgaaactccaggaagagcactgctctattgg

SEQ ID NO: 25696 - DNA, 213 bp, Glycine max
  Peptide Sequence Number=SeqID_142474
attgactgtccttttgaaagaggtgataattcatgcaacctcatcctatctttttgcaaatctctccgggaactccctcagagtgagggaacctattgggtgagaacttctaatctgcccctaggttcacttgaggttcatgcacggtgcccctcattgccccagtgtaaggctttgaggtaccaatcgttgtctttcgtcatgaccttgtag

SEQ ID NO: 25697 - DNA, 294 bp, Glycine max
  Peptide Sequence Number=SeqID_142475
atggtcaaggaggagtgtaaggaggtaagtgtctcctccaagaggttagctatgaaagaaagtcattttacaataaagacaaacattaaagaaacttcccctcttagaaaacctctacattttctccttggtaaaaagacacttgttagcattgccatagctcttcggcttgaggttcttcctcaagtaaaggagttgttggatgagggtttcattcgtaagagcttaaatgcttttgctttgttggtgtctaaaatagtgatcaaggggttcccacaaaccctaagagaataa

SEQ ID NO: 25698 - DNA, 193 bp, Glycine max
  Peptide Sequence Number=SeqID_142476
atcacgtcttttccggtttttccgacgttttcctcgaataaacgttggtggcgactccgcgcgtattcctttcgtggaacacgcatcccgcgagtctcgcgtcgccctcccgccgaagggtaggttgcgacagggagcccgtgaaattgtctccttcttagatacaacgtcttggggtaccacagtgcccgac

SEQ ID NO: 25699 - DNA, 261 bp, Glycine max
  Peptide Sequence Number=SeqID_142477
gtagtagatgaagaggcccaggtacggcagcagcgccagcgacaggatccagctcagcgtcgccaccggctcgcgcttctgcagcatgatccagccggtcagcgcgagcaggtacagcagataggccaccgccaggatggtaccgaggtgggcaatgccgtccagccagtggcgcagggagtcgaagagggcgagcatccgccgatcatagcggcgcatgccacccgatgggatccaacctcgacccgtgtgccaggatga

SEQ ID NO: 25700 - DNA, 414 bp, Glycine max
  Peptide Sequence Number=SeqID_142478
atggcattcagtagtggtggtggcaagggccccatggcagacatcaacgtcacgcccctcgtggacgtgatgctggttctgctgatcatcttcatcgtgaccgcgccgatcatgacgtacccgatcgccgtggacctgccgcagcgcgtgctcaacccaccgccgcagctggtcgaaccgccgccgccgatcgaactgaagatcgacgccagcaaccaggtctcgtggaacaacagcccgatcaataccagcgagctgcagcagcggatggagcaggaggtccagcgtgacccgaccaaccagccggaactgcgcatcgacgccagccctgattccgagtacgacgtgatggccaaggttctggccgctgcgaagaacgctcagatgaagaagatcggttttgtgcagcagtaa

SEQ ID NO: 25701 - DNA, 297 bp, Glycine max
  Peptide Sequence Number=SeqID_142479
atgacgttgctacttagcaacattccgtccggcaaccacaatgccgatctctccctgcggaacaatcagttgggatcgcgcccacaaggcacccagtggacccggaggagtccaatagggccctggggtttccagctttggttacaggcctttgtcagtcctacagggggtcgcgcccataagacactaagtggacccggagaagtccaacagggccctggggtttccagctttggttacgggcctctgtcattcctacagggtgcccgtccccccaacaaggtcatgccatcatga

SEQ ID NO: 25702 - DNA, 474 bp, Glycine max
  Peptide Sequence Number=SeqID_142480
atgaaccctggggtactagtacccacaccatcagagggctacacgccttcaccattggaggactacacgtcctcgccttcagaggactacacgtcctcaccttcagagggctgcacgccctcgccttcagaggactatacgtcctcacctttagaggactacacgtcctcgcaatcagaggactgcatgtcctcaccttcagagggttgcaagccctcacctttagaggactacacgtcctcatcttcagagggttggacgccttcgccttcagaggactgcacgtccttaccttcagagggttgcaagccctcaccttcagaggactacacgtcctcatcttcagagggctggacgccctcgccttcagaggattgcacgtcctcaccttcagagggctgcacgccttcgcctttagaggacttcgtgtcctcactttcagtggctctatatccacaccttaagagaatttaa

SEQ ID NO: 25703 - DNA, 312 bp, Glycine max
  Peptide Sequence Number=SeqID_142481
atggttgtgggcgaaactgagggtcctccaaagtgtttggcatgggtataccaccaattgcttgcccttcagtggcatatccgaggcaaggctcgaagtcagctagattgtggtggggaatttcatgtgcctcccccatgggttgagagacatttcaatgagtatgggagtggagctattgacatcctcattgggaatgacatggggttgaatcaatttagatttttcaacatggttcatgacatcttggtcaaggtgaaactggaagtaacaaggacatcaacagtcctaaatgtgtttggcagtaaatga

SEQ ID NO: 25704 - DNA, 502 bp, Glycine max
  Peptide Sequence Number=SeqID_142482
atgatacgcggagataccttacggttatccgcacccttttatcatccagaggcggcgggcccgatgacaagcagagaaaaaattgggtcattctgcacccttgtgtcatccagaggcggcgggcccgatgatacgcggagataccttacggttatccgcacccttttatcatccagaggcggcgggcccgatgatacgcagagataccttacggttatctgcacccttgtgtcatccagaggcgacgggcccgatgatacgcggaaataccttacggttatccgcacccttttgtcatccaaaggcggcgggcccgatgacaagcagagacaaaatttggcggcgggcccgatgacaagcagagacaaaatttggtcattctgcacccttgtatcatccagaggcggcgggcccgatgatacgcggagataccttacggttatccgcacccttgtgtcatccacaggcggcgggcccgatgatacgcggaaatacccgagtg

SEQ ID NO: 25705 - DNA, 189 bp, Glycine max
  Peptide Sequence Number=SeqID_142483
atggaggaggcacgaggagaagccttggctgcgcagcaactctggtttcgtgggtatttagagacgaggatgagttgtaatcgattacaaggattggtaatcgattacaggagtaataagccttctggctgtctgttcttgtgtaatcgattacactggatggtaatcgattaccagagcataaactag

SEQ ID NO: 25706 - DNA, 570 bp, Glycine max
  Peptide Sequence Number=SeqID_142484
atggctgaactggggcacggcctgtttggatcgcccggcattgaggggcaccgacaggggctggacggttccccggttttcaccaccacggacgtacagcagcagggacaaaccctgacaattacggcagaagatgaacatgcgggcctgcgcctgaccagcgaaatggcgctggatgccagcggcgtgctggcggtgcgtcatggcttaaccaacctgaaatcccaggcgtggcaggtggaccgtttcgccgtcacgctgccggtcgctgagcgagcgcgggaggtgctggccttccacggacgctggatccgtgaatttcagccgcaccgcgtcatgcttgagcacgacagtttcgtaattgaaaatcgccgggtgaaatgcacggcgacgtctggggtgtgcatctgggctggagcggcaaccaccgcctgcgcgcggaagcgaaaaccgatggtcgccgttatattcaggccgaagcgctctacctgccgggtgaggtggcgattgaagagggcgacacgctctggacgccgcgcctgtatgccagctactccgcgcagggactga

SEQ ID NO: 25707 - DNA, 361 bp, Glycine max
  Peptide Sequence Number=SeqID_142485
gtcaggtcctcttgatactcaaccgtatgtgagcactggtgttaaaggcacttttgggtatcttgatcctgagtacttcaggtcacaacagctaacagaaaaatctgatgtatattcatttggggtagttcttttgaaagtgttgtgtgcaagagcaccgattaacccattgcttccaagagaccaaataaacttggctgaatggggaatgctttgcaaaaacaaggggatactattaatgacagcggaatggagaaggaagaaagatgattggagacgccacttcaaggagaagatgagtcaagaagaagttcaccaccataggaagccatggataagagtgtgtggtaggagaagatga

SEQ ID NO: 25708 - DNA, 291 bp, Glycine max
  Peptide Sequence Number=SeqID_142486
atgccgatcttcccctgcggaagtatcagttgggatcacgcccacaagacacccagtggacccggagaagtccaacagggccctggggtttccagatctggttatgggcctctatcagtcctactaggtgcccgtccccccaggatcgcgcccgcaagacccccagtggacctgaagaattccaacagggtcctggggtttccagctctgattacgggcctttgtcagttctacggagtgcccatcgccccagcaaggttatcaggcctcttactaatcgatctttcatga

SEQ ID NO: 25709 - DNA, 423 bp, Glycine max
  Peptide Sequence Number=SeqID_142487
atgatacgcggagataccttacggttatccgcacccctttgccattcagacacagtcgtgtccgttggcacgcagagaccaagtttggtcattctgcacacatgttacgcggagataccttacggttatccgcacccctttgccattcagacacagtcgtgtccgatggcacgcagagaccaagtttggtcattctgcacacatgatacgcggagataccttacggggctgacacagtcttctgcaccttttgttcctccgggaacaacaaagtcatttacatgcggaaatttcatggtcgcccgcgactctcgtcaaccgagaggagcgaaattagtgtcatacactgattttcggggacctttgcttgatgacatgcgaccattctttggtccttgtggggtgcttggcacccatcattag

SEQ ID NO: 25710 - DNA, 331 bp, Glycine max
  Peptide Sequence Number=SeqID_142488
ggatcacgcccgcaagacacccagtggacccgaagaattccaacagggtcctagggtttccagctctgattacgggcctctatcaatgctacggagtgcccgtcgcccccagcaagggatcatgcccgcaagacacccagtggacccgaagaagttcaacaaggtcctagggtttccagctctgattatgggcctctgtcagttctacggagtgcccgtcgcccccagcaagttcatcaggccccctattaaccgggctttcatcaagaagtactgtgcccccaggcatgcgcaaggcgagacaccacagcagcattgggatggccggtag

SEQ ID NO: 25711 - DNA, 168 bp, Glycine max
  Peptide Sequence Number=SeqID_142489
atgaaagacctttttgttacaaaatttgaaagcaatgaagatgtccagaaaattcagctcaaaattcgtagtgaccaattcccagtaatttatacaagttcgtatgttcaagctgccagcaccagcgatttcaacctagaaatcaagagtagtgtttatgttgcttaa

SEQ ID NO: 25712 - DNA, 582 bp, Glycine max
  Peptide Sequence Number=SeqID_142490
ggcgttccgtgcgggcctcttcgttaggacgccagatggcgaaaggccccacagcaggaagagccccgccttcgacagatctccgcgaactgtcggaacggcgtcgtgcactgctctggtgggtgtcgaccttgatcaggtccagccgaacagctcgaatagcttcaggatcaggtacgcacagccgcctgctgccgggatggtcaggatccaggcccagacgatgcgttcgatcacgccgaacttcagcgagcgcgggttcttggcgaagccgacgcccatgatcgcggtggagatgctgtgcgtggtcgagaccggcatgccgaagtgggcggccagggtcaggatggtggccgagctggtctccgcggcgaagccatggatcgggtgcagcttgaccatcttgtggcccagggtcttgatgatcttccagccacccgaggcggtaccggcagccatcaccaccgcacaggtcagcacgatccacatcgcgatgccgtcaccggcgtgggcgtccgggtgcatgaaggccagccaggacggcaggtcgttcagtgcgccggtggcttcggcaccgatcag

SEQ ID NO: 25713 - DNA, 429 bp, Glycine max
  Peptide Sequence Number=SeqID_142491
atggccctatttgacacaggggctgattcaaactgcattttagaaggattaattcctacaaaattctttgagaaaaccacagaaaaattaagtacggcaaacggctcaaaattaaaatttaattttaagctatcaaatgcaatcattgagaaccaaggttttaggattaacacaaactttcttctgatacaactgggaaaaccccaagtaaaagaaaaaattcaatctttattaaatcatattgaatcaactgtctgttctgatttgtcacatgcattttgggatagaaagaaacatattgttgatctcccttatgagaaaggctttagggaaaaacaaattccaacaaaagccagaccaatccaaatgaacgaagaactcttcaatactgccaaaaggaaatcaacgatttgcttgataaaggcctaa

SEQ ID NO: 25714 - DNA, 1017 bp, Glycine max
  Peptide Sequence Number=SeqID_142492
atggctcggcgtgccgcggatctccaccagttcgccgtccaggctctgcgcgtctttacgcttcatcagcacgaactggccgttcacgttggccgccacgccgtgccacggcgtcagccagtcgtctttggtcggcatcatgtggatgcccattttcaggctgtcggccggctgcgggtgaatcgacaggcggatcgccgccgggaaatgctgcgccagcaggttgccccaggcccagctgcgctggatcacgccgcaggcgcgctgtttggcatctttctgcagcgcggcgttggaaccgctgtagcccggcagctggctgtcttcatacaggaagcgcgtgatggcgcggtacagcaagaggccctgttcgtcctgcatcagctgttgcttgatcgcctcttccgtttcggcatagccctccaccaacagccggcgcagcagatcgtaatcatcggtatgctccgccaggcctttgacgtcgccgaggttgaacacgctcaggtgcgtcgcgcccacttcatgcagcaggctttcaatctcacgctgatagtggttgatcgcttcatcgctgacgcggatcagatcgccgaacacgtggccgtcggagcagataacgatatgcgcccccggcgggtaatagagttgaatgcgctggcacagcgagttgaggaagatcagcgacagccgctccgccatgtccggcaccgcgccgatcaccttgttggtgttgggcgacttggtgggaaaggccggcagcacgaattcgatacgttgctcgttttcaatgaatgcccgaatgcgcggcaattgcacctgagtgacccgccgttcttcttcggcaatcgaggtatcgtcgccggggaagcggcggcgcatggcggcaaaagaattgggcatgacgacttccgccgtcagccagcatattcgccagttggaagaacatctgggcattcaattactgctgcgctcgacgcgctcattgagtctgaccgaagccggattgtgcttttatga

SEQ ID NO: 25715 - DNA, 1450 bp, Glycine max
  Peptide Sequence Number=SeqID_142493
atgaacaaccaaccgcttaattgccatattcaaccgaataccccgtttggcgcgatcctgacgccgcagcatccggggcaaaagatcggcgagctgccggtggcggcgctgcgggcgctggcgcaggaacaccacttgctggtgctgcgcggattcgactcgggtttcagcgaggcggaagttctgactcgctacgctgagcagtggggcgagatcatgatgtggccgttcggcgcggtgctggacgtgaaggagcatccggacgccaaggatcatatcttcgacagcagctacgtcccgctgcactgggatggcatgtataagccgaccatccccgagttccagctgttccactgcgtggcggcgccgtcgccggacgaaggcggatgcaccaccttcgtcgacaccacgcggctgttggccaatgcggacgaagcgctgctggatcagtggctgtcggtctcgatcacctaccgcatcaagcaggtggtgcattacggcggcgaagtctgttcgccgctggtggtgcagcacccgaacggcaggggcttaatcatgcgctacaatgaaccgccgacggaaggaaaaaaattcctcaatcaacatgcgctggaataccacggcgtgccggaacaccagcaggaacagttccaccacactctgcagcagcacctgtacgatccgcgtcactattatgcccaccaatggcaacagggcgacgtggtggtggcggacaacttctcgctgctgcatggccgtgagggctttaccgcccagcaacccggtgtgtgccaatctggcgctgaagccggccaacgcagaagcgtaaaggagcattatggcaaggatactgatggcggcggtcgccactccggggcacgtctacccgatgttagccatcgctcgccacctgattgcccaagggcatcaggtgcgggtgatgaccggcgcgctgtttcgcgaacgcgccgaggcggcgggcgcgagcttcgtgccgttcgacgcgcaggtggatttcgattaccgccacctggaagagcacttccccgagcgcgccgcgctgccgccgggcaatgcgcagatggcgctggcgctgaaggatttcttcgccgcgccgatcccgttgctggatcggcagctgcgtgcggccatcgccgccgaaaagaccgatctgctgatggtggagaactgcttctacggcgtgctgccgctgctgcagtccgccgagcggccgccggtcttcggtatcggcgttacgccgctgtcgcgttgacccgtgagcaactggtggatgaggaaacgcgcgtgctgatcgatgacgtgcagcagagcttcgatgcggcgctgctgcaggcgggcgggcgggcgctggatcgcccgttcaccgacgcgctgatcggcggctgcgagcgtttcctgcagctggctaccacggcgctggaatatgagc

SEQ ID NO: 25716 - DNA, 689 bp, Glycine max
  Peptide Sequence Number=SeqID_142494
atgcggacgggcgggaaaggtgcggtgctcatggatgcaacccctgcagcagggccgcgcgggcaatcagctggcgcggcgggaaagtacgaattcgaaccggtccagatcggccggggtggtgaccttgaagttgtcctcactgccttccaccagcagcgggcgctggccctggcgctccatggccatggcctcgtcggtgacttcaacaccggcggcagcagcgtcggacagcgcgcggctgagctggtggcgacggaacagctgcggggtcagtgcgcgccacaggcgctcgcgcggctcggtgccgtagatgccaccgtcgtcgcctgcacgcttgagcgtgtcgtgcaccggggcggccaggatcgcgccaaccgggtcggcacggccgacttcaagcaggcggccgagatcggccagggacaggttcggtcgcgccgcatcgtggaccagcacgaactcatcggcgcgcaccgactccggcaacgcctgcaacccggacagcaccgaggcggcacgggtcgcacccccgacacaggtcagcaccggcttgcccgcccactcgttccagcccggtcagtcggcgtcgtccgtggccgatcacctaccatcgcaccggccacggccgggtgcgccagcagggcgtccagggtatgggcgagcaggatctgtccacctgcctgcag

SEQ ID NO: 25717 - DNA, 204 bp, Glycine max
  Peptide Sequence Number=SeqID_142495
atgtgggtgcaagccattggtctgtttgctcaagcgacctgcgctcttgagtttggacttccaagaccgttcaatcagagattactcgtcttgcacgttggtggggagagaagtgagttatcaagaataggatgttggacaaatggcctcagttatcttaagaagggggggttgattaagatacgaagactattccccaattaa

SEQ ID NO: 25718 - DNA, 354 bp, Glycine max
  Peptide Sequence Number=SeqID_142496
atggcgatcaatgtattccccacaaacgtgtcggagaaaccaccaaccttcaatacgagcgtgtggaccgcctccttgagctccgcgttcgggatgcctgtgcaggcctttgccaccagcgttcaacaggagtacaaggcgctgagaacaacattgctgcggattttatgcaacgcgaagaccacaatgtgcacttttcgcccaacattaatgtctttgcggtgttcgcatgctcataggaataggccaatatcttcttttgtaatgtcaaaaaaggaaacagtgtcgttttgggcgtgtgagtggagaaagttgagggcttcgttgaagtttccagagttgcagagattatga

SEQ ID NO: 25719 - DNA, 243 bp, Glycine max
  Peptide Sequence Number=SeqID_142497
atgaagaataagaaggttgaagcagctagtgtctcactaagcgaggcctatgcgcttagcgagcaacatccgctaagcgaggcactcagcttgcttagcgagttaggagaatccaaaagagaatctgtcaagcttgcacgtgcccagtgcgccatcagctcgcccagcgagtcaattgtctcttatggcgctaagtgcacctggctcgctaagccaaaatccactaactctcacttagcatga

SEQ ID NO: 25720 - DNA, 738 bp, Glycine max
  Peptide Sequence Number=SeqID_142498
atgagccagtgtgttcccagttgggatgtcgaagacaacccaccaccctcaagagtctcacttcgctccaactctaattcaactgcccctgatgttcccatgttggactacgaggttgctgagctgacatgggaaaatgggcaactttctatgcatggcttagggctaccgcgtgtgccggtaaaacccccaacagccgtcacgaataagtacacatgggagaagcctcgcgcaagtggcaccttggagtccatagtgaaccaagtcacgagctttcctcaccgaggaaagccgacaccattaaacggcggtgggggcggcggcgtttacgggaacttcagggtgccgtggttcgaccctcatgccactgccaccaccacgaacaccgtgacgatggacgcattggtgccctgctcgaaccgggagcagagcaagcagggcatggagtcggtccccggcggcacgtgcatggtggggtgctccacgcgtgtggggtcatgctgcggggggaagggggcgaaggggcatgaggcgactgggagggatcagagcgtgagtgggagtgccacgtttgggagggatagcaagcacgtgaccctagacacgtgcgacagggagtttggcgtgggtttcacttccacctccatcaactcgctcgaaaacaccagctccgctaagcactgcaccaagaccaccaccgtagacgaccacgattctgtttcccacagtaaaccagtg

SEQ ID NO: 25721 - DNA, 574 bp, Glycine max
  Peptide Sequence Number=SeqID_142499
ttatagagtccacataaagtccaattacttattgtcatactctgacaggaggctgtttggtgaagaggcacccaactgctcccacaggaaatcgtttccagtgagtgataaagcttcaatgttggatgaggtgatagaatatttgaagcagttgcaagcacagttgcagatgataaatagaatcaacatgtcatcgatgatgctgccattgaccatgcagcaacagcttcaaatgtcgatgatgtctccaatgggcatgggattagggatgggtatggggatgggtatgggaatggggatggatatgaactccatgaaccgtgctcacatccctggcatccctccagtcctccacccttctgccttcatgcccatggcagcctcgtgggatgccgcggccgcagctggtggcggcgaccgacttcaagggactccggccaacgtgatgcctgaccccttgtcgacattttttggatgccaatcacagcccatgaccatcgatgcctacagtagacttgctgccatgtatcaacaactgcaccaacctcctcctgcttctggttccaagaactga

SEQ ID NO: 25722 - DNA, 189 bp, Glycine max
  Peptide Sequence Number=SeqID_142500
atggctagctgcaatttgggtgggcgtatagggttgggtgatgaaaagggaaaggagaaatggggagtagatggggttgtggaaattgcttcagtaggaaacatagaaggaacattgggaaaagatagggtgagagaagggttaatgctaggggggctgccatatgggtatgaagtgacaagggtttga

SEQ ID NO: 25723 - DNA, 744 bp, Glycine max
  Peptide Sequence Number=SeqID_142501
atggtagataataaccagttcattgataaggaagcattcctcacgaggccacctggcttcataagagaggattacctctactggaagggcaaaatggagatgcttgaagctctaggacacatcttcaccaaagctcaagtaaacctaaagatcctagacaacattccgaaggtgtgtggctctcatgtccaaaaagttcaagcagatgatgataaagaaaggaaagttttggcattcctccaaaagaaaaacacaagattcaaaaagaaatacaaggaagaaaacaacaagatcatctactctgaatgtagaaagcatgaacatatggaggttgagtgtccccagctaaagaaaagaaggtactctggtgataagaaaaagaaaagtctaatggtcacctatgacaactcagatagtgagaatagtactagttcaaacaatgaacaagccaacatttatttgatggcagacatagacgaaaattttgtggtagaaaattgttctaggtctgatacctcttcttatgcttcatcaaacaatgagaaagatatgcctatgatgttcttcttcaaaactcatatgtttggcttaggactagaaaaagggacatcatcttccaagtcacaatctgattcaaacaaatgtgacttttgtggaaagtctggaaactccaagttcatatgtattcttaagaagaagaaaatgtccaaggatactaattctactgaacccaaaaagatttag

SEQ ID NO: 25724 - DNA, 225 bp, Glycine max
  Peptide Sequence Number=SeqID_142502
atgctatacgttttgctgcagctttcctcgggaccttgtcggcgaccgtacccgttggatgaacaatgcgaagaggtaaggttgaaacctaaaaattcaaaattcaaaattgatttagccattgatctggagtcagataatattgacaaagagtttgccaacaaatacaacaccacgaagcagcgaaggttccagggctccttgcctctgaaattagcaatttaa

SEQ ID NO: 25725 - DNA, 291 bp, Glycine max
  Peptide Sequence Number=SeqID_142503
atgaaccaaaggtctccacttgatgtcaatgttgcttatgtggaagggagggatgaggcagacaaaggaacttctaatacacaggacttcttcacgaggccgtcagggaagcgaacacgcaatgatttgacttctcaatataatgctggtggatatatacctcaacaagatggagctgggcaagatggagctggggatgctgcacatggagtttttgaaattgaggtattatatactttaatctccgacacagtaacacatcttattttattcgttaaagttttgtcatga

SEQ ID NO: 25726 - DNA, 354 bp, Glycine max
  Peptide Sequence Number=SeqID_142504
atgaagaagaaagaatgcacggaggaaacctcgtgtagcaaacagaaaatgaaaaacctcagcaagtggaaaactcaacaggaaataaaagcaaaaactggaaatgaagctggaagaagaaagaaagaaaacgaaggaagcatattgaagttggtgaggagatcacgcaaacagaggatttgttccctccctcattccatcacatgtatcctctattccccattcatcttctaccattcctgtcgcgaattcatcgcaataagaactccatctcgacaacctgaaaccatcgccaatgacacctcgtcctcggcatcatcgtcgcgatcactgtgcgaggatgtgggaagatga

SEQ ID NO: 25727 - DNA, 135 bp, Glycine max
  Peptide Sequence Number=SeqID_142505
atgaaaggcacaccaatcgagcaggagtgcaataactgctgccaagtaagacaaactatttatggccaaaaacatagggatccgatttcgggccaactggtggaggaattcaataaacaacaacactttgattag

SEQ ID NO: 25728 - DNA, 435 bp, Glycine max
  Peptide Sequence Number=SeqID_142506
atggaaccgtcattcacaatgaatgtggggtttattttcaaagttatagtccagtgcccatgcgagtaccaaacctatgcgatttttcaactctcaaaagcagaatacacaatagccttcaacaaaacaacaatcaagttgtggatgaaattcattaccggcgaccagtggaagatacagttgttatgtaccgttggtagaacaacagatgcaattttaaacttacttgaacgccccagcatccctacacatgatgcggttctgtattacaacggaaggtggaacatgccatgccaaaacaactttgtgggttacgcattcaccggaataaatccaaaaaaaattgatattccaaaaggatgtagcatagatcaactgaaggatttgatcaagcaagtaacacctaaagggaatcctcctcatgggatcctctag

SEQ ID NO: 25729 - DNA, 495 bp, Glycine max
  Peptide Sequence Number=SeqID_142507
atggctgataaacggccgctcatcgtcggtaataatgcgctcttccgcgccggtaagcgtgacgtgacgcaacacgccgctgaaggccagctccaggttgtcggcggtgaaggtggtctccgtcgggccgctggccagcacgccttcgtcgcgcagttctcgcagcagggtgatgatccgcgcctcggtctgcacatcgacgccggtaaaaggctcatcgagcaggatcactttgccttcctgagcaatggcgcgggcgaggaacacgcgctttttctgcccgccggagagctcgccaatctgtcttttgcggtattcgctcatccctacgcgggccagcgcggcatcgacaatctgccggtcgcggggcttcgcccgccgcagccagcccatatgaccatagcggcccatcatcactacatcttccaccagcaccggaaaagaccagtccacctcttccgattgcggtacgtaggcaacaagattttgccgtag

SEQ ID NO: 25730 - DNA, 219 bp, Glycine max
  Peptide Sequence Number=SeqID_142508
atgaaggcccaagtggagaaagatgaaggcctagagacttatcaaggtaatccttatggcgtctactctaacttatcttccttcactagaagtggcgtcatccaaaactccgtagcctatatcaaacgatccgctcctagtcaggttcacatcagtgggccactcaggaatgatctttattctcttaaggttcatgggaaccccttgatcactatttaa

SEQ ID NO: 25731 - DNA, 566 bp, Glycine max
  Peptide Sequence Number=SeqID_142509
tggcaactttggaaatagagttagagcaactctggaggaagacactctgatgcaacaacctaaaggtttcgaggtggaaggaaaggaaaattatgtctgtagattaaagaggtctctttatgggctgaagaaatcaccaagcaaggtggaggatggttcccacatttatctactactctatgcagatgacatgctcgcagcaagtcaaaacttgttggttattcaaaagatgaagtcactacttaatagtgaatttgagatgaaaggagtgtctagtcttcaaacccaagtagatgtaccctctacttgtaccacaaaggatgtaccctccaatgtgttaagacaaagatctcaggcggttaaaccttcgatactttgtgaatggggatacaaaagaattctcaggcgggagaagggagacacaaaagaattcaggcggttagtcctttgttcttttggaaaagggagaagagagacacaaaaagaattcatgcggttagtccttagtgaattctttttggcaaagggagaagagaatgaaaagatgaataacacaagttttcaag

SEQ ID NO: 25732 - DNA, 318 bp, Glycine max
  Peptide Sequence Number=SeqID_142510
atggtaccaactattgaagagtttgaggaaatattaggatgccctcttggggggagaaaaccgtatcttttctccggctttcttccttccttgagcaagattgcagctgtggttggagattcagcaaaaaagttggatcgcatgaagcaaactcggaatgacgtagtgggcctgcctcggaaatacttggaaggcaaggcaagggatatggcaagccaagagaagtggggcccgtttgcggatatattagctttgttgatttttggggttgtcctctttccgaacgttgatggtttagtatacttagccgctcattga

SEQ ID NO: 25733 - DNA, 434 bp, Glycine max
  Peptide Sequence Number=SeqID_142511
tgaatgtcactctagaagcctttgagaaacatgctttaagggatgggagtggaaggtggaagagaaacatctgggttcattgtgaagacgaagacaaaattccactctggaagacacctctgataaaggatgagttcctgcgttgcacgagatgcgggaaggagcgcaggttccatctcaagagtagaccagacattaagaagtaccatgatgctttaaacaacaaatgttggacttgttctctttggccttatcaaaaaataacatgtgatgatgatgaagagagatcaagtctgaaagcaagaaggggctgttctcgttcttcaacttgccaaggctgctcaacttgttactatgaagggtgcatcaagtgccgctttgaggattgcaattgccaagaatgcagagactttatgctatatgctaaaccttaa

SEQ ID NO: 25734 - DNA, 216 bp, Glycine max
  Peptide Sequence Number=SeqID_142512
atggtcaactctctaaaaaaagtccccggtggagtcgccaactgttgcaacctacccttcggcgggagggcgacgcgagactcacggaaaaggcgtggtctacgaactttaagtgaaaggttcgggagttgtatttacgcacggggaagtcgacaagggtatttcccttgctcctacgtattcctcaatcgtgataaggaaatcaaacctatgtag

SEQ ID NO: 25735 - DNA, 177 bp, Glycine max
  Peptide Sequence Number=SeqID_142513
atggtcactagagatagtcaatctgctgcaatgcaagcacaagaccagctggggcattctatggagttagtccatgtagaacttttgcaagaggacaagatgaaaatcatctcagaatttaagaaggaaggcccaacagccatgattagagacggcctaaatgacgcgttggcatga

SEQ ID NO: 25736 - DNA, 234 bp, Glycine max
  Peptide Sequence Number=SeqID_142514
atgtcggctcagcggctcctcactagaatctcacttcctgcaccctgctgctgtcattctgctcccacgaaaaatgttcgcgatcatcacagaatgatgcatgcacctgactcaactctcagatgcaatgtgggaaccatgcagtgttcgtcgagaccacccggttgtgcatgtaactgcccccctcccataggtgatcagcctgggagcccaaaggagttccctaccaagtga

SEQ ID NO: 25737 - DNA, 363 bp, Glycine max
  Peptide Sequence Number=SeqID_142515
ttatatcatcttgtgttggttgccacgaactttggctttttgatgttgccaaagggggagagaaatggggtggaattaaattgtcatcataaaaaaggaggagattgtagaagcaaagactttgcctttgatgttttgatgatgccatatgatcatgatgttttgatgccttatgaaaatgcacttttcaagtttaattcaagacaaaaatccaagaataacggatacaacaacaagaagatctctagtgttttaggaagggaattccaaattgaaactgcaaaaggtttggccaagaaatttaagcaaaaatgtctttttcaagagatttactctctggtaatcgattaccagaggatgtaa

SEQ ID NO: 25738 - DNA, 1054 bp, Glycine max
  Peptide Sequence Number=SeqID_142516
gcccgtcagcgctcgcaccagtggtggtcttgccatggtcgatatggccggcggtgccgacgatcatgcccgcggctccgtggattgcgccgcgaggtcggcgagctgctcggtgaaggcggcctcgtcgcgcgcctccaggcagcgcaggtcgagccacagcgcgtcatcggcgaggcggccgatcaccggcacgggcaggcggcgcaagcgggtttccagccggtccagatggcgcccgggacggcccttgccccgatagcgcaccgccagcccgtggctgggcaactggtccaccggcaacgcgccgctgccgatctggctgaacatcggcaccgcctcgacctcgtagtccgcgcccgccgcgtgcgccagcacgccgcgcaggcgctcggccaaaggctggatctcgcgctgcggccgggtcagcaggcgcagcgtggtcaggcgctgcgccaggaattccggcgcgcggtacagctgcagcaccggctccagggccgccagcgtcagcttgcccacgcgcagggcgcgcttgagcgggttcttcttgatcttgcggatcaggtcggcgcgccccaccagcaggccggcctgcggaccgcccagcagcttgtcaccgctgaaggtcaccaggtcggcgccggcggcgatggtctcgcgcaccgtgtcctcgcgcggcaggccgaactgggtcaggtccaccagcgtgccgctgcccaggtccaccgtggccggcaggccgcgcgcgtgcgccagcgccgccacctcggccacgccgacgctcttggtgaagccggtgacggcgtagttgctgcaatgcaccttcatcagcatcgcggtgcgcgggccgatggcgttctcgtagtcggcggcgtgggtgcggttggtggtgccgacctcgaccagcctggcgccggcgcgcttcatgatgtccgggatgcggaaggcgccgccgatctcgaccagctcgccgcgcgacaccaccacctcgcggcggtcggccagcgcgttcagcatcagcagcacggcgcccgcgttgttgttgaccacg

SEQ ID NO: 25739 - DNA, 655 bp, Glycine max
  Peptide Sequence Number=SeqID_142517
ggagcgcctggaccgactccggattttggatgtctgttggatcccatatggggagcatcgggaggtccgagacttccacgtcagatcatgctactccggtctcttgcgttgggggcctgttgctgtgtattaccgaccggagagggtcgtgcgacagtttggttacacgcagaccattcctactcctcctgtcgattcatgggtctcgtatgatgatatacatgacaggtggatgcactacaaggatcatatcgtacctgcaggtgaggtgtgcgtggtgccaggggcgtgttccagtgactacatcgactggttcttccgcatctcccatcctttcatgacaccaggccacgcagtggatcctctacctcatggtcacgccccgcagccccgagttgtccctcaggccccgcagacggatatccctcacgtgtcggagccaggagcatcatcgacatctacggaggagcccagacatgaagtttgtgatgatattgctgagcggttggagcaccatctgagtctaggggtgctcacgcctggctcatcgacacatgaggtgatcgaagaatgcctcagattggccaggagtgtcacacaggaccatctagtatacgttaggtgtagacgcaggcggcgcactgatcaggcttag

SEQ ID NO: 25740 - DNA, 300 bp, Glycine max
  Peptide Sequence Number=SeqID_142518
atagaggaagcaaaagaacatcacctagacgaagatgctctaataccacatgacctagctccatgtggagctggtaggccttggatcttcttcatcaatggagtcctttgcttcttgaagatgaatggaagcggaatggagaaagcagaggattggagatgccacttcaaggagaagatgagtcaagaagaagctcaccaccatgagaagccatggataagagctcgaaggaaggagaagatgagcagagggagaaaaggagcacgaaatttagttcctcaaatgaggtctgaactttga

SEQ ID NO: 25741 - DNA, 267 bp, Glycine max
  Peptide Sequence Number=SeqID_142519
atgaagtcagctgacaagcgcgagtaccatatggtcatccgcacctttcatcaaccaggggcaaacgagcccgttgacacgcagagactaacgtcgtcttctgcaccttctgtcatcctgacccatgaagtcaggtttactttagtcgtccgaagatattcaagcccaacgacgcacgagattcttctctgctgggcggtgacgatcaagtttgatagcgcgtggaaacgtcgtggttatcccattttatcgctttcaagacactaa

SEQ ID NO: 25742 - DNA, 141 bp, Glycine max
  Peptide Sequence Number=SeqID_142520
atgcccagggcacataattctacaacagccacagtgcctatttcaggaaaagagccctggaagcaacaaagaggagcagcttgtgcattgaagcctagtttaggcctagtcttacatgagggatctacgggcgaagcttag

SEQ ID NO: 25743 - DNA, 1947 bp, Glycine max
  Peptide Sequence Number=SeqID_142521
atgacacttataaacgatggaaaaatctatttgactactgttgtgcatccccttctaaagaattgtctgtgcctgtctttttgtcctgcttgtaagctggacaaaatgaggaatattctgaattcattatggatctacttcggagatcaattgcaagtgaaagtaaataaattaacatcaacaaagacccagcttccatattcatattattcacttccctactgtgccccatcaaaaatacaggatagtgcagaaaatcttggggaagtacttcgtggtgaccgcattgagaattctctctatgtgtttaaaatgcgcgagccacaaatgtgcaatattctgtgtaatcttaaacttgatgctaaaactgctaaggagttcaaagagaagatcagtgatgagtatcgggtgaacatgatcctagataaccttcctctagtttttcccttgaaacggactgatcaggattcaactgtctatcagcttggtttccttgttggactcaaagggcagtatagtgggagcaaggaggagaaatattttatttacaaccatttggcatttactgtcaagtaccataaagacatgctaactgaatctgctagaattgtgggctttgaggttacgccattcagtgttaaacatgaatacgaaggtaaatttgatgtaagaacgactcgtttgacaacctgtgaccctcatgctaagcacacagttgtcaactccaacagtccccaagaggttgaagagggcaaggaaattatcttcacatatgatgttgaattccaggagagtgacgtgaagtgggcttcaagatgggatgcttatttgctaatgaatgatgatcaaatccactggttctctattgttaactcattaatgattgttctcttcctttctggcatggtggcaatgattatgctgaggacactgtaccgtgacattgcaaagtacaatgagcttgagacccaagaagaagcccaagaggagactggttggaagcttgtccatggtgatgtatttaggccccccaacaactcagatttgctgtgtgtttatgttggaactggtgttcagttttttggcatgatacttgtaaccatgatatttgctgtccttgggttcctttctccttcaaaccgaggtgggctgatgacagccatgctcttgctttgggttttcatgggaatctttgctgggtactcatcaactcgcttgtacaaaatgttcaaagggtcggagtggaaaagagttgccctcaggactgcaaccatgttccctgcagttgtctctgccattttctttgttttaaatgctctcatatggggccaaaaatcatcaggagctgtgccatttggcacaatgtttgctctgatctttttatggtttgggatctcggttccacttgtttttgtgggtagctatgttggattcaagaagcctgcaattgagaatcctgtgaaaacgaacaagatcccaagacagatcccggagcaggcatggtacatgaacccagtgttctcagttctgattggtggaatactcccatttggagctgttttcattgagcttttcttcatcctcacctcaatctggttgaatcagttttactacatcttcggattcctctttttggtcttcatcatcctcattgtcacttgtgctgaaataaccgttgtgctctgctacttccagctgtgcagtgaggattacttgtggtggtggcggtcgtaccttacctctggttcctctgcactgtacctctttctttatgcaactttctacttcttcaccaagcttgaaatcacaaagttggtatctgcgatattttactttgggtacatgcttatagcgtcttatgcattttttgtggtaaccggtaccattggattttatgcatgcttttggttcactaggctcatctactcctcggtcaaaattgattag

SEQ ID NO: 25744 - DNA, 606 bp, Glycine max
  Peptide Sequence Number=SeqID_142522
atggctgcttgctcaagaacttctcttttgctccttttctttctctttggattctccgcagctaaggaactattggttggaggcaaaatagatgcttggaagattccatcttctgaatcagattccctcaatcaatgggctgaaaggtctcgtttcagagtcggcgatcatcttgtgtggaaatatgagaatgggaaggactcagtgttggaagtaacaagggaagattatgccaattgcagcacatccaagcccatcaaagagtacaatgatggaaacacaaaggtgaagctagagcatgctggtccattctacttcataagtggagcaaaggggcactgtgagaagggacaaaagttgattgtggtggttatgtctccaaggcacattatttctccagcaccttctccaacagagttccactttgagggtcccgctgtagctcctactagcagtgccacaacgtttcaagttggcctactcactgctcttggagttttggccatgtatgtggtttttctcaatctgaacagagcagtggatggtgctagaaacatgaccggaagagagaaagcagagtgggatcaaacctgctctgatagttga

SEQ ID NO: 25745 - DNA, 3342 bp, Glycine max
  Peptide Sequence Number=SeqID_142523
atggctgtcttagtgctctgttcttcaaccatatgtagtagcagtttgtcctcttgttgtgcttttagtggcaccaatgtttatgttatgagcaataatgggttctttggagagaccccatttttcaaaatgaaatcttttccaaatgggtcttcggtaatttggaagaaacatggaaagagacaattgggtcttcgtgtgtttgagaccagatgtgcccatgaggtagttgtggtgaatggtaagagcaaaagtagtgtgtcttctgaagaagttattggcgctctcaagtctatttcggatccaaattctgctctttcgtactttaagatggtttcccagttgcccaatattgtgcatacccctgaaacatgcaattacatgcttgagttcttgagggttcatgggagggttgaggatatggcttttgtctttgatttgatgcagaagcaagtaattaaccggaatccaaatacatacctgactatttttaaggctctttcgattaaaggtgggattcgacaagcaccatttgcacttggaaagatgaggcaagctgggtttgtcttgaatgcatattcatataatggattgatttatttcctgctccaacctggcttttgtaaagaggctttgaaggtttacaaaagaatgatctcggaagggttgaagcctagcatgaagacctactcagcattgatggtagcattggggaggagaagggacactggaaccattatggatttattggaagagatggaaactttgggcttgaggccaaatatctacacatataccatatgcattagagtgcttgggagggcggggagaattgatgatgcatatgggattttaaagacaatggaggatgaaggatgtgggcctgatgttgtcacttatacagttctaattgatgcgctttgtgctgcagggaaactagataaggccaaggaattatatacaaagatgagagctagcagtcacaaaccagatctggtaacttacattactttaatgagcaagtttggtaactacggtgacttggaaacagtgaaaagattctggagtgagatggaggctgatggttatgctcctgacgtggttacctacactatactagttgaggctttatgcaaatctggaaaagttgatcaggcatttgatatgttagatgtgatgagagtgagaggaattgttccaaatctccatacttacaacacgttgatctctggacttttgaacttgagaagattagatgaggcattagagcttttcaataatatggaatctttgggtgttgcacctactgcttattcatacgttcttttcattgactattatggaaagttgggggatcctgaaaaagctcttgacacctttgaaaagatgaaaaagagaggcattatgccaagtatagcagcatgtaatgcatctttatatagtcttgctgaaatgggtaggatcagagaagcaaaagatatattcaatgatattcacaattgtgggctttcaccggactcagtaacctataacatgatgatgaagtgctacagcaaagcagggcaaatagacaaagccacaaaacttttgactgagatgttaagcgaagggtgtgaaccagatataattgtagttaattctttaattgacacactttacaaggctggccgagttgatgaggcatggcaaatgtttgggagactgaaggatttgaagctagctcctacagttgtgacatacaacattttaattactggtttagggaaagagggaaaactcttaaaggcccttgatttgtttgggagtatgaaagagtctggatgccctccaaacacggtgacttttaacgcactcctcgattgtctttgcaagaatgatgcagttgatttggccttgaaaatgttctgtagaatgacaattatgaactgtagtcctgatgttctgacgtataacactatcatctatggcttgattaaagaaggtagagctggttatgcattctggttttaccatcaaatgaagaaatttctctcccctgatcatgtaactttgtacaccctccttcctggtgttgtaaaggatggaagggttgaggatgcgatcaagattgtcatggaatttgtacatcagtcaggtttacagacaagcaatcaagtctggggagaattaatggaatgtattttgattgaagcagaaatagaagaggccatttcatttgctgaaggattggtatgcaattctatttgccaggatgataatttgatattacctcttattagagtcctgtgtaagcagaagaaggctttagatgctaaaaaattgtttgataaattcaccaaaagtttgggaactcacccaaccccagaatcatataactgcttgatggatgggcttcttggatgtaatatcactgaagcagctttgaaacttttcgttgagatgaagaatgcaggttgttgtccaaatatttttacctacaacttgttgcttgatgctcatggcaaatctaagaggattgatgaactttttgaactgtacaatgagatgctttgtaggggatgcaagcccaatattataacccataatattatcatctcggcccttgtgaaatctaatagcataaacaaggcattagatttatattatgaaatcataagtggtgatttctctcccactccttgtacatacggccctcttataggcggccttttaaaggctggaagatcagaggaagcaatgaagatttttgaggagatgccagactatcaatgcaagcccaattgtgctatttataatattctcatcaatggatttgggaaagcaggcaacgtcaatattgcttgtgatttgttcaaaaggatgattaaagaagggataaggccagacttgaagtcttataccattcttgtagaatgtctgttcatgactggtagagttgatgatgctgtgcactactttgaggaactaaagttaactggcctcgatcctgatactgtttcttacaatcttatgatcaatggcctcggaaaatcacgtaggttggaggaagctctttctctttttagtgaaatgaagaataggggaatttctcctgaactttatacttacaatgcattgattcttcattttggaaatgctggaatggtggaccaagccggaaagatgttcgaggaactgcaatttatgggtcttgaaccaaatgtcttcacttataatgctctcatccgtgggcatagtaagtcaggaaacaaagatcgagccttttctgtcttcaagaagatgatgattgtggggtgtagccccaatgcaggaacatttgctcaattgcctaataaatgttga

SEQ ID NO: 25746 - DNA, 2285 bp, Glycine max
  Peptide Sequence Number=SeqID_142524
atgacagacatgcttacctcgttcaatgctgactttggttctcagtacgacaaagatgtcttgaaaacacgctacaccaatctgtggaagcagttcaatgatgtcaagagccttctttctcactttggtttttcctgggatgcttcccgtcaaatggttgtggctgctgctgacgatgattctgtttgcgatgcttatttgaaatctcaccctgatgctagatgctacagaactaagccagtgctgaattttgatgatttgtgtgttatatatggccacactgttgctgatggaagatatagtttatctagtcatgatgtaaaccttgatgatcaagtgcaaggacaacacttgggtgatggaatgggaagcattgctgtaccgagtagtgagcgtgccaggacagattggactgcttctatggagcagttttttatagagcttttgctggatcagttgggtaggggaaatcaagtggataatggattcaataaaaatgcgtggacagatatgctagccatctttaatgctaagtttggatgtcaacatggtagaagggttttaaagaatcggttcaagaaacggttgaaacattactgtgatataacaaatcttataaaacaaggctttttgtgggatgaacaacaactaatgcttttggctgatgatgatgtctggaatgcttatgtcaaggcacatctgcacgcaggaacatatagatcaaaaactttgccaaactatcgtgatttagaattaatattcagaaacatggctgaaaatgagatcagtaatttgcaacaggagaaaaatcatgaagatgtcatatcagaaacaaaggctggtgaagcaaaaggaagtcgcaacccaagtggcactgatcgtactagaacatattggacacccccaatggaccgatgcctcattgacttgttattggagcagggtgggttttcatgggatgatacaatagaaatgattgatgcagaggatcatgtttgggatgcttatacaaaggcacaccctgaagctccaccacttagagttaaaacgttgccagactattggaaatggagtgttatatttgcagcagaaagttctgatacaagatacgtccatttagcacataatgaagatcacagtagtgaattaccaatgtatataacaggtgaacagaagaatggcatttgttcaaatgtttacgatgctggttctacaatagagtggacagaatcaatggaatgctattttgttgacattatgattgagcaagttaatagaggaaataggattgaaaatttatacaatgaggaagcttggatgcacatggtccaagcatttaacgctagatggggactccaatctgataagcaggttctaatggatcaatatttctgcttaatgaaaaaacatgatgacatcagcaatattctgagtcacagtgaatttgcatggaatgaaaccctacaaacgataaatgctgaggatgatgtatgggatgcatacatcaaggatcacccagatgccatctcatataaaaacaattgtttgtatcgtttctgtgatttatgcaagattttcggaaacaaattaatggaagtaccagatgtaagagtgagtgatctggagcagcttcacttgatggaagcaaatgattttactatagaaatggatatggatgaagcaaatgaaaatttgcttaatattagcagtgttgacatatcagaccagaatccgggcaggacaagggaaatggatacggatggatcatttgcgaatttgggtgtgactagtagcagtgcaacatcaggaaacttagatgtgactagtagcaatgcaacatcaaaccaaaatacagaaaggccgagggaaatggatatggatatgacatctggtaatttggatgtgactggcgacgctcaaatattatctcaagatgaacaaagccacgacgaaatggttacaaatggaacgtgtgggaatttggaattgagtggcaacactaaaatgacacagcatttcagaaaaaggcctaatatgatgtcacaagactccagacctcccaaaaagaagctgggaatgaaagaagctttgtctgagatggctagtgctgttaaggcactgatgaatgataaagagaacaacgatacatcatttgacgatgctttaagtgcacttcgagctatgccggacgtagatgatgagttagtaatggatgcgtgtgatctgttggaagatgagagaaaggcaaatatatttttagctttggatatctctttgcgaaagaa

SEQ ID NO: 25747 - DNA, 165 bp, Glycine max
  Peptide Sequence Number=SeqID_142525
atgtctgacatttctggtaatgttgagaatgtgcggaaactgttaagtcactcaacatttgatctgcgcaatttaatgctgttaaattggttcatttgcttagttataactcaatttgatcagcagcagaccgaggctttacaaagacttagtggatccctccaa

SEQ ID NO: 25748 - DNA, 849 bp, Glycine max
  Peptide Sequence Number=SeqID_142526
atgtgtacagaacccttcaacagttggagaaattcgaaaacacgaaaatcgacctcctcctctgctgaggcgatttccaagccgtactatggaggatgggctgctcctaatatatacatcttgagagctgctggggtggtgaggtttgggaattttcgaattggtggcctctctgggatttataaatctttcgactataaattaggacactttgagaggcctccctatgatcataataccattaagtctgtgtatcatgtttgcgaatatgatgttcgcaaactgatgcaagtcaaggagctaattgatgtttttctttcgcatgattggcccatagaggaaaaaagactaggtagtaaacctgctgctgaacttctagaaaaattgaaaccacattattggttttcagctcacttacactgcaaatttgctactcttgttcaacatggggaaggaggtccactgacaaaatttcttgtactggataaatgtattgctgggtgtgatttcttacagattgtggaaattgaatcagatgcaggaccttatgagattcagtgcgatgaagaatggttagcaataacacggaagttcaaccatatattccctttgacttacaaaggtgcagacttcagagggataaatcttgagatggaagattgtcttgaatgggttagaagcaggctacaagagagggggtgcaaaccttttgaatttgttagatcagctccattgaatcctcaaaatcctcagacagaatcttttttgcggcttctggaacttccatatcttcttgataggaatcctgaagcaaaggacttgtcaccttatccttctccttcaatttaa

SEQ ID NO: 25749 - DNA, 498 bp, Glycine max
  Peptide Sequence Number=SeqID_142527
atgagtaggtgtgtatcttgtggtagcgggtctgcgctgattcacaataagaatttgttgatatcaccaattcataatgcattaaaggtgaggggcaacaatagaagttgtggcttgcgtgttcaggtttctatggtggactcttcctccgctgatttcaccagacgcatcgaacgagcttggtcaatttctaagaagataggttaccaaggggtttacaacaactcattcgcacctggtcaaccagccgagttagaccttctttgtgttaagcaaccaaggccaatcgtgtgttcgtcttgcgactcaaaagggcatattgaatgtaaatggtgtgcgggtactggtttttttattcttggtgataacatgctttgtgaagtcccatccagaaacactacctgcattatttgcactggaaagggatcgatgtgctgttctgattgtcaaggaacaggctttcgtgcaaagtggttgggagaacctccttcttcctag

SEQ ID NO: 25750 - DNA, 1623 bp, Glycine max
  Peptide Sequence Number=SeqID_142528
atggcgttggtgaatccgtttctgtctccccctcgaactcccctctctctgcgagtttcagctccgccaaaccaagcactactacgttggactctctgctcccaatattcattcaaaccatcatcactaagatcgaagcacgccatgtgtggcgccactgccgacatcaaggctgcacctttagctgatggagaagcagatcacgcggttcttgtgggccccgccagcgaggacgagagaaaaggagactatgactggacacaggaatggtaccctttgtatctcactctgaatgtgcccgaagatgcacctttgggtcttagagtgtttgataaacagctcgtcttgttcaaagatggcaatggccagtttcgctgttacgaagatcgctgcccccacaggttagcaaaattatccgaggggcagttgattgatggaaggcttgagtgtttgtaccatggatggcaatttgaaggggagggcaaatgtgtgaagataccccagcttccagctgatgccaaaatccctcaggcagcttgtgttaaaacatatgaagtgagggactctcaaggtgttatttgggtgtggatgtccctcaagacacctccaaatgttagtaaactaccttggtttgagaacttcgcaaggccggagtttcaagatatttccacaattcatgaactcccttatgatcactctattcttctggagaacctgatggatcctgctcatatcccaatctcacatgacagaacagattggactgcaaaaagggaggatgctcagccgctgtgttttgaggtgaccgaacgaacccatagagggtttgcaggttggtggggcagagagaaagacggatccatgcctaacttcttgcggtttgaggctccttgtgttctacaaaacaacagggaaattgttgataagaatggtgaaataaactacttcagtggtctgttcctttgcagaccaaccgggcaagggaaatccatgctaatagtgagatttggaggaacaaaaagatcaccactagcaaaagtgtttcctaagtggtacctccaccagaatgcaagcaaggtgtttgagcaagacatgggattcttgtcatcacaaaatgaaattcttctgaaagaaaaggtttcaacaaaggaactatacctgaatctgaaatcatcagacacatgggttgctgaatacaggaagtggatggacaaagcggggcatggaatgccatatcattttggtcacagcactatctctttgcctaaagagcctgctgtggttgaacatgctcctgcgggactcgtcgcgggacaatcagcttcttcacctaccaaggggggcattggtacaatgcatgccccaaatttcgccaacagatattttaggcatgtgattcattgcaaaggatgtagaaccgttgtcaaagctttcgaagcttggaaaaatgccctttcagctgtggcagttgcattagttgctctggcaattctggtatctgggagacaatggaaagcccttctcttggcatctgcagctctgtgctccgttggagtctatgcttgctcaatcgccattgcgatgaatacaacaaattttattaggacacataggagattgtga

SEQ ID NO: 25751 - DNA, 572 bp, Glycine max
  Peptide Sequence Number=SeqID_142529
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggaagctcttcgtcaggcagtgatgacagacaactccaatgaattatctggagcagttctcgcatccaagggtctcaaattacagagcaactggtggacaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 25752 - DNA, 999 bp, Glycine max
  Peptide Sequence Number=SeqID_142530
atgggttatctcaattcagttttgtcatcttcaagcgaggttcatgctgcaggtgatgcaattgcgagtggtggggggctaagtcacaatagaaaattcagctatgggtatgctagctctcctggcaagagatcttcaatggaagatttttatgagacaagaattgatggtgttgatggtgaagtcgttggccttttcggagtttttgatgtctgtttggctgtagtgttattttctgcacaccatgaaggaaatctctttgaaggtcatggtggtgctcgtgctgctgagtatgtcaagaaaaacctgtttagtaatttaatcagtcacccaaaattcatttctgacaccaaatcagcaataactgatgcatataatcataccgattctgagttgctgaaatcagaaaatagccataatagagatgctggatcaactgcttccactgctattttagttggtgaccgcttgcttgttgcaaatgttggggattccagagctgttatatgcaggggtggtaatgccattgctgtttctcgagatcacaagcctgaccaaactgatgagaggcaaaggattgaagaagcaggaggctttgttatgtgggctggaacttggagagttggaggtgttcttgctgtttctcgtgcgtttggtgatagactcctgaagcagtatgttgttgctgatccagaaattcaggaagaaaaaattgacagctcccttgagtttcttattctggccagtgacgggctatgggatgttgtcacaaatgaggaagctgttgctatgattaaatcaattgaggatgctgaggaggcagcaaagaggctgatgcaagaagcatatcagagaggtagtgctgacaatatcacatgtgttgtcgttcgtttcttgatgaaccaaggtggatccaaagacaaagaggtagtagctcctcctcataatagtagctctgccagtaggaatccttcagtagaaggtttgtgtgataggtga

SEQ ID NO: 25753 - DNA, 1233 bp, Glycine max
  Peptide Sequence Number=SeqID_142531
atgccaaaaagctgtgaaggaggtggcacgataagtgtgtcagccccagccacaggacataaagtggggtccacgttgacaaggacgatgcgtggaaggcgatggaatatggcatgggcaccgcacggtcgaaagtccaaacccaaaaaggctccattactgccccttggccttcttggagttggattgtattcggctaagcctcatccacgtgccactcttccattagttcctcttcagatctcccttgccccactagatagacttggactcactccactcgacatggagccaccaaccatggcttccaagctctgcgactcatgcaaatcagccactgctaccttgtactgccgccccgacgcggccttcctctgcggcgcctgtgactctaaggttcatgccgccaacaagctcgcatcgcgccacccgcgcgtcgtgctctgcgaggtgtgcgagcaggcgcccgcgcatgtgacctgtaaagccgacgccgccgcgctctgccttgcctgcgatcgcgatatccactccgccaaccccctcgccagccgccacgagcgcatccccgtcacgccgttcttcgagtccgtacattcagtcaaggcctcctcgccgatcaacttccaccaccgcttcttctccgacgccgacgctgatgctgacgtcagcaccgaggaggccgaggccgcgtcatggctgctacctaatccaaagacagatctaaattcgtctcagtacttgttctccgaaaccgaaccggttccttacatagatctggattacgcggccatggatccgaagacggagcagaaaagttccgccaccgccgacggcgtcgttccggtgcagagcaacttcgagccgttcacctacggttacaagtacaacactactctctcacagtcacagtctcatatgagccagagtgtatcttctccgtcgtcgatggaagttggagttgtgccggacgggaacacgatgtcggagatatcgaactgcagctacagcaaagtggcaccggtgacggtgacggcgcagttctcggcggcggatagggaggctagagtgttgaggtacagggagaagaggaagaaccgaaagttcgagaagaccattcgttacgcatcgagaaaagcgtatgccgaaacgaggccaagaatcaaaggaaggttcgcgaaacgcactgatgcggaccctctggctggatacggcgtcgttccgtcgtgttga

SEQ ID NO: 25754 - DNA, 333 bp, Glycine max
  Peptide Sequence Number=SeqID_142532
atgggtcttatgagtacctgcgaaaatttggacgacaccttgtctgatgaaaatggtgaagaagccaacatatggcagatacaacttttgatgaatctgaatcaaatcaggaaggtgagggatgagattgttggcaatgttaagcaccctgaggtggtggagtcggccgagatagatctagagaagtgtttttctcataaggtcgatgaattgatgcagagaaatggtgggatctcgctgaacattcccttccaatcgacaattgacaatgatgaggctcgagaaatgcgtgagcttgaagatcgccaaccaaggttagcgttggcgacatga

SEQ ID NO: 25755 - DNA, 237 bp, Glycine max
  Peptide Sequence Number=SeqID_142533
atggttttggtactgtgcattgattttgcgtcacctttcacgggcggtatagtgtggggaagcggtcgagatgatgtcgaattgggagttacaagtgaggttcacagagccaaagttgttggtggtgcggtcgatggttcgaaggagtgcggtgaagagcttgccgaggagggggggtggggaggtcagaccaagagaggaactggagaaggacatggtaacgaaagacgtcggtga

SEQ ID NO: 25756 - DNA, 1113 bp, Glycine max
  Peptide Sequence Number=SeqID_142534
atgaaacagaaacacgccttctttaaatccccaaatcttaatttctgtcccttctctcactcccactccgtccatcgccgtttacgcgtcgcagatattcctctctcagacgaagatcacgacggcgacgccgtccgagaaacaccgtcgaccaaatgcttttcgcctcggaggctcgttgcttcgctgctcgcaccgctgaggccgaccaagggtctccgactccagcaacggcgccagaacgagaccggtgatttggaggcgccgtcgccgtcgtcgccgacgaacgaacttaaagggagcgacgaatcgacaggacagttacatgagagtgatacatcttttaagctaggggttggttgtggtttgctatatctgattgcagcaagtaaaaatgagctcagcaagatgattgagctgcagaaagaaatggaaatgctccttcaaaatgcgaaaggggaactgcaaagtaaagattcacttcttaagccattgaaacaaagtgacacacttgccctttccataactgatattcaagaagtttccagctctagtagtcatctttctattcattcgaatatacaatatgttcaaccagagtcaaaaagcgatacggttcctaatcggtttctggaatataacactagcgaacaagatgaatgtgcagaagagataaatgagctccgggcagaatttgaaattgagttgcagcgcttgcagttgtatttggatggagaagctggatttgatgatgcacaacaagagggagtcaaggtaactcttgaggattctagttcaaaaagccatagttcaagttttggtgaaataataatggaacctcaaggagcaacttatgatgtatcttttggagttcctccaattgaattggagagaaggttgcatgaactgcttgaagcaagactggaagaacggatatcagagctggagtctgcattagaatgtaagacgcaaaagcttattaagaaagagatagaggttacttggtggaaagacactgcacaacttatctcacaacatgttccagaaacttctcggttcacttttccacttgatcctgatatttctttgaagttgagtcaacttgtaggatag

SEQ ID NO: 25757 - DNA, 879 bp, Glycine max
  Peptide Sequence Number=SeqID_142535
atgggtcacgtaggttccagcaaggacggcaccgaggctgggccttccgccgccgcgatgggcatcgacgacgacgaagacatcgacctcggcgacgtcgatctcgacccgaccaacgccgaaatcctcgaagagctcggtgaagacattgtgaaatactggtgcaagaaagcgtcgatgctcttcttcaacgagtacggtctgatcagccaccagatcaactcctttaaccacttcatccacacaggcctccaaaaaaccttcgaatccttcggagacctagtcgtaacgcccgggttcgacccttccaagaagggagaaaacgaacacttccgttacgcctccgttaagttcggcaatgtgaagctcgataaacctatgttctggggcggtgaagggaacgcgcaggagtttaagatgcttcccagacacgcgagaatccagaggatgacctacgcttccaaagtcaaaatccaagttaaagttcaggtgtatgttccgaagaaggtacggagtgataagttcaagactgggaaagcggaattccttgacagggaggttatgaaggaagacgagagggaaatcatcattgggagattgccagtcatggtcaagtctgatttatgctggatgaaagaggcggagaaggaggatgatgaatttgaccatggaggttattttatcgttaagggtgcagagaagacttttattgcacaggagcaactgtatttaaagaggctatgggttatgaatagtccaggttggatgattgcctacaagtcacagatgacgagaaacaggatggttattaaactggtaggaaattccaggggtgaagaagtggagaatggggacatgtctcttgctgtatatctttag

SEQ ID NO: 25758 - DNA, 408 bp, Glycine max
  Peptide Sequence Number=SeqID_142536
gatgagctgcttccaatatttgttgcttctggtgatgatggaaactatgcacaaactgctgctaccgatctttcattgttgcaggcaatctctagaaggattcattacggaaagtttattgccgaggccaaattcagagaatctcctaaaggctatgagcctttaattcgtgctaaggacaaagaagcattgatgaaattattgacaattgagagcgttgaagagatggtggtgaagagggttaaaaagaaggccatggtgttagggcaggaagtgagccttgatcgtaatgtcaagggaataaaatacaaggttgatccatcagtagtttctttcttgtaccagaaatggttaatacccctcacaaaaaacgttgaagtcgaatacttattaagccgcttagactga

SEQ ID NO: 25759 - DNA, 696 bp, Glycine max
  Peptide Sequence Number=SeqID_142537
atgacgaacaaggccaaaggaaaaggcaaggaggtcgccggaaaaggttttgccggcaagcgcaagggcgccttcgacgacgacaagaccgatggcggccgaaagagaaacaatccagtgcccatgcgagtaccaaacctatgcgatttttcaactctcaaaagcagaatacacaatagccttcaacaaaacaacaatcaagttgtggatgaaattcattaccggcgaccagtggaagatacagatgcaattttaaacttacttgaacgccccagcatccctacacatgatgcggttctgtattacaacggaaggtggaacatgccatgccaaaacaactttgtgggttacgcattcaccggaataaatccaaaaaaaattgatattccaaaaggatgtagcatagatcaactgaaggatttgatcaagcaagtaacacctaaagggaatcctcctcatgggattcacgaatcccaagttttaaggtgtttgttttatcgaaaacctagtcatttggagtattctgagaaagttttagaatttgaaattattgagctgaaatgtgacgacgacgtgctgaaggtgctggtagagtccaattactggaaacaatttgtgccaatagaaattttggctctctttagtaaagtggttatggaaaatgaggacgatgtggttacgtccttgcgtgattga

SEQ ID NO: 25760 - DNA, 1215 bp, Glycine max
  Peptide Sequence Number=SeqID_142538
atggattttagtgttaaactgaaagatgatcctatagctcttgtagaatttctttccaaatactgccaatgggttgttttaacattgggcgctaatgggtgcattgctaaacatggaacaaagagtgtggatgcagaatcaaatcctctaaaagtgaggacgtgtagtcctataaaggcgagggcaagcaaccctctgaaggcgagggtgtgcgaccctctaaaggcgagggcgtgcagctctctgaaggcgaggacgtgcagccctctgaaggagagggcgtgtagccctctaaaggtgagggcatgtagccctctgaaggcgaggacgtgtagtcctttgaaggcgagggcaagcaaccctctgaaggcgagggcgtccagccctctgaaggcgagggcgtgtagtcctctgaaggcgaggacgtgtagccctcagaaggtgagggcatgtagccctctgaaggtgagggcatgtagccctcttaatgcgaggacatgtagtcctttgaaggcaaggacgtgtagtcctttgaaggcaaggacacgtagtcctttgaagccgagggcatgcggtcctttgaaggtgagggcatgtagccctatgaaggcgaggatgtgcgaccctctaaaggtgagggcgtgcaaccctctgaaggcgagggtgtgtagccgtctgatggtgaggacatgtagttctcttaaggtgagggcgtgtagccctctaacggcgaggacgtgtagtcctctaaaggaaaggacgtgtagtcctttgaaggtgagggcaagcaaccctttgaaggcgagggcatgcagccctatgaaggcgagggcgtgtagtcctcaaaaggtgaggacgtgtagccctctaaaggtgagggcatgtagccctctgaaggcgaggacgtgtagtcctttgaaggcaaggatgtatagtcctttgaagcagagggcatgcggtcctctgaaggtgagggcgtgtagccctatgaaggcgaggatgtgcgaccctctaaaggcgagggcgtgcagccctctgaaggcgtgggcgtgtagccgtctgatggtgaggacatgtagttctctaaaggcgagggcgtgcaaccctctgatggtgaggacgtgtagtcctctgaaggcgaggacgtgtagtccttcgaaggcgaggacgtgtagcctgttctcttcctgcaagtgcactggatcgcacaagtag

SEQ ID NO: 25761 - DNA, 183 bp, Glycine max
  Peptide Sequence Number=SeqID_142539
atgtatcctgtggaagaagtttggcaggttcttccacgagaaggattgaaagcttgcagaagaaggttccacaggttcttctgcgagaataaaatggagccagcggaagaaggtgttcttccgcgggctcctgcggaagaaaggtttacaatgccaacgattttaacctgcaatgtctcttaa

SEQ ID NO: 25762 - DNA, 2511 bp, Glycine max
  Peptide Sequence Number=SeqID_142540
atgcaggagtgccttgaaatgtatgtcttccctggaattagtggtttgaatagaaaggcgcgcttccttgcatatatggtgaaaggtctcttgctggcttatactggccgccgaaaatgcgacaacagggatgattttcgaaataagaggcttgaattggccagtgagcttcttgaccgtgagttgaaagtgcacattgcacatgcccggaagcgaatggcaaaagctttgcagagagacctttatggagatagggatgtacgcccaattgagcattatctcgacgcgtccataattacaaatggcttgcaaagggcattttcaacaggagcgtggtctcatccatacaagaggatggaaaggatctcaggtgtggttgcaaatgttgggcgcactaatcccttacaaaccatggctgagttaagaagagcgaggcagcaggtccagtacacaggaaaagttggggatgctagatatccgcatccttctcactggggcaaggtttgtttcctctctaccccagatggtgaaaattgtggactagtaaaaaatttggctgtcacaggattagtaagtactgatgtatcggcagtatctgaatatatactgcctaaattgctggattgtggaatggaagaacttgttgatgatacttccactcatcttgggaacaaggacaaagttctcctaaatggcgattgggttggagtgtgtcctgattccagttcatttgtggcagagctacgaagcagaagacgtagaaatgaactgcctcatcaggtggaaatcaagagagaccaatctcaacatgaagtgcgcatatactcggatgcaggaaggattctacgtcctcttttggtggttggtaatctactcaagattaaaggatttaaatcagactgtaactctttccagtctctattggataaaggtgtgattgagctgattggaccggaagaagaggaagactgttgtacagcctggggtgttgagtatttatttggaaaagaaggaaaacgatctgtaaagtacactcattgtgaacttgatatgtcattcttattgggtttaagctgttcacttgtaccatttgctaatcatgaccatgcgaggagggtactctaccagtctcagaagcactcctcacaggcaattggcttttctacaacaaacccgaacattagagttgatactttgtctcaccagttacactatccccaaaagcccctttttcgaacaatggcttcagattgtcttggaaaaccagacaattcacttggtcaaaataaaataagtaaaatacctccaaaggcagaattctataatgggcagaatgcaattgtggctgttaatgtacatctgggatacaatcaagaggattcccttgtgatgaaccgtgcttcactgcagcgtggtatgttcaggtctgagcacataaggagttacaaatctgaaatcgataataaggaatcttcagataagaagcgaaaacctgaagacattgtaaattttgcaaagctacaaagtaaaattggccgagttgatagccttgatgatgatggctttccatatgttggtgctaatttgcagagcggtgatattattattgggaagggtgctgaatctggtgcagacaatagtgtaaagttaaagcacactgaaaggggttatgtgcaaaaggttgtgctgtcttcaaatgacgaagggaaaaattttgctgtggtttcattaagacaggttcgaagtcccgttcttggagacaagttctccagtatgcatggacaaaagggagttttgggatttctggagtctcaggaaaattttcctttcacaagacaaggcattgttcctgatattgtcataaatccacatgcatttccctcacgacaaactcctgggcaactcctagaggctgctttaggaaaggggattgcttgtggtggcatactgagacaagctacgcctttctccacaccttctgttgatgccattactgaacagcttcacagagctgggttttcaagatggggaaatgagagggtatacaatggaaggactggtgagatggttcgatcactcatttttatgggaccaacattttaccaacgtctgcaccatatgtctgaagacaaagtgaaattccggaacactggtccagttcacccgttgacccgacagcctgtagctgacagaaaacgatttggaggtatcaagttcggtgagatggagcgtgattgcctaatagctcatggtgcatcagccaacctgtatgaacgcctgtttacactcagtgactcctctcagattcatatctgcagcaaatgcaaaaatgttgcaaatgtgatcttgcggcctgtctctggtggccggaaaatacgaggaccttattgccgccactgtgaatctgcggatgacattgtggtggctcatgtcccgtatggagcaaagttattatgccaggagctctttagcatgggcataaatcttaaatttgaaacccaactttgctag

SEQ ID NO: 25763 - DNA, 249 bp, Glycine max
  Peptide Sequence Number=SeqID_142541
atgaggaggaagtgtttaaagtctttgatccagcaattaattcctcctccttccctgcatactagtgtggttaagcctcacccaagtgtggggaaggaagaccctccaaggaaagtcattccaaaagaccctggatggaataagaagaagggagatagcatcactattcaagctcttggctatggagtggatgattatactagaggatcaatacaaaaagggaaaatcaccttgtttaagggtggttga

SEQ ID NO: 25764 - DNA, 963 bp, Glycine max
  Peptide Sequence Number=SeqID_142542
atgagacacactccgaagattggtgttcacggtgtctttgtgtgttataatatattggtattgttgttgagcagttttcatgaatcaacatcatcctcttcccactgtaaagcatggttagtgcaatccattcccaccgatatgccccacttatcccatgttccaggcaccctctctactggggatgtacttcggtggctggctgcaaactccaccacgaggcttcacataattgctcagtactggcagctgttaccttctcccaacgatcctcgctctggggactatggttacactcagcatcagatgcatgaatttggtgccgatcagggtgtttccctttatcaagcattagatgctgctgctgaccgcaatgttagcatcaggttactgtcccactctggagtgtatccaacttttgcctcagaaccatccaaacttgctttcggaaggcctaatgttgagaacgtgacattgctacttgaggattggtggggctccggcattgtccatgccaaagtttggatatctgatagtagggatgtgtatattggatctgcaaacaatgactggaaatctcttacacaggtcaaggaactgggaatttattttgctgattgtcctgaaatagctaaaagggttgaggtctactttgacaatttatggacactagcatctcttaattcttcagcttacacaaaaacagtgtttgatcaagactggcaagttgagagaaaggttccttgctggtcgcatttcattaatcatagagagaggtgcaagtcgcctctcccacaatatctggagacacctcatattgcaggatatcctattctgtctgagccttatatgtttaaggttccatttcaaactcctgggagtaactattcaacaaagcacccccaaggcagctatctatcatttgcacccccagaggtaacgtttactttaacacgtccttga

SEQ ID NO: 25765 - DNA, 952 bp, Glycine max
  Peptide Sequence Number=SeqID_142543
gcatgggtcgacgctgtttcactcgctggagaaatggaacccaaatatgagaacgggccatagactggtctgggctcattgttggggcattccattagtagcatgggagatggtgcaaatccgaaagatcgtggcagcgataggggacctggtggaggtggacgatgacgtcgaggagcttcgaaggttggacaggacaagggtgctcatcagaaccccatggagtcccacactcctacacacagtcaacatccacattggcggcgagatatacaaagtccacatcgtggaagaaaacgggaacggcaatggaaattgcagctgccaacctcaaagcaccctcggatcatctgaggagatcgattccggtgacagcaacaccggaacttcgatctcgaagctgctcggagcaccgggaaccgactatgcgccgagaaggactaccgacaactcgaccggtggggtagtgaccaaaggaaacttgttgttatccaacggtccaagcgctgatgaggtaccagtgggtaataaccttggtaggttggcactctgcacaaaccacaaaacaagcatgttaggaatgggggctggaaatgggacgaaaccagtggcgcaacctagactggagacagtggcgaaagcaatggcacgaagggttcctaaaataggaaatgttgacctcgtacggcgtcaacagctagaagatgacgaatgcctcaatgggtcacagctggcaaggagcaccgaagcacgtgacacaggagtggttgatagtgggcacacgaatattgtgggcgccttactagtcacaccattgctgaaacaacacaccagcaatgaggcccacaatagtgtaaatgtgagtttaatgggtgcaaacacagataaaaacaacctaaagcagcccaatgtggattctgagaaagacactacaaccaataaaggaagttaa

SEQ ID NO: 25766 - DNA, 2253 bp, Glycine max
  Peptide Sequence Number=SeqID_142544
atgacgatgttgaagaacaacgaccaaatcccagcgaagctaccaatcttcgatggaaccaactatgagagcaccgacgtcacaccattagagatgaatcccacggaggcacacagggtaactcaccgtgaacagatcaagaaagatgataaagcgatctttctaattcatcaatgtgtggattcaaatgtcctggagaaaatcattgaccatgagacggccaatgaagcatgggatgtgttggctacaacttacgccagtgacaagcaaaccaagaaggtgagattgatggcactccggcgtcaactaggtttgcttcagatggaatcaaacgaaacggtggcgcaattcataaacaggttggtgattcttgcaaaccaaatgaagagttgtggtgaggtggtgaccgattcgatgaaggttgcaaaggtactcactggcttaacaccaaactttgatcatattatctctgcaattgaacaatcaaaggacctaaaaacgttgaaattggagcaattactggattctttggaagcacatgagttaaagatgaagaatagagaaggtatcaagaaagaggagaaggatttcgagaaagccttatttgctaaaaatcagaagaaaggtggtggtgattcttggaagaataagaaagggaaaggcaagtggaagtataacaaacaagaaaacaagggttctacaagtgagaatcaagagaaagaaggagaaaacaatggaaagagaaagaagaaatcaaaggagcatattcagtactataattatcaaaagtatggccattatgcagatgagtgcaataatcctaaagtgcctaggaagaggggtgaagaagcacaactcgcgcgtgactctaatgatgaagaagcaatgatgttaatggccactgttaacagtgaaacaggcaatgaggaatggtggtatttggacactggttgttcaaaccatatgacaggacataaagattggttctgtgaaattgatgaaacagtgaaaagaagcatcaaatttggtgatggcaggtcagtaatggctaaaggaattggcaaggtggccataagaagagtagatgggagcaaggtgattatcagtgatgtcctatatgttcctaacatggaaagcaatctgctaagcttgggacaattgctagagaaaggattctcaatgcatatggaaggagaacacatggaagtagctgattctaatgggaatgtgggtgtgagcaccattgagcagaagtgtttgactgctcaaagcaatgacagtatgtggaagttgcatagaagacttggacatttgaacttcaacaacctaaacaagctgcagaagaagaacatggttgtgggactaccttcaattgaagtaccaaggcaagtgtgtggtagatgctgtgaaggaaaacaaccaagtaaggcttacaatgcagcagttccaactagggccaaagagaagcttgcagtgattcactctgatcaatctggttgttcaattaagatgcttagaactgatggtggaggagagtacacttcacttgaatttgagaatttctccaaggaagaaggaataattcatgaggtaatggctccatacactcctcaacacaatggaactgctgagagaaggaatagaacagtgctgaatatggttagatgcatgctgagagagaagcatcttccacatgatttaagggcagaggcagtatccacaactgctcacatcttgaatagatgtcctacgaagaggcttgacagtttgacaccagaagaagcttggagtgaactcaagcctagtgtgaaacacttcaaggtatttagctcactctgttataggcatgttcctaaacagaatagaagaaaactagactcaagggctcaaactatgatcttggtaggttatcacagtactggggcctataaactttttgatcccttgagcaagacaattgtgataagtaatgatgtgattgtggatgagacaaaggaatggaactggaacattggtatggaaagacaaaccaatgaaacactagaagttgaactgggaggagaagaaatacaggatgaagttcagattgacaatgagcaatactatgatgtctttcctgatgctgctatcaatattaatggtgaattgatgaacttagtgctcttagcagaagcaaaactagtttcacttgaagaggcactagctagtccacattggagaaagaccatggaagaagaactgagatcaatttag

SEQ ID NO: 25767 - DNA, 618 bp, Glycine max
  Peptide Sequence Number=SeqID_142545
atgaaggatgaagaagaccattttgagcctcagaatgaagtggcaacaactaatgaaggtgatcaatctgctcagaatgaggatggtccaaatgttgagacaattgttgatggtttggccaagctgaggattgctaattcctgctttgagaaagaggaagatgagaaagaagaagagccttttgagaaggtagaaaagtttgaagctattgtagtgattgctcagaatgaaccaaaggttgcaaatggtgagaaaatccttattgggtcagtgaaggattccttcttcaacactgaaaacatgaagaaattcttcaactctcctctttttgacacctctgtgaagaattcttgtggccttgctcccctttatggtgaaccctcagccatttccattatatttccttctttcccctatgagacaactactacaaaactttctaaggttggggaggaggttcctcgtgtttatactccctctcttccacctactaatgaacactttgctaggtcaatagaaagtaagttgaaatcaatggagaagcaagtcaaaaaaatcagttttgtccagaatttgtttttctccaatgttgatcaacttcgaaagactcttaattag

SEQ ID NO: 25768 - DNA, 687 bp, Glycine max
  Peptide Sequence Number=SeqID_142546
atgcccatcaacacacctcatttcccaacctgtgagaaatgtgggattgtacacggacatgagaatgcacgtcaaggacaagacttcgggaaaaatcagaatcaagggatgtataggcctccacccatgcaaaatcagtggcctagacaagaagagagacaacccaccttccaagaaatcatgcttcaacaatcgggcaaccgtcttgcacaatttgaacttaaccctaagaatgaggatgatgacacctctctaaaagctataaatgacatcctcattgaagaggaccaagcacctaagaaggataagacccctactgatgggaaccaggtgcatgacaaggaagaagataaaaagaaggagatattgatgtctcctaaggtggaaaagttcatctttccaaccaattttgtaattttagacatggaggcagatgaggatgtccctaccatattggggcgaactttccttagtacaggcttggatgcattcccaagtctggggatgcctgaccctccagagacagttctcactgatgaggaccaagacagggagctaaacctagacatggaggagacagtaacactgctacaaactcatcctagccctaggacatcttattttgagaggttagagtatggaaatggtccaaaggaaaagccctccattgaggaacctcctgaataa

SEQ ID NO: 25769 - DNA, 255 bp, Glycine max
  Peptide Sequence Number=SeqID_142547
atggccgtggtggatttttacaattggggtctttgtcaacaactttgtgtcgcaaataccttttctcagtttgaaatgtcccacaatgtcacaacttctgacaatggtcgtggtcaaccacgagggccttcgtcaatcacaagggttgtgatcaaccatgagggccctcgtcatttcaaacatctcaagcttcagcatcaggattccgataataacagtggtggatatcaccatggccataataagcttaattaa

SEQ ID NO: 25770 - DNA, 654 bp, Glycine max
  Peptide Sequence Number=SeqID_142548
atggcgtttgcgcatatgtttgtgaatattgcttatagattgggtttgttcatgtatgattgccatttttggaggtgtggacagcttacgggggaaatagctccaaagaaactctccacgaagaggtctagaagagacgccacagaggaaggatccagtgctgcctcagagtttgatagtcatcgtttccggagtgctgagcaccagcagcgcttcgaggccatcaggggatggtcattccacagggagaggcgtgtccagctcagggaggatgagtatacggacttccaggaggagatagctcgcagacgttggacaccgctggtgactcctatggccaagttcgatcctgagatagtcctagagttctatgctaatgcctggcccacggaggagggagttcgggacatgcgctcgtgggtaaggggtcagtggattcccttcgatgcagatgcccttagccagttcctgggcgacccgctaattttggaggaaggccagcagtgtgagtttagccagaggaggagcagggctgacgatttcgatgaggaagccatcgcccagctattggaggcgggtgtggatcatgcgcaccagcatgaccactttgacccagacatggatgacattgctgctcagcaatgtcttgcctag

SEQ ID NO: 25771 - DNA, 564 bp, Glycine max
  Peptide Sequence Number=SeqID_142549
atggagcgacagttagaggggatccccggcgaagctacgccggcaccaagcctggacagcacctccatgcttctcacgcaaactggagggagagatcagacatctcaactttctacttcacgaggttcccagaagatgcaatgcaacgaagaaggacctttgggtccagttcaaaaagtggggggatgtacggaagatcttcatctccaaacaaagaaacaaaggggggaggagctagacaaccttatagttggaggattaaagttgtacgtgaatatcccaaagtatgaaagagaaaatgagagacacgtagaacacagaacaaaactcaaaatccaatggggtgatgacaaccatggaacgatagcagctcgacagaaacaatcacaacacaaggtaccttcaatgtcatacgcgaaggtagtggccacaaacacaatgacttcagggcaatggcaaaatcctgagaaagcgagcttcagacatgatgggtcacagtcatcggtacacctcgagattccgacgggggacaaacagtggtacaccgatgcttgggtgggttga

SEQ ID NO: 25772 - DNA, 178 bp, Glycine max
  Peptide Sequence Number=SeqID_142550
ctctgtactgaagaaaacggcgattgagagggagagtttgagaatggtgaagaaggaggagttcttgagagaaaacggcgacaacgaaaaccgttccgtctcgcggagtgacttccctcccaacttcatcttcggagttgccacttctgcatatcaggttcctgccaatccacattaa

SEQ ID NO: 25773 - DNA, 592 bp, Glycine max
  Peptide Sequence Number=SeqID_142551
atgttacagaagcctaaaaattgggccaaaaagatccaggaggaatggaaaattttagaggaaaatctgccagagacaatctttgtgagagtttgtgaatcaaggatggagcttctaagggctgttatcattggacctcaaggcaccccataccatgatggtcttttctttttcgattgcctctttccttctacctaccctgcaggtccaccgaaagttcactaccactcaggtggcctgaggctaaatccaaatttatatcaatgtggaaaagtctgccttagtcttttgggcacttggcatggtagaaatagtgaaaactggattccagaaaaatcaaccatgctacaagtgttggtttcaatacaagctctaattctaaatgagaagccttttttcaatgagcctggatatccatcaacatatcctggttctgaggggcaaagaagatctaaggaatacaatgagagtacatttattttatccttgaagacaatgatgtatactctgcgtaaacccccaaagtttcgatatcttagtggctgtttaaaacttcgtaccccattgcccagaggctcttcgctatgcgaag

SEQ ID NO: 25774 - DNA, 575 bp, Glycine max
  Peptide Sequence Number=SeqID_142552
atggaggctagtttatgcattccgggaaagggctttattctaagcatagagggccaaccatggaagctcctcagaaaagatcttaccaccctggctcagacatggagcatcttctcttactcaaacctagctcctacctcccgcacttcagatttgaacacagacagagctaggttggtctatggcttaatcacaaggatggacatgaacattggcagtttgatctctggacaaatgaccatgatggctcagtctaactcttctcgcttaggcttcccagctttaatcacagccttgtgtagattgaggggagttggatctgatgctcttacctcctacgaaaacctaagaccggtcattgacttagcctatatcataaggaactgttggaatgcgaatgaaccaaaagttaattttctagaggcaaagaagaccaagctcagagcagctgatgttccttattcctttgcaccaatagctggcatccctgcatcttctacttcaaccccacttccagctttagcagacttatctgcccagagctcccagacttcagatgcccaactgcaaagctt

SEQ ID NO: 25775 - DNA, 408 bp, Glycine max
  Peptide Sequence Number=SeqID_142553
atgggatcaagtcaaaagccttcacttaaaaagaggttctatccagtcaaggtcaagagcctagggatcaccagtctaagagagttagggcagttgatgggtcagctccagcagcaagcttttcgtaaagcttacggtaaaatctgggacctagccatggtagaagtctccacagaggccattgcctccctcgcccagtattatgatcagccgttgaggtgcttcatctttggggacttccagctatcaccaatggtggaagaatttgaagagatcctaggatgtcctctagggggaaggaaaccatacctcttctcagggttctacccctcattggccagaatttctaaaatagtccaaatctcggcgcaggaattagaccgccaaaagcaagtcgaaaatggggtg

SEQ ID NO: 25776 - DNA, 930 bp, Glycine max
  Peptide Sequence Number=SeqID_142554
atgtcgcagtacccgtcccacttcctctctctccctcctcccccagccatacctcggcatcacctactttggccaccctgccaccccgcagcacccgtccccctccccctccccggagcgcatcgtcgtcgggctccgctacctcaacgcaagatccctccgcctcgaagacgtcgaccccgccatcacccgcagcctcctctacaacaacaacaacattttcaattggatcagggaaacaagaacaacaacaagggcaattacaattactttgtttttcgcgatggtggcgtgtcggggaaaagaagtttgttcaattggggtgatcatccatctatggctgctgatgctgttgaaaatggatggtcacgatttgctttcacagggtacaagagttacatgccatctcctttgaaaaaatcagcacttttaggagtttgcgctgcacatggtggaggaagtgattttggaagagaattagaggctgagataagctgggaagtggcctgtggatctgctgagtttatgcagaaggaagagggtggtgttgctgtagaggaggctgcgggtgatggcggggtcgacgtcttcgaggtggagggatcttgtgttgaggtgacggagcctggtgacgatgcgctccggggagggggacgggtgctgcggggtggcggtgggggcgaagtaggtgatgctgaggatgggaagaacagaggaatcggaatagccaccgaaaacccttattatggaacctttcaaggcgtcgctaaccactatcctcctcaacaccaacaaccacccgttccctacgctaattattaccaacgacaaggataccacgtcgttccagtttatgccgttgctgaaggaaggcctgtgagagaacgtcgtcttccttgctgtggacttagtctgggttggttcttgtga

SEQ ID NO: 25777 - DNA, 486 bp, Glycine max
  Peptide Sequence Number=SeqID_142555
atgtcgaggagaaaggttagggagccaaaggaggaaaatgtcactcttggtccagccgttagagacggtgaacatgttttcggcgtggctcgcatctttgcctccttcaacgacaccttcatccatgtcactgatttgtctgggagggaaacccttgttcgcatcactggtatgagttattctcttctcatcgcaagacctagtgggatgaaagttaaagctgacagagatgaatcatctccatatgctgctatgcttgcagcacaggatgttgctgccagatgtaaggaactgggcataactgctcttcatatcaggctccgtgccactggtggaaacaagaccaaaacacctggtcctggtgctcaatcagctcttcgagcccttgcacgttcaggaatgaaaattggtcgtatagaggatgttactcccattccttcggatagtacacgtagaaagagtggtagaaggggtagaagactttaa

SEQ ID NO: 25778 - DNA, 134 bp, Glycine max
  Peptide Sequence Number=SeqID_142556
gttttactctcgtcgtcttaaaacattcaagcccggcgacgtgcaagattcttctctgttgggcagcgacgatcgagtgcaatggcgaagggaagtgtcgtggttgtccaactttgttgctttcaagacactga

SEQ ID NO: 25779 - DNA, 261 bp, Glycine max
  Peptide Sequence Number=SeqID_142557
atgtgttgcaacctgccctccggcgggggcgcgaaaaggtctcttggatgggccaagggtgcatcttccatcgaaggaaaacacatggagtcaccaccaacgtttattctaggaaatcgtcggaaaaaccaaagaatggaaaaggtcgaaggtctgcgtattttgaaaatgagggtttgggagttgtttacgcacggggaagggtgtttccctcgctcctacgtattcttcaattgcgatgaggaaattagacctatgtag

SEQ ID NO: 25780 - DNA, 641 bp, Glycine max
  Peptide Sequence Number=SeqID_142558
gagccaagaccttgctgcaaacctaccttgacgaccaggaatgggatttgactgcctttgtagacttgattgaagatgacgacgatgaaggactcttcgctcttgttactgctcttaatttatatagatacaggccgacggaagagctccggtggtatgtatgctctgtattgaagctgaatttggggattatatggcacagtgctagtgtttattctagtcctataattctaatgaagaaagaggactccatatggcaaatgtgtattgattattgtgcccttaatcaggtgaaggaaaagctgaatttggggattatatggcacagtgctagtgtttattctagtcctataattctaatgaagaaagaggactccatatggcaaatgtgtattgattattgtgcccttaatcaggtgaaggaaaagctgaatttggggattatatggcacagtgctagtgtttattctagtcctgtaattctaatgaagaaagaggactccatatggcaaatgtgtattgattattgtgtccttaatcgggtaactatcaagtttccaattcctatggttgatgaattgcttgatgagttgtacagggcttgtttcttttccatgcttgatttcatgagttgcacgtga

SEQ ID NO: 25781 - DNA, 201 bp, Glycine max
  Peptide Sequence Number=SeqID_142559
atgattcttggcaagatattgaagacaactttccccctttctattttagtccgaatgcatagtggatggcgaagaggaaaggaaaagggagggtggcaacggagagggagaggttacgaaggaggttgggggcggaagaggagggtggcagcggatgatggtgatgatagcaaaaacgtggagggacttctcaatctttag

SEQ ID NO: 25782 - DNA, 942 bp, Glycine max
  Peptide Sequence Number=SeqID_142560
atgggtcgtggaagaatacctatggaactcatccagaaggagaaagcccgtaagaaaacttttgacaagagaaagaaaggattattgaagaaagcctatgaaatttccactctttgtgcggttgatgttggcatagttatctatgctcccaagtttctcaatgaacccgaaacatggccccaagaccaagattcaagagaggtcaaacgtatcattcaaaaatatcaaaacaccactagtgacaggtattctaagatgtataatgtgcaagagtattttaacgatagaatgaaaaagattgaaggtgagatttccaaagtgcacaaagagaagatcaagctcatgtacccaacttgggatgactcttacaatactcttggagaggaacaattgcggatgtttgttagcattttggatgttaaacttgatgcttgtaatcaaaggatgaatatgttaaagcgggattcaaagggaaaaagaataactaaatcagacaaaactcagacacttactccctgcatgacctcaaatttcatgtctcaaacacaacaactttttccatctagtgataacaaccaagtagcattttacccatgtcagcttagccaaagttctcaaccttccatgttccattttggtcaaagttgcatgcaattcatggaaaaaaatgcaatggtggattgggctaatcaagttggtgtcggtgcttgtgatcctaaaatgggtgtattaaaggaggatggatctgacaaaaatcaaaactcctcaccatgctacaacggaaatatgcaaactcttccttctcaattgcagtacgatgcaacttttcagaccctaccaaatcaactagaacaaccatcaggggttgaacttaatggtttttacgattcaaatatgcttcaattatctcaattttttaactacatgcatggaaggaagtag

SEQ ID NO: 25783 - DNA, 469 bp, Glycine max
  Peptide Sequence Number=SeqID_142561
atgtcagaggtttggcatcttctgaagaaatcacttcgttgcaaacctcatgcattagaagttcatgatccgaaggcatatagcagtactcagagaaaaccacaaggcaagattagcacgcagagacactcactagaggaccatgttagccatgaaattttccttgatagatcaagcggtgagattatgctttgtccatgttgtccttgttctcatgaaggcagtgaagatggaaaaggtgtacaagaagagcctcatcctcctagatcaaccaagcgaattataccttcatcaaaaacacattatgttgattgtgatgaatgtaattttttctcaaagaaaaaggtgccactgaagaaagattctaatgatgatctcccaatatcaactcgtcatcatgaatgtgatgagaaactaaaatctactgacactgttgaagaacatgatcataatatccctgaacattcag

SEQ ID NO: 25784 - DNA, 1149 bp, Glycine max
  Peptide Sequence Number=SeqID_142562
atggccatgaagaaacttgttgctaagagagctaggaaggtaactgcaagggaaggatccagcacaaccccacaagtggaaattgagtttgctggccaccgcttccgaagcgaggagcatcagggtcgttttgaggtgattaaggattggtcttttctcaaagaaagacgggtccacctagcaaagggggagtatgtggaattccaagtcgaagttgccaggaggcgttggacacagctgacagagcctatggcgaagtatgatcctgaagtagtcatggagttttacgcaaacacctgtcccattaaagaaggagtcatggacaggcgctccagggtgcggggccaatggatcccatatgatagagatgctatcaaccaattcttggggcatccattggtcttagaagagcgacagcgatgcgagtacgctgagagaagaagtcaattttcaggttttgatgaagaggtcataggtcagctactttgctccctgggacatgattttgcacggagtgtagtagggaggcaggtgcggattattcgcactagcatgaccactctgactcaaatccgaatgttgctcctgctcagtaacatccttcccaatgaccataactttgatctctcgctacccaaatgccagttgatctacagcatcatgacccagatcagtgttcatgtggcgcagcttatctcggatgccatccaccagttcataggtattgcacctccgagacacctagtggacccagagaagtccaacacgacactaggatttctggcattgttcagaggtctctgccaattctacagggcaggcacagcagccggggcaagaccagtagcaacagtcggtcgcagatgcatcaccatcgcctccacatcagccaccatctctagagtccatctcagctcacatgcagaggatggagctccagatgcatgccatttccaggaccctaacccttacccgtggcctactcctgagtattttagagccactgtcacatggcctgggggtaggcccaattttcaggaggaggtaggtcctacagatgctcaaggagttgcccaagggagtgaaggtggagctaaggatgatggagacatggcagatttgcttgatttcttcattggaggagactga

SEQ ID NO: 25785 - DNA, 258 bp, Glycine max
  Peptide Sequence Number=SeqID_142563
atgctaccctttacgttgcatggttatcgaacttctgtacgcagatctattggggcaaccccattctctttggtgtacgggatggaagctatactcccatttgagaaggatcaccaagggaaatggaccccaaactatgaaggaccatttatactaaagaaggctttcttaggaggagcattgttgctcatgaatatgaatgatgaagagctaccttcgcctatgaattctgatgttgtcaagcgatattatgcatga

SEQ ID NO: 25786 - DNA, 174 bp, Glycine max
  Peptide Sequence Number=SeqID_142564
atgaccagcactcaagagccaatgctcgaatcagcccgatcaaaagtcattcgttcagcattagagcatgtgccaacaggtgctaaggccatgttcggatttgctcacgatcaaagagaagaattaggaacaatgagatggcgaagcctcgactacaaccacacgtccagctga

SEQ ID NO: 25787 - DNA, 522 bp, Glycine max
  Peptide Sequence Number=SeqID_142565
atgaatcttgtagccaagggtctccgtgtacaaattgaaggccgcgcggttgctcttgcgcacgtggagggacacgtactcggcaccaaacacctgcggtcacacatgcaaaatttccttggactagcagcagtcatgcatcgcgagcgggagcgggacccaatgagttggagaacacccacgatctctgatgcaggacaaaaagaaagagtggaaactaaaggaaaagaaagggggatagggggaatggcatgcctgttccatggcgttctgggctgcggtcatgagcttggtggcgaggccgagcttgcggtgggtgcggaggacggcgagggaggtgatgtggccgtggcagtcggtggtttcttcctccatcttggcgaggacgtagccgacgatgcggccgttgtagtcttcggcgacgtagaggagctggggccaggagaggatgtgatagaggtagtacttcatctggtagttctcagggaggcagaacaggttgcacgcctgcatcgccagaag

SEQ ID NO: 25788 - DNA, 339 bp, Glycine max
  Peptide Sequence Number=SeqID_142566
atgactgctgctagtccaaggaaattttgcatgctgtgtgaatcgaatgggaatcgaattgaacacgtgtttggtgccgagtacgtgtccctccacgtgcgcaagagcaaccgcgcggccttcaatttgtacacggagacccttggctacaagattcatgatgtggaggccaagtattatgcagatggggaggatgcttatgacatgaggaagcagctcaaggggaagcagcaccaccatcatcaccataatcaccatcaccatcaccaccaccaccacgagcacagtggtggctgttgttcaggggaggccaaggggaatcctgccaaagccacctga

SEQ ID NO: 25789 - DNA, 144 bp, Glycine max
  Peptide Sequence Number=SeqID_142567
atggcaaaagagagtgctggtgaaagttcaaggagcatgggaagcattgcgggaacaagtgcttgtctcagaggaggcgaaggaaatcagatggcggaagagccaagaaaagattcatataaattagaacaacatccaccataa

SEQ ID NO: 25790 - DNA, 513 bp, Glycine max
  Peptide Sequence Number=SeqID_142568
atgagcttcacattcaacctccatgttcccaaagctctgcctcctcttccctcttcatcacgtggaacaacttctctcttcttttcttccaagcacaaatcataccacaacaacactagtcctagccaatcactacgtataacatgcagcagccagaaatcaaatcatgatgatgatggcagcctaaagtatacaagtttggcactgcaaataggagtactcttggccttggctgagcagccagtattggctgtgactggagagaataaccggccagaactcctctgggttttgacacaatggggggttgttctctttggatatttccttgtcgtgccatgtaaatcctctgagttcagggttattctttgggcaccatttttaaacttcaggaaattcccacgggacccttccttgcagtacccttggtctgtacctgaagatccttcaaaaattagaagttcatacgcaaagtacccatatgccgaacctgaagattatgataatctatga

SEQ ID NO: 25791 - DNA, 309 bp, Glycine max
  Peptide Sequence Number=SeqID_142569
atggggatgggatgtaaatacacactcccgtcgatttcgggggcggggatggggagggaaatggggagtcaagggcggggatggggtaaacaaaacccgaccccgacccgccccgttgccatgcctaatttgtacacggtaaaaggcagctcacttcaaagcgcgggatccgtccaatcggagagacattcaaaagattcagcacatgttacagtgtatgcaataaatgcgatccttatcttgttacggaaatgtttgtttcacgtaaacacgatactcaattccggtaaatggacacgggtgcaatag

SEQ ID NO: 25792 - DNA, 519 bp, Glycine max
  Peptide Sequence Number=SeqID_142570
atgagcaaacagcaacagagttttgcggcgacggcggcggcgaaaaggggtccttctccaccgagtagcgaccagattaaaaaaaaacgacgggaaactccgacaaccatactgtccctggaccccgacatcgtcaccaccatcttcgctttcctcgacatgttcgatctcgttcgctgctccctcgtttgtaaactctggaatgccatcgttgagtcccggtcgctgcgagaattctgtgagaggaagatgcacaagtcttttgctgaatttaccaaaaagcccctgagggtgattttaggggaagtggctatggaacagcatagcttggctcttcagtgtggtggcttttacgttgatcagtggaaggctcattcaaccacggttgctcagtgccgaatgaaaatgggcatgcttgttactggcgtgggtcataagaacaggagtgaagactttggttacaacatctacaatttgaagcttcattgggcggtattgctatctcgtgttgggccctaa

SEQ ID NO: 25793 - DNA, 241 bp, Glycine max
  Peptide Sequence Number=SeqID_142571
atggttagaactagaggtttggatcgggctttaggcaaggttataggaaaagctctagggagaggagtaaatcgtgattcggataaagctccccagcggcgaagacctacaacatctgctcataggaaatggggaattgcacctgttgctgaggatgttcaacacgtggatcatgcagctgacagggtccatgaacaacctgaagaaccagctgctgatgatgtagttcctaatgctaagg

SEQ ID NO: 25794 - DNA, 186 bp, Glycine max
  Peptide Sequence Number=SeqID_142572
atggacagagtcttgggtgaggttgaaaggagtggggagcatctgggttgtaggaacccgaaattgcaatggctaccctgcttcaacatgatcccaaatcatgatcaaatgatttatgccaagaaggagaatgtgttcttggctatgggttccaaagctactcctgaaagcgcttggtgtaagtga

SEQ ID NO: 25795 - DNA, 162 bp, Glycine max
  Peptide Sequence Number=SeqID_142573
atgcctttccctcttcttcttctccttctcccactctctgtccaactccttatccctctcacatactctaatgttgcaagatgttgcttagccgaggagcaatcgttgtctaggaagaaagccaacaaaagtggcaaaggaggtgaccgcaagggtgcttga

SEQ ID NO: 25796 - DNA, 189 bp, Glycine max
  Peptide Sequence Number=SeqID_142574
atggcgacaacaaacgcaaacggtggtggcagcgtgacaggaaccaggaaacgaaggaggggcaacaccacaatgtcgtacggaaaggagggagaagtatttgtgctgggtgcacctagcaacaccccaggccggtcaacaaccccaaaaaacagggacttcaatttagactcaatgaaacaagtttaa

SEQ ID NO: 25797 - DNA, 432 bp, Glycine max
  Peptide Sequence Number=SeqID_142575
atgggacaaaacacaccgaataaaatagatgatgatggctcaaattctcacgaaggaaaacctaaaaataatgatgacacatcagtgcgcaaccatttgcttaaagaacttgcaaaatggtttgatgagtatatcaacgtgcttggtggcataagtagatttgaggaattaaagtggtccctacttgttgatggattatccatggttaccatggatgagtggatgaatataaccaacataggatatatgattgcatcgaggtataatgtgatccttgtttctctttctctccaacaaagcatgacgttttttcctcttagaagtcagcccccaacagattggtttgtacatcacgtatttctaagagaccgttgtcccttaccgccactaactttgttatggtctacacattatcattctcaggcaaagtag

SEQ ID NO: 25798 - DNA, 6552 bp, Glycine max
  Peptide Sequence Number=SeqID_142576
atggcgcacctaggaggaggcgctgaagcgcacgcgcgtttcaagcagtacgagtaccgcgcgaattcgagcctggtcctcaccaccgactcgcgcccccgcgacacacacgagcccaccggcgagcccgagtccttgtgggggaaaatcgatcccaagagcttcggcgaccgcgcctaccgcggccggccgccggagctcgacgagaagctcgagaaggcgaagaacaagaagaagaagaaagaccgtgatgctgccgctgatgacgccgcagctgtcccctcgaagcggcgccgagtgcagcatgacagcgtgctctccgcctccgacgacggcgtgtaccagccgaagacaaaggagacccgtgccgcctacgaggcgatgctcagcgtcatccagaaccagctcggcggccagcccctcagcattgtcagcgctgccgccgatgagatcctcgccgtgctaaaaaatgacgtcgtaaagaaccctgataagaagaaagacattgagaagcttttgaaccctatacctggccatgtttttgaccagcttgtgtccattgggaagttaattactgattttcaggaggctgtggatgttcccaatgggagttccgcgatggatggtgaggaggggcttgatgatgatgttggtgttgctgttgagtttgaggagaatgaggatgatgatgaggagagtgatttggatattgtgcaggatgaggaggaagaggatgaggatgtcacagagccgaacagttctggggctatgcagatgggtggaattgatgatgaggatatggaagagggtaatgaagggatgggtttgaatgtgcaggatattgatgcttattggcttcagaggaaaatctctcaggcttttgagcagcagattgatccacagcactgccagaagctcgcagaggaggtgctcaagattcttgctgagggggatgatagagaggtggagaacaagcttttgtttcatcttgagtttgataagttcagcctcattaagtttttgttgcggaataggttgaagattgtgtggtgcacgcggttggcgagggcacaggaccaagaggagagggagaggattgaggaggagatgaaggggacagagttgcagccgattttggaacagttgcatgcgacaagggcttctgcgaaggagaggcagaagaatttggagaagagtattagggaagaggctaggaggttgaaggatgatactggtggagatggagataaggaaagtagggataggagcaggagggtggttgctgatagagatggggagagtggatggttgaagggtcagcgccagatgcttgatcttgatagtattgcttttgctcaaggtggttttttcatggctaagaagaagtgtgacctgcccgatgggtcttataggcatctcagtaagggttatgaagagattcatgtgcctgccttgaaggctaaaccgcttgatcctaatgagaagctcgtgaaaatatcttctatgcctgattgggcacagccagctttcaaaggaatgacgcagttgaatagggtgcagagcaaggtttatgagactgcccttttccagcctgataatcttctgctctgtgctccaactggggctggaaaaactaatgttgcagtgctgacaatacttcaacaaattgcccggcacaggaatcctaaggatggttctattgaccatagtgcttataagattgtttatgttgcacctatgaaagctcttgtggctgaagtagttgggaatttgtccaatagattgcaggattatgatgttaaagttagggagctcagtggagatcagtcactaacccggcaacagatagaagagactcaaattattgtgacaactcctgagaagtgggatattatcactcgaaagtcgggtgaccgcacttatacacagcttgtaaagcttcttatcattgatgaaattcatctacttcatgataacagagggcctgtactggaaagtattgttgctagaacagtaaggcagattgaaaccacaaaggactatattcggttggtgggattgtctgctactctccctaattatgaagatgttgcattgtttttgcgtgttgatctgaagaaggggctgttttattttgataatagttatagacctgttcctctttctcaacagtatgttggaatcacagtgaagaagccacttcagaggttccagttgatgaatgatatctgttatgagaaagttatggctgtggctggaaaacatcaggttcttatctttgtacattccaggaaagaaactgccaaaactgctagagccatcagagatactgcacttgcaaatgatactcttggtaggtttcttaaagaagacagtgcgagtcgtgagattcttcatactcatactgatcttgtgaagagcaatgatcttaaagatcttcttccatatggttttgcaattcatcatgctggtatgaccaggacagatcgccagcttgttgaggatctctttgctgatgggcatgtgcaagtgttggtttctactgcgacccttgcttggggcgtgaatctacctgctcatacagtgataattaaagggacacagatttataatcccgaaaagggggcctggactgaactaagtcctcttgatgtgatgcagatgctgggtcgtgctggaaggccccaatatgactcatatggtgagggaataattgttactggtcatagtgagttgcagtattacctctctctcatgaaccaacaacttccgattgagagtcagtttgtgtccaagctggctgatcagctgaatgcagaaattgttcttggtactgtacaaaatgccagggaggcctgtaattggattggatacacttacttgtatgtccgtatgttgaggaatccttcattatatggtatagcacctgacgtcctaacaagagatataacattggaagagaggagggctgatttgattcatacagctgcaaccatcttggacagaaataatttggtgaagtatgataggaagagtgggtatttccaagtcacagatttgggtcgtattgctagctactactacataacacacggatccatatccacatataatgagcatttgaagcctacaatgggggacatagagctttgtcgattgttctctttgagtgaagaattcaagtatgtaacagtaagacaagatgagaagatggagctagccaagctcttggaccgtgttcccatccccatcaaggaaagtctggaagagccaagtgccaagatcaatgttttattgcaagcatacatttcacaattaaagcttgaaggactctcgctgacatctgatatggtctttatcactcagagtgctggacgtcttttgcgggcactttttgagattgtcttgaaacgtggctgggcgcagttggctgagaaggctttgaacttgtgcaaaatggtgaccaagaggatgtggagtgtccagacacctctgcgtcagttcaacggaattcctagtgatttgttaacgaagttggagaagaaagatttggcttgggaaaggtattatgacctatcatcacaagagataggtgaactcattcgtgcaccgaagatgggaaggactcttcataaatttatacatcagtttcctaaactgaaccttgcagcacatgtgcagccaattactcgcacagttttgagggttgagctgacgataactccagactttgcctgggatgacagaattcatggatatgttgaaccattctgggtgattgttgaggataatgatggagaatatattcttcaccacgaatattttatgctgaaaaagcagtatattgatgaggaccacacactgaatttcactgtgccgatatatgagcctcttccccctcagtactttatccgtgttgtttcagatagatggcttggatcacaaaccgttttacccgtttctttcaggcatctaatcttacctgagaagtaccctccaccaactgaactactggatctgcaaccacttcctgtgactgccttgcgaaatccatcatatgaatctctttataaggattttaagcattttaatcctgttcagacacaagtcttcacagttctgtataattctgatgacaatgtcttagttgctgctccaacagggagtggtaagactatatgtgcagaatttgctattttgaggaatcatcaaaaatggcctgatagtgtcatgcgtgtagtttatgttgcgcccattgaatctcttgccaaggagcgttatcgtgattgggagaagaaatttggaggtggtcttaagttgagggtggttgaattgactggagaaactgcgacagacttgaaacttcttgagaagggtcagattattattagtacccctgagaaatgggatgctttatctcgccgctggaaacagcggaaacatgttcaacaagttagtcttttcatcattgatgagctccacttgattggaggtcaaggtggtcctattttagaggttgtagtttccaggatgagatatattgctagtcaggttgaaaacaagattcgtgttgtggctttgtctacctctcttgcaaatgctaaagatctgggcgaatggattggagctacctcccatggccttttcaatttcccccctggtgttcgtcctgtgcctttggaaattcacattcagggtatagatattgctaattttgaggcaaggatgcaggcaatgaccaagccaacttacactgcaattgttcaacatgccaagaatggaaaacctgccctcgtatttgtacctacaaggaaacatgtccgactgacagctgtggatctgattacatactcaggtgcagacagtggggagaagccatttttattgcggtcagcagaagagcttgaaccttttcttgacaagattactgacgaaatgttgaaagttactttacgtgaaggagttggatacttgcatgagggcttgaacagtcttgatcgtgacattgtgactcagctatttgaagctggctggattcaagtctgtgttttaaacagttccatgtgttggggagtgacattgtcggctcatttggtagttgtgatgggcacgcaatactatgatgggcgagagaatgcacagacagattaccccgttactgatcttctgcagatgatgggtcatgccagccgtcctttggtagacaattctggaaaatgtgtcatcttgtgccatgctcctcgtaaggagtactacaagaagttcttatatgaagcattcccggttgaaagccatcttcatcacttcttgcatgataacttgaacgctgaaattgttgctggaattattgagaacaagcaagatgctgtagattatcttacatggacattcatgtacaggcggctcacgcagaatcccaattattacaatttacaaggagttagtcacagacatctttctgatcacctctcagagatggtggaaaatactttgagtgatttagaagcgggcaagtgcattacgattgaggatgatatggagcttgctcctctcaatcttggaatgatagcatcctattattacatcagctacacaacaattgaaaggttttcatcatctgtgacttcaaaaactaaaatgaagggtcttttggagattctgtcttcagcttcagagtatgctcagcttccaatacgacctggagaggaagaggtcgttcgtaagttaattaatcaccagaggttttcctttgaaaaccccaaggttacagatccacatgttaaaactaatgctttgcttcaggcccatttctctagacaattcgtaggtgggaaccttgcattggaccagaaggaggtgcttctttctgcaaatagactgcttcaggcaatggtagatgtgatatccagcaatggttggctgggcctggcccttcttgctatggaagttagtcaaatggtgacacagggaatgtgggaacgtgactccatgctgcttcaactacctcatttcacaaaggatctggctaagaaatgccaggagaacccagggaagagtatagaaactgtgtttgatttattagagatggaagataatgagaggcaagaattgttgggcatgtcagattcacagttgttggatattgcccgattttgcaaccggttccctaatattgatttgtcatatgaggtgctggacagtgacaatgttcgggctggggaggttgtcactgtgctggtcactcttgagcgggatcttgagggaaggacagaagtaggacctgttgatgctcccaggtatccaaaagccaaggaagaagggtggtggctcattgttggtgataccaaaaccaatctgttgcttgccattaaacgggtttccctgcagcggaggttaaaagccaaactggaatttgatgctcctgctgatgctggaaggaaatcctattcgctttatttcatgtgtgattcatacctgggttgtgatcaggagtatggtttcacaattgatgttaatgctgatggtggtgatcaagatagcggcagagaatga

SEQ ID NO: 25799 - DNA, 501 bp, Glycine max
  Peptide Sequence Number=SeqID_142577
atgcctggtgcacaaagcaacaaccactgccctacttatccgactcgtctagaacacgaggttcacaggtcaagccttaaacaagtcagaccgggcattcaggatgattttcggcaacaatgcatcctccacacagaacaaaaacctttgtttctttcttgtttgtttaatgtggctaccatcgagtgtctgaacctacctatcccaaatctccctccttctttcatcgcatcaccatctcatcctccctcttccgctcctttagcagcccttgcactgccacctttgccatcgagcctccgtcggactctgatcgtgtccctgccgctgtctactacaccaacctctgtgttgattgttgcaccttcaacgattatcgggctatcatatccatccttcgcgacttttccatcaaatcgacaagcgcagctcgttaatgtctacattggcggcgccgatgaggtgaggaagctctatgatagcgacaactgcttgagttga

SEQ ID NO: 25800 - DNA, 372 bp, Glycine max
  Peptide Sequence Number=SeqID_142578
atggctggatcttgtgttggatttcttctacacaacagatacaaagcatctgtatttatgggtaatattggatctttggcacttggtggtgcattagctgcaatggctgcatgtactggaatgttcttcccgctactcatttcttctggaatcttcattgttgagtcattatcagttatcattcaggttttgtacttcaagatgactaagggcttccagggagcatggtggtggcgctttttgagaatccctccctttcattacgggctccagttacgtgggttcagagaaccaaatattgtattgggagcttatattatatcatctgttttggctttgcttggcggctatgtgggtcttgtttcagcataa

SEQ ID NO: 25801 - DNA, 528 bp, Glycine max
  Peptide Sequence Number=SeqID_142579
atggggtctctgcagactgatgaaacttccaatttttgctttgctttctcttggttacatgctcttgtggaatatgagactattgaggctgctgagaaagctgtggctatgttaaataatgaacaagactggagaaatggcatgcgggttaaacttctcaagggaatggggacgtatgggcacaaaaaacaagcttggaaaggatctcattctgagaagaatagctcaaggcatgtatctgaacaaacaggagatgaggagaatcatggctctaatgagcatcgtgaagatgcacatgaggaagaagatggggatcatctgtcgaaggacaaaggtgggcagaggtatagaaatcaaggaagatcaagaaaacataaatatcgtgctggaaatggaatgggccatggaagtacaccatcaactcatgctgccgaagcatcgaagccaccccctggaccaagaatgccagatggaacacgtggcttcgcaataggacgaggtcggtttcctgtccctgcttcgaattag

SEQ ID NO: 25802 - DNA, 567 bp, Glycine max
  Peptide Sequence Number=SeqID_142580
atggctccaacacctagccacacttccattccgagggacatgaaaagggacacggctgcctttcttgtcatctattacttaaatccttacatattgtcctttcatttttgtggtgctttggtaacccagttcagaattgttagacttcccttgtcacctttttacttgacccgcccatttctcatatcagccattttagcttcttttgctggctatgtttgtgtcccaatttttcgtcattttaaaattatccatgtaatcaagaaacaaggacctgctagacatcacatgaaaaagacggcacccacattgggtggtttgctttttatacctattggtgtagttgttgctcatgtctttgctggttcctcatctatagaagtgtctggggcagctggagcaaccattgcatttgctgcagttggtttacttagtgatatattaagcctcaccaaaaatcattggagagctttgcctgcattgacagaagttctcttggagggtctgattggtagggaagaaaggaaggaggtgagaaattgggtggatggaaacagggaaggttaa

SEQ ID NO: 25803 - DNA, 429 bp, Glycine max
  Peptide Sequence Number=SeqID_142581
atggagttggacatgtgttatatgagtgtcaatgtccaacatgtgttgaacacttgcacacagcttcaacatgtagtgtcagtgctacatagaaacagaaggcaaatcaagatcattcactggagtaagaaaaatttcgccatcactgtcttccccgtcactggaagagagcttatatgcagaagaactatcatcagcattccaatcatcaagcattgtgagatcaagagcagagagtacctcgagactagcgcaatcgaagcgggaacggggagagtagacgagggacgtggttggagggagagagaggcgtttgcggcgagagaggtggagagggagagagcgatggcggtggttgaggatgcgagaatgagaaggcatggatgcgatgcagagaaagtagatctgaggagagagtggagaaaatga

SEQ ID NO: 25804 - DNA, 487 bp, Glycine max
  Peptide Sequence Number=SeqID_142582
cgccgccgccggctatcccaacgtctctcctcctccgctcgctgatcctgtcggtgcttccgatctcgctgctgctgcctcggacgacgttgttgcggaacctgaaattcacgcgctgatttcagacgaagagcacgatcacgatcacgatcacgagcatgagcatgagcatgaccatgacctcgagcacgatcacgagcatgagcatgaccaccacgaggaccgcgatgatcacgccgccgtggcagctgtctccttggaagatctcaaactcaagatcattaagcaggcaacgcctcttctccccttcaactattctcaatttaataattgctttgttcctgcggaattcgcgttttgtgatgctgacttgtggaattggagagtggagtattatttcagcgatgaaaatctgcccactgacaagtatctgttgggttttgtcaagaggaacaaggaagggtttgcagatcctaagggaagttaa

SEQ ID NO: 25805 - DNA, 544 bp, Glycine max
  Peptide Sequence Number=SeqID_142583
atgaaaacacaaaattataataatgataataattgccttttgccggggctagtggcgaatggagattttgaggttagcccatcaagtgggttccctaacgaggcgattgtggagggccccagcgaggtcccaaactggaagtcaaacggcaacgttgagctagtggaatcggggcaaaaacagggtgggatgatcctcattgtaccgcagggtagacacgcggtgaggctcggcaacgacgctgagatcagccaggagctaccggttgagaagggttccatttactcgctcaccttttgtgcggctcgcacctgcgctcagctggagtccatcaacgtgtcggttgcgcctgcatcgcagacggtagacctgcagacactctataacgtccagggatggaacccttacgcggtttctttcaatgcggatgaggacacttttaggttggtatttaagaatcccggcatggaggatgaccccacttgtggccccatcattgacaacattgctattaagaagcttttcactcctgataaacccaaag

SEQ ID NO: 25806 - DNA, 627 bp, Glycine max
  Peptide Sequence Number=SeqID_142584
atggctaccaagtccattgtgcagggagacaacaacattaactatggtgggatagatgactttagtgtcaataataaggagagtaataaagatatggagtattcgatgggtgtctacaagaatccgaaactgattgttcctaaattagttactcaatcatttaaaacgcaaccaataaatcattttgaagtaacgattacggaagatgatccaattattgcattaaatgttgcaaacaaaaagataagccaaactggcttatacaaggtttcaaagaggttgtctcagattgtaaccttcatgatgatccaatggaaggctacaaatacacttggactagaagaaaaggcaagccaaatggtgttgaggaaacaattgatagcgctccaacaaatattgaatggtttgataagttcccaaacttttgcctcgttaatgccatttccaccaagtctgactactcgtaacggttgcttaaacaaaactttcagaaagcgcttccattttgagaactcggatctttccacactcattgagcatggttggaatgctcccccaaattctgatcttatctccaagataagaagttgtacgaaagagatgcaccaatggggaaaagatctttga

SEQ ID NO: 25807 - DNA, 333 bp, Glycine max
  Peptide Sequence Number=SeqID_142585
atggggatggttttcgccaatactactggcggaacctatgctggatggtgtctcgatacatggcatggccatggggatgctgctaacatgcacatgttgttgcagtggtgttacgcagttggagttggcgatatgcatgccacgcaagcagtgtgtttcgtcagtggtgatggcgaaacacacttggcacacatgattttttttgctgatatgaacagtggggttacgctgatgggaatggcgatatcacgtgattttttttacaaaacagaccccttgaggaatatgtttaaaaagggaccccttttgggaataagttaccaaagaatgtga

SEQ ID NO: 25808 - DNA, 162 bp, Glycine max
  Peptide Sequence Number=SeqID_142586
atgaagaagaaaaagaagcggtttctagtgactgtgtctgaaacgaagaagaaaaagaaggtaattttgatttctggacctactgattttggcaagagtcgcctcgcattggaactcgcaaagcgcctcaatgacaaaatcgtcagtgccgactccgtctag

SEQ ID NO: 25809 - DNA, 297 bp, Glycine max
  Peptide Sequence Number=SeqID_142587
atgaagaagatcctaggcctacaagctccaatggagcttgcatcacaaaggctatcatccttactgggagtcacaaaacaactagggaaaggaaaactcaagagggatcaactgaatgagtcgggacaaaatgacaatgaagaaggaatatggtggaatgggtttttgagacctccatggtttcaaccttgcaatgctagggaagttaggtggaaattgtccactgatcatgatgttatggttacaaaaattttcgaagctaaatactttccacaaggtggattcttggaagcttaa

SEQ ID NO: 25810 - DNA, 273 bp, Glycine max
  Peptide Sequence Number=SeqID_142588
atgggtagagttgagcaaacaggctggggcccatgggctatccacaaaatccacagcccgcatgaaaaagtgacactcgtgttggttgtccaattgagagatccaatgagacgctatgatgcagttggaggacctatgatggtgctgattcatgcaacaagtgcttacacaaaagggaaggaggaggagaaaaggttcaagaatttttctcacaacggagaagaaacaatagcaaatcacaagtatatccaacaacaacaaaaaatcaaatga

SEQ ID NO: 25811 - DNA, 409 bp, Glycine max
  Peptide Sequence Number=SeqID_142589
atggggattaagattaaagttgcaacttacatgagtatgggactacgtacgagtatttttttaaaaggcgggtatggggacgagtactataggatgctacccattgtcatccctaaaagaggcttgccgagtccaagtggggatatcctctttagccaagtatttagcttagttataaagggaaataagagtactcagtcagtgtcaagtctaaatggtggagtattcaaagtgacatcttatgtttttaggatacttgagggtcatcatccatttggcccatcgaataaggcgtttccccctggcggctccctcgtgcgctctcctgttcctgcctttcggtttaccggtgtcattccgctgttatggccgcgtttgtctcattccacgcctgacactcagttcccgg

SEQ ID NO: 25812 - DNA, 315 bp, Glycine max
  Peptide Sequence Number=SeqID_142590
atgccaaaaggtcaaatcaagttagatgaatggtcaaattggcaactagggaatgattggttgagccaaggggttcatagatcctcttcggtctatcgagtaattgcaattacatcaagcctaggggttcttagaccctcttcggtctatcaagtaatttcactcctcaacttgtttagctgggagtctattatgtcgaataatcttggagtttcttcggtcttgcacaatggttgttttgactctagagaacttggatttcctagtctatttgatcacttcaaactccaagtgccatcatccttcaatctttga

SEQ ID NO: 25813 - DNA, 159 bp, Glycine max
  Peptide Sequence Number=SeqID_142591
atgaacactaaaagaggtgtgaaagataaggctcccaacacacttccaatgaaaaggccttttggttacaaacttgaaagcaatgaaatgcttcttagtccaatagctcttaaggtggttggccccttgcttcttgactcaaattcttcaaagggatag

SEQ ID NO: 25814 - DNA, 339 bp, Glycine max
  Peptide Sequence Number=SeqID_142592
atggcagcggaatggagaaggaagagagaaaggagacgccacttcaaggagaagatggatctaaaagaagctcaccaccataggaggccacggataaaagcttggaggaagaaggagatgaatgaagggagaggaagagaagagcacggaattttgtgctataaaaaagctctgaaatctaaaataattggacctaaccttggctcatgggttcagaaatctaccctaaggttcatgagaaccctaaggtcttcttcagcagctctagcccaatcctcttggagcctctcgctcatggctctagtgattggtctcttcctagggaggattgggccttaa

SEQ ID NO: 25815 - DNA, 357 bp, Glycine max
  Peptide Sequence Number=SeqID_142593
atggtggaggaacagatggagtggagagaagtcagaaggagagagatgaggcgtcgttctttctctaagcatcaatctacatggaggcaatcaaacaaagtggtaggtcgatggatgggtcataaggacgaggatggtgaatacctcaaactttacaagaggggtgtggaagttgacgacagagaattctcgactaatcatgggaagagagatgaggaaaacaaatgggtgatataccaatattcagagaaggcgggtcatagaggtgcccatgcacaccttgggatctcttacactaattccacaaggaagatcattccaaagtttgacactcatgggaggagaggtggacgctga

SEQ ID NO: 25816 - DNA, 309 bp, Glycine max
  Peptide Sequence Number=SeqID_142594
atgttcagaactaccacttcccacaaaccaaaaaggaagaaagattgcaactttcccaaggacataggagaaacaaaacataccacaaacccgagatcaaagggtacccaaaaaacaataaaaaagaaagaaagaaagaaagaaaggaacatgaatgaaacaaacctcagaagtcagaaggtggacgaggaaacaagtgaagaaacaaaacaaagatggttttttatagaagaagttgcagagaagactcagttgagaaagcgtggagatggagttgagttgtgtggttgtgttggttttatcagttaa

SEQ ID NO: 25817 - DNA, 321 bp, Glycine max
  Peptide Sequence Number=SeqID_142595
atgtatggagagttcctttatgttgaagaacccattgaaagtagggaatgtcttaattttgcaagatttttcaatcgtatgaatatgaaggatctcgtcaatactatgattagagttcatattaccaaggacatctttgagattaagctagttgaagaagaagtagaggattgtgcaaaccgccttctatgtagaaaatgtgcagttagtctggtgatgaatgtcgacactaatgacatggaagatgacttcgatgagtcattcataaacggggatatccaaagatgttgtgcttcatacataatagacaagtcaacctag

SEQ ID NO: 25818 - DNA, 414 bp, Glycine max
  Peptide Sequence Number=SeqID_142596
atggtggagattctaagagaggaaattgaaaagctagaaacaaagcaattacagttggtgggtaaggatctgacaggattgggtttaaaggaattgcaaaatttagagcagcaacttaatgaggggttattgtctgtcaaggcgagaaaggaggaattactcatggagcaactagagcaatctagagttcagattgaggagcttcggtgtctgtttccacaatcagaaagcatggtcccattccaataccaacatactgaaagaaagaatacttttgtaaatactggcgccagatgtctcaacttggctaataactgtggaaatgagaaagggagttcagatacagcatttcatttggggttgcctgctggtgttcaagaggaaggcccccaagaaagaaaccttttcaaatga

SEQ ID NO: 25819 - DNA, 1446 bp, Glycine max
  Peptide Sequence Number=SeqID_142597
atgaaagaagaagtgaggaaagaagtcctcaagttacttgaggctggactcatctactttatttctgatagtgcttgggctgtcataggttggaggacgtgcatcgactaccggaagctcaataaagccacgaggaaagatcattttcctttgtcatacatggatcagatgatggagcggctagcaggacagtctttttattgcttcttggacgggataccatttggattatgtaatgtaccagccactttccagaggtgcatgttagccatctttgctaatatggtggagaagtgcatagagtgtctcttcatggtccaagaaggaatagtgttaggtcacaagattttagcccaaggcattgaggtggacaaagcaaaaatggatttcatcgagaagctaccaccaccaactttgaaagctaagcttgtatctaccccaataatggttgcacctaactggagcaaggagttcaaactgatgtgtgatgctagtgactatgctataggtgcagttctgggacaacaacgagacaagatattccatgccatatactatgccagcaaggtcctgaatgacgaacagttaaattatgtgaccactgaaaaggaaatgatggccattgtctatgccttaaagaagtttcgatcttatctggttgataagataagtcctgttgattcaagagttcgacatcacatcaaaggcaagaagggatccgagaatgtggaagtgacgcaagaggaacaagaagtgaaggatgaattttcagatgaatccctcttatttgtagctacaaggtcatggttcacagacattgccaactacaaagccactggagtcattcaacaagatctctactggaaccagtttaaagcatattgtggcactgtcacagctcaccttatggagaccattatagtggagataggacaacttccagaatacttcagactagatttttctagccctccattttcaaggatgcccatgaccacttacttcgcactggggggattgattttgtggggtcctcaaccatcctcacacgggaaagcatacatcctagtgtatgttgattatgtgtctaaatgggtggaagccatagccactccacagaatgatgctagaatcatgatcaaatttctgaaaaagaatattttctcccgctttggaatacctagagtgttgatcagtgatgggggtacgcacttctgcaatgcacaactgcagaaggttctgagacactataacgccagacataaggtggtttcaccttatcatcctcagaccaatgaccaagtaaaagtgtcaaacagagagatgaagagaatttcggagaagaccgtcacctcttcaaggaaagattgggcagcaaagttggatgacgccttatgggcttacaggactgcattcaagacttccataggcctctcacctttttag

SEQ ID NO: 25820 - DNA, 456 bp, Glycine max
  Peptide Sequence Number=SeqID_142598
atgagggaagattgtgatgattttaagaaaaagctttccacgctgagcaagccatctcgcgctaagctcgcccaaggcacaaatgggctaagcccaggcatcccattaagcaccactaccactgattggagggaagatcaagggactcgtgtccatcagatgctaagcgcgccctacacgttaagcgtcaacaccattaatgcagctgtaattgtcaggctacgcgctaagtgccacactcacgctaagcgcgtccctcgcttagcgcgtagtctcgtgctaagccccagcaaatggcttctaggaaacgccaaaccggacccagccaaacatatgaaggggattccacctgggactcctctcggttcatctcagagacagcatggcaccgatatcaagacaaagcttcctgagaaggagattgatgtggccctggtgaaggatttctactccaac

SEQ ID NO: 25821 - DNA, 285 bp, Glycine max
  Peptide Sequence Number=SeqID_142599
atgcatggggtagttttcacccttaccgccaaaaggcctgactttgctacacctgccaaacaacttgaacaatcgaatcaagtgaataagcatgctgttaaggacatagtcaggcaatgtttcatcatcgataattactatcactggacaaaaaggacatcaagggccaaggctttatcttccaaggcaaatatggtgcaagataatgcaattcagaaaaggttgtggttcatgaatagcagatttgtggttttaaacattgaggacaacaatctcaagtactaa

SEQ ID NO: 25822 - DNA, 1398 bp, Glycine max
  Peptide Sequence Number=SeqID_142600
atggagaagaataccaatatgagactcagagatcttagtgaaaccaaagatgaagaggttcctcaacttcaacgaaagaggaagaaagatgaagataagggaaataagagaaaacttggcattcttgagaagaactggaatccaccctctccatctcatgaatctactcaaagattaatcaagaacaattcaagagttcaagataagaatcaagaagaattcaagactcaagaagagagtctagagacaagaatcaagattcaagggtacatcctttgtggtacaagtagagggtacatctacttgggtttgactgagaacaagagagggtacatctcttgtggatcagttctagtggagggtacatccactaggttcaaagagaacaaggtagggtatatcccttgtggatctttgcttgtaaatggatttttacaagtgaatccagttgatcttgttctatcacttgttgagaactccatgattggtggcattcttgcagaggtgtatgctttcaaccaagcaattgcatattcaccaggtctacacatcaacagaacaactgatatcaagattgaaccagatcattgctaccccaggctacctcctagagatgaaggcaaagagaaaggattcaagctttattataatgaagagatgctcaacaaacaaaaaaatgttgaaaccttctggaatcaaattgtttggaatgatatgatcaaggctttatcatttgattatgacaacaatgacaatgttgaccacgaggattccattcaagactctgaagatgacacaatcatctctcggctaatagaacttcccatcatcttcaacgacattgtctatgatcttatgaagatggatgagagggatttcaaagatcatgtgatgaaaattcatgaagtgcagaagcctaaaagaaaagagttagagaaagcttataaagttgttattgaggctaagaaagttgtagaagaaaatgctaaggcagaaattgaaaagagaacaaaggcaatccaacaggtgttggatgatgctgcaaaagttactaaggtatttattgatctcactatcgaggaggttcgtgatgctattgttgtcttctctagcaactttgatgttgcactaatcaacttatctgcctctagttccttaactaaagatcacatccaagcaatgcttgatcaagccctgacaaggcagaatgaagaaactcaaatgttggtaactcatgtcatggctcaacaaagagaggaaacaaggaaggaactacaagcttatgttgaacaacaaatattgaagagtgagcaatataagcattccattcaatttactattgctactcaattcaccagtctatcaaaaatgctactacataacctacaacaagcttaa

SEQ ID NO: 25823 - DNA, 1284 bp, Glycine max
  Peptide Sequence Number=SeqID_142601
atgtctccctactccgactcctacacccgcttggcgcaggcggccgtttcgccgccggaaagttcgtatcccgtggccccgccgctgtaccagacggccagcttcgccacggacgaggccagcgtcttcctcgacatggcgacgcggcccctgcattcgggattctatacacgctacggcaacccgacgacccgcgcgttcgagtccgcggtggccgacctggaaggcggcgagtgcgcgctggcgaccgcctcgggcatgggcgccatcacagcggcgctcttcgcgttcgcggcgcggggcgaccatgtggtcgcgcagcgcgtgctatacggtggcaccacaggactattgcagaacatcgccccgcagctgggaatcgacgtgactttcgtggaccaggcggacgtggccgggttcgcggcggccgtgcggcccaatacccgccttttcatgctggaaagcccgtccaatccaatgctgcgactgaccgacctggcgcggctggcggaaatcgcgcgggcacgcggcatcacgacgctggtggacaatacgatcgcgtcgcccatcaaccagcgcccccttgaattcggcatcgacctcgtcatgcacagcgccaccaaatacctgtgcggccacggcgacgtgtcggcaggcgtgctcgttggagacgagaggcgcatcaaggccgtctgggaaaaggcttacctgctcggcgccacgctggacccgttcgcggcctggctggtgctgcggggcctgcgtacgctgcccatgcgggtcgcgcgccagaatgaaacggcgctgaaggtggcgcggcacctggaagcacacgcgtcggtctgcgcggttcactaccccggcctggaaagccacccgcagcgggcgctggcacaaacgcagatgagcggccgagcgagtcgtgggcgcgcttgcgctggcccatcgttcggcaagcttcgggtcgttctcgacgctggtggtgcatccggcggcgatgtgggccggcatgatgacaccggaacagttggcggcctccgggctgccgccaggtctgatccggctgggagtgggtttcgagagccctgccgcaatcatcgacgatctggataccgcgctcgcggcagccgactgacgcccccgctacgtccgcgcgcgcaactcgcgcgcggatacgccgaagcgtcgcttgaacaagcggctgaaatgggccggatgcgaaaacccgacctgataggccagctcggcgataccgcgatgccgatggcgcggatccagcagtag

SEQ ID NO: 25824 - DNA, 378 bp, Glycine max
  Peptide Sequence Number=SeqID_142602
atgaggattctctggtggagcggcaccaccaaatttgcgtggcgacggctccatctgggtgttgtgggcgtgttcgttgagcctcatggacacgcgcagcaccagccactcccacttcgagttttgtttgaagaaaaattcaaatccgtgattcctctcctctttccttcttccttcaccactagaccaatcttatctctcccttctttctctccaacatttataaaacaaccacagtatgcaacctgtagagaatccccacctctcgtgggaggcatgttctccagaactcttgagtatggtttagttctgttaggttgcaccatgaatcatgatcctgatgaaaatacaccctgcaaaaagttccaaggatgttga

SEQ ID NO: 25825 - DNA, 288 bp, Glycine max
  Peptide Sequence Number=SeqID_142603
atggagaattcttcgtcttcgcagtcgagcaaggtgacagtgttaatgaatatcaatgacatcttgtgtcgttgtgcccagttggcagacattaaggaattgcaggataaagttgagaaaatgaaggatgatttgaatgaagctagtaggaaggttgaattggggaatgaaatgttagtggttgtgaggaacaagagtgacgaaaatggtgttgaatgtaggaaaattaggttttttgtatgcataatgttgcttttgttggttgcaagattgatgtatagttcctga

SEQ ID NO: 25826 - DNA, 336 bp, Glycine max
  Peptide Sequence Number=SeqID_142604
atggcagagtttgaggaaaggttgtttgcaaaagtggactctgaagttgatattatttacaacaaggccaatgaaggtgaaagtgacaatgatgaggatgatgtcgctgaaggtgaagacacagagggtgatgctgcaagtctaccgtcaacaaagttaacccatcatctcacacaaggtatatttctcgaggttggtgaacaagacaggatgaaattcacactatacttggtgttggattcgcacaacatcatcaaggagaagatcattcagcatgcaacagctaacaggaaacatttggaggataaacaaagaaggattgttgtgccgaattga

SEQ ID NO: 25827 - DNA, 309 bp, Glycine max
  Peptide Sequence Number=SeqID_142605
atggaacgcataacaaaattggcatcacaaaaggcagtggtgatcttcagcaagagctcatgtgggatgagccatgcaattaagaggctgttctatgagcaaggtgtggggcccgcaatctatgagcttgatgaggacacaagagggaaggaaatggaatgggctctgttgagactcgggtgcaacccttctgtgccagcagtgttcgttggtggcaagtttgtgggttcagccaacacggtcatgacccttcacctcaatggctcactcaagaagatgctcagagatgctggtgctctatggctttag

SEQ ID NO: 25828 - DNA, 819 bp, Glycine max
  Peptide Sequence Number=SeqID_142606
atggcttctccgacgcccaaatccgccgcatcatccaaacatacccttacttcctctcctacaacgcccgcaaaaccatcctccccaaactcaccttcctcctctccaaaggcgcctccacctccgacctcgttcgcatcgtcaccaaaaaccctagaatcctccacttcgatctccacaacgccatcaccccgcgctacgacttcatcaaaaaattcatgctttccgatgattccaccctccgctccatcaaatcatgccccagcatcatcttttcgaacacccccctcctcaacattcaatttctcctccacaacgatgtcccggaatccaaggttgttatgttgcttcgctactgggcctgctcgctcgttgccaatgcccccacgtttcaggatgcggttcgggaggaaatcgttgtgggagaggaaggttgaggtgtataggaaatggggctggtctgaggagattctgctttccacgtttctgaggaacccctggtgtatgctggtctctgagaagaaaattgaggccatgatggagttttttattactcatttgggtttggattctttgtgttttgctaagcatcccgtgcttattgcgttgagcttggagaaaagggttgttcccagggcttctgtgttgcagtttcttttggcgaaaggtttgcttaaggatgttaattgggcgtccgcgtttatagttactgataagattttcttgcagaaatttgtggtttcctatgagaaggaagccgatcagctgttgaagctctatgaagagaagagagatgttcctagagaagagagatgttga

SEQ ID NO: 25829 - DNA, 1191 bp, Glycine max
  Peptide Sequence Number=SeqID_142607
atggtttccatccatcaccaagagctggttgctgtggtgttttatgtggcactaaatggacatggggagactttggtatatgatgttgtaaaaagtgaatggtctgtggcaattacgtcacctccatcttctattactaccaacaagggttttagcgtagcacttgtgcaacacaaggataaagatttccttgttgcatttgggggatccaaaaaggagccatcaaatcaggtggaagtgttgataacagaaaaaattgaatcagtcctgggaagacgaccaacttctaccaaagatccaagatctatacttcttgaaaaacattcattatctgctggattggcttctcaacttaaaaatgattcttcgcaacatttgattaactctgttgctcgacaaaatcttgcgtctgtaattgaacatagttctgaaagaaaatctctctcagaatccctacttgtacaagattccaattctctccctaccaacatctcccttcgcaggcaatttgatcatgatgaagaatgcaatgcagatgtcaggattgacaagcattcagaagatgaaagttctttccctcggaattcacttcaggcagctgatcacaaaacaaatcaaaatgaccctcgaaatcacatgagcagaagtggagccaaaaccaacatggaggaacaggtgtcagtatctagaagttcaaatcagaaaaacctcggttttggaaaccccgtgctagaaagtgatgatgtgtcattccctgaaaacagtaaatcaggatcactgtccgctgcttcagacatccatcattactatgaaactaaagtggcttccctaatgagaaaatttggcattctggagggacaattggcagttgcattagcaagcagagaagcttctgagaaaagcttagcatctgcctttaaaagcaggcaggagatggagagaaaattggctgacacactgaaggagatggaattactgagagagaagctggtgagtgcagagttagttcaagaagaagctaacaacctatccaacatggtccatgctgacaatgtaaggcttgagcatgacgtggctttcctcaaggctgttttagatgatactcaaaaggttgaagtttttcatctcaaacagagacttcaatcaatggaaaaacgagcccctactcccaggaaaccttttcaagtgtag

SEQ ID NO: 25830 - DNA, 1614 bp, Glycine max
  Peptide Sequence Number=SeqID_142608
atggaagttccgaaggatcaaatcgccactcttctcgaacatggcctatacaactccgctcagatgcttgtgctacttggtgattctttcttccgtgaaagggagtatcgtagagccattcacacctacaaacaagctttgcaatgctacaagatgatcccaaaacagaacatgacatcttctcggagttcattgtcatcaaaccggtcttcgtcaccgaattcctgcaatggatcagtgatcaatgagaatgaggtgaagttcaaaattgcatcatgtcactgttttctgaacgagaataaagcagctctagttgagatggaaggcattccaagtaaagctagaaatttaccgatgaatttgttattagggaagctatatcgaatttctagacatagccgagctgctgttgctatttacaaagaatgtctaagacattgtccttttgtacttgaggctatcacagctttagcagaacttggatccactgcaaaggacatcattacattgattcctcagaccccgaatagaagtggtagagcttcatttgatcatactgattcaagtcgttggcttcaacgctatgttgaagctcaatgttgcatggcttcaaatgattacaaaggtggattggaactctttgcagatcttttacagcgtttccctaataatatacacttactacttgagatggcaaaggttgaagctattattggaaagaatgaagaggccattatgaattttgaaaaggcccgttcaattgatccatacatcataacatatatggatgagtatgcaatgcttctaaagctaaagtctgattatccaaagctgaacaagttagtgcatgatttattgaatattgatcctgcaaggcctgaggtttttgtagctttgtctgttttgtgggaaaggaaagatgagaaaaaagcattacaatatgctgagcagagtattcggatcgatgagaggcacataccagggtatataatgaagggaaatttattattgacgatgaaacgggcagaagcagctgtgcctgccttcagagcagctcaagaattgagacctgatattcgctcatatcaaggtttggtccatacatatttggctctctctaaaatcaaagaggctctgtatgcttcaagagaagctatgaaagcaatgcctcagtcggcaaaggctttaaaattagtaggtgatgtgcatgccagtaattctagtggcagagaaaaggctaaaaaattctacgagtctgcactaagactggaacctggttaccttggagctgcactagctttggctgagctccatgttattgagggccgaaatggagatgctgtgtctctgcttgagcgatatcttaaagactgggctgatgattcgcttcatgtaaaacttgcacaagtttttgcagccactaacatgctgcaggaggctttgtcacattatcaggctgcattaaggttaaacccccagaatgaagcagcaaaacggggtttagagcgattagagaagcaaatgaagggagtggatcctgatgcacctgaagaagatgaagacaatgatgttgaagatgcagacggagatcaagacgagactgaacttctgtga

SEQ ID NO: 25831 - DNA, 1440 bp, Glycine max
  Peptide Sequence Number=SeqID_142609
atgggaatgcgcttaatagatgttgagtctgctacatcttcaatctcagccttcgctcgtcgcaatgggaaccgcagcagcaaaatcccaaaccctaagtttcagaaaccagtcctccccgtccccggtggcgaatccaccacctacactcgcctcctgctccctcccctctctcctctcccgaaatcaagctctccgaaacggcgccaccggtcacccgcttcctccgcaatcgaaaacgacccaaccgaacctgaaagcgacggcgagtacgagttttcgggagacgagaatgtggtcaaaggcgaggaagagactccgagtgtgaaggagaagtctgtgccggcggtgatgcggtctttcgaccgggcgaagatatatgtgaaggcaggggacgaggggaacggcgtggtagcgttccggcgggagaagtacgtggcggtgggggggccgtcggggggcgacggaggtaggggtggcgacgtgtacgtggaggtcgacggggcgatgaactcgcttctgccgtttcggaacagcgtgcatttccgggcagagagagggggccacgggcatgggagcatgcagagtggggcaaaaggggaagatgtggtggtgaaggtgccccctggaacggttgttcgaatgagtggcaagaataatgtgttgttggtgtatccgggacataaagggttgctgttgccaggcggtagagggggaagagggaatgcttcgttcaagtcagggactataaggtggttggagttagaactcaagctggttgtggatgttggtatagttggtgctccaaatgcggggaaaagtacacttttgagtgttgtttgtgctgccaagccggctgtggctaattatccttttacaactctgcttcccaatcttggtgttgtttcctttgactatgattcaaccatggtagtggcagaccttccaggtctgcttgaaggggcacatcgaggttttggtttaggccatgagtttctacgacacactgaaaggtgtgcttccctgctgtgtttgattctagagttaccagcttaccacactgctcctagggtacatgttgttgacgtttcgtcaccgctgccagatcttgagtttgatgcagtttgtctagagctgaagctttttaatcctaaacttgctgagaagccttatgtagttgcttttaacaaaatggatcttccagaagcatatgaaaactggaaatccttcaaagaaaagttgcaatctcatgggatcacacctttttgtatgagtgctgtcaaaagggaagatggaggagatatggtaaacttgaaccatgtcgctgttgcagtaaagaagctgcggaatgcatccattagtgattttgagatttgtcatgacagtgattcaaatatttggcatgtagttggatctggattgcaagatttatacagatga

SEQ ID NO: 25832 - DNA, 1428 bp, Glycine max
  Peptide Sequence Number=SeqID_142610
atggccaaagaagatcagaaatttgtcataggaatcgatcttgacaatcagagattgattggtgatgctgctaagaatcaagctgtcaccaacccagaaaacactgtttttgatgcaaagagattaattggcaggaaatacagtgatcccattattcaaaaagagaaaacgttgtggtcattcaaggttgttgccggtatcaatgacaaacccatgattgttgttaagtacaaggatgcgggagatttcagaggtttatttggaaacacctctgaagaatgttgttgttaccgtacaaaagatgctggtgctattgctggcctaaatgttatgagtataattaatgaacctactgcaacagatatagcatatggtcttaacaagagaactaattgtgttggagagcgaaacattttcatttttgaccttggtggtggtactttagacgctgctctcctcacgattaaggacgtctacgaagttaaggctactgccggaaaaagaaagtttgaggaaatcgatatggagctgtttgaagaatgcatggagacagtagataagtgtcttactgattctaagatgggcaagggcagtgtccgtgatgttgtccttgttggtggttcttctaggatttccaaagtgcaagagctattgcaggacctcttcgatggaaaggatttgtgcaagagcatcaaccctgacgaggctgttccttatggcgcatctgtgcaggctgctatgttgagtgaaggcattaagaatgttccagacttggttctattgggtgttacaccactgtcacttggtatattgaccaagggagatgtcatgagtgtggtgattccaaggaatactaggattcctgtaaggaagacgcaagtatgctgtaatttagataaccaaaaacgtgttccttttagtgtttacgagggtgaaagggcgagagccaatgataataatttgttgggttcttttgttctttctggtttgcccccttctcctcgtggtcatcctttagatgtaagttttgctatagatgtaaatggtatcctatctgtttccaccgaggagaaaactagtggcaataagaatgagattaccataatcaatgacaaagatagactgtcaactgaagaaattggaagattgattcaagaagctgagaagtacagggctgaagataagaagtttcttaggaaggccaatgctatgaattctttgggttattatgtttacaagatgaggaatgttttaaagaaggatattagttcgctttgctcaaaagaaagggagaagatcgattatgccattactaaggccacaaatttgctagatgatagtaaataccagtatgaagtggaggtgtttgaggatcatcacaaggagcttgccagcttctttgaatccatcgcgagcaagattggttag

SEQ ID NO: 25833 - DNA, 883 bp, Glycine max
  Peptide Sequence Number=SeqID_142611
atgtcaacctcaagaacctcagatgcttccctcaaaggatatgagtccaaccaaacccaaatgaatttgtctctccttcaacgtaacatgtctccttctggtgagagaagaggccggggaaagcaagcagaacctggaaggtttctcggagtaagaaggcgcccttggggtagatatgctgctgaaatcagaaaccctttaactaaagaaagacattggcttggaacatttgacactgctcaagaagcagctcttgcttatgacagagctgctctgtccatgaaaggatgccaagcaagaaccaacttcatatattccaaagacaccaataccaacattttccacaatgctctcactcctatgaatgctcaacctctcttgccaccttcatataacactcacaacccacaaccaatcaatcaaagtggcctatctcaccttggtaacatttcttcccacattgaaaacccttctggcatgagttcatctgggtcacctcaggatgataatttcttcttctccagtgattctaactcgggctatcttgaatgcatagttcaggataactgttcaaggaagagcaatgccagtgcttcaagtcatgaccttaagcttggccacgttaatacaagttccatgcatgttcagccacattttgacaccactcatgaagtcctgaacatgcaaacaacagtggcttcaaactccgcagatttttcttaccctagtaaaggattatgggattgcagctccaatgaactagcagctatgtttaaaaatccatcaagggctgaggaagggtgcatgaatgcattgtatcccttcactgatagttcaagctacggtttcatgactcaggctgagcctgtttcttcaactacat

SEQ ID NO: 25834 - DNA, 1347 bp, Glycine max
  Peptide Sequence Number=SeqID_142612
atggagcagtacggccggtccagtgaaggttcgcggtctgatccgtcgccggaatgggccgggcccgaagcccaaaccgggctcgaagctggttcgatcttgattgtggaaaatgcagagcccatgtggcaattgggaatgggtggtgctggggaggaatcgtatccgcaacgccccgatgaggttgattgcacttactatttgaggactggcttctgtggcttcggttcccgctgtcggttcaaccatcctcgtgatcgtgccgcggttgctggagctgagaggaccacaggggagtatccggaacgagtaggccagcctgtgtgccagtattacatgaggacaagaacatgcaaatttggttcgtcttgcaagtaccaccaccccaggcaggcaggaggcactgctgctactcccatgtcactaagttattatggatatccattgcgaccgggtgagaaggagtgttcctattatgtgaaaacaggacaatgcaagtttggtgcaacttgtaaattccatcatccagttcctgctggcgtccaaattccagcaccatcgccagttgccccatcgcctttgcctgtaccggtaccttcgccgttatattcaaccatgcagcccccacctggtccttcgtcccagcaaattggggtgctggttgcaaggcctcctatgttgcctggctcattagtccagagcccctatggacctgtggtactgtcacctgccatggtacctatttctggctggggtccttatcaagtaggtcaagcttttctttttgattgctcagtcaaattacatgtgcattcattgaagccattaactattgagttcttggtgcaggcttctgcgacaggtgctgttcatccttctggtactccatctaatgttggttcaccacagctttatgggataacccaactaccttcaccagtagctgcctatcctggaccttatcaaccttctggttccccagttggtccttcaagcagtagtcagaaggagcaggcatttccagaaaggtctaaccaaccagaatatcagtattatccgaaaacaggggaggttaaatttggtccatcatataggtataaccctccaccggacatgagtgcaccaaaagcaaatgtgattcttagtcctgcaggtcttcctttgcgcccggtaatggatgcctctcaactttgttgtaatatatggcgccttttattgagttgtgaattacatatgcatgatccatctcccctcttccacatagtaggaaaaggctttgctgttgttgatccatcttccctccaacagagttctatagcttccagagatcaaactagctatttgtga

SEQ ID NO: 25835 - DNA, 264 bp, Glycine max
  Peptide Sequence Number=SeqID_142613
atgggcccaccagttgacaaagtcaagccaattgacccagtcaatgttgatgaagacattctggatggaacagactccttgctagatcctgaggatagggtgcaactggcatgtcagccagggaagaagcagatggactataactcagtgatcccatatgatgatcgaatttgcatgcagaaccaaacttacacactccatgttgtgcataatgaatgcaagctggtgccgccccctgattatcaaacacaaacattagattga

SEQ ID NO: 25836 - DNA, 381 bp, Glycine max
  Peptide Sequence Number=SeqID_142614
atgttgttacaaaagtttcaacaagctcagcagagcatgcttatagctatcatcaaccctagcgtccaaccacaaccaactcttccacctacatctacaccaagtattctacctacacctgctcaagttgaacctacaccaccaagtaagaaagaaaagtcgttggcacttagcatccataggaccaagaagccttcatcgtctataactccctcatccaaagcatcatcaaaagcactaagtgtgggcaattgctatgatgatgaatctaaagacaaagaaattaacgaagatgatgagttgccattcatttcaagaaaaattaggaagatgtggagagacaatagtggatccaaaaggttcttcaaggaaaaaaagtaa

SEQ ID NO: 25837 - DNA, 372 bp, Glycine max
  Peptide Sequence Number=SeqID_142615
atggagaagaagcttgtagcaattcaatacctttgcatgttgagagaaaatcgatcctctgtggatttcacatatgacacaaaggagaagacaaaggacgcaaaggagaacatagaggatgttgtggggtctatgaaggacagggtggagaacgcagcagagaagacttttgactattcatatgacacaaaagagagtgccaaggacacaacgagaatggtcgcagacaagagtagggagggggctgagaggatgaaggagaagatggaggaggtggcggtgttggcaggggagacactaaagagtttggcgaagaaggcaaagcagggcgtgcaaggggcatgggagatggcggtaaaccttcaagactaa

SEQ ID NO: 25838 - DNA, 551 bp, Glycine max
  Peptide Sequence Number=SeqID_142616
atgaattcattgcctagcgttgttcatgcgtcctccaccttcgagtctggagccccgcgaattgattgtctagcgctgttcgccaattctccattctccacttttattaggagccccatgaatatattgcctagcgctgttcatgcgtcctccactttcgagtctggagccccgcgaattgattgcctagcgctgttcgccagttctccattctccacttttattcggagccccatgaatttattgcctagcgctgttcatgtgtcctccaccttcgagtctggagcccccgctgttcatgtgtcctccaccttcgagtctggagccccgcgaattgattgcctagcgctattcgccaattctccattctccacttttattcgcagccccatgaattcattgcctagcgcttttcatgcgtactccaccaatgagtctggagccgcgcgaattgattgcctagcgctattcgccaattctccattctccacttttatgcggagccccatgaattcattgcctagcgcttttcatgcatcctccaccaacga

SEQ ID NO: 25839 - DNA, 228 bp, Glycine max
  Peptide Sequence Number=SeqID_142617
atggcaagggactggagtagttttggtgtcattctgcttgaaccgctaacaggaaaaactgcagtgactaagagaatggagttggtaaagtgggttttaagtaatccaacagaccaagattacattcttgattttaatgtcagtaaaacatcacaagtcattagaaaccacatgcttgatattctcgagattgctcttgtttgtgttagtacatccccagaagtatga

SEQ ID NO: 25840 - DNA, 201 bp, Glycine max
  Peptide Sequence Number=SeqID_142618
atggcattagcatattatctgttgaagtacaagtttaaggtgaagtcctacaaacctgagcctttaggtattgggttaaagtgtggtgtcaagttcacttatgtggttgctcatggccgaaggtgttgcggcgatgcaaggaactggagcatgctagcggaaatgactagacgagcgaggacaacaacggttaagctttaa

SEQ ID NO: 25841 - DNA, 1002 bp, Glycine max
  Peptide Sequence Number=SeqID_142619
atggattcctggggctatcagggttctgtcgatggttcattagaggatgccattggaacgaccccaatcctcctcttaccaaacttcaacttgcctttcgttcttgaaacatatgcttcaggtgttgggatgggtgttgtgctatttcaacatggtcacccaatagctttctttagcaagccttttagccccaaattgattcatgcctcaacatatgttaggaaactttttgcaatcatagctgccacactggagcaacaaatgtatcttgcgaggttgattggttatgactacacgattcaatatcgatccagcaaatcgaatgtggttgttgatgccttgtcacgagtgtcggagatcccttcgagcaccttcctttcattatcagatgtcgagcgttttgtagccacttgtgtggattgccagcatacaaagtatgagacacgcaaggcagcaaggttgcttggtcacaatactatcctggtggttgttgatcgcttccctaaaggaatccatttgagcatgcttcccttgcatcacacttctctcacagttgtgcttctcttcatggaaatcatgggaaaactccatgggatgcccaaaagcctcatcttagaccgtgactcgctttttattagtcgattttggcaagaactgtttcggatcagtggaactaaattgtgcatgagttcggcgtatcaccctcagttcgatgggcaaaccgcgttatcaaacaataccttcgtgccttcgatcacaagagaccctttacatggggaaagctctgatctttctccatacgagctcacttttggcaagaaacccttcaccatttcgcagtatgatgctggaacatccaatgaggaggtcgttgatgattttttgtctagtcgggaagcagtgtttgcagaacttagaaagaagcctctggaggcccaggaaaatatgaaacgatatgtagatagcaatcgcagggatgttgattctgacaaagaagactga

SEQ ID NO: 25842 - DNA, 306 bp, Glycine max
  Peptide Sequence Number=SeqID_142620
atgaaaaagctagcaaggaagtttcacaatgaagaagacgaaaacttgcctcttccgattcacgatggagactctcgtcccttggaccctcaagatttagattttgatgcacaaagcaagaagagctggttcgttctcttgaaaggagtcaagctcaacagagtcgcttatggaggaccatatttgcaactctattcttctgttacatcgtgtttcttttgtactccatcttccagtaggcttcatctctgtgggaactggttcacttctcttgtcaggatttctgcttcccattttatgttatga

SEQ ID NO: 25843 - DNA, 642 bp, Glycine max
  Peptide Sequence Number=SeqID_142621
atccactacgttgtggatggaaaagacgaagttagccctcaacttgaagaagaagaagatggtcatggtggtgatggtcgtggaaaagacgaagatgctctgccttgcagcaataacgaaccccaacgacgacgatggggaggaggagacagtggtaacaggtctcgcggcaccacccagtacccagccctctgcatccagtccctctccgtctacgcctccaccatccagcaagacccccacgagctcgtccagacagccctctccctctccctcaaccacaccgaggccaccaaaaccttcgtcgcaaaatgcaacaaattcagaggcctcaaaccgagagaatacgctgccttgaaggactgcgctgaagaaatcagtgacagcgtcgaccggctcagccggtcgctgaaggaactcaaattgtgtaaggtgaagggtgaggacttcacgtggcacatcagcaacgttgagacgtgggtgagttcggctttgaccgatgagagcacttgcggcgatgggttcgccgggaaggcgctgaatgggaagattaaggaggcgattagggctagaatggtcaatgttgctcaggttactagcaatgctctctcgcttattaatcagtatgctgcacaacactag

SEQ ID NO: 25844 - DNA, 258 bp, Glycine max
  Peptide Sequence Number=SeqID_142622
atgggaaaaggaaatgaatacctcagtggcacaggcgaacacgtagagggaattttgaggtttttcgacgacaaggatgttgtggaagcggatgtgatggtggaagatgctgtagcggaaggcgtcatgaaagtcgaggatgaggggcttgaggtcgacacgggtgaggattttgaagatggcgacaaaggtggcgtgggtgtggtagaagtggggctagcagtcgacccagtcgaagaacatgacgccctttactga

SEQ ID NO: 25845 - DNA, 168 bp, Glycine max
  Peptide Sequence Number=SeqID_142623
atgaagaggttagcaagtccaaacagaaatcatggcatagagagcacgggtcaaggcaaattgacccttaattttggggagttggaattttggttgggtgaaaaattttgtttcaacaacatcaccaatggcacacacgcaaagataaaatatgatgagttgctatag

SEQ ID NO: 25846 - DNA, 498 bp, Glycine max
  Peptide Sequence Number=SeqID_142624
atgggaaccctaatagatttaaaacctaagacacagttatggtccccaagacaccaaatcataaacaattttctcatctcctcatctgaagagaaaaatgaaggtctcaaaaggaataaggagatttggttgaggaaaaccatcaaaccaattattcgtgtctgttttccagattctgttgcatttgcttcgtcaatcattatggatctaggtatttctaaaactcttcctgataatctaatgttatgggttcctgacggttattggaacaaggtgagggaaggacttctgatcgagggctcgcaaaggctgaaagaaagggaaaagagacgtacgtcatggaaattttgtgaatatagagtgaacggaaaagatgacggttttaagaaaaacatcgtcattttcgatccctctatttacgatattgccaccgcttcaaattcgacgacgattccgcataattgtcttcgttttgatgtcgttgaagtagttttttag

SEQ ID NO: 25847 - DNA, 2307 bp, Glycine max
  Peptide Sequence Number=SeqID_142625
atgactggtcacaaggactggtttgttagccttgatgagttagtaaatcacaaggtcagatttgcagatgatagcactataagagttgaaggtcatggcaaggttgtgattaaaagaagggatggtacagtgtcatacattgaggatgtgctctatgtcccaaacatgagatgcaatcttctgagtcttggccaactacttgaaaagaaatacagaatggtgatggaggacaaagaaatgaagatctatgacaaggacagaaggttgatcatcaaagctccattgaacaggaatagaacttttaaggttggtattcaagtcatgaaacacaattgcttgcaggctgagacatgtagagaggaatggttgtggcactacagatttggacacttgaatttcaaggatttgagtcaactgcacagaatggctcaaggaatacctcagctgagacagatgacagaaaactgcagagaatgcctggagtgcaagcaaccaaggaatgcatttcagaaatttgtaccagtaaagtcaacacagaaattggaggtgatcttttcagatgtatgtggtcctcttcaagttgaatccataggaggaaacagaactgacggaggtggtgagtacacctccaaggaatttgctgaattttgtgatgaggcaggtatcactcatgagttcactccaccttatacaccacaacacaatggtgctgctgaaagaagaaacgggactatcctgaatatggtgaggagcatgttgaagactaagaagctacctcatttcctatggagtgaagcagctgcaatagcagtctatatactcaacaaatgccctaccaagagactgaaaggagtgacacctgaagaagcctggactagtactaaaccaaaagtgaatcaactcagaatttttggttcactttgttataagcatgtccctgagcagctgaggcagaaactggatgataaaggtgaacaaatgatccttataggctatcatgcaactggaggttacaagctacttgatccaaggtcaaagcaggtctctgtgagcagagatgtgatatttgatgaactaaaggaatatgagtggaaggaggaccctataaacaatacaaccaagattctggcagattcaatcattctagaagaattgagtgacactactgatgaactgcctacaaggaacactgaaggaggaaccaggaggtctcaaagggttatgcaaccctcacaaatgttgaaagattatgaagtcatgaaagacagccaaatcacagatgaaggtgatattgtacacttttccctatatgcagatgctgaacctgtgagtttcgaagaagccttgaagaatgacaagtgggtcaatgctatgaaagaggagctgaaatcaattgagacaaatcatacctggcagctaatggagttacctaaacttaaaagacctattgttgtaaaatgggtttctaaagtgaagagaaatcctgctggtgaaaaagaaggtgtagactatggtgagatctttgcccctgtggcaaggattgaaacacttgatgtaaaatctgcatttctgaatggtcctcttgaagaagaagtgtttgtcaagcaaccacctggatttgaagttgttggacatgaaggaaaggtatacaaactgaggaaagcattatatggcctgaagcaagctccaagagcttggaacaagaagattgacaatgtcctaattcatattggctttagcaagtgcatatctgaacatagaatagagattgacaagattaagcaactgttgaagaatcaatttgaaatgactgacttaggatttctcttatacttccttggaattgagttcaaggaaactgaagctggaattgtgatgcatcgaagcaaatatgctacatacctgttgaagaagtttcgaatgactaactgtaatgcagcagccaccccagctgaaacaggattggcattgagtttgagagatgaaggagaacctgttgatgaaactcagcttatgcaagctccaaaaactcctcacatgatgacagcaaagagaattataaggtatattagaggcacaattaactatggtattctattgccaaataccatcacgagttcaaacatggaactggttggctatactgactcatactggagaagagacaatgatgataaaaagagcactgctagatatattttcctacttggagatgcactggtgtcatggagttcaaagaagcaagatccggttgccttatcaacttgtgaagctgaatacataacagcatcaatatgctcgtgttaa

SEQ ID NO: 25848 - DNA, 1291 bp, Glycine max
  Peptide Sequence Number=SeqID_142626
tgcagaacagtttctaggtatggaaactctttcatatgggtcagcaccatgctgccaagttgtgaactcaaagtggaaattagttgaaaagagtttgagttcacgtcaatcaagagtttcctctataggaaaacttggagtttattacacaggtactatttctgcatgtgcgcctgtgagattttatgagatgggtactagggtgcagctaagaagctcaaaaagattcaatttcaaggtttgtagtggaagttatgatgatggttatgtgattggtgaagaggaagcaagggatatttcagggttagaggagcctgtaacaaccaaggttctgattccaggtctgcctgatgattcaaaaggtgaatctggtgctccaataagtagttgtttttggggatggaaacctaaactcaatgtgcactatgagaaggccgggtgcgaaaacgtcaatgatttgcctcgtgttctctttttaccaggttttggtgttggctctttccattatgagaagcaacttaaggatttggggcgtgactacagagtgtgggctctggattttctaggccaagggatgtctttgccttttgaagatcctgcccctttgtctaatgaagaggctgcatcaaatggaagtgtttcttcatggggttttggagatgaaactaaaccgtgggcgactaagcttgtttactcggttgatttatggcaagatcaagttcgttgcttcatagaagaggtcattggtgaaccagtctatcttgtgggcaactcactaggaggattggttgcattgtattttgcggcaaacaaccctcatttagtgaaaggtgtcgcattgcttaatgcaacacctttttgggggtgggagaaaattagtgatcctaaaagtattgctgaggtacttagtcaggtttatgcagatcattcaacaaacgtagataacgttttttcacgcatagttgaaaccacaaggcatccagctgctgcagcgtcatttgcttcaatcatgtttgctcctcaaggagaactatcctttaatgaaacattatccagatgtcgagcaaacaatgtgccaatctgcctcatgtatggaaaagaagatccctgggtggggccaatttggggtctccaggttaaaaggcaggtgcctgaagctccatattatcaaatcagccctgctggtcactgccctcatgatgaagttcctgaggattgtactgtatttgatttatcagttcttaaagtcatttcttccatgttttttcctttccatattgagaaatgttag

SEQ ID NO: 25849 - DNA, 522 bp, Glycine max
  Peptide Sequence Number=SeqID_142627
atgccacttcccttgacaatgactgatattgggcctattgtactacctgctaaggtactagctgcacgtgtgattcaacaaggagagttgaagattccacaggttcttatccaatggacaaacatgccaccagatgaatccacatgggaagggttggaagatatgaaagccaattatcctagcttcaaccttgaggacaaggttgtcttaaatggggatggtattgtaataagacaaattaaggagaaggaaatagatgttgctgagtcatcaattcaagtgtgtaagggcccacatggaatgcaagaggataattctgttatgcatgatccggaattacagggaatgcgcaaaagcaccagagcacgcaaggccaacaaccaattgaaggatttcgtcttggggtgggggtgtagttattatggcaaagggatcaacgtgaggtttcattcagatctggaacggaagggggtgcaagggaaaggaaaggacacatttgtccatttaagtttcctatgggat

SEQ ID NO: 25850 - DNA, 339 bp, Glycine max
  Peptide Sequence Number=SeqID_142628
atggttgtctccatagtgaccgccaatttcatggtgtctaaggtgcttattgaccaaggtagctccacagacatactttattggaagacattccagagacttaaagcctcacctgatacaatccagccacattatggatcactcctcggctttgcaggagaaagagtagaaaccagaggctacgtggacctaatgaccaccttcggtcaaggccaactctcaaggagaatcatagtcaggaaaacgttgaacgaacttggggccatcgtctctacacctcatcttaagagaaatttcccaaccttgataggagagatcgtaactgtcaaggaggactag

SEQ ID NO: 25851 - DNA, 1458 bp, Glycine max
  Peptide Sequence Number=SeqID_142629
atggttgagggtggcagcctcaacatgttcaagggttgcaggtttgtcaagaccccccagcctggacaagtgttgtccaggttgctttgtatggggtactcatgcttgttgttctacaggaaaattcagtgcgcattaaagagggacattctatttctctttgttgcgagcggtttcgcatggacattcttggtgaagcacgtcggacttcctggtgatgatgtgcctccttctaccgttgagcctcttgtaggaaaaatgggtcaacttgctactaggtttggccctgatgatgatgaagctgttgagcatgatgacggggttggggtatccgaacctaagaagtcaagtgtggaagcaatgccttccaaggttattttgatgatgccaaagaatcaagagttaagcaaatttcaaagattcaagaatctagtttcaagaatcaagattcaagattcaagaatcaaggtacatctacttggggattgttatactgagaacaagagagggtacatctcttatggatcagttcaagtggagggtacatccacttggttattcaaagagaacaagggagggtacatcacttgtggatctttggcttgtaaaggattttacaaggctactattgctgctctcactccttcgacaccttcttccttgcctactcaggaggtttctgtctccctatctaccatggttgctgcactagtccctttggccgctcctatcatggctcctccttccatcactgttacacctttgcttagtgttggtgtagtgactatgagtactttggtggtcccacctccttcttcttccacttcaccagtttcaacttcatttgtgttgtcgttggtgttgccttccttctcttcttgcccagcatcaggaagggtttcctctttagagactaaggttgcagagtggagggccactactcgaacaatatggagagtgaagcatcccaaggtggtcaatgttactgtcacccttgatgaggccactcggcattataaggacttgctaagagagaaaaatgacttgactgacaaggtggagagcactattgtagagaaggaagagcttgttgttgagtctattaaggtgattactggtctccgggcccagttgaaagagtcagagtccaagcaggaggagtttgagctcaaggcatcgaaggggaggaaggccagtaaagagcttaaagaggagttgttggagttcaagaaggaagccatggagccacacaagaagggcttttacaaggccgttaggcaggaagaaataattatcatggaggaggatgttggtgtagagaaagatgttggggccaatcaaggctcaccaaggccggaccttgggtttgatgagcctttggagaaactagactcaccaaggggggaccttgggtttgatgagcctatggataatccaccagggatgcatcaatcctag

SEQ ID NO: 25852 - DNA, 1783 bp, Glycine max
  Peptide Sequence Number=SeqID_142630
atggtgaaagagatgctagatcaaggaatcattcagcccagtaatagccctttttcatctcccattgtgttagtgaaaaagaaagatggaagttggaggttttgcacagactatagagctttaaatgccattacagttaaggatagtttccctatgcctactgtagatgagttgttagatgaactttgtggtgcaaagtatttttcgaagctggatttgaggtccggttaccaccaaatcttgattcaaccggaggatagacacaagactgcttttagaacccaccatggtcattatgaatggctagttatgccatttgggttaacaaacgcgccagcaaccttccaatgtctcatgaatcaaatttttcaacatgctctgaggaagtatgtattgtaccacttggaaggaccacctcacacatttggaagcagttttacaggtgttagaacaaaataccctgagatagagtatctgggacatgtggtgtcagggaaaggggtagcaatagaggcaaccaagattgaagcagttctcaagtggccaacacctactaacctgaaacagttgagagggtttttaggattgaccggctactatagacgattcattaagtcgtatgccaaaatagcagctcctttaacagacttgttagggaaagattcattttgctggaatgaaacaacacaagaagcttttcaagggctgcaacaagccatcacatctgcacctgtattagctctgccgaatttccaacaaacttttatccttgaaactgacgcttcaggaattggagtgggggcagttctgcaccaaaatggccacccgatagcatttttctcaaagaagctggcaccacgaaaccagaagaaatcatcttactttagagaaatgctcgctatagctgaagccatcgcaaagttcaggcactacttattggggagtaagtttatcatcaggactgatcagaagagcttgagaagcttgatggatcaaagcctacaaacacctgaacaacaagaatggctacacaagtttctgggttacgattttgtcattgagtataatccaggaaaggagaacatagctgccgattccttgtccagaatgttcatgatatcgtggtctgaaccaaagacacgatttatgcaacaattactagatgaagtgaagagtaatgataaaatgcaggagctcataactcaatgcaaagatcacccccagctgaagcctcactacacgaccaaagagggactgctttattggaaaggcagcaagcaaaatcttctcatagtttaccagctgggttgctccaaccattgcccattccatctcagtgattacagcagtaaaacagttgcagaggctttcatgaattatatagtgaagttgcatggaattccaaagtctatagtttcagacagagacaaggtattcactagcgatttctggaaaagattatttgagatacagggtacaacattggccatgagttctgcatatcacccacagtcagatggacaatctgaaattctcaacaagtgtttagagatgtttttgagatgtttcacttttgagaatcctaaggcttggtataaagctttaacttgggctgaatactggtacaatacagctcaccatacaagcattggcatgacaccctttaaagcactctatgggagggaccctccagctttaactcgctataggcctcaaccaaatgaccctattacggtgcaagagcagctgggagaaagagacagaactctacaacagctcaaaa

SEQ ID NO: 25853 - DNA, 492 bp, Glycine max
  Peptide Sequence Number=SeqID_142631
atgtctcttggtgatggtattgagatgcccgatctttttagtgttggccagtttggagagcaagtctactctagtgttgttctcccttggtatgtggaacaactcaaagcaatcaaagtcatcaatgagggtttttgcaacatgatagtacttgaaccttggcttgatatttgtttgcaacttgcccttaaacaagcttgctctaaagtaacattgtcgagcccttcaaggatgatgcttgtccctacttccctttatgttggatgctccatccacgtagaggttccaccagtttggggaggtttagtcattgccagcaaactctactatgaagtcctctatgaattaggttttcatgggaccttgagggcagaactgaaggccttctctacgactgagaggattgctcgcaagcttcatcccacaagaatgactcggtttttcggagtagcttgtagaatggatttgccttctcctcgagtttcgggatga

SEQ ID NO: 25854 - DNA, 282 bp, Glycine max
  Peptide Sequence Number=SeqID_142632
atgcacccctcccgacaacctccacaacctgagctcccattggcctttcaccatgtgggggatggacatattgggaccattgttaaaagccctaggagcggtcaaccacaaccaaaatacgacacagatgccatgaccccctgtcgaaagttggggaaccatcaacaagaaggttgtttttcccaggcacaacaaaatgaagaaaatatgaaggtggaactagagatgaaggatggagtccaaaagatggctagaatcaacgaagaggccaccaagctctga

SEQ ID NO: 25855 - DNA, 618 bp, Glycine max
  Peptide Sequence Number=SeqID_142633
atggatggtgtgaagattacacttttggggtttattggacaaccctccataggaaaatctggccacaatggtgttgattgcccctctgatttgttggacggactcatttttctgctcttgctaaggctgacattcgcgtctctactggtgatgcctctgtctccctctattttctactttatccctccttctatcgacatcatgatttttgtgttggttgtcttggtgccttccggactgtttgcgaacttaccagtcgtagagggagcaacatggagtgtagtgccacttcaagattcagttgaaacgtttgacaagggtgtcaaagctatcgatggactgtggggggagtcctctgtaccatgtcaatgttgccactttgagggacgttggaaaaactcgacacaagattgtgttgtcgttcgtgtaaagattagcctagggatgtcgacgagtcatccgtccttcatggcggtgtatgtgcgaaaggttgggatcatcttgtgtgttgatgtgtcattgtctgtcatggttgttggggaaaggttagagctctctagaggtgtctcgcgtttgaggtcagaccacatgctaaccattggtgaaaagaagccgtag

SEQ ID NO: 25856 - DNA, 192 bp, Glycine max
  Peptide Sequence Number=SeqID_142634
atggttagtggaaattgcattttaatctttctcatagtgttagaaaggcttgtttgtaagaacattgcaaagagaagagaaagagaaagaatggtcgcaggaggagaagaacgtgccaatctaaatgaagaagatgagcaggttgaggggacactgcaagacttcctcacccttctccattgggattgctag

SEQ ID NO: 25857 - DNA, 459 bp, Glycine max
  Peptide Sequence Number=SeqID_142635
atgagaacctgggagagtgagaaggaaaccctagctgcggctaataagcttgaaaggagtatagaatgttgtgtgtgttacggttttggaggtggtgccagcgagcgttgttgtgttgttgaaagcgcaattgagaatgggaagagaagaggaaacttcgtaggttgggcatcaacacgtgcgacgccagagtctgttccgagttactggggccaccccccaacacaacactcttcaatttcaatccctttctgccttcagacttcactatccgacccacaccccttctacccgacccgtctccagatttcagttagccttagggctaatgtgggccttggcccggcaggccgggctaaaaatgctggggccagacttcctgactccacccacttgctccccaacaggacaatgggacagaggattgattcgccacacataaaatgtaaatattattaa

SEQ ID NO: 25858 - DNA, 1779 bp, Glycine max
  Peptide Sequence Number=SeqID_142636
atgactcttgaagatttctttaccttgaccgagatgaaagatgggctcacagcaccttctcgggtgcaggagctggtctctgtgatgcaaaaggagaaagatagtgaggttaaaaatgctgctgatgcgacaaggcagtgggcttctgttgctagcactattgctgctacagagaataaagattgccttgatctttttattcaattagatggactttgcttcattaatagatggttaaaggatgcccaaaattttggggttgatgcaaatgacagcttcgttgaagaatcaatcactgcaatgttacgtgcagttgaaaagctgcatatagacagtgagaagtcaatgtcttcaggaattcgcatcactgtaagtaatcttcttgaccatcatagtgctagggttcaggatagagcaagaacattgtttgacagctggaagggagttggaaatggtgatactgaatctcatgaagtggagcttgctaaggttgacaatgcaagtgacaagattgtcagggaggaaaggcagccatctgctttgaatgaagatggcaatgataatgatcctgcatcaggactaattggatgtgagaaatctctattgagaagctcggatgatttactggtacatagttctgataatgtgccccagttatctgccagtgtggaatgtattgacatcaaagagggatcagcaaaccatgttgctggtgttccttcttctgctcaagaagttgctcccactcatgaaggattgcctatatgcactacgggtgagaccacttcggctggaacctgtaacttttctgtttcaaatcaaagcagttttgaaggacagtcagatgtggtacagttaagtgacttggctaaaatggaaaagcaggagcaaaacgttaatgacgctccagaaaaatttggagcaccagagatctgttctgtgtcctctaataagccagagcccgagcctgagcctgtttccatggttgcttgtgaagccaaagcaccagagtctgtgaaagaaccagctttagagcaaaatgttgaacacagtgaggatgatgtttgtcataaattaactacttctgctagtatgaggacacctgcatctgacaggagtggggaagatgatacaactagcattatacaagtttttaaagctgcagaaaatgataatgattgttgttctaatgccttgcagggcacatcagtcagtgacagtaacttgggaaagactgaagtgttagacatgtctgtctctggaacagaatatgtcacagcatcaaaggaagataagggccacgaagaagatacatcaattggttctgattgtagtaaacctggaatagatttcagaagctctaacataattgacaagagaggttctgacaatgaacttgactgtgccattgtggatgctttggaatttgctcgacaagttgctcaggaagttaatagagaagtcagtagttcttcagaaaaaatctcagaagacagaatcaggcaaccgggcagtccaaattctgtaagaaaagaggaccagctcactcctgtccctcccaaggaggtttcctcccgacaaagccatgctactgaggcatattcaatggagaggcatgcaagtattttagacaacaatgaggctgagccaaaatgcagacctgatatggtgtccttagaggtgactgaaacagctcaagattcagcaggtaattcagagaaacgactctgcggctttgatctcacgaagttggtgctgatgatatggatgtttctgtaa

SEQ ID NO: 25859 - DNA, 786 bp, Glycine max
  Peptide Sequence Number=SeqID_142637
atggagggacaactctttcttggaagaaatggatattggagccaatcccgtgcatcgtcgtcatcatcaatgcagccatctgttagaaacattgatttgaatgataggccatgccttcaaactgatttggtagaccaggggcccaatgctcctgttatctctcttctgggcgccaaggtagaagttggtaaaaatgaatgtgttcctcaaatgtcgtctttgcagaatggcaaggctattgaacctgcgatagatcttagaatgtcaagagcaggtagcgttttagggatgacccccacagtacccttcaatcattcacctgtttttgggtataatggagtggcatcagcatcagtggcacccgcaatgtctttttcatcagccatgtacggatcaggtggcacaattccatacatggtggactcaagaggagctccagttgtccctcaagtgggtggatcttcatcaactgtcctttcatcttactctcagccaccaatctttatgaacatgactggtacacaacttggtctgaatggatttggaccttcacgtcctaacttggacctgaactctggcttcatgattgagggtgggaatagagacacattagctgcaaggcaatttttctttcctggtcagggcagggctgtggaggagcaagtaagatccatgccacaaccctcaagttcaggggttagtgggaaacgaaaggaaccagacagtggtttggaaccctacccatttatctacaaacatccgcaacctcctggaagtagcttctaa

SEQ ID NO: 25860 - DNA, 492 bp, Glycine max
  Peptide Sequence Number=SeqID_142638
atggcgatatctgatgcggtggcgaggaacttcagcaccatcttcgtgggtctcatggcgtgttttgaggcctatggctttgcttcggggagaaggtttagcggcggttatgttgttattgtgtccaccgccgcggtcattctcttcctcgtggcaacgctcacgtgggacgtctcgcgtaaggccacgtgtgcctttcacagagaccacgctgacagccaagaggatgtgtgcaagggaggtatctgttggcacggcgtcgcgccgcgatccccagcctctcagggtttggtggactggttgacactgcctgtagttgataagaataatacaattaatcattatggaatttgcaaggtgaaggtggaattgaattgtgagtatggagtatggactacaaagtccactgtgtccgctagctgtcaagccagaatcactgacatggcctctttattgtcccagtttgctgctcgattattttcattttcataa

SEQ ID NO: 25861 - DNA, 186 bp, Glycine max
  Peptide Sequence Number=SeqID_142639
atggccgagtggtctaaggcgccagactcaagttctggtcctcaaatctcctcaggcccaaatcgcctaggactttttgaattgttaatgggatgggcattgctttgcgcaccaggaaagctgcttgtgcacccagcgctttttcatttttccaaaattatccctgacaaatttacggatccataa

SEQ ID NO: 25862 - DNA, 320 bp, Glycine max
  misc_feature (305)..(305): n is a, c, g, or t
  Peptide Sequence Number=SeqID_142640
atgtcagaagaatatgagaggagtgaggaacatgctgatgatgactcttcaatgggatcatcccagaaatgctcatcctttgatttgaatgaagaagctagtagtgaagataacaatgacaacgatgaggggtatgatgaggaagcaaaagacgaaggtacttcaactaataaaagtagcagcataacgaaggaaggaagtaatgaacgaagaggtggcgtgagacaatatgttagatcaaagatgcctcggctccggtggacacctgaacttcatctatcctttgtacatgctgttgaaaggcnttggtggtcaagaaa

SEQ ID NO: 25863 - DNA, 1014 bp, Glycine max
  Peptide Sequence Number=SeqID_142641
atggatcacttaacactagcatttccatttttactaacacttcatctattagcatcgggtgtattagcaacaacaacgttcacactggttaacaaatgcgactacacagtgtggccaggcattctctcaaacgcaggaatcgcgacgcttccaacaaccggtttcgttcttcaaaccgctgagtccaaaaccgtaaccgctccaacctcttggggcggccgtttctggggccgcactctctgcacccaagactccgccggaaaattctcctgcattaccggcgattgcggctccggcaagctcgaatgcgccggcagcggcgccacgccgccggcgaccttggccgagttcaccctcgacggcgccggaggcctggatttcttcgacgtgagcctcgtggacggttacaacgtggcgatgctggtggctccccagggtggctccggcgataactgcacgagcacggggtgtgctggggacctgaacggcgcgtgtccttcggagcttagggttacgagcgaggatgggaaacagagcgtggcgtgtaagagcgcgtgtgaggcgttcgggtcaccgcagtattgctgcagcggcgcgtatgggtcacccaacacttgcaagccttcgccttactcgcagattttcaagaacgcttgcccacgcgcctacagctacgcgtacgatgacaagaccagcacgtttacgtgcgcttctgctgcggcttacaccatcactttttgtccttctcctaacagtaatcccagtcagaaatcatggcaggggcaaaaccctaaatcagatagtagtggctcggcttcatcttcttctgggtcgccacaaattaacaacggcacaattgtgtatataggtagcatggatccaagtgaattatggtccgcaggcatgcgtgtcattttaaatacatcatccatcgatggaactccaccaccttacaatgcaacacaagtgttctgtttttgtcctggaacccccaaaagcacaatcccatgttaa

SEQ ID NO: 25864 - DNA, 687 bp, Glycine max
  Peptide Sequence Number=SeqID_142642
atgggaaatggtggaattattctagcaagtgattacaacgatcgcagttatttccatggtctcatgcatccctcctccctatcaccttcacaatcaaaagccatcgattcaaggcaccaacaatggtacttcaatagtcatcaaccttatagaagaccaagttactttagcaacgaagttgtctcctcaacaaccttacaaacgcaaggaagatcaatgtcttcaaaccaaattaacctaatggatgctaccagcattgcacccatgaaaccaagccagtttcttgaagagaaaaagtggcctcccttagatattatgaacaaccatcactggaagaaaaggctacctgccaatattagttcaaatagtgggtcgcaacctgttgtacatcaatttggcaccacttcaccatctctaagacctagcgagttgaacttcggaaacaacacaagaatcagctgggaacatctatcaaactccgacgagcatcgtaactattccaacagtttaaagctagaattggagcctctttttcggattaagtcgaatcaagaaaaattgcagaaagagaagcaatgggcgcctgatttgcgactgagtttaagtcagagagacggcaacaatgatggcaagactgatcattgcagagaaacccaagaaatcaacacgaaactttcactttcatag

SEQ ID NO: 25865 - DNA, 423 bp, Glycine max
  Peptide Sequence Number=SeqID_142643
atggccaaagaagataaagctgaaagattggcagccgatcaagaaattaatcaagaatccatgtccttgcaacttgtgccaagttcatttgacaaagatgcagagatcaacaaccagcaaattgtagtggttgatgattcaggaaaagttgacaatgaatatgttctgcatcctcttgccccaccattgccaaagtcaccttctgagtcctggctttgtcgtgccctgcctctagtctcttctaagaattcattcccacattctaatcaaggtacacattcccaggctaaaagacaaggttttagtagagcatcaaactttactaagtgggaaacaattgtgaaatcttcgaatttgaatcatgatcatgtaacctattctaaggaactggtcgtgtacaaatctcagcatatgaaatcatag

SEQ ID NO: 25866 - DNA, 918 bp, Glycine max
  Peptide Sequence Number=SeqID_142644
atgactatacaacctcctcaatatgcttcttttagaaagcaacaacctgttctggcagaacaacctagggaatttatcaaattggttcctgagcaaaagaagtcctttgttaatagacatatcactgacattgtaccatatactggtcaatgccaagaggaggaggaggaagaagaagaaagtgacgatgaaactaatgattatgcaaataattcagctaaaggttgcggattgtttccacgcttatgtgttagaaactcattgtgcttactaaatccagtgcctgggacgaaaatggggaatcagtttcccttgtattctgcctatgaggttgtaaaacctgataaaagttctcatattcgttctcatagaccagctccagctataaagaaggcttgggatgctattaataagagcaagttaagctctagctctcgagctgcatcaccagacaagaaagatgtgaggaaaaaatggactagtgaatcaagcaggtataactactcaggtgaattgaagcagctaggtaggctctctccctttcgtcgttcaagagctgcttctgctggagtatctccttttcgaagtaaacctcaacctccctttcctggagcaaagttgcttggtgattccgaacaagctgataataatcattctggcaaattgaaattcccgaatagaggacatgcaagtattcaagaggtgctatcacaaggagccaaaaaaagctatagctttgggagcctttctgttgaaaagacattgtacatagatactgcaagcacagtaaaatcatcatgctctagttcacgttctttaggtagcacaatagtggtaggaaaagacagaaattcccttgtagattcttttcgagatatgaagcacctagaagctttggaggagaatttggattctcaa

SEQ ID NO: 25867 - DNA, 501 bp, Glycine max
  Peptide Sequence Number=SeqID_142645
atgactgagttatcgaatatcttcgtggataattattttaaagtttcatctttttatgaggtagccaatagtgcaaatatagcagtttcagtcacgtgttgcgcgccatctgctgagagcatattctctgagttctcacttttactcactgatgaacccattgaagaaccagagactattgatatgggtgttatttttggggaagacaaacttacaacctctggaaacagtggtgaggatgacgacgacgatgcacttattgacatggatgatcaactatattttcctccacaacagagacaaattgacatttcaaagaacataagggacagggtgcatcttgagattaccatgaattcagtatgtggtcctgggtgcaaaggcatgtgcctgaaatgtggtcaaaactttaacactggcaattgcaattgtagcaaggaggaagtacaagagaaaagctttggcccgcttggaaatttgaaagagaagatgcagttgtaa

SEQ ID NO: 25868 - DNA, 432 bp, Glycine max
  Peptide Sequence Number=SeqID_142646
atgggaaaacggtattatggtccctaccaaatcacaaagatcattggttcagttgcttataaagtggctctacctgagtcagctaagattcatccagtgttccattcttctttgctgaagccttatcatgatccatctcaatctgaacaacccctacctccaacagctatagagggaaaaccaactatccagcaaatcactatactggatcacaagtgggattcgtctgattcacccaaacgcttggttctggtgcaatggctgggtttgcaacctgaagattccagttgggaagattggactgaattgcaagctaattaccaccttgaggacaaggtgtttcttgaagggggcgaaggcgtctatgacgatgatggcgtcggagcgcgcgattgtcaagtggttgtccgttactactgtcgacttgtctaa

SEQ ID NO: 25869 - DNA, 1620 bp, Glycine max
  Peptide Sequence Number=SeqID_142647
atggcagacaacaccagaatgaaagagctcgccaccgacgtgaagaaaaacgccgacgatatcaagaagttgtacgatgaagttcagatccagtttgagcgttttggtgctgtgacggatgctcgatttcaaaccatggaggatctgcaatcgtccactgatgggaaactggataaaatcaacgaagctctttcgatgttattacgcaactcctctcagacctcttcccatggtgttacgaactcaaacaaagctccgtttcaggtaagaaatgtcaagctcgatttcccccgttttgatggcaaaaatgtaatggaatggatttttagagctgagcaatttttcgattattatgaaacccctgataaggatcgattgactatcacatctgttcatcttgatcaagatgtggtaccttggtttcaaatgatacagagaacacatccttttaattcctgggctgagttcactcgtgccttagaactggattttggaccttcaatctatgattgtcctagagctaccttgtttaagcttagccaaactgggactgtgagtgattattatcggcaatttactgctttagcaaacagggtctatggattaagcactgatgctcttgttgattgttttataagtggcttaaaccccgatattaggagagatgtgatgattcacactcctattaacattgtgaaagctgtgtccctagcaaaagtttatgaagaaaaatacacttccaacaccaaaccacaaaaataccaaaacccaaacactcaataccaaaatagagctcacttcaattcaaataaaccagaaatcaaccaaaaaccaaccaatactcccttattaccaacaccccctaccagacccatggacattaaccaaaagaatccaaatatcaaaagaatcacccctgcagagatgcaattaaggaaggacaaaggactgtgttattggtgcgatgagaaattctcatttagccacaagtgtcctaacaaacacctgatgttgttgcaatctgaccatgaaccagaaaatgcagcagaagaggaaacagaaccaccagaccaaccacaaaacatcataaaccaaactcacacagaacatcacctatccttgaatgcaatgaaaggagccaacagtctagggacaatgcgtttcatggggaaaattggcaaactccaagtacaaatacttattgatggagggagctctgataattttgtacaaccaagaattgcgcattttctgaaattaccagtggaaccagcaccctgctttaaggtgttagtgggaaatggacagactatgacagcagagggggtagtgacacaactccctgtagtcattcaagagcatgaaatgttgattcctgtgtaccttttacctgtagctggtgcagacttaatattggggacagcttggttggctactttagggcctcatgtggcagactattcagctttaactttgaaatttttccacaaaggaaaattcattacattacagggtgacacaagcatgggaccaggtcaggcacaattacatcagctgaaaaggatgtgtaacactagaagtattgatgaagtgttcactggaagagagagtacaagctga

SEQ ID NO: 25870 - DNA, 189 bp, Glycine max
  Peptide Sequence Number=SeqID_142648
atgtcgctagaggtggaagcatgccggcaaaggcaccatcacgcgccttcatgtgtggcgagtataaaggtccaccagaaagagggcgacaagcaaaaggcctcatcagggacaatgggtcgccagaaaagtgacggtggccaaaaatgtcaccggaaaaagaagaaagggtcatcgaaagataggtga

SEQ ID NO: 25871 - DNA, 1146 bp, Glycine max
  Peptide Sequence Number=SeqID_142649
atggttaaggtcgagatagaagattctagaactggtcccgttaacatcacctttattatggttcaaatcgatcatggaggacaagtccgaatcacttgtcatcacgtggtggaactcaattgcggcaatggggtgatgattgtaaccaaacccaaagccacatggatcggccatgctggcgtgggacggcagtgggggtgtggttcaggttgggcagagggggtgagattcaggttgagcggcgacatcatggttgcagctggaggactcgatggcgtttggcagcagcaggagcatagaaggagggtggcagcagcagcagccatgaaggaaggaagggaagtaggagatgatttggtaggaagggtctatgatacgactttgcacctctttgttgcagttcttagaaacaaaacattatcttttaggctaatgatgagaatcatgaaactggccaaatacaggctaaaggtccaagtggagaaggacgaagcccaagtggagaaggacaaagcccccgagtggagaaggatgaaggcccaagtggagaaggatgaaggcccagaggcagagacactatcaagacaattaattagccaacatgagactaaagtaggtgtagcggagatgaggatgttgcggtggatgtgtggtaagactcgacaggataaaattagaaacggagctattagagagagggttggagtaacgcctattgtagagaagatggtggaaaatagacttaggtggtttgggcatgtagagagaagaccggtagactctgtagtgaggagaatagaccagatggagagaaggcaaacaattcgaggcagaggaagacccaaaaagactataagagaggttatcaagaaggatctcgaacttaatgatttggatagaagtatgacttatcaaggtaatcattgtagcgtctaccctgacttatcttccttcactggaagtggcgtctaccctgacttatcttccttcaccggaagtggcgtctaccctgacttatcttccttcaccagaagtagcgtcatccaaacctccatagccagtatcaagcgatccgctcctactcaggttcacatcaggctatgccgcaatactgttcttaccagtaaacagtttcaatggtgttga

SEQ ID NO: 25872 - DNA, 111 bp, Glycine max
  Peptide Sequence Number=SeqID_142650
atggtggacatggcttttatagagcaagtgtgggaatgggagacaatgataggcagttgctggctggcaaggatattgaggtgttgcatcaacaatgatatacggatgtaa

SEQ ID NO: 25873 - DNA, 498 bp, Glycine max
  Peptide Sequence Number=SeqID_142651
atgcatcaagtgcccactgccaacacaaatcctaccaattgtattcctttactcatgatgaaaaaccaatctatcttgttgttttccccagcttctgcccctctcaaaccaacccaacctgctcctaccacaccagctgctgctcctcaacaaccattggttccctcattgccacaacctccaactgattccacccgacaagggagtgtgaacatctcgacgggtgaggttaacaccaccatcactggcattatatatactgataagcatcttgctatatataaggtggggaaggtgcttcttcctatggacttctttactgttgctaaagcaccggcaaaggcaccctcattggctccagaggcgcctaaagaggataaggagaagtcactatccccagattcctcagaatcatctgagattaattccacaaacgacaactctggcactgtgaaatcaatttgcatggaaagtgggcgtcccttgttcctggactag

SEQ ID NO: 25874 - DNA, 1224 bp, Glycine max
  Peptide Sequence Number=SeqID_142652
atgatgatgcaacattctctcatcttctgtgcctcacttgtacttgtgatgatcaccacatcagcccaacactcaccagcagcatctccaacaataccaaaattgccacaatcacccttggcatctccacagggaatgaatactgttccattggtaccagtgtctcccattggtgcccctacacccgccacttcaaaagctcccaccattgacattgctcaaatcctgagtaaggccaagagattttctgttctgattcggcttctgaagacgacccagttgatcaaccaactcaactctcaactcctcacgtcaggttctgggggattgaccattttctccccacctgattctgccttctcaaagctaaaagcaggattcctcaactcactcaacgacaggcaaaaggttgaacttttacaatttcacactctttcttccttcctctcaatctccaacttcgacactctcaccaaccccgttcagacccaagccggtgatgactctaaaaggctgcaacttaatgtcaccacttatggtggcagccaagtgagcatgaccaccggtgccgtcaatgccaccattaccggaaccgtgtacacggacaacaagcttgccgtttatgaggtggacaaggtgcttgtgccacttgacgtggttcttcctaagcctaaggctccggcaccttcaccgtcgaaaggagaatcacctaaaacgaagtcatctgcagatgaaagtggtgatagtaacaaaaatagtgatgatgatggtgctgttccagtggacgcttctgctggttccatgaatttcaacagcgtacatgtaacgcggatgtctttcgttgtcgggggtgatttggtcaaatttgtgaaggcagtagcagcaactggtctatatgtccatctctggattggtccatacgcatgtgctgaatggaactacggtcttcagacagaaatgaagcagtttactgctaagattatggatatgatcaagcaagagaacctctatgcatcacagggaggacctataattttgtgtcagattgaaaatgagtatcgggacatttatgcggcctatggtcctgctgctaaatcctacatgaaatgggcagcatcaatggaaacatctcttgatacaagagtaccttgggtattgtggcaacaggctgatgctgatgctgctgatccaattgtgagttttctcgtgttatgtttttgttga

SEQ ID NO: 25875 - DNA, 951 bp, Glycine max
  Peptide Sequence Number=SeqID_142653
atgatgatgcaacaacattttctcttcttccgtgcctcatttgtacttgtgatggtcaccacatcagcccaacactcaccagcaatatctcctacaataccaaaattaccacaatcacccttggcatctccaccgggaatgaatatgatagcaatcctgatagaaataacagcacaacaggcctcataccactaccttaggcacattacgtatcagaatactgttccattggtaccagtgtctcccaacggtgcccctacacccgccaccgcaaaagctcctacaattgacattgctcaaatcctgagtaaagccaaaagattttctgttctgattcggcttctgaagacgacccagttgatcaaccaactcaactctcaactcctcacatcaggttccgggggattgaccattttctccccacctgattctgccttctcgaagctaaaagcaggcttcctaaactcactcaacgacaagcaaaaggtggaacttttacaattccacactctttcttccttcgtctcaatctccaacttcgacactctcaccaacccggttcagacccaagccggtgacgatgctcaaaggctgcaacttaacgtcaccacttacggaggaaaccaagtgagcatggccacgggtgtcgttaacgccactattaccagcactgtttacttggacaacaagcttgccatttatgaggtggacaaggtgcttcttccacttgacgtcgttcttcctaagccaaaggctccagcaccttcaccgtttaaaggagaatcacctaaaacgaagtcatatacagaagaaagtggtgatggtaacaaaaatagtgatgatgatggtgctgttacggtaaacgcttctgctggttccgtgaatttgatcaacaacgtaaatttaatgtttgttgtggggctcgttttgatgggtggagccatgctgtga

SEQ ID NO: 25876 - DNA, 873 bp, Glycine max
  Peptide Sequence Number=SeqID_142654
atgaagatgatatctctcttgtcattttcactagcacttctagtttcacttttgtattccaccaccactttagcccaattatcaccagcggccgcccctctcaaaccaccccaacctacccctaccccaccagctgcggctcctcaacaaccattggttccctcattgccacaatcaccaagtgatgccaccccggacactgcagctgttgacattgttggaatcctgaggaaggcaaagtcattcaacatcctaatccgcctcatgaaaaccacccaattgatcaaccaactcaatgctcagcttctaactactaaatcaggcggcataacaattctttcacccgatgacagtgctttctcagagctcaaagtaggcttcctcaactctctctctgatggccaaaagctagaactcttgcaattccacgttctttcagactatgtctctagctccaactttgacactctgacgaaccctgtgagaacacttgcaggggctaaacctggaaaggtggaactgaatgtgataagttacggagggagtgtgaacatctcgacgggtgaggttaacaccaccatcactggcattatatataccgataagcatcttgctatatataaggtgggtaaggtgcttcttcctatggacttctttgctgttgctaaggcacctgcaaaagcaccctctttggctccagaaccttcaagtgatgcggcaaaggcacctaaagctgataaggatgagtcatcatcttcagatgcatcgcaggttaatcccactgaacagaactctggcatcgagaagatcagtgtgtacggaatgtgggtgtcccttgtttttggactggttctcctgattgcattttcatag

SEQ ID NO: 25877 - DNA, 591 bp, Glycine max
  Peptide Sequence Number=SeqID_142655
atggagcttttttttgacacatggggtgcagggataactggtccagtgatattgaaaggtttgaagaatggcagcactcttgatttatcgtctcgaaagtggacatgtaaggttggccttaaaggtgaagatttaggtctatcaagtggtacttctggacagtggaattcacaatctaccttacctacaaatcaacctttgatttggtacaagacaaactttgttgctccctctggcagtaatccagttgcaattgacttcacgggaatgggaagaggtgaagcttgggtgaatggacagagcattgggcgatattggcctacatatatgtctctccaaaaggtggctttactcactcatgcaattgtagaggaagtgaaggcaatcctgttagatacagaatcagaaggaaaagtagtccctttagtgtcactggagtgcccgtatcctaatcaggtgatctcatccattaaatttgcaagttttggaatgccttatggaacttgtgggaactttaaacatggacactgccgaagcaacgaagctctatccattgtgcagaaggagttatatatcaagcttcctttttag

SEQ ID NO: 25878 - DNA, 219 bp, Glycine max
  Peptide Sequence Number=SeqID_142656
atggcaaagaatccgagacacatcactccattcaccatctataaataccctgccagagttaagtactcacaagccaagagaacctcccttgtcaagagtaccgttctacgcttatacaaactaaagctcgcactggaaactgtcaaaagacagtatgaaaacctgttagccaccagaagagagttcattagcctatcgaaccatgtcaaagagaacaag

SEQ ID NO: 25879 - DNA, 1707 bp, Glycine max
  Peptide Sequence Number=SeqID_142657
atgatgtctgaagaaaccttttctgttcctcctcccaactccaccatcagagccacctccttggttcatcatcatgctcatgttcaacccccaagcccaagcccaaaccctaatcctaaccctaattcaaatccagctaagagaaggagaaatccagatgcagaagtggtggctctttcgccaaagtccctcatggctaccaaccgtttcttatgtgaaatttgcaacaagggttttcagagggaccagaatttgcaactgcatagacgtggacacaaccttccatggaagctgaaacagagagcgaacaaagatcaagtgaggaagaaggtgtacgtgtgccctgagaagagttgcgtgcaccatgacccctcaagagccttgggggacttgacagggataaagaagcactatagccgaaagcatggcgagaagaagtggaagtgtgacaagtgctccaagaaatacgctgttcaatccgattggaaggcccatagcaagatttgtgggactagagagtacaaatgtgactgtggcacacttttctccaggaaggacagcttcataacgcatagagctttttgtgacgctttggctgaagaaagtgcgagggtaacaacagttccagcagctttaagcaacttgagaaacgatcatcatcatcatttgaccaatgctcaagcttcgaggatccctcagattaatttttcagggttccactcatcagatcaattattcggtggtggatcatcagaagcattattggcgaatcatcatcatcatcaacaacaaaagctaaggctaccactatggctggatcatcaccaagtcaataataatcctcaagtacttcaccaccacactcttaacaacttctcaacaaaaccaaatggtttcactactaattcaggttcaggaccaaactctgtgactgatttagttcaaacaatggacatgtttgggtcacagacagagtttgtgaattaccgttacccagaagcatcatttggaggtggcaatgccaacgtgtctgtgctaccgccacatgaactgaagcaagaacaagaagaaaacaaagaacacttgtcgcatagcggagcctcttataataacttgtacttgagtagtagtgatattcagaacccaccacctcatcatcatcactacatgtcagccaccacactgttgcacaaagcggttcaaatgggatcttcaaggttgatgaacgacaacgtatttggctccatcttgggcaccaccaccaccaacagcaacaacaacaacgttgttgttgaggttcagaagctgaacgagttggtgagtgtggaagctgctgggtgcaccaacaacaaccttggaggtgggtatttattaaacgactcaaacaatagtaactcgtttgtggttgtgaatggcaccaacaagggtggtggtttggagcacatggtgatgccggtggatgaagagacacaacaagcatcaattatgggaaagcaattacactcatcactaagctcaaataacaagaatcaacaacttggtttaacaagagatttcttgggtgttggagatcataataatagtattgactctataagaagaccttttcttcaacaagaccttgttgaatttaatgcaatggggtcagcctcagcctcagcatcagtcatgaacctgcagagccagtacggtggacactactgctag

SEQ ID NO: 25880 - DNA, 216 bp, Glycine max
  Peptide Sequence Number=SeqID_142658
atgatggatgaagatgaaaagaattggaatgaaatggttaagacaatgatgaagattaacataaaatcatatgaaatattcaacacaattcatattaaggatcagccttatggtgaagtgagtaggacctttgctataagatggaaggatcaactagaacatacttggtatctgctagacaacaatgacaacatccactctattacatacaactaa

SEQ ID NO: 25881 - DNA, 276 bp, Glycine max
  Peptide Sequence Number=SeqID_142659
atgtcaatccttaccctcggaagcaaaaaaaagagaaggaaaatttccaatcaaagaaaaagagaaggaaaatttccaatcaaaggaaaaaaggaagcaaggaaattcccaatcaaagagagggagaaagaaaaaagaaaagaaagaaaattcccaaccaaagaatgggagaaagtaaaaaagaagaaagctcctggtcaaagaaaccagaagaaatgtgcagagaggtctttggaccagacaatatctgaacaatacagaattgtcaccaaatga

SEQ ID NO: 25882 - DNA, 264 bp, Glycine max
  Peptide Sequence Number=SeqID_142660
atgtcggaggaaaataccttagctaattccttgatctcaaggaacaggactcatgacacaatgaattcacttttggatagctttgagggtgatgatgacaaaaaaagttgggcctccttccgtgaatgcattgccaaggtccctgaacaagtgttgaggggtaccaatgctaagccaatatggcctgtttcaagtggtcggccatcaaatgctgatatccctagatatagttattgcaccggagtccagacctatgtgttgtga

SEQ ID NO: 25883 - DNA, 2088 bp, Glycine max
  Peptide Sequence Number=SeqID_142661
atgaagcccttctgcagattcttgattcttgtatcgctattttctctggtggaatcttcatgcaacagcagtgaagagcatgacttggtgtccaaggctttcaaatcagtctctggcttcaacgctttctcctcctcgttcccaaccaacaactgttcacaaactcacatcatcaccagcatagtacttccatcccaaaacctcagcggcacaatttcatggaactaccttaggaacatatccaacttgcagattctcgatctctccgggaatttcctacagggccacgtgccaagctggttttggtcgagttcatccttattggcaataaacctctctagaaataggttcggagggagcatccttcaacccacatcagaaaacacctcgttttcatccattcaatccctcaacctctcatacaataggtttaccaactcaatccagctttctggtttcaaaaaccttaaaatcctcgacctttcccacaacaacctcgtaacactcccttccgggtttcaaaacctcagcaacctacaacacatcgacctctcaagctgcaatcttcaaagcaacgtaaaacccatttccgctcttcactcacttcactacttggacttatcaaacaacaccttcacgggtaatttcccttatgatttccctccactcaccaccctcaagttcctcaacatctcgttcaacaacttcacctcagcaattagcgtaaacaagttcagtagattcttcggtaaatcagctttcgtccacgctggcagcaacttcacctacaccaacgacagtaataaaaacacaaaacaagaagccatcatcgaaaagaaacaaaagaagcgaaagtccaaaacgctgattggtgcagcgtcgtctgcggcatcagcaattgtcctaattctcttgggcatatgggcagtccgcattgtgattcagaagaggaagcaacgtgccaagaagaacaagtgggcgatttcgatgccggtcccacaagggatgatgatgatgatgaaatcagggccgttcgagttcgagacagaatcggggtcaacgtgggtggctgacctgaaggaagcgtcttcggcggcggtggtgatgttcgagaagccgttgatgaatctgagcttcaaggacctcattgttgcaacgtcacacttcgggaaggagtcgcttctagcggagggaaggtgtgggccagtgtatagggcagtgctacccggggacctccacgtggcaatcaaggtcctggaagaggccagagacgttgatcctgatgactccgtggccaccttcgttgacctctcgagactcaagcatcccaacctgctgcccctctccggttactgcattgcaggtaaggagaaactggtgctgtacgagtacatggcaaacggcgacctaggaaggtggctacacgagcttccgactggagacaccaacgtggaggactggacaggcgacacgtgggagattcaaaacggcgtcgtcgacgacggatccccagaaaagatgggatggctcacacgacaccgtatcgcggtgggcatagcgcgtggcctcgcgtaccttcaccacgcgcgttccaagcccgtggtgcacggccacctcgtcacctccaacatcctcctcgccgacgacttcgagccccgcatcgccgatttcgggttgcgacccgacccggatccgaatttcggcacggagaccgacgtctactgcttcggggcggctctggtggagctcctgacggggaaggggagcacggcggaggcggtggcagcggcacggaaggcgatgagggaggggcacggcgttagggttttggacgagaggctccgactcgggggtgactcggtggtactgagtcagatggtggagactctccgagtcgcgtttttgtgtactgctgaatgcccttcgaagaggcccacaatgcaacagactcattttttggggggaaaagaaaaagtggaaaaggacaaaaagatgggcatgatgaaggcgcaaagggagagagtagtttactctttttttttggggagaggcatagggccagagaatcccactcaggagtttccataa

SEQ ID NO: 25884 - DNA, 462 bp, Glycine max
  Peptide Sequence Number=SeqID_142662
atggcttcggaagattcgaagccggtggtgaagaaagaggtggattccaacaacaagagttccgtttccaaaaaggtcacaaaattcaagaaagaagagcccgaagccgttaagaagggtcctaaagtcaagaaggaagaaaatgacgacgacattcccatctggagaagcacctccaactccaaggaagtgaagaaaaagaggataacaataaagaaagaggaagagaataagaataataagaagaagaaagaaaaaaaggtttatgatttacctggccagaaacgagatccacccgaggagaaagaccctcttaggattttctacgagactttgttcaagcaagtccccagcagcgaaatgtcacaaatctggtttgttttgttactgttttgtgtcttctttgtggaatataatttagctgaaatgctcattatggctccccagcatgaacactattag

SEQ ID NO: 25885 - DNA, 114 bp, Glycine max
  Peptide Sequence Number=SeqID_142663
atggtgtggcctttgaaggagagaggaagcaagctaggagtaccaacagaagctgggagtagcgcagttggtggccttgctcttggttttggcctcttacctctccgatttcag

SEQ ID NO: 25886 - DNA, 831 bp, Glycine max
  Peptide Sequence Number=SeqID_142664
atgaagggaagcaagaggcccatccacgccgtcaccacatgggttcggcgccaaccgcccaagatgaaggcctttctcgcggtgctgtccggcctggcagccctgctcttcctcagaatcttcgttcacgaccacgacagcctcttcgtcgccgccgagcttgtccatgcgttaggaatctccgtcctcatttacaaactcaccagggaaaaaacctgtgccgggctttcgcttaagtcgcaggagctgacggctatgtttctaggtgttagactttattgcagttttgtgatggagtatgatatacacaccctactcgatatggcaaccttggtcacaaccctttgggttatttatatgatacgcttcaaattgaaatccagttatatggatgataaggacaaccttgcaatgtactatgtggttataccttgtgccgtgctgtccttgcttattcatccaacaacccggcatcatccacttaataggattctctgggcattttgtgtttatcttgaagctgtttctgttctccctcagctgcgagtcatgcagaacgcgaagattgttgaaccattcacagcacactatgtttttgcccttggagttgcaaggttcttgagttgtgcacattgggtcctccaggtattagatactcgtggacatctactgactgcattgggttatggattgtggccttttatggttcttctatcagaaattgtgcaaactttcattctggcagatttttgctactactacgtcaagaggtggatatcttgttgggggacaacttgttcttcgacttccttcaggagtggtgtaacttaa

SEQ ID NO: 25887 - DNA, 159 bp, Glycine max
  Peptide Sequence Number=SeqID_142665
atggctatctcaaagcttctagttgcatcccttctggtatcctttgtcctcttccatctcgtggatgctgatgaccaatcggcacacgcacagactcagggttctcttgttcagcatataggtattccatcagcatctgtacgcgcgatattttattaa

SEQ ID NO: 25888 - DNA, 369 bp, Glycine max
  Peptide Sequence Number=SeqID_142666
atggccactgttcagcacttgttgattgccaataggaagaagaggcccattatttgtagaatcaagccagacctcaatagaactcccaaggaaactaccaagatgtccgtcataaaccaaaagaagattgaggcttccattaaaaatcttgaagttcaggttgtacaacttgcaacacaactctctgagcatggaagtggatctttctcaacaaatacacatgttaacccaaaggaacaacgtaactcaattacaacaaagagggggactatgaataaagaaggagttgaaaatgaaaaagagaaaaatgaggaagtggtgactagtgaaaaagtggaagagaatgtgataagtgaagaaaagaagtag

SEQ ID NO: 25889 - DNA, 1776 bp, Glycine max
  Peptide Sequence Number=SeqID_142667
atggacataagtgaaggaggagaagcgatgacgaaacgacacactaataaacaacaacaatctcaatctgcttcttctgggggacgcaacctaatccctgccgcgtgtggtttgaatgcgagtcttggggaccttgagttttcggagaaatcgaagaaggaaaaggtgagaagcttgagtgctgttgccaaagcattatcaatgggttgccgtgtttctcactctcaaaaaccaaccaagaaatttaagcttcccataaagtttctgaaggactgcaatggcgttgatcatgcctctgttccacggaagatacgttcagctgtgaagaaacggggtcgcgaatccttctttggtgattcagaaaaggtgaaccataggatgaacggaatggaatctccccaaaaagatggcataaagaaatccaaaaaacaaagaaccccgggctggtccacgaggcaagtttcaccggggcccatcacaaaggatgaggaagaggttgtggagactctatatgccttggctggaatgttcccttcagataaggcctccaatgttgttaagagtgaacttgacagtgaatcattaccagaaaactccacggttttacaggaccaagaggagagtcagagtgctaatgttactcttgaagcctcgggagctactcaggatgctggagaaaagtcacctacggggtgtaaaaaagccagttctttgaatgaaaccattggtcaagaacagactgattttcccgagagtgctaacttcttggtggctactgacaacactgctccaaaaacaaatccgcaggccgtgcctatgatggttaagactgaaaatggcggcaacgttgcattgcatgactctcaattgttgtctctggaaatgggattaaatgtgcccacacaaccacaaatttcacatattggaaggcaatcagacgtgggatttcagacggtcggaaccgttggttataagcaagaacatctaattaagtaccaaaatgaaactggttcggcattgtggccaggcttgtctccgattgcatcagctgggattactagggcttcttatttgcagttttcttctgctgccaaagctcaagattggatgaaaactgctatgggtgtctcgaaacaagatttgatggaaacttgttcttctggtggaaagttcttcatcccagtcaatgcactccactcaaaaagttcagtatcgatgcagatttccgaaattattactcataaaaagtcatggaagaggtgtgcagctcatgttcacatcagtcatctcatccgtagtttagaagtgtcaaaacgacaggcgggcaaagaacatgagctttttcctcaaacaatagtacaccaagggtcaaaatgtggggtactaacaaaagcacacaacttgaattggatgagaagtggaaatagtcatgctactcaaacagtttattctgctacaacgagtaattcacgtgaaactaagaatggtattcttcaacatgacctttatcatgaggctcccccaacacctggggtgtatgatcctcaaaagcaatgtttcaacttcttgtccttgtcaactggagttagtgatcagttaaaggccaacgaaatttttaataaaggtgaaagtaagttggagccatattcaaaacagcaactgccttattttcagtcactacaactacaacagcagaggcagcatggcctcatgcccgttcaaagttctccgtatgcctcaactttcctagatcagcttccagttgcaggaccacag

SEQ ID NO: 25890 - DNA, 570 bp, Glycine max
  Peptide Sequence Number=SeqID_142668
atgaacatggaagatggtgtcatgctggtcagaaaggccgagatagacacaagggcgccattccggtctgtcaaagaggctgtctcgttgtttggtgagaaagttttggccggggaagtttatgcaagtgctaacaagctcaaaaagatacagagtggagcaaatgaaaacggcgttgaattttcgagaattgaaagcgttgaagccgagttagatgagacgcgggaaaacctgcagagggcaaaggaagaaagcatggaagagctagaacgtacgaagcaagagctccgacaattgaagcaacgggaaacacagaagcacccagaggaatctgaaatcgaagatgtaaagtttgtggagaacttaacgacgtttggagtgaaaagttcgagattcgacgaggataagatggagttccaaaagaaaaggtgcgtgacgttcgcgaacccgcaacacggggttgaaaagttggaaaggcacccttctctcaggaagaagaacaagaagtcgctcattcctttcattggagccatcttttcaaggaaaaagggaacccaagaaattccatga

SEQ ID NO: 25891 - DNA, 405 bp, Glycine max
  Peptide Sequence Number=SeqID_142669
atggtcgtgggtggtggtgaagaaggtgttagggtttgggtgggcgttcagagaggaggaaagggggaaaatcatgtttttcacgttgaagaacgtatttataatctgcagatctcacttagtgagctcgtcttgctaagtaggagtctacttttcgcgcttagcgcgacaattcgcactgagcacaactccctctgcactaattctcactcaactgtggagaattgtcttaggaacctccaaccaaaatttgaagacgatccaccggttaacatatccagtgatgtagctccatgtggagctttagaatggagatggaagaaacatgattggagacaccgcttcaaggagaagatgagtcaagaagaagctcaccaccataggaagccatggataagagcttga

SEQ ID NO: 25892 - DNA, 372 bp, Glycine max
  Peptide Sequence Number=SeqID_142670
atgtacaacaagcacaacaacccacataaatcaagaacagagggttttgttgttatacaaataagaactgaagaagaagcatcctttgaacaaatccctcaaccttgtccaaagttgaacctctctgccatgaagctctttcaacgctttcgcaagatcttcatgcgcctagtgttctcggtacctaattctcgtcgctcaaaggattcgaagcacaaagtaaacgaccggtttgaaccgcccaagacttcatgcagttcgtactattcctcttactcgcattacaatgaggccattgcggattgcatcgagtttttcaataagtcagcacaagatggcgttttggatggtcgaaaatctgatgttgtctga

SEQ ID NO: 25893 - DNA, 1006 bp, Glycine max
  Peptide Sequence Number=SeqID_142671
atgagtcaaagatatgacaacaatgttttcaaatctcacataaataatatccaacttgctcctggtatcaccgaaacacttcatcttcctcccccacttcaaaccgagcctaccataagaggaaagcaaaatggtaaatcaaaaggtccaagaaatgcaaaatctgcgaatgccgattcccctaattcgactgcagttaacaattgtcgctatgacagttccttaggactgttaaccaagaaatttgtgagcttaatccaggatgctaaggatggaacgctggatctaaatagaaccgccgagatcttggaggttcagaaaaggagaatttatgacattacaaatgttcttgaaggggtaggattgatagagaaaacatcaaagaatcatatacagtggaagggatgtgatggacttgggcctcaagaactggaagaccaagttaatagtctaaaggcagaagttgatagtctatatgccgaggaatccgaactggatgattgtataaggtttgctactaatatcgaaaaagcaggagcttctaagaaacctggaggaaagcgaaagctctcaaaagaagatattcttagccttccctgcttccagaatcaagaaattattgcaatcaaggctccaaaagctagttgcatcgaggtccctgatcctgatgaggaattaggttttcggcaaaggcagtacaaaatgattgttcgaagtgccattggaccaataaatttgtatctcttgagcaaggacgacagcaagtttgaggatgatagtgccaaacggatgaaattaatggatccatcatggaatagtgatcccatcagaaagaggggtgtgggattattagaaagccaacatgatgaaaaaaatccttctgagcatttcagtttgcagggttcacaagcatttggaattcaagaaattactcccacggattttgaaatggaagatgactattggtttcaatcagatcctggagtgagccaaacagaattgtggg

SEQ ID NO: 25894 - DNA, 783 bp, Glycine max
  Peptide Sequence Number=SeqID_142672
atgccatctgtcgatcatttctctggactggtggaactactatctctaggaaattccccatctcttggaagcagtaagaaggacagtctgtggattaagtggataaattgttattatatgaaaaatggcaacgtgatgtcaatgggaataaaagattcttgctcttggattttaaaaggtattctgaagcagatacaaaagattcaatctcttactaactggagtactttgttgcaaaaggatagatttgtgttgaagataatgtacaatgaattgcaggatgtttccagtagagttccttggaggaaattatttttctccaacctagctagaccctgtgcaaagtttgttttctggactgtctgtcatgacagacttgccactaaggttagaatgatgaaatttgggttacttagtgataccaaatgtaacttctgtgatcatcttgaaacaattgaccacctcctgtttgaatatgctgaaatgaaggatgtttggattcaaatcttggaatggcaaaagattaaccaccagccaaagaagtggattgaggagcttagctgggcaatggcgcagggtaaaggaaaggggcatagagcaactttactcaaaaccgcattaaccgagactgtgtatgagctttggaaatataggaatgaagtgagttttgggggtatagtcaataatacacacataggaaaaaagattatggatagtatagtttatagaagttggactcataaaaagatgagagaatatattgctaggcttctgatttcttag

SEQ ID NO: 25895 - DNA, 216 bp, Glycine max
  Peptide Sequence Number=SeqID_142673
atgtggtaccatctccaaggaaatagcctaagcgtgtccacacgacactctcacttaggaaaactaggcaataactccccctatggtgatcaacctgagtctcaagggagttccaaactgagtggcatgcccccaagtacaagtattcctcttcatgagaaactacaagtacttaatgacaaagtttatactatttccatgtcatatgaagtatga

SEQ ID NO: 25896 - DNA, 948 bp, Glycine max
  Peptide Sequence Number=SeqID_142674
atggcaggatggtttttggttatgccttcccagcctatgaatgctataaagcagttgaaaagaataggccagaaattgaacaacttcgcttttggtgccagtactgtatgtgagcggattgctgatgctttcatatcatgggtcccaatgtatagtgaagctaagttggcatttgtcatatacttgtggtacccaaaaacaaagggaacaacatatgtgtatgattccttctttagaccatatgttgcaaaacatgagacagaaattgatcgcaacttgttggaactaaggacaagagcaggagatattgcagttttgtattggcaaaaagctgctagttatggccagactagaatatttgaaattttgcagtacgttgctgcacaatcaacaccttcaccacgccctgctcagcaacaaccagctgtgagggtgcgtcaacccgcatctagtaatagccaaccagcagctgcaacagaaccacaagctgagaatccatcttctcctacttctagctcatccagtcagcaccagaaggaagtagcagagaagttgggttcttcacaggtgcctaaagcaccctacactgttgcaggtttaagtagccagaagtctaatcctatacctgcagaggatgagccaatgcagattgaagcagcaccaccttcatcctcttctgcaaatgaaaatgagaatcctcccttggaagatacaataatggaagaaagcattagaccccttaggagaacgattctcatgatcccggctgatataggatcagggggtgtcatcagagatagtgttggtaattggctggcaggtttctatgcgtatgatggaactgagattatgggtttccgtcaaggcctgcagtcatgggtcttgggcttaaggaatatcatctgtgaatatgataaccttcctcttgtgaatccaatttattggtag

SEQ ID NO: 25897 - DNA, 264 bp, Glycine max
  Peptide Sequence Number=SeqID_142675
atgccagttgagattgtggaaatctcaacatcttcgtcttcttcatccaatgaaccaaaagaggactttaatgattatgagtgtaccttgactactccttactttcccatatttggttgccagtggatggtgtcacctctggtggtagagcttggggactatgagattgaaaatgaccccaagatgcttaaggaggactctaagactaaggaggaccttaagatgcttgagaaggacccaaaggaagagggaaaggtaggatag

SEQ ID NO: 25898 - DNA, 210 bp, Glycine max
  Peptide Sequence Number=SeqID_142676
atgtcttctccctcacatggcgacagtgccacggtaagagaaagacatacctcatcgccgagaccgacaccaacaccgatagctagcacaagtgggagattgagaccgagagcaagtgtgagtgggagtaatatatcgagtgcgagcgaaagcaagtgtgttgagaggaggagttacaacaccgcggaggaagtgagagcgttagggtga

SEQ ID NO: 25899 - DNA, 285 bp, Glycine max
  Peptide Sequence Number=SeqID_142677
atgataatcttgttagtgggaaccaagcttcaagtgatcataaccgagatgggtctaagaattcaacaaagaggagaggtcctcaagggtgtgcccttggttcagccaggggatcatttgttctggtttaaccgacctggccttattctttaccttatcaattttgtgctctttcagaatgcttttcagctggctttcttcgcatggtctgcgcttcagtttgggattaaatcctgtttccattcgcacacggaggacgtggtgatcagaatcacaatggggtac

SEQ ID NO: 25900 - DNA, 753 bp, Glycine max
  Peptide Sequence Number=SeqID_142678
atggcaggaggaagcggaggaagaaacttggaggaaacgcctacatgggctgtctccgctgtttgttttgttttgatcttaatctctataatcatcgagcacatcatccatctcataggaaagtggttgaagaagaagcacaaaacagctctgtacgagtcacttgaaaagatcaaatcagagcttatgttattggggttcatatcgttgcttctaacggtaggacaaggtccaatatcaagaatatgcatttcagaaaaagttgcagggacatggcacccctgcgacgatagtagcagcatccacgagtcagatactgaagaatcagaaaacgtaaacggaaccaatagccgcagattattggcggcgttctatggttcagacgacgtaaatccacgacgtgttttggcgggaggaggaaccgacaagtgtcgtgagttaatgtcaatcaaattatgtcaaggttccttaattgctttagaaaaaagtcgtttctacattaaaatatactacagtgatacgtattacatgactgcgtatttcttctatggttgtgccactttgtcaaagggtaaagtcccgtttgtgtcatcggatggcattcatcaactccatatatttatcttcgtgctggctgtttttcatgtcctttactgcattctcactatggctctgggcagagcaaagatgaaaaggtggaagcgatgggaagaggaaaccaagacaccagaataccaattttcacacggttag

SEQ ID NO: 25901 - DNA, 1515 bp, Glycine max
  Peptide Sequence Number=SeqID_142679
atggctcgttgtcccggggcggcggcgaacctctgctgcctcttcgtccaccacaaccagtccccgccgcccgagaccctcggcatcctcgccttcgacgccgtcaagaccatgtgccgcctcatctccctctacaattcccttcaccaccaagaaatcctccacctccgccgccacatcattagatcaaaatccgtctctaacctcaattcccgcgatgagtgcttcctcctcaccctcgcctgcgcggagcgcctcgaggacctcaacctctccgctgccaccgtctaccaccttgccacgcgctgctccaaccgaaacctcacccgctgcttcgaggccatcgacgcccggaagctccaattcggaacaaaagacgttgagaccaaaattgaaaacatggagaagctcgtactcgccacgcggagcctccacaaggcgatggaatcgctcaccgagatggaggcttcggagagaaagatgcaaaagtggagaaccattagggaaaaccatgggttaaaagtgaaggttgaatgcttcaatgataagatcatgttttataggagacaggttgtgtatttcaagcaagtttcactttggaaccagacatttgataaggttgtcgcgctcatggcgagaatcatttgcattgtttacaacagaatatgttcggtttttggaacctttgttaccggcaatgtcaaacgtagaaatcaaaacaagaacaacaaaaatggggttgttagacgacgtattttcgaaaacagttattgtcgcgtggagcatcgcgagttgtataggatgaacctttgcatgttcgaccaaaccgaggaagtgttgaagaagcgtgcgtgggggtgttgtaacgtgaagaggggtgctcctaccggggttttccggttccaccacgcgccgtcaggggaaggtggtgaggtggcaatgaataaccgcgtcatgcggctggcaccggcgaatacggttggcggggcagggctttcactgaggtatgccaatgttattttgttggccgaacgatgcatgcatgcgcctgatgccacgattgggaacgacgcgcgtgttacgttgtatgatatgttgcctgggaggttgaagatgaaactgagagcaaagttgaaaggggaatggttggaatggaagaagttggagggtggagaagaggagcactctgaggcggcgacacgacgtcacgtggtggcggcggaggtgatggaaatattggtgccggtggctcatgacatggtgaggtggcaggcggagaggaacttggagaagcaaaagtttgagacgaagccaacggtgttgttgttgcaaactttgcattactcagatttggagaaggtggaggaggccattgtggaggtgttgattgggttgagttatatgcattggtcatcattaagaggtgatttgcttcaatatcttgatcaatgcactaggctcaacagagattacaaaggaagagtaggagggacatgggctccaatgacattgtag

SEQ ID NO: 25902 - DNA, 234 bp, Glycine max
  Peptide Sequence Number=SeqID_142680
atgggtttcatgattccgcaaagacgaggtggaggaggttctagaaagggccaccgtcgcaggcagcagatgaggaggaacagtcgtcgtcggagatcacgtggtcgacgcggcacttgctctctcgagagtgagggagtggaagcggcgcttgctctttggagactgaaggagcgtgaagaagaaaatgccaccgcaccactttctacaccggttcccaaacaaccgtcgtag

SEQ ID NO: 25903 - DNA, 1930 bp, Glycine max
  Peptide Sequence Number=SeqID_142681
atggctacccttttgaaaattttatctcttttggtgctccttttgatcccagtttcatgccaagttgaccaggttctctattctggattcaaggatgtaggtgccagtaacctaaccatgaatggggtgactacaatagagcgcaatggaatactcaaactgacaaatgaatccagcaggtcaataggtcatgctttttacccatcaccttttcaactaaagaactccacaagtggtaaagctctctccttttcttcctcttttgcttttgctattgtccctgaataccccaagctaggtggccatggcttggccttcacaatagcaacttctaaggatctcaaggctctaccaaatcagtaccttggcctccttaactcaagtgataatggtaacttctctaatcacatctttgctgttgagtttgacactgtgcaagactttgagtttggggacattaatgacaaccatgttggaatagacatcaatagcatgcagtccaatacttctgccaatgttagtttggtcggtctcactctcaaaagtgggaaaccaattctagcttgggttgattatgattctagattgaatcttataagtgttgcactttctccaaattcatccaagcccaaaactcctctcttaacctttaatgtggatctctcacccgtttttcatgatacgatgtatgttgggttctctgcatcaactggtttgcttgctagctcccattacatcttgggttggagctttaaaatcaatggtccggcaccaccccttgatctctcttctctcccacagcttccaaagccaaagaagaaacaaacatctttgataattggggtttctgtctcggttgttgttattgtcttattagccatctctattggcatttacttctacagaaaaataaaaaacgctgatgtgattgaagcgtgggagcttgaaattgggccacatagatactcctatcaagagctcaagaaggccactagaggtttcaaggacaaggagctacttgggcagggtggttttggcagagtttacaaaggaacattgccaaattccaagatccaagtagccgtgaagcgagtttcacacgaatccaagcagggcctgagggaattcgtgtcggaaatcgccagcataggccggcttcgccaccggaatttggttcaattgctcggctggtgtcgccgccagggcgacctcttgcttgtgtatgatttcatggccaatgggagcttggataagtacttgtttgatgagccaaagattatcctaaattgggagcataggttcaagatcataaagggtgttgcttcagctcttatgtatcttcatgaaggctatgagcaagtggtgatacatagagatgtgaaggccagtaatgtgctgctagattttgagctgaatggaagactaggtgattttggattggcaaggttgtatgaacatggtgccaacccaagcaccacaagagtggtgggtacattagggtatttggcacctgaattgcctagaacaggaaaagcaactacaagctctgatgtttttgcatttggggcacttttgctcgaggtggtttgcgggcgtaggccgatcgagcctaaggcgttgccggaagagatggtgttagtggattgggtgtgggaaaagtacaaacaagggagaatacttgatgtggtggacccaaaactaaatggccattttgatgagaaggaggtgatggtggtgctgaaattggggttgatgtgctcaaatgatgtgcctgctgctaggcctagcatgaggcaagtggtgaggtatttggatggggaagttgaggtgccagaggacttgaaaaaaccaggggcagtaagccaccatgaggggtttgaggagttcttgcactcacttgcatcttcttcatttgataagatgagttcag

SEQ ID NO: 25904 - DNA, 417 bp, Glycine max
  Peptide Sequence Number=SeqID_142682
atggaaaattgttggtgggagaaagagttacaaccttacaatcaatatgaagaagaaataatttctaatcttgataatttgttgatgcaactaatggaaacatctaaagctactcaacatgcaattaaaattctagaaattccatttgagcatgattcaagagaaaaagatgaagaaaaaaatgaggagagaacacaacaacaatggaaggagtgctcacaagtagaaatgcaacaagaaagtattctccaagtcaatatccctcctcatcaactaattgtcaaggaagacagacatggagaacatgataaatctttaagtgtcattctctccttgatcactagcacttctcttgcaatgatatggaagacgtttccgggatacatgagtttcatggagtctttagctaagaggtaa

SEQ ID NO: 25905 - DNA, 681 bp, Glycine max
  Peptide Sequence Number=SeqID_142683
atggtaccaggcaaagcgaacgattcgaagccaaaaatcaaccaaaagaccaaccaagcaaccaaaattggcacgggtgaagcccaccaaagctttagtttcagacaaaaccgagtttttggtaccactaggagcacaaacattatccaagggagacccgtgtgggacaagtctattaccaaaacaaaaattgttgttgcacagaggaaacccaaatccattagcacaactcaagctcccattgacacacatgataaaacatccacagaaaatgtcaatctcggattgaagaaaagtgtcgcattcccacaacaacttgcggaaaaaacaacaaagaacagttcccaagagaaggtttctgcttctgtgccaaaaactccagtagcatcatcgttccgtgttagaagcaagtcatccacaccattctactctgctttgaattgtagcaaatgtcattttgataggcttgagacatcttcttattgggttggccaaatcaaaatggctgagtctgtgggcaagcattttgttgcctctgaattctttaggcttgctttggaatctcatgctgagccaattaggaaccttgggatcgagcttaagaggtatttgttaaggcatgggtacctatcggagcagaaggaatggagagaagttgctgctaggtatgggctacactag

SEQ ID NO: 25906 - DNA, 153 bp, Glycine max
  Peptide Sequence Number=SeqID_142684
atgagaagagggaggttttcattcttcaccaagccaggagagaaagaggtaatgggtgaggttgtattttttctctatgatgttcttccatgggagcgtggagatgaaaaacttctatcagatgcaggtgcattttgcgaaaaagagttgtaa

SEQ ID NO: 25907 - DNA, 3067 bp, Glycine max
  Peptide Sequence Number=SeqID_142685
atggagagtttcctgaatccggaggagttcaaactgagtcacagggatcgttccatcgaaacgttggagaaatggagatccgcagcgtggttggtcaagaaccctagaagacggttccgctgggccgcggatctcgtcaaacgcaaacacgccgaagataaacgccgcaaaatacagcatgacattcttgaaaggttgttgatgcaaaccgacaagatggtggcgcactggctgccaaacaggcccaacagtgagcgtgaagcgaagtccaaagaaatctcggtatccatgaagggagaggcaacaatggtcgttggtggtcgtccgcaaaaggatagcacgattcggaccgctctcactgttagaagggcagcagatcaatttatcagcgttcttcctccagctgaatacaaagtgtcagaaaagacgagagaagctggttttagtattgaaccagatgatattgcatcagttgttcgaggccatgactacaattactataaaaaaattggtcaagttgaagggattatagagaaactcagtgcctcagccgatgacggtgttggtcaagacagtatagataccaggcaagatatttatggagtcaaccgttatactgagaaaccttctaaaagcttcctgatgtttgtttgggaagcactgcatgacttaacactaatgattctcatggtttgtgctatagtttctatagctatagggcttcccactgaagggtggccaaaaggtgtttatgatggtctgggaatcatacttagtatattcttggtggtcattgttactgccatcagtgactaccagcaatccctgcagttcagggatttagacaaagaaaagaaaaagatctttgttcaggtcacgagagacagaaaaagacagaaggtctcaatttatgatttggttgtgggagatattgttcatttgtcaaccggtgatcaagttccagctgatggaatttatatatcagggtattctttggtaattgatgagtcaagtttaacaggtgagagcgagcccgtaaatatagatgaagaaagaccttttcttctttcaggaaccaaagtacaagatggtcaggggaagatgatagttacaactgttggcatgaggaccgaatggggaaagttgatggaaactctaagtgagggaggagaggatgagactccactgcaggtgaaattgaatggagttgctacagttattggtaaaattggtttgactttttctgtgctgacatttgtggtgttgacaataaggtttgttgttgaaaaagcagttcgtggggagtttgctagttggtcttcaaatgatgcattgaagctgctggactactttgctattgcggtaaccataatagttgttgcaattcctgaaggattgccattagctgtgacactaagtcttgcttttgcgatgaaaaagttaatgaaggataaagcacttgtgagacatctttctgcctgcgagactatgggctcggcgacctgcatctgcacagataaaacaggaacattgaccactaaccatatggtggttaataaaatttggatatgtggaaagatcaatgagattaaaggcaatgagagtattgacaaactgaagacagagatatctgaagaagttttaagcatccttttgcggtctatatttcaaaatacttcttccgaagttgttaaggacaaagatggaaaaacgacaatactaggaacaccaacagaatcagcattattggaatttggcttgcttgcaggtggtgattttgaagcgcagcgtggaacatataagatacttaaggttgtgcctttcaattcagtccggaagaagatgtctgtgctagtaggtcttcctgatggaggtgtccaagctttctgcaaaggtgcatcagaaatagtattaaaattgtgtaacaaagttattgatccaaatggaacagctgttgatctttctgatgagcaggcaaagaaagtctctgacattataaatggatttgccaatgaagctttgagaactctttgtttagctctcaaagatgtaaatggaacccaaggagaaagcagcatccctgaagatagctatactctgatagccattgtgggaatcaaggatcctgtgcgccctggggttagggaagctgttaaaacttgtttagctgctggaataactgtccgcatggtaactggtgataacataaatacggctagggctatagctagagaatgtggcattcttacagaggatggtgtggccatagaaggaccccactttcgggacttgtctacagagcaaatgaagagtattataccaagaattcaggttatggcgcgatccttacctcttgacaagcataccttggtaacccgtttgaggaatatgtttggtgaggttgtagctgttactggtgatggaaccaatgatgctcctgcactgcatgagtcagacattgggcttgctatgggcatagctggaacagaggttgccaaagaaaatgctgatgtcattataatggatgataacttcactactattgtcaatgtggccagatggggacgggccatatacataaacattcaaaaatttgtgcagtttcagttaacagtcaatattgttgctctgattattaactttgtttctgcatgcatcacaggatctgctcccctcacagctgttcagttgctttgggtcaacttgattatggacactctgggtgcattggctttggccactgaacctcccaatgatggacttatgctaagacccccagttttcaatgagataaacagccgagaaatcgaaaagataaacatattcaaaggcatgtttgagagctggatatttttcacggtgatattctccacagtggtgtttcaagtactcatagttgagttcctgggaacatttgccagcacagtgcctctaagctggcaattctgggtgctcagcgttgtaataggagcatttagcatgcctatatctgtcatactcaagtgcattccagttgaaagaggaggtattacaacgcaccatgatggttatgaggcactaccttctg

SEQ ID NO: 25908 - DNA, 393 bp, Glycine max
  Peptide Sequence Number=SeqID_142686
atgtttggcagtcgtcttgacatccttttgcggacgaccaccaacgaccattgttgcctctcccttcatggataccgagatttctttggacttcgcttctgcaaggaaatttaccaatgtccctcgcacaaattcattttgtgcgcaactttctttgtgggtgaacagtaccacgctcactgttgggcctgtttggcagccagtgcgccaccatcttgtcggtttgcatcaacaacctttcaagaatgtcatgctgtccacgtgcacagccaactcaacacaccaccgcaacaaccccacgcaaggccctttttccagcaagagaagttcacgcacacaatgcgtgacacatctcaaatgagtgtcacactggaatcgtctccttttgtctaa

SEQ ID NO: 25909 - DNA, 399 bp, Glycine max
  Peptide Sequence Number=SeqID_142687
atggaagcttgcttgtggggcttctatggaggctggatctttgagcttcaatggggtcctttaatggtgattttccaccatggagatgcagcggaagacaaaggaaaagatgattgcatcaatcactgccatcaagttttcgttgtacgaaaccaacttcagaatcaaccgcatgaggtgcgaaaccttacgaggttcacgacgttctccactgccgaaaacttgacgctcttgtcggtgagcgagtgcgagagagaggaacgtgagagagaatcagagaaggggaaaagtacagtaacaaacagccatgtatgtggatcttccggcaaacttcttctgtctgccctccacaaaattcacccgctgccatcgccatggatgttactgaatatgggttga

SEQ ID NO: 25910 - DNA, 3243 bp, Glycine max
  Peptide Sequence Number=SeqID_142688
atggatcgacggtggccttggaagaaaaaatcatcagaaaagtccgtgattgagaaagcaactactgcattggattcctccgatgcttccaacaaccaggataacaacaagaaaccaaactatgttcaaatctctgtggaatcctattcacatctgtctgacttggaagatcaagtgaagacatatgaggaaaaagttcagacacttgaagatgagatcaaggaaatgaatgaaaagatgtctgcagcaaactctgagatcaataccaaggaaagcatggtaaaacaacatgctaaagtggctgaagaagctgtatcaggctgggaaaaggctgaagctgaagctttggcattgaagaaccatctagaatctgtcactcttttaaaactcactgctgaggatcgcgcaacgcatttagatggtgctcttaaagagtgtatgcgacaaatacgaaacctgaaggaagaacatgagcataaaatacaggaagttgctctctcaaaaaccatgcaattagacaagattaagggggagctggaggcaaagatagtgaactttgaacaggaacttcttaggtctgctgctgaaaatgggactctgtcaaggtcattgcaggaacgctcgaacatgctaatcaaattaagcgaagagaagggtcatgccgagggtgaaattgagcttcttaagggcaacatagaagcatgtgaaagggaaattaattcacttaaatatgaacttcatgttgtttctaaagagcttgaaattcgcaatgaagaaaaaaatatgagtatgaggtctgctgaagctgctaacaagcagcatatggagggtgtaaaaaaaattaccaagttagaggctgagtgccaaagattacgtggtcttgtgaggaaaaagttacctggtcctgctgcacttgcacagatgaagctagaagtcgaaagccttggccgagattttggagaaagtcgattaaggaagtcccctgtgaagcctgctacccctaatttgtctccattacctgatttctccctggagaatgtacagaaattccagaaggacaatgaatttcttacggagcgtttattagcaatggaagaagaaacgaagatgctgaaagaagctttggctaaacgtaacagtgagttgcaggcctcaaggagtatgtgtgctaaaacactgagcaaacttcaaagtttggaagcacaatctcagaaccagctgaaaggatctccaaaatccatcgtccagttaactcacgaacgtatttataatcaaaattcaagcagtgcaccaagtttgatctccatgtctgaagatggaaatgacgatgcagaaagttgtgctgaatcttgggcaacagcaatagtctctgggctatcccaatttcctagagaaaagtgcaatgaggaatcaaataaatctgaagtcactaacaagttggaactaatggatgactttctggaggtggagaagttggctcgtttgtcaaatgattccaatgtagatgccactatttcagtttcttcaaacaataagacaactgactttgtggctgatgatttatcagaagtctgtactggcaaagaaggtctgtctgaaaaaaatggcgattcagatcaattgccaaatgaagtgtcttctgatgctttgatgtcagcaccagattctcaaactgacgttagtggcttgttattaacagaacttagatcaagaatattactggtttttgagtccttagctaaggatgctgacatagggaagattgtggatgatattaaacatgtgcttgaagattcacatgacactaccatccaccactctgtggatgcccatccttctgacactacatgtgataggaaggataatcctgaagatgctggcttaaatcttgaaaaggaagtaatttcatcccagcaacccaaagaatatgtgcagataactacagatttggaagctgcagtttctcagattcatgactttgtattgttccttggcaaggaagcaatgacatcatttcatgatgtatcttctgatggaaatgaaatgaggcaaaagattgaggaattctccgtcacctttaataaagtgttatgcaacaatgcaagtttgctacagtttgttcttgacctgtcctatgttctagataaagcaagtgagttcagatttaatgtccttggctacaagggcaccgaagctgaaagtaacagtccagattgcatagataagattgctttgcccgaaaataagttagtacaagacaattcatctggagaaagatatcaaaatggttgttcccatattcttaatccatgttctaatcctgaggttcctgatgatggaaatttggtctcaggttataaagcagatgctgcatcacagaaactgtcaatagaggagtttgaagaattgaaactagagaaagagaaagtagtgattgatctgtcaaattgtactgagaatcttgaaatgacaaagtctcaattgctagaggcagagcaacttctagctgaagttaaatcacaattggcttctgctaataaatcaaacagcttggctgagacacagctaaggtgtatggcagaatcgtacaactcacttgaaacacgtgcccaggacttggaaactgagctgaaccatctgcaaatcaagatagaatctctggagaatgaacttcaagaggaaaagagggctcatgaagctgctatggccaggagcaaggagctagaagagcagttaaaaaggattgagtgcttggcagctgatgatgaccacaagactccgcatgagagaaatttgacagctgctgctgaaaagctagccgagtgtcaagaaaccatacttcttctgggcaagcagttaaattctttacgtccacaaactgaggcaaatgactcaccgtacagtaagataaatccaaaagatgaaggattcacagaagatgaacatactactaatggccaaaagtttcaagaattaggccagttggagatggacagttctacttctgcttttgtgccaagattgagttcggagtcccccttgcatttttccaacagtttatttagcccttcggacagcgagtccaccattccagccagatccccagtacagcattctaaatcaaaaccaaaacacaggcctaccaagtcagcctcttcttcagtttcttccgccaccacacctgagaaacatgcacggggatttagtagattcttttcacctaaaggaaagtctggtcattga

SEQ ID NO: 25911 - DNA, 324 bp, Glycine max
  Peptide Sequence Number=SeqID_142689
atgctgcggcggtggcgtagcaaggcccgcatgtcggcccaccgaataccgtccgatgttccagcgggacacgtggcggtgtgcgtgggcaccaactcgaggagatttgtggtgcgcgcgacgtacctgaaccaccccgtgttcaagaagctactggttgaggcggaggaagagtacgggttctccaaccacggccttctcgccattccctgcgacgaagcgctattcgaacaactactacgcttcatttcacgctccgactgccacctcgcccttagaaacaacctccacttctaccttcaatccctaccactactccactga

SEQ ID NO: 25912 - DNA, 195 bp, Glycine max
  Peptide Sequence Number=SeqID_142690
atgcatttaatgcaaggtcccaatgaccattatcatcaaatgaagacaagtgaagaatccaatcattggaaaactgccagggaaccacatttcaagcgaaacctcaaagagagttgggcttcgtcctcaaaaggaaacaacaccagaaaatctagccttccatggattcaaacagaaaacgcaaatgaaacatga

SEQ ID NO: 25913 - DNA, 255 bp, Glycine max
  Peptide Sequence Number=SeqID_142691
atggggatattcctattttctagaccagaacctgaatggacagatgttgatctagccattatggatctgaacacaaaagcaagatacactctgacatgtattgagaatgtcagattgagaaaagctacgactttgaccagacactatgaaagctttgctataaaggatggagagtctgtggacaacatgtttggaagacttttactccttctaaacattatggaaactcttggacaaaaatatcccgaggcttag

SEQ ID NO: 25914 - DNA, 224 bp, Glycine max
  Peptide Sequence Number=SeqID_142692
tattcaacagtgcttttaaaggacttgacgatactccacaacctaaatccaaggttggtgctaggtggattttgttaaaacaaaaaggaagcactgagtgtggctattacgtgatgcactggatgtcaactataatcttaggaagttttaggaataattgggaaacgtattttaatgatggtagaccattggaatcagagagattgaaggcgcttcgcatctag

SEQ ID NO: 25915 - DNA, 420 bp, Glycine max
  Peptide Sequence Number=SeqID_142693
atgggtgaagtagaggaggtgcaagaacagatgaaggccgacacggaggccttgaaaaagcaaatggccacaatgatgggggccatgatgagcataaaggagataatggaggtcaatgtggctgcaatagccgttatcagcaccattgttgagcatgccttcccaccatatggcttgcctcccaactatacaccacccaatgtggcatacactcccagtgaggatgtcaataactccgctcccatactcattgaaagccgacaacctcaaactaatcatgcacatgtctctcaaaccatgggggagacacatgaaattccccaccacaatctaagcgacttcgagccttgccttggatatgccactgaagggcaagcagttggtggtatacccctgcaaaacactttggaggggtcttaa

SEQ ID NO: 25916 - DNA, 1176 bp, Glycine max
  Peptide Sequence Number=SeqID_142694
atggcttctccttctccaccgaaatcgaagttcagtgtctatcaaaatccttccttttctgcggttctcacttccaacagtcttcaaccttccaattccacaatcctctccatcctctccttcttctctgcctccgcattcgtttttctcgctgccttcttcagggaaaacggcttcgtccacattttgtgctttggaactttgtcccctgtcacagcttattggcttgccaagacgctacaagctatagtgggttttatcttcattggaactgtttctgcactcttcaacgttgtgtttctgcgtagagctaggtatgctggcggaggtgctgctgttgcggctaagtctctgtctgattctaacagtgttcataggaatgagattttgctaaccaaacatcaattagggcttttaggagtgaagccaaaggttgatttggttcaacctgactcggcgaagaagccccccaagtctaaaccccaactgccttcttcaggtttgctggttccccttcaccagccaattcccagtcccactcgaggttcttcgtctcgcattgatgccgatggttcaaactctaataggggtggtgctgctcgttctattggtactccatcaaggtcaccaggtttggcgtcgttgtatctttcaccgggtgtggtttctccacctaggagtttggctggcgtggattcggtggtttcgagtccttggtctaacaggcgagtctcctctgctaacaagataacgtccgaggaaaagctggagagattcttagctgaagtggatgaaaggatcaatgaatcagcggggaagatgtctaccccacctcctacagttcctggttttggcattgtgagccctagtacagttacaggctcagctaatacctcaggaactgcaaggcgtacaccactgaggcctgtgaggatgtctccgggctcgcaaaagtttaatactccccctaagaagggtgagggcgagtttcctgcaccaatgtccatggaagaatttgttcaagcttttgaacatcttggcatctatcctcaaattgaacggtggcatgatcgactcaggcaatggtttgcttcggttctgctcaatcctttgcttaacaaaatcgagacaagtcacattcagattatggctggtaatactactgcaaaaggttga

SEQ ID NO: 25917 - DNA, 189 bp, Glycine max
  Peptide Sequence Number=SeqID_142695
atgtatccagaagaattgtcaccatcagaagatgcacctaagaacctgtgtctgagtttcgtcgaagagcaaggaggtggagaaagcagcagagtgaggccgagatttgcttctgaaaacagcagaaaaaatggaccttgcggtgttgatcctatgcatggtggcagcaacgaagatgggcacaattga

SEQ ID NO: 25918 - DNA, 915 bp, Glycine max
  Peptide Sequence Number=SeqID_142696
atgcaagcagctgctaaacttggtatttcaatcacgattagtcaagtgggcagtgatatgctgtctactggcatcccttctgctttgccaacaattgataagaatcaagagtggcaacctgcactgtctctcaatgaagatggattacttcatcagttacattctactcttgtgcaggctatagattcttccaaatccaagttgcttgtatctaatatgcagcagtctccacagcagacttctttagtttctatcatgcaggattgtgtggatgctatcactgaacaccaaaggcttcaagccttggttaaaggagagtgggttaaaggtttgctacctcaaagcagtgttcgtgctgattacactgtgcaaaggatccgagagcttgcagaaggaacatgcttgaagaattatgagtatcttggaagtggggaggtttacgataaaacgaataaaaagtggacacttgagctaccttcggattctcacttgctgttgtatctgttctgcgctttcctagaacatccaaaatggatgttacatgtggatgccatgtcatatgctggagctcaatctggcaaaaacccattattcttgggagtccttcccccaaaggaaaggtttccagagaaatacattgctgtagtgtctgctgtcccttctgtgctgcacccaggagcatgtatactagcagttggaaagcagggtcccccaatttttgccttgtactgggataagaaactgcagttttctcttcagctatggatttgtcagggaagaacggcactttgggattccatcttgcttctgtgccataaaattaagatcgggtatggaggtgttattaggggcatgcatttaggcgcttcagctttaagcattctcccggttatggaagcagaatatgaagattaa

SEQ ID NO: 25919 - DNA, 219 bp, Glycine max
  Peptide Sequence Number=SeqID_142697
atgcagacaaacaaggaaagtcaaggggtaaggataagaactgcccttagagcccttgtggacggtaatttccacatggcatctttcaaatggaactacgaacaaagtaacaaagcctcttcgggtacaagatgctatcctgccacctacagtgcagaactcagtcaacatttagataacaaaactgctcacttcctgtcaagcctcttgatccgttga

SEQ ID NO: 25920 - DNA, 1167 bp, Glycine max
  Peptide Sequence Number=SeqID_142698
atggccgaaacgtcttctacagaagaggatcacaatcatattcccatcgaaattatcagcgacgacgaaatggctctaattgaagctgctttcgcttttgcttccactcgcactttctcttcacttcgttcttcttcttcttcaaaattacccctttgcacaaacgccttatccatcacacctttgtccaaaagaaagttatcgagtgacattgaggatttacccacttgcaagaaaaaacacactctttctgattcttttcttcaccgcttcaggaacaaacggggcttgtccgtcaccgatctcacttccacggaatggtgcccaaaacaaatggagttttctctccttcttggagggagaaaagtgaatgaagcaatgagagctggcattgctcgccatgcaaagcttgaacaagaggttatacaacgggtggaagtgaaggtcaaatctcaagaagattattgggccttgaagtttcttaattttatagctggtgcaaatcaattattgtttgaaggattgactcgtgaactgccagtaataggctttgcagaagatatatggatggtgggagtaattgatgagattcggatgccattaacagaaaatgatcataatccaattctaattgacacaaagactcgatctcgagatacacttcctgctgaaccgcaacgaagaaatggaaggcttcaattgatgtgctacaagtatttgtgggacaatttagttgctgatgatttcccttctgagaaatttttcacttattttggcttaaaccctcaaaataatctatgcgaagatctgaaagtgataggtgctgactctggattttcagcttcaaccctggatgatgcggtgagatattacagaaatacatgcaggatgctggcccctgctcatgatcagctcttattgagatatgagtatcagaaagatcattcgctgcttggggaagttaaatttgcatatgaccgtgactggctaaagaatcaacttcgttcttgtcttgagttttggcttggagaacaagaagccacttacactcctgaggaggagcgctggaaatgtcaatactgtcaatttgccagagtctgtccagcatacactaatagtaaaggaacagagtcacctaaaagaaattattcaaatatcaaaggctag

SEQ ID NO: 25921 - DNA, 312 bp, Glycine max
  Peptide Sequence Number=SeqID_142699
atgcagtccatgctaaaccttcgtgcaactcatggcgttccactttgtctctctggaattactcaccctcttactcttcctaaagagatggctgatcatgaccgtaggaggaaggccatgaagagacaaagattacgagccagaagaggtggtggtatgcatgcaaatcaacaaaagggtatccacagatacaactttgaaagtgattttctggagatcaaggttgaggaatatgattatggagatctagatgaccttatcttgcatgatctgttccatacttacctggatttaacagcaaaagctgcatag

SEQ ID NO: 25922 - DNA, 396 bp, Glycine max
  Peptide Sequence Number=SeqID_142700
atgcagttggcgcagagtaatcccaagatcaacgaattccttaaagacaaacgtttagagaatgttaatcgagctcatttgactcttgcccacaagagaagtcatggcatcaaagctgtagctgattatggtatctatcataataaaaaggtgccggtggagttgacagcgctactcttcacagataaaatggctgcatttgaagcatgtaccggctcagtggaaggtgagaagatagtttcaaagaattcgtggcctcatattaccttgtggactgccgaaggtgttgcagccaaggatgccaacatgttaccacagttgcttgcagaggggaaagcaaatcggattgacttcaatcctcccatcaatatatctggcacactcgacttttattga

SEQ ID NO: 25923 - DNA, 2164 bp, Glycine max
  Peptide Sequence Number=SeqID_142701
atgtgggctaagaagaatgctggtggaaaagaacaggtggcaaaattagtggatgatacatataggaaaatgcagatatcaggggccactgatctagcttctaagggacagggtgcatcagatagcagtagtgtaaaggttaaaagtgaatttgatgatgcttttcaacgagatgtaaagattcgctgtctatgtggaagtagattggaaacagaggatttggtcaagtgtgatgatccaagatgccatgtgtggcaacacatcagttgtgttattattcccgagaaacctaccgaaggcatcccaccagttcctgataaattttattgtgaactctgtcgtctcactcgtgcagacccaaacaacccagtgcagagtgtggagagaacatttcaactgactagagctgacatggacttagtatcaaaaccagaatttgatgttgaggttggcttggtgtatgctcctgaacgacaaggttccattcaggatgcaatggccacagtatacagacctgcaggtgttcctgttcgtgcaactaacagacctggttcacagttgcttggggctaatggtcgggatgacggtccaattatcctaaactcaatcccaaaggagtctgatggagagaaatttgaagaagctcttgcacgtgtctgccgttgtgttgggggaggaaatgcagctgatgatgctgatagtgacagtgatttggaagtggtttcagatactttcactatcaaccttcgatgtcctatgagtggttcaagaatgaagattgctggaagatttaaaccctgtattcacatgggttgctttgatcttgaagtttttgtggaaatgaatcagcgatcaagaaagtggcaatgtcctatatgtctcaaaaactatgctttggagaatatcatcattgacccttatttcaatcgcatcacttctatgatgatgaactgtggcgaagaaattgcagagattgaggtgaagcctgatggttcttggcgtgttaaggtaaagagtgaaagtgaacgcctggaattaggaaatctagcacagtggcgccttcctgatggaaccctttgtgtttcaactgatggagatgttaagagagtggatacattgaagcaggttaaacaggaaggtgtttcagacagtcctgctggtttaaaacttggcataaagaagaattgcaatggagtttgggaagtcagtaaacctgagggcacaaacacctcttctggtaataatttgaaaagggtttttggaaatcccgaacaggttgttattccaatgagcagcagtgccactggaagtggtcgggatggtgacgatcctagtgtaaatcagggtggtggtgggcatattgactattccactacaaatgggattgagatggattctttgtgtctcaataatgttgatttagcatatgaatatactgcacccaacacttctgcccaggtgggtggtgcagaagttattgttcttagtgattctgaagaagacaatgatctgttggcatctcctgcaattgcatataagaacaacagaaatgatgctacagatggttactctgtaccaccacctgtaattgttgattcatatactgaagatcataatcttggtggaaattcatgcttgggactctttcctaatgatgatgattttgggatgtcttccctatggccattgccttctggaagtcaagctggtcctggcttccagttatttggttctgatgcagatgtgtctgacgcattggtccatctgcagcatgatcctatgaattgctcctcgtcactaaatggttatgcattggccccagatactgctttgggatctggcggtatcttgcaagagtcctctgctggtcgctcagttgctgatttgaatggtggtttggtggacaatccattggcatttggtggagatgatccctcatttcagatttttctccccacaagaccagcagattcatccatgcacaatgaattgagagatcaagcaaatgtggctaatggtgtctgcactgaggaggattggatatcccttagacttggaggtggtgctggtggtaacaatggtgatgctcccactcaaaatgggttgaattctagacatcaaatcccaaccagagaaggcgccaagaatactttggatgatactg

SEQ ID NO: 25924 - DNA, 1458 bp, Glycine max
  Peptide Sequence Number=SeqID_142702
atggagtgggtgaagatgaaggggtacgcgagagagttcatggttggagtggcggagatgacggtggagttcggaaaaggttgcagagacatagttaaacagagtctggtcaacgacgactcctacatcgtcaaaaacttcggaagagactcctacattggaaaaacagtgacagaacctttcgctaatcttttccagaaattgagtttcttcaacgagtacttgcccgaggataaagatcctcttcacgcttggtccgttattttcttcgtttccattctcgccttcttagctttgtatgcgaattttgaacgtgatgcgtacgcggcggccccggtgaagcatgtgtttgtgcatcctccgagtgctacttgcgtagtgcttcctgatggaaggtacatggcgtataaggagcaaggtgtttcttctcacagagctaggttttcggtgattgctcctcatagttttctttcttcaaggcttgcagggattcctggagtgaaagattctttgctgcaagagtttggtattcgtttgttgacgtatgatcttcctggttttggtgagagtgatcctcatcccaaccggaatctggaatcctcggcaacggatatggcgtttttagcgaatgctcttggtgtggacaagttttgggtggttggttactcaagtggcagcatgcatgcttgggctgcacttagatacattccggataggcttgctggtgcagccatgtttgctcccatggtgaacccgtatgatcctataatgacaaaggaagagagacgaagaacttggaacaaatggacacgaagaagaaaattcatgtacttcttagctcggaggtttcctagacttctcgctttcttttatcagcgaagctttttgtcaggaaagcatggtcagattgataggtggctgtcattatctctgggaaatagggataaagcactgatggaagatccaatgtatgaggaattctggcaaagggatgtggaagaatcaatcagacaaagaaatgtgaaacccttcatggaggaagctgctttgcaggtcgcaaattggggtttcagcctttcagacctcaagttgcagaagagaaaacggagtagtaatttgctcagttggcttaagtcaatgttcactgaaactgaggaatatatgggatttctgggccctatacatatatggcaaggaatggatgataaagtggttcctccatcaatgactgattttgtgcaccgcgtgctacccggagctgctgtacataaactcccatatgaaggtcatttcacctatatctacttttgtcatgaatgccacagacagatatttactacactttttggaaccccacaaggtccactcagcatttctatagaagtagatcaagctaacctagaagaaaccaatattgaacagcaagtagtaaacgatggtgattatgccacaaactag

SEQ ID NO: 25925 - DNA, 774 bp, Glycine max
  Peptide Sequence Number=SeqID_142703
atggcttgtcaattctggttcaaagaaggtccaggtgcttacaaggcttattacctcagacaaatgaaaatatggggaacctctgcagcaaagcagagagaacttagcaatatgcttgatgaatgggctgtgtatataagaaggaagtgtggaaataagccactgtcatcatcaacatatctaagtgaagctgaaccttttcttgaacagtttgcaaaacgtagtccacagaaccaagcgctgataggttctgctggtaatttagttaggactgaagatttcttggccattgtcgagggaggccaggatgaagaaggtgatctagttgcagagcgggagatagcactgccagggcctaatatctcagtcaaggacacagttccaaaatatgaagggttgattgtattctttcccggaatacctggttgtgctaagtctgccctttgcaaagaattgctaaatgaccaaggaggattaggagatgatcgaccagttcatagtctcatgggtgatctaattaaagaggttcttaacatgattcagatccattttatgtatcccactgctccagtgctcttatatataaaagttgtcagttctacgtgtataactaatacagagtatcatggagtatcaacaggaaaatattggcagaaagtggccgaagaacgcagaaagaaaccgaattctataatgcttgctgacaagaatgccccaaatgaagaagtttggagacttgttagtgttctaactaatttcattatggcttactga

SEQ ID NO: 25926 - DNA, 972 bp, Glycine max
  Peptide Sequence Number=SeqID_142704
atggattacacaaaccttaacaaagttttcccaaaagacgcttgcctttttcctagcatagacagacttgtggatggggttgcaaggcaccacctgctcaacttcttagatgcatactcaggttacaatcggattttgatgcatccacgagatgaagaaaaatatgccttcacaaccgagtctaccaattattgctatcaggacacttttcaagggctaaagataatactagtcacaccaccactcttagccaaaccatacatccaagagaagttgatcatctacttgtcaatctctgacgattcctctaatcaaaatgggtgtagagctggggtcttgttagaagcacccaaccaaatgacattggagcaatccctcagatttggtttcaaagcctctaataatcaagcagagtatgaaacacttctggtcgaactcaggctagcaaaggagtattttcatgctttcatgaaactaaatgacgagtttgaagaagtgcaggttgaacacattgatcgaaattacaacgaaagagaagatgagttgactaagatagtgagtgacaagaggcctacccaactgagaaccctaatacatgaaacattactagaaccgagtatccactcggatgaatgcatgaatatttcttcagatagcaaggaatggatggtcgacataatggattaccttgccaaaggaaacctccctggaaatgccttaaaagctaaacaagccaagtatgcaatcagagagctacataaaggaatttgtggggtgcattcaggaagccaaacgatggcaactggagtgcttaggtccacaaccaacgaaataccatttcggctaacttatgggacaaaagcattgattctagtaggaattggagaacccttgttccaacaaatgcattatgacaacacaggaaatgtggaagctttgaaagatgaacttgacctcatcgacgagctatga

SEQ ID NO: 25927 - DNA, 2883 bp, Glycine max
  Peptide Sequence Number=SeqID_142705
atggctacagaccaaacattcttcataagcatcatccgcatagccatgctacaaagaggaacaaagttgtcatgcgtgagtatttttgttacaggatgcaatcaagggataatgaagcacgagcaatacttcattcaagaagattgtttcaccaatgggttgttgatgggacgaagcccaactctctttgaggtttcgcttgtaatgtggtttcctggcagttttcccttcaccagttatcccaatttcgtgaatattaatcagtgcacgcttcgtgttcgattaattgcctctgagcctaacttgcgttcatgcttaatggacgaagggctaactgtacggcctcgatcaacaggatgcaatcaagggataatgaagcacgagcaatacttcattcaagaagattgtttcaccaatgggttgttgatgggtattagatatatggaacaattgtattttgatgggatggaaatttgtgcccatgttggatttcctgatttattcttgacattaacgtgtaatccagcatggccagaaatacaacaacaagttgcaaagtcaaatcttacagctcatgatttccctgatgttgcgtcacgggtattcaaaatgaaactaaaccagttgatgcatgatcttaagagtggacatgtatttggtcccattcttgcatttgtttacaccattgagtggcaaaaaagaggattgcctcatgctcatatcttaatctttttgcatccttcaaataagtatccaaatccagaagacattgacaacataatttctgctgaaataccaaacaaggacacagatccagaattgtatcaaattgtctctaaccacatgatgcatggtccatgtggactggctaataaaagggcaccatgtatggccaatggcaagtgtttcaggtatgtgtcggctcctgaagcatgttggaagatttttgcattcccaatgcatgggcgtgcactggcagttgaacatctttatttccacctagaaaatcaacagcctgtttattggaaagatagtcaagaaattggcacagtactggctaagagtacaatcaaagaatcaattggagagttgttctacatgaggatgatgctttcctctactaaaggatcacaatgttatgaagatattagaatagtagaaaatgttgtctatcatacattcagagaagcatgctttgcaaaaggttttctaggaagtgatcaagaatttgttggtgccttacgagaagcaaacacttggggaactccacactatcttaggaagttatttgtgaaactgctatttatgaataccatggataggcctgaatatgtgtggaaacaaacttggcaatggatggcagatgatattgtatttaatcataaaagacaaggcatccaactaacagacaaagaaaaaatgcatctttgtttgacggaaattgaaaacctcttgcaagccaacaggaaaaggctacgtgattttccttcaatgccatacccactaggatatgccgccaagacgcaccaaaataatctcatctacaatgaattggcttacgacagggagatattggccgccgaatttgacaaatgctaccagtcgctaacagatgagcaggcttctatttttaataagattatgcatgtggttgcaactcaatcaggtggagtttattttctatatgaatatggtggcacatgcaagacatttgtgtggaaaactttatcatctgctatacgctctactggcggaattgttttaatagtagcttcaagtgggattgcctcaatactattgcctggtggtagaacaacacattctaagtttgctattcctgtccctgcaacaaaaaattcgacatgcaatatccatcaagggagtgatttggctgaattgttgcatatcacaaaactcatcatatgggatgaagctccaatgtgtcacagatacagtattgaggcccttgacaaaagtttacaggacatcatgcacaacatcaatccttttggaggaaaggtcattgtttttggtggtaatttccgtcaaattctacctgttgtgccaagagacataggtgatggtaaacttgcagaacctaatgatggttatggtgaaatcaccatcccagatgagtttcttatcaaggactttcaagatcctatccaggcaattgttgaagcaacatatcaagacttattacacaactacagcaatgacgatttcttgcaaaaaagagatgtccttgcctctacaaaagatgttgttgataaaataaatgactatgtcctgtctttgatttctggtgaggagaaagagtattgtagtgctgattctgttgacaaatcagatgaactactcagtcctgcatttggagtactaacagctgaatttctaaactcattgaagacatctggcataccaaatcacaagctcataatcaaggttggtacgcctatcatcctactacgaaatctggaccaagctgatgggttatgcaacggaactaggcttattgttacaagacttggttcaagtgttgttgaagcggagattattactgggcctaacataggtcatagaacttacataccaagaatgaatctttctccttctgattcagcatggccattcaagctaattagaagacaaattccattcatggtttcatttgcaatgacaatgaacaaatctcagggacaatcgttggcacatgttggattgtatttgccaaccccagttttttcacacggccagttatatgttgcactttcacgagttcaaagcaaaaaagggctccacattcttattcatgataatcaaggcactccaaaaaatactaccgttaatgtagtatacaaagaagttttttcaaacttataa

SEQ ID NO: 25928 - DNA, 648 bp, Glycine max
  Peptide Sequence Number=SeqID_142706
atgcagatagaagacatgtgtcacaaaacaagggcatctgctgtaccagttgtagctgaatctgaaggaactgattcaaatccattttctcttgatgcattagctgttttcatgtttcgtgtgcttcaaagagtcaatcatccgggaaatcttgacaaaggatctccaaatgctggctatgtgctgctaatgttttatcatctttatgagggcaggaaccgtagagagtttgagggtgaattaattgagcgttttgggtcacttgtcaagatgccactattgaaatctgataggaatccccttcctgagccagtgcagtctgttttggaggaaggaattgatctatataaacttcacactaagagacatggaagattagagtctaccaaaggatcctacgcaaaagaatggataaaatgggaaaaacagttacgggatattctttgtggaaatgctgagtattttaattctattcaggttccatttgagtttgctgtcaagcaagtgttggaacaattgagaagcattgctaagggagagtacacaccaccagatactgaaaggaggaaatttggtaccattgtttttgctgctctcagcatgccagttactgaaattcatggcgtcctcaataaagtaaggaaatag

SEQ ID NO: 25929 - DNA, 717 bp, Glycine max
  Peptide Sequence Number=SeqID_142707
atggcagaaacacaacctccacgacagccgtcaaccaaacaaccacagccagtccaagtcccttctccccatatgagtgaagatcatggggaggccattcaagttctaagagaagagaatgttgagctaagaggacatcactcacaacttccccttaggagggacatccctcaaccgtcccaagtggaagtgtccagtgtaccacaggctagtcacttgcaaggagtaacccatccttccaaccccgtcagcacttcacttgctcctggacttaagagcccattcacagcaaggatcaatgatactccattgccttctacatggaagggagttactttggataaatatgatggtattattgattcaggcaaacacattgacatctatgttgtgcaagttgggttttacaatatgaatgatgttgtcctatgcaagattgctttaaactttgatgacccggttcaacatccaattgaccccacatttgacatcggtagcactggtcagtttgaggcaagagaagaaagaaacgctatgatctttcctggagagctaggaccctttattaacagtttttgcaagaagttggcaatagatcttgatgatcttcattgtcgggcagctaaatacaggcaattggaggagcttatcgagtataactgtcagctgaggagtgaagcatctggttcatggaaggaaccaaaaaaggatttctaa

SEQ ID NO: 25930 - DNA, 180 bp, Glycine max
  Peptide Sequence Number=SeqID_142708
atgctcgctcagcctggagttagcggatggctcgctaagccagagaattggcttagcgagcggctcaaaatcagcacttctacaaacttgcttattttacctgaaattgaaatggaaaggttattaaatacacaaaagtgggatactaagtacttattacctatatttaataaaaagtaa

SEQ ID NO: 25931 - DNA, 333 bp, Glycine max
  Peptide Sequence Number=SeqID_142709
atgggatacagatactcacaactttgtgcaaaaaatccctacaaacttctgaaatttattggcaaacttcataaccttgagaccttagacataaggagaacatatgtcaaggaaatgccaaaggagattctcaagcttagaatgctaagacatcttttggttgatgatgaggaattgtctccattgaggaagggtcttggaggcatgacatccctacaaacattgtctcatgtaaagctaactatggatgatgatggagtagagctaagcagagaactgggaatgctgacgcaattaaggaacttagggttgaattatgttaagaaagaatag

SEQ ID NO: 25932 - DNA, 322 bp, Glycine max
  Peptide Sequence Number=SeqID_142710
gctagaagtattgtttggaagtgttgtcaaatttagtaaggacttgaactgtgttattctaaagctgaccccgaatagcatctgcacacaaggagtgatacagagcaagagtcaaatacacaacagaaagataacaaacagctgcaacatagggattacgcagggccagaaaagaaaagcagctgaccacatacaaaaccaaaacatcccttctatgagcaacactacacatatggagcaccgaagtcctaccccatgcagcaaacaccactatacacatacttcaaatataactaacacctcaatcacccaaattggttaa

SEQ ID NO: 25933 - DNA, 348 bp, Glycine max
  Peptide Sequence Number=SeqID_142711
atggctgaccacggaaccagaaagacaaccactgatcgcctcgaggaagccatcgtttgcctctccaatagccaagcctccatcaatgatcgctacaacgacctcgctggcaagggccatcaacgcaacacagttaagtttgacataccgcggtttgatggacgccatccgttagggtggatcttcaagatcactcagctattccaatatcaaaacacaccagaggaagaaagaatcaccgttgcatccctgtaccttgacggtgccgcattaagctggtatcaatggatgttcagcaacggctttatcacgccatggaacggcttccttcaagctcttgaatcgtga

SEQ ID NO: 25934 - DNA, 2574 bp, Glycine max
  Peptide Sequence Number=SeqID_142712
atggggaaatctacctcctgcttcaaactaatcacttgcggtggcgatgcggcggagaaggatgattaccaccaagtctctgagatcaaggaatctaacgataaacgtggttggagtttccgaaagaaatctgcaaggcatcgtgtgcttagcaatactgtgatagcagaggccccatcttctgcaaataaggaaacttcagaatgtagtacttttaattttcaaccacttcctgaacctaatgttgttgagaagatttacacaacaaattgctctgatgagaagccccagttatcttcctttgaaagctcacaagtagaagaaacaaatgtcattgaaactgaggagaagttggatgtgaatccaccagagtctgatgtcatcatcatccaggctgctattagagggttattggctcagagagaactactacagcttaagaaagtagtgaaattgcaagctgctgttcgtgggcacttggtccggagacatgctgtaggaaccctgcgttgtattcaagccatcatcaaaatgcagatccttgtgcgagctcgtcgtgcttggcagtcacgtctggaaaatcatttaaatcataaggatggcaaaagggattcctcagaagctttgggaaacaaaaatctcatgaccaaatcaaatgtgagttacatttccattgagaagctgcttagcaataggtttgctagtcagctgttggaatcaacaccaaagaacaaacatatccatgtaaagtgtgatccttctaaatccgattctgcttggaaatggttggaaaggtggatgtcagtatcatcaaaagatattgcagagtgcaaagaaactagttctttggcagagcaatcaagggaaagcaaagatagttctcccctgtttcaattcgaaacaggtattccttctgaaccttttccccaagcagctgactcagagctcactgttgaagattcacttctgccatctgaggatgaagaaaagttaattacttatgatgctaatgactttgagtttcaagcaagctactccacatcatctattgtaaaagatgacttggtacaggttcctcctgaagaaagaattgcatatgatgctaaagttgcctcagacgaagctgattccttcctaaatgaaaaatcagcatcagatgcaagtgccccaccagagcttaatttcattcataaggggcctgaaattgccccaccatcagagcatcattctcttcagaaggggactgaaattgccccaccatcagagcatagctctcttcataagggtcctgaaactgccccaccatcagagcctaattattttaatcagaagcctgaaattgatggtgagcagggcatacgatccatgaaaagatttgcctcagaccaattagaggctgaaggaaagaaacctgtaaatggttcaagaaaggtcagtaatcctgcatttattgctgcacagtcaaaatttgaagagcttagttcaatagcaaattctgttaggacaagcagtttgtcctaccaagattcagctgttgaatcacaaggagacacctcttctgtaggcaatgatactgcatatagatcaaaagagtttgcatttgaaaatcctgctgcttatctttctaggtttgctggttctgaatgtggcactgaactctctatttcttccactcttgattcacctgacatatcagagcctggagctacggaaaatgagcgagatgccaaagatttagtggaagggattggtattcttgagaacactgtaaaccgtgatgatgaggccaatggcaatgtttcacatgtcatcccagcttctaacctagctaattctgttttggataagtcagagattgttgatgacattagtgccaatttgggtcactcggtggtagctgtggactctgaagagcctgctattaagaccgagaaaaatgcacctgacctgcagagagagctgccagagtctgttctgcaagatttaagatcatctccagaagcttcacctagaagccatttaactgtccctgaatcacaaggaacaccttcaagtgaagtgtctgtaaaacctaaagatagtacaatcagcaagactagatctggcaataaacgtcggagcctatcattgagtaacaaatcacctacaaatccaaatcatgattcaggctcaaaaggcagtagggagcaactgcctaaagatcagcagaatggaaagaggcgcaattcctttggcttagtaaagcctgatcacattgatcaagaacctagagataatagtactaacaacaattctcttccccatttcatgctagctaccgaatctgctagggccaaggttaatgcaaataactctccaagatcaagtccagatgtgcatgaacgagacattgaagttaagaagagacattccttacctggtgccactggtaggcaagtttctccccgcatccaacgatcaacatctaaggcacagcagagtgccaaaggaaacaatgtacatcctcctcaagggctgtgttcattacaagaatccggactatgtttacagattatgtctgggtataacctttga

SEQ ID NO: 25935 - DNA, 1221 bp, Glycine max
  Peptide Sequence Number=SeqID_142713
atggctgaggttaggctattcttatcagaggaatctccttcacaggttgggttaaattctcaagaccacgtccaagcaaagacatcattgctgttgcatccagatggagcaggttctgacgacattctgcctcctggatttgagggaactcatgctaaaagtcagtccgagattaagctatcccaaataccagttattaaatggattactcctccaaagattgaggtaaatcccacatggcgagtagcggttggggaagaaagcacagaggtagaggatcaacctcagagggagatgagagtacttgaagctatttatcctcgaatatcttccattcctcaaaacccttctgtttcaatggatgttgaagagtcccattgcatggatgatcaaactgctttgataccaataacaccaattgaagaagaagaagcagcagcaaaagcattaatggattccttgaaaccatttgatgtttcacaatctcttcaattagctcctggtattcttaaggattcaaactctgctacaagtatgcagttagcttgtggtcttgcatctgatgtagttgctgctgcatttgttgctttaactagccttgtgaagagaaatgaacatggaaattttattgaccatgaatcagttaatcatattctcaacaatccagaagtgatcgtgaagttggttagagattatagagctgctaataattcacaatatgtacataatgcggggtcatccttggcggccttttcaaatccatcgattcctattcaaggagaaaccactacaccttcatcggttgttttttcaggcacttcttcctatgctcccccaattggaggtctggtggaacctattactacccaatggcctcctaggcctgcaatgagttcagctattgtttcttcttccattgaggtccctcctgcaagaaatgtaaactactataagagcttaattcaacaacatggaggagataaacaagaaacacttccatactccagtaaacgtcagattcctcagtcagcaacaaactatgagacaacctcctacaatcatagaggtaaagatgtcggaagggagctaactgtgactaccatcatgatgcatcattttaaccacggggtaataccgtgtcagggatacaaagttcaaagaggatcaaaatggatcatgagattagcagttaaaatgaactctgttggctggtggttttga

SEQ ID NO: 25936 - DNA, 591 bp, Glycine max
  Peptide Sequence Number=SeqID_142714
atgttgaaattcttgtcgagagtgaaaatcgagttcaacgcgttggacccgcgaacggcgtcgtgtatggagtttctggcgcaatgcaactcgcggaaggcgaaggagtcgaacccggcgtgcgaagtggaggtgaagcgcgtgagggaagagcgcgcgccgcagataacggtgacgttcgttaacggcgttgaggaagtgttcgacgcgacggcgacgccggctcagagcatacgaaacttgattctggaaaagggtcagcacctcgagacggagcagatgttccgcgaagctggggaaccctggcccgttgtcatccccgacgaggagctctcgcaaatcgcaccccctaccaaagtgtgtgtgcatcataagttgcaatggagaattttttggattcatgagttgtgctataaggcaatatgtgtttggtttccagaggataattaccgtttgcatgcactgcttacttgcctaactgctacaaacttccatataattttccttgtggctgctaacgcgaagcaactacatgatgctgttcctgcacgacatcctgctgccctgtacaacctgcttcttcctatttag

SEQ ID NO: 25937 - DNA, 699 bp, Glycine max
  Peptide Sequence Number=SeqID_142715
atggatgatttggagcgcttgaagaaaataagaaatcaccatggtttgaggcactactggggccttcgcgttcgtggccagcacactaagtgtactggtcacaggggtaaaactgttggtgtctctaagaaagttggttctgccgtcgtcttccgtgaccttgacgctgacgactttcaccaccctcttgataaacaggtgcacccaatttggcggaaactccatgaaagcataacatacaatggcaaagccttctcaaatgcaatgaagaggagtagagggaagaggaaaagggttagcattggacaagaaatgctcacaaacccaagcttgttgttcctggatgcatctggattggactcaacaattgctaagagaattgtctcaactttgtcaaatggagggagaactattttgatgaccatacctcaaccttcaagtaggatgtattgcatgtttcaaaaggtgtttatgctttcagaagggaaccttgtgtattttggaaaaggatctgaagctatggaatatttttctagatttggatatgccccaaccacggtcatgaacccctcagatttccttttgaatcttgcaaatgcaattcctcgtgctgctaaaaagagacatcaaagagaggaagtatgcatcatctttgacatgcagatttgtctggtccttatggttgctcttattgcatga

SEQ ID NO: 25938 - DNA, 1311 bp, Glycine max
  Peptide Sequence Number=SeqID_142716
atggctttccgcacccataatggtcgtttcaaatatttggtaatgccctttgggctttgcaatgcgccctcaatgttccaatctgccatgaatcaactcatgcaaccattcctatgcaggtttgtgacgcgctataaatgcctcttcgcacaagaaaccatcgagtacctcggccacattgtctccgacaagggtgtcactccaaaaccatcaaaagttcaggctatgttgcagtggccacctccgacgatggtcaaggaactacggcattcctggggctcaccagattttataggaaattcattaagagttacgcctccatcgcagctccactcacagccctgctatgcaaagacgctttcgactgaatgggcaccctctggcatacttcagcaagagtcttggaccccggttactccacacatccacgtatatacgagagctccatgtcgtggtggccgcggtgagaaaatggaggtcatacagacaccagaacaacactattacctctcgaagttgcttggctacgagtactcgatccagtacaagtccggcgccactaatgtggtggccgacgcgctctcacgagctccacctccagtgggtcaattgctaatactctccataccccagcttgacttcctccacgatattaagcaatcactcaccgaaaatctagaatttcagcaactcacaagggcaatccaggatcatccaaccacctaccctgactattctcttggtaacggcctgaaacaagacgttaaaaggtttattaaggaatgtgtcacatgccagcagaataagaatagtcacaggcgcccagctgggttactgcaacctttaccgacatcagagggcgtgtgggaagacctctctatggacttcatcacccacttgccaacctccaatgggttcactgtcatcctagttgtggttgatcggttttcgaaaggagtgcatctaggtgctcttcccaccggattcacggcgttcaaagtcacaagcctattcctcgatatcatatgcaaactacatgggttccccaagagcatcgtgtctgaccgggaccctatcttcgtgagcaagttctggagggagttattccggttgagtggcacacgtttgaggctcagcacgacgtaccatcctcagtccaatggccagatggaggtgatgaaccgcatcattgaacaatacctctgttgcttcatccatgatcaaccatctgcgtggtaccagtatctggcccttgtagagtggagttacaacacctcggtccactctagctccggcctaactccgttctaa

SEQ ID NO: 25939 - DNA, 213 bp, Glycine max
  Peptide Sequence Number=SeqID_142717
atggatgatcctttatctcagcatgatataaaagatgtgttaaggtttaagggaggtattacatcaaaagggaatcttatcattaacacggtgaaaatcaatacaactgcgaggatagatgttaggatagtagctggtgttgctatcatctctcccctcttgaagaataaccttgtcctcaaggttgtacattgtgtgcagagtatcccatga

SEQ ID NO: 25940 - DNA, 261 bp, Glycine max
  Peptide Sequence Number=SeqID_142718
atggtgtgtgtagaccaagtcgaggaaaaggagggcgaccttgtgcacggtgtagttggagggaacggtgctgaaatgggcacctttcgaaaattggtcgatgatgatagaatagtggtgaagccctgggaggatggtaacctagtgataaaatccagggatatgtcttcccaaattgaagaagggattggtaaaggctccatccgaggccaattgaagctctcctgtaatcgacgaagcgtcttagcaactcccatgtga

SEQ ID NO: 25941 - DNA, 519 bp, Glycine max
  Peptide Sequence Number=SeqID_142719
atgtctgcgtccgaagcggagaagaaggtcgaggaggaagagaagaaccaagaggtcaaagggggagaactcttgttctgcggtgccacgtgttgggatatcattggtcgtcgcaaaggcgccgtcgacggtaacctcgtctctccctcgcgcctacgtcctctcgtcggcgtcgatattcgctacgtcgcctccggctgcgtgtcttgtcattgcgtggcattggacgttgaagggcgttgttatacatggggacgaaatgagaaagggcaactgggtcatggagataccattcagcgtgacagaccaactgttgtgtctgaactttctaaatacaaaattgtcaaagctggatcagggaggagccatacggtggttgttacggaggatggaaattccctagcatttggatggaacaaacatggacagctaggttctggttctgagagtcacatgggaggcataaaggagttggaatttgcaatagaaacgggggatagtcggacaggagtcacgtaa

SEQ ID NO: 25942 - DNA, 1077 bp, Glycine max
  Peptide Sequence Number=SeqID_142720
atgtcccacttgttctccagttaccatctgtggctggagttttactcgatcatctcatataattccaaagacagctctgtgaggttggtttatgaaccccagccacgtcctcgagcaattgctgctcttgctggggaaacaattgttaaagtggcatgtggaacaaatcacacagtggctgtggataagaatggctttgtctacacgtggggttttggtggttatggaaggctaggacatagggagcagaaggatgagtgggtcccacgccgtgttgaagtttttcaaaatagaaatgttttgccgcctgattcagtcatatcagctggttctgtgaattcttcatgtactgcaggtggagggcagttgtatatgtggggaaaattaaagaacactggtgatgactggatgtatccgaagcctctaatggatttaagtggttggaatctacgatgcatggattcaggcaatatgcaccattttgttggggctgattcctcttgcataagttggggacttgctcagaatggagagctgggatatggacctactggacagaagtcttcagctgtacccaagaaggtggatttacttgagggtatgcatgtaataagtgttgcttgtggtatgggtcattccatggttattgttgatagagcaaatgttgctgatcgacttgaccagcttgatatatatgatgggaaagctgttggtgaaggtaatgaggccgtaaacacaactccagtgcctaagcaggctgcgaaaaagggtgcaaaaggagctgctgacaattcgaagaagaggaaacaattgaaagattcatctgagtcagaggaggaagaggatgctgaagaaagtgaggatagtgaggatgaaattaatggtgaggttgaggcaaaaaggcctcgtagttctggtaaaggccgaggtaaggctccgaaaaaggcgggggccaagggaaaaggcgctaaggaaaaaggttctggccgtggacggggtgggactgctgcaaataaaagcagttctaaatctcctcaggtgaaaactggtaagagaggaagaccccgtaagtcataa

SEQ ID NO: 25943 - DNA, 513 bp, Glycine max
  Peptide Sequence Number=SeqID_142721
atgcatatagaggaggcagattgtgatggagaacagaacagcagtgagcaggaggaattaggaattaggaaatatgctggtttatctaggaatgaagaaattttcaatgataaagttcaaccggtgtggcacactctcaacgacattatctgtaaggaagttactcaatcgttgcaacaaccttcagttcatgcagagttactcgccatctatcatggtttgaagatagctagagacaaaggaattggaagattgatctgcgaatcagattcgaagctaatcactggagaaatcaacatgtttcatcaatatttccctaccatcacgctgatccatttgtcaaagcagatggattgggaggtgacctttgtgcacgtgtaccgtgaagggaacaaatgtgcagattggcttgcaaagacggaaaactcctctcaacaggacttgattattcactctgccaggccatataccaagcttaccttggtcatgccatgggtgtcacaacccaaatga

SEQ ID NO: 25944 - DNA, 159 bp, Glycine max
  Peptide Sequence Number=SeqID_142722
atgtcagtgaaaaaccacgtcgggcgcctaggagcgcatgacaagacaaaccacacactagcaagtcaggtcactttcactaggcttagaggagcactcggaccgagtgagccccaagggctacattccgaagagtccgtccagggctctccctcctga

SEQ ID NO: 25945 - DNA, 500 bp, Glycine max
  Peptide Sequence Number=SeqID_142723
atgcctggatctccaaaacggttcaatccaccactcacggaggatccagattttcaaccaataacagattccgagacagtgaaacagaaagaaaccgaaatcagaggatgtacaacggtttcagatgctcggagtaccacttttgctgttgacacttcccaagtgggtgccttgaagtcgtattctcaaattgccccatggatggaaacacaacggaaacatgaagcctcgaatgttcagatctgtggcaggggtggtggcatggataacattactagttgggggatgtgtgctagagatcatagaggcatttttgtggctaccaagactttgtttactgttgttggtctcaagattacacgaggtgaagcattgggcgttcatgcaattcaatgctcagtacttgctgatgttgtaaatgtatctgaggtgggttcgattgtgtctgagtgtaaaacattacttccttcacagttcaactttaaggttaagtttatgag

SEQ ID NO: 25946 - DNA, 1221 bp, Glycine max
  Peptide Sequence Number=SeqID_142724
atggatgatgctgggcatcgtgagaatggaagacacaaagcagcagatcaatataaatctgctcagggtcagtggttgatgcaacatcagccttccatgaagcagattatggcaatgattgctgaaagagatgcagccattcaagaaagaaatctggccatttccgagaaaaaagcagcatatgctgagcgtgacatggcatacatgcagcgagatgctgcaattgcagaacgtaataatgcaatgttggaacgagataatgcaattgcaactcttcagtatcgtgaaacctccttaagtagtggcagtatgccatcatgccctccaggatgccaaatttcacgtggtgtcaagcatgtacatcatccccaacaacaggtgcaccatatacctaacatgggtgatgcctcttacaacacaagggaaatgcacacaacggaggtcctccctgcagcccccatcccttctgagactgggaagtcaaggcgggccaagcgaccaaaggaaccaaagtcagctccacctaataaaaagacttcaaaaccctcaaaaaaagtcaagaaggagagtgaagacttgaataatatgtttggcaaggcacatgagtggaagagtggtcaggaaatggtcaatggaggtgatgatcttaacaagcagttagcagtgtcgaaggctgattggaaaggtcaggacttggggttgaaccaagtggcgtatgatgagtcaaccatgccagcgccagtatgctcttgtaccggtgtcctgaggcagtgttacaaatggggtaatgggggttggcagtctgcctgttgcacaactactctgtcaatgtatccacttcctgcagtgcccaacaagagacatgctcgggtaggcggccggaagatgagtgggagtgctttcaacaagctgcttagtcgacttgcagcagaaagtcatgatctgtcaaaccctgttgacctcaaggaccattgggcaaaacatggaacgaaccgatacatcacaataaatcatcctggaaccctatctgcgttaatatgtaaaatcaactatgaggtggcgaatatgaaccctatcccttggttcagcaaatccatgctactacccgtctctgcgttaaaatttggagacatgcttacgttgaagcaaatcgaagtgttgatattttggctaagttcgggcattatctacaagggcatagttttttcttcttatccatag

SEQ ID NO: 25947 - DNA, 462 bp, Glycine max
  Peptide Sequence Number=SeqID_142725
atgatgaacaaatcttatgaaactacaagcaaactaatgctagatcactgcttatgtacgattgattatactcatacctcaccagctccacgtccaaaagtatttgatattggtttgaaaaaaaaggtattctgcttccactatttggcaccattagtaggcaataatgctatgcaatttaaggctggggatgcaatgcattgcgttgaatctgctgttactgaatctgtgcctggggatgcaattcattgccttgaatctgttgtgaccaagactgtatctcttcctgattatgcaagttgtcgatccatgcaactcgtgagggattccctgccaagttcggaaacagcacgcctcaaacgccggacttcagcatccaaagtctcattcaaagctgcacaaacaacgacaaagattgtcatacagctgttgaattgcaagtatgtaatcctaatagcatag

SEQ ID NO: 25948 - DNA, 1374 bp, Glycine max
  Peptide Sequence Number=SeqID_142726
atgaccacacttgttcttcttcttcttctcctcctctccgttaccgaagcttccaattccaacggccagtggcaacttctccagaaaagcataggcatagtcgccatgcacgtgcagctcctcaacaatgaccgcctcatcatctacgaccgcaccgacttcggcttctccaacctaaccctccccaacggcacctgccgccacgacccctccgaaaaggtcctcaaccaaacagactgcaccgcacactccctcgaatacgacgtcgcatccgacaccttccgccccctcttcgtccaaaccgacatctggtgctcctccggcaccaccgtcgctaacggcacactcatccaaaccggcggctacaacgacggcgaacgcaaaataagatccttcactccatgcgaaacgtgtgactggcaagaaacggataatgcccttctcgttaagcgctggtactccaccgatcattatttaccagacggacgtcaaattataataggaggaagaagacaatttaattacgagttttacccgaagataaattcagcagagtacgataaaccctacgtgttaccgtttctgtttgagacttatgataagggcgtggagaataatctctatccgtttgtgtttttaaacgtggacggaaatcttttcattttcgccaacagccgtgcgattctgtttgattaccaaaacgacatcgttgtcagaacatatccggagatacctgggggagaccctaggagttatcctagtaccggttccgcggttttgcttcccttgaggaatttggaagcgccgagtgttgaggcagaggttttgatctgcggtggggccccaaggggggcttttcagctggtgccacagggggttttcctccaagcgttggattcttgcgcaaggattatgattacagatccgaatgccacgtggacagtggagagcatgcccatggggagggtgatgagcgacatggtgatgctccccaacggtgacattttgatcataaacggagctcaattaggaacggccgggtgggataaggcgatggaaccggttcttgaaccagttatttacaaaaccaacggttgggttgggtccaggtttgttttgcaaagcgcctcgagtattcctaggatgtatcactcgacggcgattttggttcgtgatggaagggttctcgtgggtggtagcaaccctcacgagaaatacgatttctctaacgtgtcttaccctacggacctgagtttggaggcgttttctccttactatttggaccctcagttttcacccttgcgtccgatgattgtagagccttgttctcatgctaatgtcacatatggtgagaaatttaagatgggtattgag

SEQ ID NO: 25949 - DNA, 201 bp, Glycine max
  Peptide Sequence Number=SeqID_142727
atggtgattcacagactcgaattgtgcataaccatggttcgactagccatagagttcgtcgtgagcgtcgcggaaacagtggtcatagttcaacagagaaccgctgagcctcttggaacgttgaatcgcgcaatcttgattgagacaccacggtgtcctccagcttattttttggatcagagattaatccgcttatggtaa

SEQ ID NO: 25950 - DNA, 780 bp, Glycine max
  Peptide Sequence Number=SeqID_142728
atgagcagaaggccaccacctgatcctgtggcagtgttacgtggccatcgagcttcggtcacagacatttcttttcatccctctaagccaatattattctccggttctgctgatggtgaagtgcggatttgggatacacttcagcatcggacagtgtcatcagcatggttacatagtgccgcacatggtattgttgctgttgctggtagttcttcccttggaaacaataaatttgtcagccagggtagggatggaactgtaaaagtttgggaacttggtgatgctgggaaagcatcagaagattcctatagatcagagctaggaggagtgcctgatagagaaattctggaggatagaagagaagaggcttataccaatcaaagttgttctgaaagctttggagaaaatatgtataatgaagggctacaatatgtggctttgtcaggggaaaagtcctctgaggttgaaatttgggatctcaagtcagctgaaaaagttgtacaactcccttcaagcaatcctagtaactcttcaagtccttgcaacaaaggaggccgaggttataaggtattgactaccatctcatatcctatattccaatgtagatatgaggatggttccatgctttggtgggatgtacggaatcccggagttccagtaacttctgtaaaattccattctgagccagttctgagcgtctgtaatgatgggtcttgcaaagggggtatctcaggagctgcagatgacaaaattgtaatgtacagcttggatcattcttcg

SEQ ID NO: 25951 - DNA, 825 bp, Glycine max
  Peptide Sequence Number=SeqID_142729
gaatgcgacagcgttttggaggttttggatgtgaaagagaatcgcattgctcacgcgccgtttccctcgtggttgacccacgcggcgacgacgtcgttgaaggccctcgatctttctggaaacttctttaccggttctctgccggtggacattgggaatctttctgcgttggaagagttgagagtgaagaataatttgttatccggtggagttccgcgtagcattgtgagatgtaggggtttaacggttcttgatcttgagggtaaccggttctctgggttaattcctgagtttcttggggaactgaggaacctgaaggagttgtctcttgccggtaacaaatttaccggttcggtgccttctagttatggaacgctttctgcgcttgagacgctgaatttaagtgataataagttaaccggtgtggtgcctaaggagatcatgcaattggggaacgtgagcgctttgaatttgagtaataacaaattttcaggtcaagtttgggccaatattggagatatgacgggtttgcaggttcttaatttgagtcagtgtgggttttcaggtagggttcctagttcgttggggagtttgatgagactaacggtgttggatttgagcaagcagaacctctcgggtgagttgccccttgaggttttcgggttaccgagtcttcaagttgtggcgcttcaagagaaccatttgagtggtgatgttcctgagggtttcagcagcatagttagtctgcggttcattgtcaaaattgtcaaatttgacggtgttgaacctttcttcgaatcaattgacagggaaaattccggttga

SEQ ID NO: 25952 - DNA, 255 bp, Glycine max
  Peptide Sequence Number=SeqID_142730
atgacatggcttctgaacccaccagagcaagatttgccattgattttagctgatagtgggtttgacctgtggattgcaaacaccagaggaaccagatatagccgccaacacatctcattggacccctctagcccggcctttctaaaggcttggaaagtcgcatgccagagcaactcacatatctcgcctcatcataccagcaaaacagacattcttgctgaagcctactaccttcagtggtccatgcaagtctaa

SEQ ID NO: 25953 - DNA, 336 bp, Glycine max
  Peptide Sequence Number=SeqID_142731
tgtgattggtttgataatactccttatatagggacacgagtggataaaaagtatgagattgttgaaggacatcgaggattgttagccgtaatgaagacaaaagctcacagcagaatcactgacaatatagtaagtgaaactaagcaagaggctccataccaagatgatgagcttgtagggcttcaagaagtgttggaagttgaccctgatgtcattaatgaatctcttgtggatgttgatggaggtggagaagagatagatgtagatttactcaaacaactagacttggttgaactagacgatgatgaatgcatattaagtgagaatgacatttag

SEQ ID NO: 25954 - DNA, 279 bp, Glycine max
  Peptide Sequence Number=SeqID_142732
atgagtagaaaactgtggaaccgttctgtgtctctctgtcaccggcgggtgaccggagaaagagagaacggagtggagaatgagatgttattagggaatgaaaggcaaaaccgttgttcttcttctggattccgcacccacctgccagacataaaaccgttaaccccgctaaaaatttcaagttcaatcactattttgacccttgtttttcctccacgtgccctatttctctcaactttactgccccaatcctgttactttactgtgtataacaaataa

SEQ ID NO: 25955 - DNA, 101 bp, Glycine max
  Peptide Sequence Number=SeqID_142733
atgaagacaaaagctcacagcagaatcactgacaatatagtaagtgaaactaagcaagaggctccataccaagatgatgagcttgtagggcttcaagaagt

SEQ ID NO: 25956 - DNA, 2979 bp, Glycine max
  Peptide Sequence Number=SeqID_142734
atggtgaagaccggagatacagcgtccatggcagacgtcaaagaggagcagggaaacatggctctgtcaaatcctctggaagagagaatcttcgtttccatcagagtaagacctttgaacgatagagaaaaagccaggcacgatgttcccgattgggaatgcatttctggcaacaccatcagatacaagaacaacggccatgcggaaccgcgaccactctcaatggatacctacgcctttgatagggtgtttggggaaaggtgcaatacaaagcaggtttatgaacaagggattaaggaagttgccctttcagtagttaggggtattaactctagcatttttgcttacgggcaaacaagcagtggaaagacacacaccatgtctggcattactgaatatgctgtgagggatatctatgaatatatagagaagcacaaagacagagaatttgttgtcaagttctctgccatggagatctataatgaagctgtcagagaccttctcaatgcaggtgctacttcactaagaattctagatgatccagagaaaggggctgttgttgagaaactcacagaaaagacactgacagagaggagacagttgcagcaactactttcaatatgtgcagctgaaaggacaacggaagagacggccatgaatgaaactagctctagatctcaccaaattcttagattgacggttgaaagtaatccttgtgattatgcagacaccgcaagatccggagctctcttcgccagtgtgaattttgttgatctagcaggaagtgagcgtgcttctcaaacaatgtcagcaggctcaagattgagagaaggtagccacataaatcgcagtttactgagccttggaactgtaattcggaaactaagcaagggaagaaatgaacacataccttacagagactctaagcttactcgcattctgcagaactctttaggtggtaatgccagaacagcgatcatttgtaccattagccctgcaaggagccagagtgagcaatcaagaaatactctgctttttgctggttgcgcaaaacaggtgactactaatgctcgggtcaatctagtaatgtcggacaaggttttggtaaagcaactacaaaatgaattggctagattggagaatgagttgaggagcttcaccccaaataccatgttacttaaggagagagaacttcagattcaacagatggaaaaagagatcaaagaattgactcggcaacgtgatctctttcaatctcgtgctgaaaatatggtccaacctgctgggaaagatcggcttttaagagtagacaaagattcggcctcggaatcttcaggtgctgttgctaagaatcttctttgcaggacagacagcgcatctgagagtcttgacagaacaacaaccagtttacagcacactgagaattctgaagacaactttctcttggatggcaattctcccacgtttgctgggcctgacccatgtcatggttgggaggagatgacaagcagcagagaatctgaagaaaactgcaaggaagttccatactttgaaataaaagaagtcgagacagaacacaaaacagatgttaataatacgcctcccattcctgtttttgaagaaactggaggaaatacacccatgatacaagttgtgaatgtaattgctaaatcatcctcaagaaatgagcttagagagttgagtcttgttgccgtagataatagtcaaaatgctctggagggaaaaaccgatgagagcctacaaaataccaaagatcttattgtggacatctctaagaaatccgatgggtcctctgaatccgaatcacatatctcgaatgccatgtctcctcctcaaatagataaggaaacttcaatacttcctcagatcactagtaatttggagcagaatgagtcacctcagtttaataagttggaccaggaatccacctcacctcctcagtgcgatgtgcaagagcttaaaactacgttacctcctcaacttgataagccatattctgctagtttggtttcctttgaggacaagctacctgaatcgaatttacaagctacaaaaagaaactcttccagaaaatattctccaattcactatagggatgcttcagttgagcataaaactacgttacatcctcaacttgataagccggattctactagtttggtttgctttgaggacaagctacctgaatcgaagttacaagctccaaaaagaaactcttccaaaaaatatattcactatagggatgcttcagttgaagatgtagaatccctttgggattctgatgtggaggatactgccagcgtcctcaattttgttggaaaaatgaatgaaagggctaagcaaaagccattcaacaaggacatggatgatattatggtacgtgcaaggacatctggaatcaataaacgtgtgagcaaagtaaaaggggtcagtttccatggaggtccgaggacgttgacgccttataattttgagaggcagcagagagatacaatccaactttgggatgcatgtaatataccgttggtacacagatcctattttttccttctcatcaaaggtgaacttgcggattctgtgtactttgatgtagagctcaggcgtttgtccttccttaaggacactttttttagcgcaacaaacattgcaggacatggttcggatgtcacacctaattcaagcttgatgtcactgaatcgtgagaggaaaatgctaagcaagcaagtgcataagaagttctcgatgaaggaaagagaggaactttacgtgaagtggggtattgatttgaagtcaaaacacagaagtgtgcagttggcgtggcggttatggacgaatacaaaagacttgaaccacgtaagggaaagtgcagcacttgttgcgaagctggttggttttataaactcgggtgaggccccaaagaaaatatttgggtttggcttcttagtccgtcgtaagtaa

SEQ ID NO: 25957 - DNA, 492 bp, Glycine max
  Peptide Sequence Number=SeqID_142735
atgagtttagaatctaccctaaggctcatgagaatcctaggaccttctcctgcatctctggctcaatctttttggagtcttctatccaatacctttggggggaatggatccacttctaacactttggtagttaaggctacagattcctacatttggaaagctcttactgagcaatggagtagtttccaagagatggagatgtggtccattcataatgtcatgatgagctttttgttcgtccgttcaaaccttgaagaatttgttagaaattacaaggtgaacttaccccatagtgagagaggttatcaagaaatttttgtccattggcaacctcctttacgaggttggttctgcctaaatatggatggagcagtgaaagggaatggtggcattgaaagttgtggtggtttaattagaaacaacaatggtcaatggaagggtgggtttgctaaatacataggacgatcttctgtgtttgtagctaagttatag

SEQ ID NO: 25958 - DNA, 273 bp, Glycine max
  Peptide Sequence Number=SeqID_142736
atgcagatggtggctggaaggtttgtgaatgcttactcttccaatgattggacgttaggcataactttccgtgccagtttactctctcatggattagctggaatccaacctgttgatgttcctggggttgagaatgttgatgtgacacaacttatagaaggtcactcttcctacttgcggatgacacaaaaaatactggagcagcttgaattggacaactgttgtgctgttttcaaaagtggacaagaaaatccacaggaagaaaagagttag

SEQ ID NO: 25959 - DNA, 330 bp, Glycine max
  Peptide Sequence Number=SeqID_142737
atggcatcatccatggtatacaggctcacttgggtaatgtacacatccaggtgttcatatgggtctgtggtgtcatcgtacttatcaatagttaagttcttccagttggaagaaagagtctcctccatgatgctagggacaaaggggttcttgaattacgacaactatcttcttaaggtgttgaaggataggggaaaagtatccaaactcacacttatattagtggctcaggataagtcgaccatggttgattcaacttctcctcctcccaataggttagcctcaggttgttgtgacctatgtgcctcccgaagttggttgctccattga

SEQ ID NO: 25960 - DNA, 1059 bp, Glycine max
  Peptide Sequence Number=SeqID_142738
atgggagaggtagacacagctttcatccaagaaccagaacacaggccaaagctctctcccaaccaagcagaaggaattcccataattgacctctctccaataaccaaccacgcagtttcagatccatctgccattgaaaacttagtgaaggagatagaaagtgcatgcaaggagtggggtttcttccaagtaaccaaccatggggtgcccctcactctaaggcaaaacattgagaaagcctcaagactgttctttgaacagactcaggaggagaagaagaaggttagcagagacgagaaatccacaactggttactatgacacagaacacaccaagaacgttagggactggaaagaagtgtttgattttctagccaaagatcccacttttattcctgtcacttctgatgaacatgatgatcgagtcactcactggactaatgtatcccctgaataccctccaaactttagggatataatggaagagtatattcaagaggtggaaaagctgtcctttaagctcttggagcttatagctctgagcttaggccttgaggcaaagaggtttgaagagtttttcatgaaagatcaaacgagctttattcgactcaaccactatcctccatgcccttaccctcaccttgctcttggtgttggccgacacaaggatggtggagccttaaccgttcttgcacaagatgaggttggaggacttgaagtgaaacgcaaagcagatcaagagtggataagagtgaaacctacaccagatgcttatataatcaacgttggtgatcttattcaggtttggagcaatgatgcctatgagagtgtggaacacagagtgatggttaactctgagaaagaaaggttttctattccgtttttcttcaaccctgcacatgacatagaagtcaagcctttggaggagttgacaaatgaacacaatccttcaaaatataggccatacaaatggggcaagtttcttgttcacagaaagggaagcaatttcaagaaacagaatgtggaaaacattcagatttatcattataagataacctaa

SEQ ID NO: 25961 - DNA, 348 bp, Glycine max
  Peptide Sequence Number=SeqID_142739
atgggagaggtagacccagctttcatccaagacccacaacataggccaaagctctctatcatccaacctgaacacattcccgtaattgacctctctccaataaccaacaacacagtttcagacccatcttccattgaaggcttagtgaaggagataggaaatgcatgcaaggagtggggcttcttccaaagctctccaattggttactatgacacagaacacacaaaaaacattaggaacgggaaagaagtgtttgattttctagccaaagaccccacttttgttcctctcacttctgatgaaaatgatgatcaactcactaagtggactaatccatcccctcaatag

SEQ ID NO: 25962 - DNA, 1059 bp, Glycine max
  Peptide Sequence Number=SeqID_142740
atgggagaggtagacccagctttcatccaagacccacaacacaggccaaagttctctaccatacaacctgaagacattcctgtgatagatctctctccaataaccaaccacacactttcagattcatcttccattgaaaacttagtgaaggagatagggagtgcatgcaaggagtggggtttcttccaagtaacaaaccatggggtgcccctcactctaagacaaaacattgagatagcctcaaggttgttctttgctcagagtttggaagagaagagaaaggttagtaaaagtgagaacaatacccttggttatcatgacacagagcacaccaagaacataagggactggaaagaagtgtttgattttctagccagagaccccactttcattcccctcacttctgatgaacatgatgatagactcactcagttgactaatcaatctcctgaataccctccaaatttcagggttataatacaagagtatattcaagagatggaaaagctgtgctttaagctgttggagcttatagctttgagcttaggcattgaagcgaataggtttgaagaatttttcatcaaaaaccaaactagctctattcgactcaaccactatcctccttgcccttaccctggccttgctcttggagttggtcgacacaaggaccctggtgccttgaccattcttgcacaggatgaggttggaggacttgaagtgaaacgtaaagctgatcaagagtggataggagtgaaacccaccctagatgcttatattatcaacgttggtgatattattcaggtttggagcaatgatgcatatgaaagtgtggaacacagagtggtggtcaactctgagaaagaaaggttttccattccattcttcttctatcctgcgcatgaaactgaggtcaagcctttggaggagctaataaatgagcaaaatccttcaaaatataggccatacaaatggggcaagtttattacccatagaaagaataccaatttcaagaatcaaaatgtggagaacattcaaatttatcattataagcttgcttaa

SEQ ID NO: 25963 - DNA, 666 bp, Glycine max
  Peptide Sequence Number=SeqID_142741
atggagacggctttgagaagaagttcaagggtcctctgtctaatccttgcaattgttgggcttattagatgtgacaatgaggtgataaatggcaacgcttcttctagttctagtcctagtcaaggcaacaatgcaacatttgtaactttcccaagtcaaggcgtaaatgaagaagtagtaaaagaaaaacacaacagctattacaacaataataataaagtccacgtcaagagtactagttggtattatggaggaagtggaggcggtggcggaggaggaggaggtggaggtggttatggatggggatggggtggtggtggaggaggaggaggaggaggaggaggaggaggaggaggtggaggtggagggggagggggaggtggaggaggaggaggcggtggtggaggaggaggaggaggcggtggtggaggagaaggagggtggaaatgtgttaaaaggaaaggaggtggaagaggagcacataatcataatcattataataagaaagggatgttagatgagaaagaatatagggtgggggagtatgctgaatgcatggcaaaaacccgatgccggggaatgaggttggaatgccctcttcattgtggtggaccttgttactacgattgtcaccatatgtgtaaggcccattgtcgcagaccttga

SEQ ID NO: 25964 - DNA, 810 bp, Glycine max
  Peptide Sequence Number=SeqID_142742
atggaaccacaaagattctctactattctcgtatcggagttgttggaagaggatgatgagagtgtgacccttatgcctggtgatattttcaaattcagcgttcatgtttactatcgccctatcaatccaggtactcggatccgaggaagcttagttcaccgctctccttctcgatgcataccctgccacaatttcttccaagaggggagagaattctttaggagaatgttgtggcgcgtacccctctatgtggaatctcctgaggatataatagaaaacctcatgtctaccatcggagaacggttcttgcatgttgatgccgctgcttctccttctcctcctcctccttcttcagaatctccacaccgagagattcctttcgaattgaccattctcatattagatacttttaatctcgaactgcatgcagctttggtggaagagtctatgctgagtttcaaaatgatcccagcatctaacgaagccatcgaaacgttgttgaagaaatctacggttatgacacggagcgagagtccttgttctatctgcttggaagatttggaaatcaatgatgagtgcggcacaatgccatgcaagcatacgttgccattgattgacgtaagtatttctggcaaacatagactattccataaagtatctagtcaggacaaagggatatatattgggcatgcccaaatcgacctttcaatcacgtatccacatatattgacgaagggatatcaggaagtggtaatgtcaaaaagaactggaaaagaacatctcaacattacatggccagggatagcgtga

SEQ ID NO: 25965 - DNA, 1146 bp, Glycine max
  Peptide Sequence Number=SeqID_142743
atgggtgaagaaaggtgtcgagcagtgcggcaagaagtgtccaagttgacagctgccaagttcatcaaagaaattgactactcgacttggctttccaacatagtcatggtagaaaaagttgaacaggaagtggaggatgtgcacggactacacagacttgaaccgagcatgcccaaaagaaggtcagcttggatcaaacctagaagtcttttagacgacatggtaatcaaatctgacgacctgacaacccatttggtgggtctgagagaagttcttttccagctcaaaagatacaacatgaggttgaaccttgagaagtgtgtcttcagggtaggaggaagaaattttttgggtttcatgctcacccaccggggaatacatgccaactcggacaaatgccaaaccatcttggagattaggagtccccggaatgttaaggaggcccaaagactggctgagagaataacatccttgtcgagattcttaccaaggattgtcaaaaaggctaggctcattatgaacctccttataaaggccaaaatctttgtatgggatgaagactgcaaagaggtctttcggcaactaaaagaaacactggcgacaccgcccattctatcaaagctagacaccaccaagaaattgatcgtttatctttcaatcatggtcaaggccataagtttggttctggttcaaaaagaagggataggcaagaatggtggaccatgcgtgtgggcgacttctctaacaagcacaatagcagagttggggtcattctggaagtacccagcgacgtggccatggcataatccttacattttagattcaaagccacatgcaatcagcgactccaagatcgccactgagcaaattaacaaggtgtttcagacccgagaccccaagctcctaaaatactatcatgcgtttgagaagcttaggggacaatttgaggaagtccaagtgactcacataagtcaagaggtcaatgacaaggccgacaagttggctcaactagctacctcccctaagcttggacaacttaaaaccttcatccttcatttagtgcccaaacccaacatctcaagaaaaaatgtttacaggtggaagaagccttccaggggtagagataggagatactcaactacttga

SEQ ID NO: 25966 - DNA, 1143 bp, Glycine max
  Peptide Sequence Number=SeqID_142744
atgggagaggaagtagacactgcttttgtccaagcaccagaacacaggccaaaatcctcagtgatcgtggcagaaggaatccctctgattgatctctctcccataaactaccaaaacgaagacaccctcttggattcttctatcgaaaacttagtcaaagaaataggcagtgcttgcaagaaatggggtttctttcaggtgatcaatcacaaggtgcctttggataaacgagagaggattgaagaggctgcaaaaaagttctttgcacttggtttagaggaaaagttgaaggtgagaagggatgcggttaacgtgttgggttactttgaagcagaacataccaagaacgttagggactggaaagagatctatgatttcaatgttcaggaacccacttttataccaccctcagatgaaccagatgatgaggaaaacgttcagttccaatgggataaccggtggcctcagaatcctcctgagttcaaagaagcatgccaagagtatgcacaagaagtggagaaacttgcttataagttgatggaacttgttgcactgagcttaggcttagtgccaaataggttccgcgggtatttcacacataacacgagcaatatccgtctgaatcattatccagcttgcccctaccctcatctggctcttggactcggacgccacaaggacactggtgtcttgactgtgcttgctcaagatgacactggtggtctagaagttaggagaaaatcagatggagagtggattcgagtcaagcccattttcaattccttcatcatcaatgtcggtgatatgatccaggtaagtaattgtggaaaggtttgtttaaaattatattcattgtcaccacattttcattttaccgaggtttggagcaatgatgcttatgagagtgtagaacacagggttatggtgaactctgagaaggataggttttcaattccattctttctgaaaccagcactctacactgatgtgaagcccttggaagagttgctagatgatagaaaccctcctatatatagaccagtcaactggggtaagttccgctctgcaagaatgcgaagtaattttgccaaatccaaagttgaaaacctccaaatttatgatttcaagtttcctagtaactga

SEQ ID NO: 25967 - DNA, 423 bp, Glycine max
  Peptide Sequence Number=SeqID_142745
atgaaatgtgaggcacttgaggagaggggggttgaggcatttttgtattccaagaggttgcaatactttaatgctctttccaatgatctccagttcattggaaaagtgataatggatttgcaacctaacagtatatattctgattacaatttagtatcaagatatcaacatgtggaaagtaagcgagctatcatgaggctggaactaggtgcccattcttgtattcaaagagccattgattcacatggagcatttgccattttgtacagtcgccactcaaagcattatattaagaaacctgaggttttacttggacgagcaacagaaggtgttcctgtagacattgatttgggcaaaggagggcatggcaatgcaatatctcgacgtcagtgtatgaagatgaaggatctatgtatgctttaa

SEQ ID NO: 25968 - DNA, 186 bp, Glycine max
  Peptide Sequence Number=SeqID_142746
atggccttatggaaagaggaagccaagaagcaactatggctggcagggccaatggtatttgttagtgtgtttcagtatagtttacaagtgatatctctcgtgtttgtaggccatttggatgagttgcttctggctagtacttctttggctacatcatttgtcaatgctactggtttcaacgtgttg

SEQ ID NO: 25969 - DNA, 318 bp, Glycine max
  Peptide Sequence Number=SeqID_142747
aacattgtacctctcttgatggatcttcttggtcgagtcaggcagcttgacttagctttagatgcaattcagagaatgctactgaaagtccaagctcaagcttggggtccattgcttagtgcttataggatttatggcaatgttgagctgggggagcttgcaactgttaggttattagacagtagtcctggaagctctggaagtggaaggaggcacatgttaagaaatctgatagatggtaaaggattggttaaagaatgtggctggagccaagttgaggtcagcgatagctataatacatttgctgcaggaaattaa

SEQ ID NO: 25970 - DNA, 909 bp, Glycine max
  Peptide Sequence Number=SeqID_142748
atggaaggattggatggtttgatagagaggcttttggaagtaaggaagaacagaggcaaacaaattcaactggtagagtcagaaattcgcagcctttgcagcacggcaaaagatctcttcctcaggcagccaaacctgttggaattggaagctcccattaacgtttgtggtgatatacacgggcaatatccagacctgttgcgagtgttggagtacggtgggtttccgccggattcgaattacctattccttggagactacgtggacagaggaaaacagagcgtggaaacaatatgcctgctgctcgcctacaagataaaatacccagaaaactttttccttctccgaggaaaccacgagtgtgcctctattaacagaatctacgggttttacgacgagtgcaagcgcagattcagcgtccgtctctggaagatattcacagattgcttcaactgtttgcccgtggccgcagtgatcgatgacaaaatcctctgcatgcacggcgggctttccccggacatggagagcctgaatcagatcaaagccatagagaggcccgtggacgtgcccgaccagggcctcttatgcgacctcctctgggccgatcccgacaacgaaatcagtggctggggcgagaatgataggggcgtctcctacactttcggccccgataaggtctccgagttcttgaagaaacacgatctcgatctcatttgcagggcccaccaggtcgtcgaagatggctaccaattcttcgctgacaggcagctcgttaccatcttctctgccccaaactattgcggagagttcaacaatgccggtgccctcatgtgcgtcgaccaaactttactctgttcctttcagattgtcaaaccctttggcacctttagaggaaaactcacttcttaa

SEQ ID NO: 25971 - DNA, 632 bp, Glycine max
  Peptide Sequence Number=SeqID_142749
atgggtatgtcaagcgcactagacacattttgtggtcaagcatatggagcaaagcagtttcacatgcttggtgtacacacccaaggtgccatgttggttctcacccttgttaccatacccctctccattatttgggtattcttagggcctattctagttgctctccatcaagacaaagaaattgctgcacatgctcaactatatgccagatacttgatcccaagcctttcggccaatggtcttcttcggtgcattactaagttcctacaaacccaaaacatagtctttcctatggtgctagccactggacttactagcttcttacacttctttctgtgttgggttttggttcaaaaagttgggcttggcatcaaaggatctgccattgcaatttgcatttctaattggtttaacaccataatacttgctctttatataaagctctccccttcgtgcaaaacaacttggactggtttctcaaaggaatcattgcataacatccctaaatttctcaaacttgcttttccttcaacactcatggtgtgcttagaatcatggacgtttgaaataatggtgcttctgtctggtgctcttcctgatgcgaaattgcaaacttcgatgctttcgatatg

SEQ ID NO: 25972 - DNA, 516 bp, Glycine max
  Peptide Sequence Number=SeqID_142750
atgagagaagatagtgaacaacctttctggaaagaaaaatttctagtcagtcttcctagatcattaggagataagattaataatctgctcattgaaacctcagaggaagaaaccgaagatgtatcctctgaagaaaatcttaacctagttcaacaagatgatcaaccatggtctacgaatgatgaagatgaagatatccaagaaatcaacactcaaacaagagaccaagatcttttgtttgaggcaatcaattccataccaaaccttcaggaaaagaaggttttcctgaataaactgaaaaagtctttggaaaccaaacctaaaccaaaagatttcattaccaataaaaaatttgatgttagcaatattctcaaaagactggaaaacacttccgtcaaacctaccacaatccaagatctccaaacagaaatcaacaacctaaaacaagaggttaaagaacttaggcaacaacaagaaattcatcaaatcatcctatctcatttcgaagaacactga

SEQ ID NO: 25973 - DNA, 231 bp, Glycine max
  Peptide Sequence Number=SeqID_142751
atggagatcatcacaatgatagtgggcacattactggtgttctactatgagaagatggtgagttacatgccttcaagctttgccaatttagttttcgctggtgaaaggatcgaagggggtctgagaagaggcaaatttgattatcctactttgatgaatgggaagcctggggcaaatggagagaataagaaggagggaagaatccacactgtgattgccgttcccatatga

SEQ ID NO: 25974 - DNA, 435 bp, Glycine max
  Peptide Sequence Number=SeqID_142752
atggcggtcattggaaaggccgcaggtgcagatcgacaagatcgagggcggccccgtggctgccaaacaggcccaacagtgggcgtggggacgtcggtgaatgtcgttgcagaaacggagtctgaaggaatcttggtagccatgaaaaaagagccaaacaaggggctagtgatggtcatcagaggcaaggaaggcccgggaaaggtgacggtggtcactggtggtcattggagaaaggatgctgagatggcttgcaaacagcaacaaagtcattcgtggaggtcccaagacatcaatttccaagaatcaaaaggaaaatacaaaagaaaatggaagaaagtgcaagaaaatgtgtgggactttatttctcttactgaacaccttgggtcattcatagaggtcccaagactctcccctcaacaacttctcaactga

SEQ ID NO: 25975 - DNA, 240 bp, Glycine max
  Peptide Sequence Number=SeqID_142753
atggaacagctcacaaagacattggcatctttgttcaatctgtatgaggcaaatcgaaattcaattcatgtgcatgagaatgcagctgaattccattcattatatgtgctgcttcatcttggttcatacagccaaccaatggttaatctctacatcattgatcattctgacttggtagttataaggatttcttctgtactgcagcagctcaggcattatatctgcagttctgcattatga

SEQ ID NO: 25976 - DNA, 279 bp, Glycine max
  Peptide Sequence Number=SeqID_142754
atgttaggatccaattgtaaggtatgggacttgagtcatatattgatattggaagtatgggattctagtttggggttttataggtctttaggctctccaattacaacgttccatgggcattggatgcgaaagcagggtgtcgagttggaagatgaggatacccatgacaataaggatgaggtgcctgatggggttcttcctaccatgcacaaacatgttgaggagcacccaatgagaagtggcaaggactgtggtggagaggattctatcttttcataa

SEQ ID NO: 25977 - DNA, 324 bp, Glycine max
  Peptide Sequence Number=SeqID_142755
atggagggcgggaacggaaatggcagcagaacttctacctctgttctcagtgacacggaagaagaggaagtacagccatcttccaattttgttggaacatgtccttacatgtgcccagagttgcaatgttggattttgtatgatggcatgtctcttttggtgagattggtaaagaatgagagagtggggttgctaccaataggggttgggtctggcagaagagcctttctgatgtacattgaggatactattgaggttactagttgtgcaaaggagaaggaatacaagggaatggcattttgtcttgtatcacttgagaactga

SEQ ID NO: 25978 - DNA, 261 bp, Glycine max
  Peptide Sequence Number=SeqID_142756
atgacgccaccgcacgagatcgtgaaaaggagggtggctgcaaaaatggcgtttttggtgtgcacgggaaatgggaggacattgaagggacgtgatttgagtcaagtcaagaattcgatcctgagcaagcagctttcaagttgggctattcatgaaggtttgctttgcttgtgcgtgcaatgtccaaaggtgtgcgcagtgtaccatattctggtgcgcaatgtccatttcttcaattcaagagagggttttgaattttga

SEQ ID NO: 25979 - DNA, 363 bp, Glycine max
  Peptide Sequence Number=SeqID_142757
atgcagtatttaactaagcatgtgactgaattttatcagattgagaatgaatatggcaaaggaggtaaagagtatcggaaatgggcggctaagaaggctctaagtcttggtgttggggtcccatgggtcatgtgtagacaacaggatgctccatatgacatcattgatacatgcaatgcatactactgtgatggatttaaaccaaactctcataacaaaccaacaatgtggacagagaactgggatggatggtatacacaatggggtgaaagattgcctcatagacctgttgaagaccttgcttttgcagttgcgtgttttttccaacgtggaggaagctttcaaaactattacatggcctaa

SEQ ID NO: 25980 - DNA, 3564 bp, Glycine max
  Peptide Sequence Number=SeqID_142758
atgccagtactagaaacccttggtggtgctcttttcggtgctgtccttcaggtgctgttggacaagttggattcttgtcatgttttggactactttcgtggacgaaagctcgatgagaagctgctgtacaagttgaaggcaacgcttcggtccatcgatgctgtggttgatgatgcagaacaaaagcagtacagctattcacgggtgagagagtggcttcttgaggtcaaacaagctgtgcttgatgctgaggatctcctcgatgaaatagactgtaaagctttgaaatacaagctggaagatgactctcaaaccactactagcaaggtgaggaatttattaaatgttttttctctcagttccattgacaaggaaattgaatcaagaatgaaacaactacttgatctcctagaacttcttgcaagccaaaaaagtgatttaggtttgaaaaatgcttgtgatgttgggattggatcaggattgggtagtaatgtgttaaagatattgccgcagacatcactggtggctgaagatgttatttatggcagagacgatgaaaaagaaatgatccttaattggctaacatctgacattgatagccgtagccagctgtcaatattttctgttgtgggtatgggcggattgggtaagaccacacttgctcaacatgtatacaatgacccacagatagaggctaaatttgctatcaaagcttgggtctatgtttcggatgattttgatgttttgaaggtaataaaagcgattattggggcaatcaataaatcaaaaggtgatagtggagacctagaaatacttcataaatatttgaaagatgaattgacaggaaagaagttttttctcgttctggatgatgtttggaatgaagatcgagaccaatggaaagctttgaaaactcctcttaaatatggggctcagggaagtaaaattcttgtcacgacacgcagtaacaatgttgcttctaccatgcagtcaaataaagtctgccaactaaagacattacaagaagatcacagctggcaagtttttgctaaaaatgcattccaagatgatagtctccaattgaatgttgagctgaaggagattggtacaaagatcgttgaaaagtgcaaaggattgcctctagccttggaaacagttggatgtcttttacgcacaaaaaggtcatctgtttcagagtgggaaggtgtaatgataagcaagatatgggatttaagaatagaagatagtaaaattctccctgctttattgttgagttattaccatcttccatctcaccttaagagatgttttgcttattgtgctttattccccaaagatcatgagtttgacaaggagagtttaattctgttatggatggctgaaaattttctgcaatgctctcaacagaataagtctccaaaagaagttggtgaacagtacttctatgatctattgtcaagtttatattatgctcaaaggctacgtacatttatgcccatatctaggacaacaagttttattgataaatgggattgcaagattttaacacatgagtttttctccatgtttaagttcttacgcgtcttatctttctctggttgtcgtgaccttgaagggctgcctgactctataggcaatctcatacatctgggttcattagacctttcacatactcgcataaagacactacccgattcaacatgttcactttgtaacttgcaaatactgaagctgaactgttgtttctttttggaggagctgcccataactttgcataaactcaccaatttgcatcgccttgaactcatgggaactcatgtgacaaaggtgccaatgcatttaggaaaacttaagaatcttcaagtattgatgagtccgtttattgttggacaaagtaacgagttaggtatccagcagctaggagaactcaatcttcatggagatttatcaattcagaatctgcagaatattgtgaatcccttggatgcattggcagcggatttgaaaaataaaacacatcttgtggggctagatttagaatgggatttgaaccagatcattgatgattcaagcaaagaaagagaaatacttgagaatctgcaaccttccagacatttggagcagttgtcaatcagcaactatggtggtaatgaatttccacgctggttatctgataaattattgaatgtggtgtccttaaacttgaaggactgtaagtattgcggacatttgcctcctcttggacttttgccatgtctcaaggacctgagaattagcggacttgattgggtggtgtgtattaaagctgctttttgtgggagtagtgattcttcattttcatccttggaaacattggaattctccgacatgaaggaatgggaagaatgggaattaatgacaggtgcttttccacgtctccaacgtctttctatacagcattgtcccaaactcaaagggcacttgccaaagcaactttgtcatttaaaggaactacttgttcaggactgcaaacaacttgtgacttttgcccccaaggccatagaaatttgtgaattagacttggaagactgtggaaagcttcacattgattatcatcctactactttgaaaaggctccagattagaggttacaacatggaggcatcgttacttgaaaggattgagcacatcatagcggatacttctcttgaatccttgcgcattagctattgtccgaatatgaatattccaatgaaccattgctacgatttccttgtaagattggagatctatggtggttttgactctctaatgaccttgcctctagatttcatcccaaaactctgcgagcttgttgtatctaggtgtcgtaacctacggatgatatcacagatgcaccctcataaacatctgaagagtctcagcattcataagtgccctcaatttgaatcatttcccaacgaaggattatctgcaccacgattagattggtttgctattgaaggattgaacaatttgaaatcattgcctgaacgcatgtctatcctccttccatctcttactagtctgtgcatacgggattgtcctcgagtggagttctctgatggatgtttgccatcaagtctaaaacatttggatctcttgtattgtcccaaacttgttgtctcactgaaaggagctttgggagccaacccctctctggaaagattgcatattttaaaagtggataaggagtcttttcctgacatagatttgctgccactgtctcttacttatctacgaattttgcttagtccagatcttagaaaactagactacaagggtctctgccagctctcctctcttgaaaaattgattctttatgactgccccagcctccaatgcttaccagaggagggtttgcccaaatccatttcaactttcaaaattcagaattgtccattgctcaaacagcgttgcaaggaatcagaagggaacttggaaaatagtgaaggcagtgaagtgcggaatttctggcatccatttggtgctgggcactgtgtcgttgggagttggggcggtttcatccattcccttattgggtaa

SEQ ID NO: 25981 - DNA, 258 bp, Glycine max
  Peptide Sequence Number=SeqID_142759
atggggacggggacatatacagatatgaaaacaggaacaggaaatggaaaatctagaaatctcaagataagggaaagagaattgaaatccatatcttggcataaggggaagaaggagaagggaagaaaagaaaaagaaagtgagaagagctgccacagtggaatcactggagggagaagaaaaggaggagaaagaggaagatctaagaaaaatccattttatgatggccaaaagctgctagtatttgagtattattga

SEQ ID NO: 25982 - DNA, 285 bp, Glycine max
  Peptide Sequence Number=SeqID_142760
atgaaccttgttttcctaggtcagctgcgtgaaccaaaatggggtcacttgaaagatttacatgctgctttgaagctttgtgagcctgccctggtggccactgattcaccaacatatataaaactgggtccaaatcaggagataggcactctgagcatgctaaggtcacggtttcaatcattgcctggtgcattcaacacatgtttggttccttttgataagaagcaaaaaggaagattctcttctcaaagaaatttgctgaggttgctaccacattttcattaa

SEQ ID NO: 25983 - DNA, 228 bp, Glycine max
  Peptide Sequence Number=SeqID_142761
atggttggagcattctcgcaaaacatcgtgaccctgattggtctccatatacctgacaaactcatggtgtgtatatatgtgaggggtagagggtgtcacaccactggcgatggtttggagactgaggaagccgttggggtagtcaacggcaaaggagtctgcttttttgtccagataaaacctctagttaggccaacaaaggacataatgagcattcgacattgttaa

SEQ ID NO: 25984 - DNA, 360 bp, Glycine max
  Peptide Sequence Number=SeqID_142762
atgggatgttacaagtggaaacctcctagcggtggaattcgacaccctggtcaagttagcgacttgggaggcattggagtggatctcaaaagtggtgactcgatgaacacgtggatcgagtacaacggaaatgccaatgggttgtgcatttcggtctcatactcaaacgttcgacgaaaagatccgattttgaaggtagatctcgatgtgggactacccaaggtagcacggaggttcacagtgttgagtggtgtatggctaaggaggcggcgaggtcgacgacggttacacggtggtcccatgattcgggcatgggtgaagggagggggaagcaagagaatgtggtggtatcgtggttag

SEQ ID NO: 25985 - DNA, 360 bp, Glycine max
  Peptide Sequence Number=SeqID_142763
ggcatcaactgcttaattgaatttataagttcatacccgatagcagtagccaatgtcggaagaggagccgttggtgctttagttccgcagctcttgcctgagacggaaagttggcaaaggcttcagacgcggtctccggctcaaggtcaatttatttttgagttcccggcccaagtcaaggcgatgcaatactcgggcgataaggaagaagcagtcccaggccttagaatcacccatcagccttcggatctgagtttgaattggctagggggcatgagcggtagtcagctgtcctcgttctcctctttccttccgatgaagggatcttgctcgcttttctctatctgtgggatcctctag

SEQ ID NO: 25986 - DNA, 414 bp, Glycine max
  Peptide Sequence Number=SeqID_142764
atgctgaaactaccaccacctccttctccagttaacactcaccaacctcagcttccaagagttttaacaaaaccaaagcttcaagcagtggtgccagaacagaaagagtttcatcagaacaacaaatctgttccaaaatgcaaaaaggctaccaatgaaaaaaagttcaactcaaggctcatcaaaaggcctccacagacatcagacatcatcagaaacaagcaagaagaaccattcatcattcgtcccacatcgcctactagagccagtgacatcaaaaacaccaaaagcaagaaaaatcatccattgtcaagcaatctcctcaacaacatcagcaatgtaccaaatcttctacctgtcaagacagacccttctccttcggcaaccaaaattccttccaaacaggttatttaa

SEQ ID NO: 25987 - DNA, 279 bp, Glycine max
  Peptide Sequence Number=SeqID_142765
atgtcgggacgcaacgctctgataggatgtgacattgggatatatgtgtggggtagagggtgtcacaaacatgggttgggttggaaacgggtcaaggagacccagcccaacccgcatttaggaatcaaggttgaaacaatcctagatgacctagccccaaaacggcaccgcaataggagaagccaccacggagggtggtgcgcctccccgacaccactggtgcatggcatcactatgcgaggccgccacggggacggtggcggcactgatggctgttga

SEQ ID NO: 25988 - DNA, 1091 bp, Glycine max
  Peptide Sequence Number=SeqID_142766
atgctgaaactgccaccacctcctccagttaacactcaaccacatcttccaagagttttaacaaaaccaaaggctcaaacattggtgccagagcagcaagagtttcaccagaacaacaaatctgttccaaaatgcaaaaaggctacaaatgaaaagttcaactcaaggctcatcaaaaggcctccacagacatcagacatcatcagaaacaagcaagaagaaccattcatcattcttcgtcccacatcgcctactggagccagtgacatcaaaaacaccaaaagcaagaaaaatcatcatccattgtcaagcaatattctcctcaacaacatcaacaatgtaccaaatcttctacctgtcaagacagacccttctcctccagcaaccaaaattccttccaaacaggtctgtgatacttgtcatcaagagtccaaaagcagttcacagttatctagttgtgcgcgccagaggtacaaacaagaaggaacaacaaccacactactcgctacccgagatagatcagagaacaagcctaacaacggtgctttctccttctcctccaccaccgtcgtccaacctcacaccccacaagagcttcagtacatcacagcaatcctagcccgtaccactgccctaaagtcacagggtatccccacaacactgtccttaaaccaagggtggttctctccgaccaacccactcgacccatcaatcttccaccacctcgaacacccagaaagcgacaaagatcgcaacttttccccaaaagaccaactgggtcaccgttggaatcggagattgctgttcgatttggtggatgaggttctgagggagattttggggcctcaagagggagagagagaaaagaagagactttggtttttgaagggtggtgtttgtaaccaaaaagggagcgttgtagggttggtggagagggtgtgggagagggtcgaggagttcccgcgtgccaagtgtgaggtgttggaagacattgatgagttggtcgacatgcagagagagaaagatggtgagaaaatggaagaagaaggggaagggttggtggcagagattgaagggaacatatgggacac

SEQ ID NO: 25989 - DNA, 249 bp, Glycine max
  Peptide Sequence Number=SeqID_142767
atgactatcgttgtcgtcattggtgccatgatggtggtggtggcagcgacaacaacatcgatcatggaaacaaaagtggtgacggtcatggtgatggtggcggcggcagtgacaacaacaacggtcatggcggcagcagtggagacgatcatggtgatggtggcgatagcgacaacaacgatcatggtggtggttgtagcagtggtcatggtagtgattgtgacaccctctaacccaacattaatataa

SEQ ID NO: 25990 - DNA, 426 bp, Glycine max
  Peptide Sequence Number=SeqID_142768
atgttgtcataccctaatttcatccggggactatcgttcattgatcttttgatccttcctagtcgacttacggtgttgaaacaccagttacactcgcccaggctagcctctggctcgcctaggccaccaaatgacttcagggtgaaggaactaactcgcctggccgagccaattacttcaggactaagccttagctcgcctgggcgagctgcaagtcccctaaaatggccctttgcctatataaataggcgtgctaggggggctgagaaggggtttcaaggtttagaaggtgagggaattgagagaagacagaaagaagaagaagaagaaagaagaggaaatgaggtcgaggcgctaccgaatcgcaaccacgatcattccttacttcatttcttgttccgtgttctttgtgcgaccgtcggttag

SEQ ID NO: 25991 - DNA, 204 bp, Glycine max
  Peptide Sequence Number=SeqID_142769
atggcaggaggaaaaattgggggcgagggttttcgagagagtgaaaggttgcagggatgcgtcgtaatcgattacacaaatatggtaatcgattaccagagagcaactttgccagaaataactgcttgtaatcgattacactattatggtaatcgattaccagtggttattttagccagaaaacaaaaacaaaaggctttctaa

SEQ ID NO: 25992 - DNA, 510 bp, Glycine max
  Peptide Sequence Number=SeqID_142770
atgaagcatgctagaacaccaaggtcttttaaagagatttacaggcaagatcttaatttctggaattgggccaaaaacaaaatgttaattgggaactgtcatgttgaatttttgaaaccaaaatccaaagagcttctaagagactcgtaccaagcacaggatacttgtttcaatcgatataaggtgttgtgcaatttacaagcatggtcagaatactacagatggacaatcccggttgatcatgataacattatttacatcaatttggctcaaggatcacatttaggtatggcaaagagaacaagctttatagtttgcacctcaaaaacgagattgaagacgagccttatattaagtcatcgagccatcaggtttgcatttgattcatacaacccatatgttaaaaattgctttgaagtgatgaagctagataacaagatatcaggtgccattagcaacaagagcattgagctagtcagacattgcattttcgaactcacattgctgtaa

SEQ ID NO: 25993 - DNA, 1386 bp, Glycine max
  Peptide Sequence Number=SeqID_142771
atgtcgtacgcgcgattgcaggaagaaaagctacttgatgctcgccgaccttcaccgtatcgcacaccaacttccacggtgggatccaccactacacgttcttcatccacaaatactacactgtctctgctcccaacgccggtacgcaactcaacatccattccctttaaacgattgacaccagaggaattggcaagtcgccgcgagaaggggctatgttttcattgtgacgagaaattctctcgagggcacaaatgcgcatcctccttattttttctagtcatggaagacgaggaatctacggtggaagtagaccaactgcgagatgcttcatccacgccagagttactaccggaatcaccaccggcacagctgagtctccaggcgttatccagtcacctagcaccggaaacattatgccttaaaggctttatcaacaatcgtcctattagtattttgatatatgggggtagtacacacaatttcctccataatcgcgtggtagtgaacctaggattgaaaccaatagaaacaacaccacttcacgtcacagtggggaatggaaaggagattcgctgtcatcagttgtgcaccgccgtacaagtccatattcaacagcaatctttcaccattgatttccatgtgttacccttgtgtggggctgacgtagtactaggggtgcaatggctaaaaacccttggaccagttttaacagactacgacgcattaacaatgaagtttatcactggtggcaaactaatcgagttggagggggatcgtgagaaggaagttgagcaggtgtcaccttcgcagttacgccgatttgtacacacaaaccctactagcactttttttcacattcgtattgaatcagcagccaaacttactcctcaaacgacccactccttactagaaatcgataccttaataaccaaatatgcttccctcttccaacccctcacgaacctgccaccatcacagccaacagaccacaccatcaacctattgccaaactcaaccctggtgaatgttaggccttacaaatactcgtattttcaaaagaaagaaatagaagaacaggtagctaccatgcttgcgagagggtttatacaacctagttccaaccaattttgctcacctgttttattggtaaagaagaaagatggatcatggcgcttttgtgtggactatagagccctaaatgccataacggtgcatgatcgtttccccattcctacggtggatgagcttctcgacaaactgggaggggcacaatggttctctaaactagatttgatgcaaggctatcatcaaatattgatgaacacgatcgatatcagtaagacggcgtttcgtaccatcaagggaactacgagtttcgggtga

SEQ ID NO: 25994 - DNA, 491 bp, Glycine max
  Peptide Sequence Number=SeqID_142772
atggatgttgagttgcgtaccggcgttgggagcagagacagtgtagtatttgtggatgaagaacgtgtagtggtggatcccaccgtggaagttggtgtgcgatacggtgaagcacctgcctgcacttctctgcgaatagatggactcaatcccgagataaaacaactcaatacaaatggcgccggtaacccaactattctatttgctagggactcaaactccgagagagcatggaggaaggctgaccacgaggacaactgcacgttacgatgcatccactggaaccatgccagtgctggtccctccattcagttggatcggagccatcgaatcgcggaacgtccagcttcatacggtgcagtggactgtgcgatggtgtctgtcctgccgactaagacgatggcatttgcggttgttgctgattcacttcgagttgcgacattcggtggaggagatcatcgatctttgagttcatggcgagttgtgaagct

SEQ ID NO: 25995 - DNA, 660 bp, Glycine max
  Peptide Sequence Number=SeqID_142773
atgtacattcgcgcaacagcgttagaatatctcgggcacatggtagctggtaatggagtcacaccggtaccggagaaggaggcttctgatgcatttcaaaatctcaagaatgccctcacggcggctccagttctcgcgttgcctgatttcagtgcaccattcatggttgagacggatgcatcaggttcgggtatgggggtggttctgacgcaagggggtcatcctctggcttacttcagcaagcaattttgccctaaactattgaactcttctacatacgtacgtgagttagcagcaatcacagcagcggtcagaaagtggcgccagtacttgctagggcaccactttgtgatattaacagatcatcatagcttacgtgaactcatgaaccaaaccattcaaacaccagagcaacatcgatatctagcccgcctgttaggctttgactatacaattcaataccgcgcaaggaggtccaacgtggtggctgacgcgctatcacgagccatggaaggccaagctgcctctctttatctcttgtccatgccacgatttgtcttcctcgacgatcttcgtaaggaactagcttctcttgcgacattcctggacttacgtgatcgcattcaagaagatcctgcggcatacgggattatacactga

SEQ ID NO: 25996 - DNA, 303 bp, Glycine max
  Peptide Sequence Number=SeqID_142774
atgtcgatggaggagaagaatgatcaaagcccaacaaaaatgacaccgagggaagggaataagaatagcggcagcacaaatggaggtaggggaagaagaatagcggcgatgcaaatggaagctcattgtgctggtaactttgcggattacctaacgatggatgttaagtacctcgaggcggtcaagcgaaggttgcatgccaccaaacaatggtctccggatgaaattaggggaattggaaatgaggatcggtgccatcccttgaagaatttgagtcaagaagcaaggagccaaccaccttaa

SEQ ID NO: 25997 - DNA, 366 bp, Glycine max
  Peptide Sequence Number=SeqID_142775
atgactccagttaatttggctggccagtttggtgacacaacatacactaaggtgtttgttggaggcttggcctgggagactcaaaaggagacaatgaagaagtattttaagcaatttggtgagatcttggaggctgctgtcatcactgacaaagccactggaagatctaaaggctatggatttgttacttttcgtgaaccagaagctgccatgagagcttgtgtggatcctgctcctgtaatcgacggtaggaaagctaactacaaccttgcttctttgggtgtccagagatctaagccttcaaccccaaaacatgtagtgaatggtgaacaagtcaggtgggtccataggaggcaaaggagttaa

SEQ ID NO: 25998 - DNA, 354 bp, Glycine max
  Peptide Sequence Number=SeqID_142776
atggtttctccacctgactcgcctcctcctcctcctccttctcctcctcctccccttcctcctccttcagacgcatcagcttcgccatctgccatgaagcggacacacaaagccacattggttcatgttgatcctgctaccggcaaggccgacagtcccgacaggaagaaattaagaacatatttggggattgtggcgcgtgataaggtggacgtcacgtacgagaacgggaaggaggtccctactgctcagaaggacttgatttgggaggatattcaagtggaatttgaaatcccagaggcttctgacagtaggacgaaaaagaagttacttaagactgtcaacgagagatag

SEQ ID NO: 25999 - DNA, 177 bp, Glycine max
  Peptide Sequence Number=SeqID_142777
atggatgactggaacattccagaaatccctcaggatcaactatacgttcctgaaacaataaagaacaaacacaactttgattacataatcaaaacagtagaaaacaatattcctctaggacaagatataggggaagaatttcatttactttcaaaaattcaatttatgaacatagtc

SEQ ID NO: 26000 - DNA, 300 bp, Glycine max
  Peptide Sequence Number=SeqID_142778
gccgcagacgcaccaccaccacctcgtcaggctgatccagctgggtcatttggcatggagcagtatttacagcacttggttcgccagcaggtggccaaccacagggggcaggtgcagacccatgagtgtctctaccagctcagcctcagtctgcagagccatggtttcgctccttttgcgtgccctactccaaatcagttcagggtagggcagaggttgcatggcccggagattggcctgaggcccaggcaggagaggcacccgcagaggctcctggcgatgcagatgaggcccgcatag

SEQ ID NO: 26001 - DNA, 447 bp, Glycine max
  Peptide Sequence Number=SeqID_142779
atggagttacttaacatcggttttagcaaaaccgatgttaactacttcatgttaacatcgttaaaaaaaatagagatttcagaagccgtgcgtttgaaaaccttgccctacctcttctctttgtcatccttctgcctgaaattgctgttctctttctcctcccgcccgaaatctgccggaaaccgcttcgtgggcacccacattgtcattggtcgaacccacagaaccccctacactgccggaaaacccacattgtcgtcgctggaacccacagaaccgacattgtcctgggtcaaagaaaaccctagatacagagttgctactagggtgctgaaacagtcgtcggtgctcaaaggtcaaagctttctccgcgaggctccgctaacgtgcgtgtgttgctgggttctcttcatcaaggtaactgttgataactgtttgggactataa

SEQ ID NO: 26002 - DNA, 225 bp, Glycine max
  Peptide Sequence Number=SeqID_142780
atgtcattgtcatcatcaagcaatgcctacaacgttccatgggtagaaaagtatcatcccatcaaggtcgccgacgctgtcgtcaatgaggacgccgtctccaggctccaaggtcctccaagaactatcaaaaccactagcattctcgctctcatgcacaagcttcttggaggaccaaattgcaaggaagctattctcgaactaaatgcttcagatgaaagatga

SEQ ID NO: 26003 - DNA, 120 bp, Glycine max
  Peptide Sequence Number=SeqID_142781
atgcctgagagtgaagattttagaattcggcatccaaaccaagtggttttcaaggattgtaggaactggtttcactccaaagttaatctcggttcaaaatctatgcttttgaggccgtaa

SEQ ID NO: 26004 - DNA, 126 bp, Glycine max
  Peptide Sequence Number=SeqID_142782
tgcccttctattttctctctaacgtttgggaactctatcagagtaatcagaggaaaaattgaggaatctcagaaaattgctagagatgtcgctatagctgtcggaagacacgtgagccccgcttag

SEQ ID NO: 26005 - DNA, 420 bp, Glycine max
  Peptide Sequence Number=SeqID_142783
atgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagaagcgtcctcagtggcggaccggggcccaagtcccctggaagggggcgccagagagggtgagagccccgtcgtgcccggaccctgtcgcaccacgaggcgctgtcggcgagtcgggttgtttggaatgcagccccaatcgggcgggaagcggatggggccggcgatgtgtcccggtcggatgtggaacggtgagagccggtccgccgatcgactcgggacattga

SEQ ID NO: 26006 - DNA, 990 bp, Glycine max
  Peptide Sequence Number=SeqID_142784
atgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggccccatccgcttccctcccgacatttcaagcactctttgactctcttttcaaagtccttttcatctttcctcgcggtacttgtcgctatcggtctctcgccagtatttagccttggacggaatttaccgcccgattggggctgcattccaaacaacccgactcgccgacagcgcctcgtggtgcgacagggtccgggcacgacggggctctcaccctctctggcgcccccttccaggggacttgggccccggtccgccactgaggacgcttctccagactacaattcggacgccgagggcgacccgattttcatggtgggctttttcccgcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaa

SEQ ID NO: 26007 - DNA, 213 bp, Glycine max
  Peptide Sequence Number=SeqID_142785
atggacgtcagcgctcgctggagcggcttcggcagcggtcagcagagcttcaccatcccgggtatgcagctcgatcgccgctcgcagtggtttggtgcgcgggttgatctggtgcagtcggcacgcgcgcggctgttcctgcgtgctgaccgccacgtggccgatcgcggcgatgagaaagtgctgcgcggcggtgtcgacgtcacgttctaa

SEQ ID NO: 26008 - DNA, 840 bp, Glycine max
  Peptide Sequence Number=SeqID_142786
atgtcggtaggcgttgcgttgctgctgacggaagatattgcccaggcgcgcatgctggccagcgaacttgatgcgcttaatcagacgcgcaaagagattgagcagggcatgaagagcgaggcgctggcgctgtgcgatgagctggagcgccagcatcgcgatctgccgctcgggctggcgttttatcacccggagtggcatcagggcgtggttggcatcctcgcgtcacgcctgaaagagcgcttccaccgcccggtgatcgccttcgcgccggccggtgacggcacgctgaagggctctggccgttcgattgccggcctgcacctgcgcgacgcgctggaacgcatcgacacgctctatcccggcctgatcatcaaatttggcgggcacgccatggcggcggggctgtcgctggaagaggcgaagtacgatgagttccgccagcgctttgctgcgctgatcgacgaatggctggagggcgaggcgctgcagggcgtgatgtggtccgatggcgaactgcatgcgcaggaatttaccctgcacaccgcggaaatgctgcgggaagccggcccctggggccaggcgtttccggagccggtgttcgacggtcagtttaagctgttgcagcagcgtctggtgggcgagcgtcaccttaaggtgatggtcgagccgctgggcggcggcccgttactggatggtatcgcctttaacgtcgacaccagcctgtggccagacagcagcgtgcgtcaggtgcagctggcctacaagctggatatcaacgaataccgcggcaatcgctcggtacagctgatcatcgaccatatctggccgcagtcgtaa

SEQ ID NO: 26009 - DNA, 423 bp, Glycine max
  Peptide Sequence Number=SeqID_142787
atggccacaatgatagaggccatgatgagcataaaggagataatggaggtcagtgcggcttaccgaacccgtgctagagctagagtaatgggtgaagtagaggagaaaatggccacaaggatggaggccatgatgagcatgaagaagataacggaagccaatgtggttagaattgctgctaccagcgccgttgctaaggtgaacccgatgcccccatctggcctcaaccaaatgaatcatccaaccccatatatggtggacaaagatttgggaagtacgagcggcccccattatgtgcaaattcaaaacaaacacgccttcacgccatatggcttgccttccaactatacaccacccaatgtggcgtacactcccaatgagaatgtcaataactccactccgatactcattgatagccaataa

SEQ ID NO: 26010 - DNA, 216 bp, Glycine max
  Peptide Sequence Number=SeqID_142788
atggcgactccgcgcacctttcctcctttggaaagcgcacccgtgagcctcgccctcgctcgcccgcgaagggcacgttgcgacagttggcgactccactggggactttttttttcacccacgggtttgagtgaaaaggggccctacacctgggttcatgggaatttaaggagtggaggtgaatctatcatcatgctaggtctccgacttgcttga

SEQ ID NO: 26011 - DNA, 468 bp, Glycine max
  Peptide Sequence Number=SeqID_142789
ggtggacccttgggtacttgtacctatcacttttagaggactacacgtcctcaccatcaaagggctgcacgccctcacctccagaggactacacgtcctcgccttgagaggactacacgtcctcagcaccagagggctgcacgccctcacctccagaggactacatgtcctcgccttgagagggctacacgccctcaccttgggtactagttaccctcaccaaggactacctgtcctcgccttgagagggctacacgccctcaccttgggtactagttaccctcaccaaggactacacgtcctcgccatcagagggctgcacgccctcacctccagaggactacctgtcctcgccttgagagggctacacgccctcaccttgggtactagttaccctcaccaaggactacatgtcctcgccttgagagggctacacgccctcaccttgggtactagttaccctcacca

SEQ ID NO: 26012 - DNA, 453 bp, Glycine max
  Peptide Sequence Number=SeqID_142790
gttctgaaatgcagactcctcactacggggtcggatgaagggattcgaaagacagcatggatcggggagaggagggagaaaggtgaatccgctcatgatgcgtggaaagtaggggaagagtctgattcaaaaccgtctgcgatagatcacgctcatcaaatgcaaacatggctcttgttggccttggcccggccgtcaactgcttcaactgcagatgcggctgacctagatctagatgtcccatcaatagcgaaggaagtggctgaactcgttctttgggacttggactctgactttccgtactcgtccctgaacccaatagggaatccgtccctttcagcccctgaacctaatgaatctgtttggtacgctgaggcttctccttcccctgaggccgaagtagaaagaaaggaagtcgcttgtgcttggcgtgctctaagctccgaagctgat

SEQ ID NO: 26013 - DNA, 665 bp, Glycine max
  Peptide Sequence Number=SeqID_142791
atgaatatcttgacggcacacgatcaagagtgggaacaagaattaagttcttacgatcaatatgaagaagaaagaactcctaatcttgaaactgtgtttgaggaattcatggcataccatgccagctcaaaagctaatcaaagctcaatgaaaaatcatgaaattcattttggtaagagctactcaatagaaaactttcacgcgggaccaaagttacaaccttactatcaaaatgaagcagaaagaggatccaatatggataaattgttgatgaaattcatggaaacaactaaatcaactcaacaagcactccaaagtgtagaaatccaggttggtgagctggcagaagcagtaactcaatttatgtccagacgagaaaaatcctttgtagaggctgaagctcaagagaaaagccctataaaagagcatgaatcaagagaaaaagatgaggagaaagatgaggaacaaacacaacaacaatgggagaagtactcaacagtagaaaaccaacaaggaaatattctccaaagcaataaccttcctcatcaactgattgacaagaaaggaaggcaaggagagcatgaggaaaccttaagtgccataatttctttaataactaacacctttcttgaaatgaattggaatgtccttccagattatatgaa

SEQ ID NO: 26014 - DNA, 354 bp, Glycine max
  Peptide Sequence Number=SeqID_142792
atggtgtcaccaccttcaccacatagctcatgtgagtccactgagcccaaccaagaggacaacaataacaataataatgaagacgacaataacaacaacaacggcggcgatgacaataaccacaacaacaatgacgatgacaacaacaacaacaacatcatcatcatcaacaacaacaacaacaacaacaacaacaataacaacaatggcgacaacaacaacaacaacaatggcgacaacaacaacaaccaccaccaccctgaagctccttccttggtgctagtagggttccctcactgtcttatgtatctgaggataacctcatgtgcccaaaatgcaaaagcattaatttga

SEQ ID NO: 26015 - DNA, 454 bp, Glycine max
  Peptide Sequence Number=SeqID_142793
atgtttatttatcagcacttccactctgttggcaacggtacctttaaaactggttcaatttttaacttgagtggtagtgattcgttctattgggtttacgactgtggttccaccaggaaaacttctctcaagcataaaatccaaaacatgtccactcatccgtgtttcccaagtaatattgatatgctggttctctcccattttgatgaggatcacgttaatggagttgaggaccttctcagacactgccacgtaaaatccctggtactacccttctcagaatggacccaaagtgtgcgcgaaatttcggttctgggaaaaaagggaacttcaccatccacagcacttttgcaacttaatcccctgcaatggttagcaactagagaatttgatgttcaagttgatgaggttgtactaatccaaggaggttccgatagaccgcctaatgctcttg

SEQ ID NO: 26016 - DNA, 237 bp, Glycine max
  Peptide Sequence Number=SeqID_142794
atggatcacccaggggaacctcccaacaactcactatccctcggtttctacctcttcctgttttacatcctttctaacagtcttggcgaaaggaaagggcttttgatagagccctttacaggaggagatgctcagggcgcgataaagctcgtcacgagaccgagaaagctcatcagtggaagaaatatgtcacgtagtctcgatttcgcagtttataattatgaatctctcccatag

SEQ ID NO: 26017 - DNA, 229 bp, Glycine max
  Peptide Sequence Number=SeqID_142795
gtgggcaactggggatggtgtgcttatgcctgggcttgtggaaatgggatgtttgctttgcgccatcgcccgatcgccacctagtaccacatatgacggagtggtacctcaggatatgtcgcgggggtcaggagaccttggggacgtcaggtggggtgctattgcccaaaaccaagcttggccaatctcgacccaacccgggcatagtaagccagtgagaacctgtgac

SEQ ID NO: 26018 - DNA, 290 bp, Glycine max
  Peptide Sequence Number=SeqID_142796
gtgttgccagaggatgtggttggcagaaacttggtgcatatgtcaatctagggtcatattattttttgggagttcctttttccgttgtgtcagcttttgtcttccacatgaaaggacaggggctatttttagggatcctaatagcacttactgtgcaagtggtgtgtttccttctggtcaccttacgcgccaattgggagaaagaagcaaaaaaggcagcaaaaagagtaggaggcgatggagtccaacttggggaccttccgtgtgaccaaaatgccaatactgcttga

SEQ ID NO: 26019 - DNA, 717 bp, Glycine max
  Peptide Sequence Number=SeqID_142797
atggcaacccaagctttacgacccgagattgagcttgtggttgacgacacgaccacctccaacgttattagccacagcaatcacgaaccaacctcgttgatggtcgcaaagcgctccttaacgtccctaaattctatactaacaaaattccatgcaggttacttcagaataagcctctccctcggtggccaagctttgtggtggaagacactgatcgaatcaccaacacacgacgtcacaagcgctctacgacgcttgctttgcacgcttccttcctcagcttttcttgcactgtggatggtaaaggcggatttcttgcaccctgtacgagttaactacctcttcgctccgtggatttcatggcttctgttgcttcaatcagcgccattcgtggcgccgaaaacaccgacgtatttggttatgtggtggttcacgaaagtgaagaggctttttatcgacggtagcaaacccgacgagccagatgtcggtgatagggaacttggtcggggcacaagctgcggcgaatatgggttggaaagagagagcggtttgcttgttttcgctggggatggtgcattacttggtgctgtttgttaccctctatcagcgttccggtggagatcgccttccggtgttgttgaggccggttttcttcttgttctttgcagcaccgagtgtggcaagcttggcttcagaattcatggttggcacctttga

SEQ ID NO: 26020 - DNA, 165 bp, Glycine max
  Peptide Sequence Number=SeqID_142798
atgtctctcatgtttgtaggccatttggatgagttgcttttggctggtgcttcattggctacttcatttgtcaatgttactggtttcaacgtgttgctaaagtatccggaagaactcatcttgcattttgttgtgaaactttgttttcacaagtttcttgtctaa

SEQ ID NO: 26021 - DNA, 784 bp, Glycine max
  Peptide Sequence Number=SeqID_142799
atggctggtttcttctctctaggcggatcacaaaacaaggaagaagaggaagtagaaaaaggaggagacaagaataacctattattgttgaggaacgaggagatctacaacagcaagggtgggttcgagatatggccacagtcgtcgtcctcatatcatcagcatcagaatcaggcataccaaaactactttgcatttggagtgggtcctagtcgcaggaacagatcggaagatgtttcattgtgcgtgtctgatcatgagtctacgagatttggattaactgttatgaggtctggagtaagcagcagcatgagcatgaactgtcaggactgtgggaaccaagccaagaaagactgttcccatctcagatgcagaacttgctgtaagagccgagggtttcagtgccaaacccacgtcaagagcacttgggttcccgcagccaagcgccgcgaacgacaccaacaactcgctgcgttgcagcaacaacatcaacatcctaaacgacatcacagagacactactactactcaacttgcctccgctccacaacccatcatagggttagagctgggacaattcccacctgaagtgagcacttcggcggtgtttcggtgtgtgagagtgagcgcagtggacgcttcagatgaacagtgtgcgtatcaaacctctgtcaacatcggaggacatgttttcaagggatttctctacgatcaaggtcctgaaagttcttacactactagtgcagcagctgagggttcatccggtggcgaacctcaaccacttg

SEQ ID NO: 26022 - DNA, 510 bp, Glycine max
  Peptide Sequence Number=SeqID_142800
atggcacgtaggctacggttgtttaaggaacaaatgacgaaagcaggtgtatcgccctcaacgtggtcaacaagagacaatcattttgatctggaacatttggaggttaaacttgaagaacttgaagctgagctcctcgagattaatgcaaataatgaaaagttacaacacacttacaatgagctattagagtataagcttgttctggagaaggttggagagtttttctcttcagcaaaaaataaggctgtagctcagcagaaagagcttgaatttcagacaactgttgaagggtctattgacagtccattattattggaacaagaggagacgacaacaaagcaaattaagctgaggtttattagtggacttgttcatagggaaaaatcaattcctttcgaaagaattatatttcgtgctactaggggaaatgtgtttctcaaacaggctgtgattcaacatcctgttcttgatcctttgtcaggagagaaggttattttaaactcttaa

SEQ ID NO: 26023 - DNA, 141 bp, Glycine max
  Peptide Sequence Number=SeqID_142801
atggcgtccaaccgaagcagcagctgggctcgcggtgaaggagaaggctcgcggaagagggattatgtgcgggtgtgggtgtggtgtggcgtgtacctttgtgtgagaacaggaaatgctaagagccttactagttactaa

SEQ ID NO: 26024 - DNA, 298 bp, Glycine max
  Peptide Sequence Number=SeqID_142802
atggggaaatggctgacgacggagtcttccggaagacccgttaggggttcttccggaagttccggaagaacgttttccggaagaagtgttcttccggaagtaaccaaacgtctttcggaagaacacttcttccggaagacttccggaaaacgtcttccgggaactttccggaagaagtggttcatccggaagaattccggaagacgcccacttccggaagaagtttcaaacttccggaagacctttccggaagaacccttcttccggagtgtttccggaagaaccacttcttccggaa

SEQ ID NO: 26025 - DNA, 1029 bp, Glycine max
  Peptide Sequence Number=SeqID_142803
atggctttgaggatcgtgctggcttgcattgagagtcatgctaatcggtataagcggtatatcgttcctgtgttatctgttcagatggatttttatcttcgtgtttttgttcgcatatatacttctgccagtgctatgaaaaacacccccctaaagctttcatatgtttatcagtgcactggttgtgattctttccacctacagcccattggaagaaccatttccaagaatactagtgtcagatatttgcctggctttggtcctgttgttcctcaagaatgccgtgattgtgggaaaaaattcaatatggggggccctatatggtctgcccctatccacgaccaagaatgggtggctgctattctagcagatgtgaaatctatgaaagacagatatccagcttatgatcgcatttcagctgtgttgactacaatatcagaggaattgccagatgttcccctctttttgagtctgcacaacctctgtgcaaccctcaaatgcacttctccatcagcaattattttccgttctgcagtgatcaatgcaggctatcgtatatctggaactcatgttaatccattgggacttaaatcagatgcacccatggatgttatttgggatataatgcgctgctgggtaaaaaatcatcctgtgaagcctcaaccagcagatcaaccaggaagcatcatacttgcaaaggaacctgttcttcagggcttttgggccatgatgattgccatgaacttggatatgatcttggtccagattttggcatttggcttggcctatgataaggctaattttgctcgagctgtagcatctcttagcaaggcacaagctaagaaggttgcgcgctttcttccaaatcctgaaagacactggggtccaaaacttagggcaggacgtcaaattacaagcaagcatgtctctcttttgggtcctgaagcaattaatggagctctcaatcaggaagacgatgaagaacctaaaagtaagaagccaaagaccgaagatagtgtcacttcttag

SEQ ID NO: 26026 - DNA, 714 bp, Glycine max
  Peptide Sequence Number=SeqID_142804
atggcatttggcggacgctatatcattatgctgatggccctcttctcaatctataccgggttgatatataacgagtttttctctgttccatttgaactatttggaccatctgcttatggatgtcgtgattcttcatgcagggatgcttctacaacaggttttataaaagtgcgtagcacttatccatttggtgtggatcctaaatggcatggaactcggagtgaacttccatttcttaattctttgaagatgaagatgtcaattctgctgggggtatcccagatgaatcttggaatcataatgagttactttaatgcaaaatacttcgaaaacaacataaatatctggtaccagttcgttccccagataatattcttaaacagcttgtttggctacctttcactcctcataattataaaatggagcactgggtcacaggctgacctgtatcatgtgatgatatacatgttcctaagtccaactgatgatttgggtgaaaaccagctttttgttggtcaaaagctccttcaactcgtgttactactgttggcacttgttgctgtaccatggatgctagtaccaaagccctttctcctgaagaagcaacatcaagaaaggcatcaaggccaatcttacgatttgctctacggcaccgatgaccctcttgaatcagaatcacaaagtattccccatgacgaatttgacttcagcgag

SEQ ID NO: 26027 - DNA, 309 bp, Glycine max
  Peptide Sequence Number=SeqID_142805
atggcgaggtctcagatatgtggtcgagtccacacacacaccttagctcattcagagttgtcgagtgttttctatgacaaagttctccttctggcctgggggtataatagcactattgttctcattgttggcatttttgtttttatctgtgcaactgttggtgtgttactgttaatggaaagtctaagtgctttcttacatgctttgagacttcactgggtagagtaccagaacaaattttatgagggagatggttacaagttcttcccgttttcgtttacattactcacggatgaggatgaactgtaa

SEQ ID NO: 26028 - DNA, 1188 bp, Glycine max
  Peptide Sequence Number=SeqID_142806
atggctaatccctcactcttgttcttcagtctcctcctattatccgccaccgtagccgccgccgaacggatcgacgatgaagacgaccttctgatccgtcaagtggtgccggatgcggaggaccaccacctgctcaacgcggagcaccacttctccgccttcaagacaaagttcggcaagacctacgccacgcaggaggagcacgaccaccgcttccgtatcttcaagaacaacttgctccgcgccaagtcacaccagaaattggatccctccgccgtccacggcgtcaccaggttctccgatctcactccggcggagtttcgccgccagttcctcggcctgaagccgctccgccttccctctgacgctcagaaggctccgatcctaccgaccaacgacctccctaccgatttcgattggcgcgaacatggagccgttactggagtaaaaaatcagggttcgtgcggatcgtgttggtcctttagcgccgttggagcgttggaaggtgctcattttctttctacaggtgagctcgtgagccttagcgagcaacaacttgtggattgcgatcatgagtgtgatccggaagagcgtggagcatgtgactcgggttgtaacggtgggttgatgaccactgcatttgagtacacactccaggctggtggactaatgcgagaaaaggattatccttacactggaagagaccgtggtccctgcaaatttgacaagagcaaagttgctgcttccgtagctaacttcagtgtggtttcccttgatgaagaacaaattgcagcaaatttggtccagaatggtcctcttgcagtttttatgcagacatatattggtggcgtctcatgcccatatatctgcggcaagcatttggatcacggggttcttttggtggggtatggttctggtgcttatgctccaattcgttttaaggaaaagccttactggatcataaagaattcatggggggagagctggggagaagagggatattacaagatctgcagaggtcgcaatttaacattgcccattccttctactacacggccattgcaagaaaaatctgccaagagaacagtgcatgtacacgcaatgccttctgcactagggaaacacctcaaatggttatcgactagatcagccaatgggatggaaaccagtgtctttcattcctcttaa

SEQ ID NO: 26029 - DNA, 615 bp, Glycine max
  Peptide Sequence Number=SeqID_142807
atggacgcgctagggttgttgagatcggtcaccccgaagacggtagagtccagggaagctgacgcagcgatgatggcggaggacgaagcactggagaaagtggatatcgcagtgatggtggccatggtggaagcgaaacagagaaagatggatgaggagaatggttacagtgggagtatcagctctaacttggagactacaaaagcagagagatctgtgtggctgatgaagtgccctttggtggtggctaagtcatggcagacccatcctccttctcaacctctcgccaaggttgtgctctcccttgatcctctccaccctgaagaagacgatccctctgctgtccagacaacagaggagaatgaaaggatcgtgggaagtattttgttgattgagagacagaatcccaaaattactggggcgttaagggaaagggggcgcggtgccattgaagatcgatgctgggttatttttgggccgcgggttattaaactgggtcgcaaacctgacctgcgaaaagccgaacaacaactagcagaaaagcaccgtgctcaccaagcatcgatcttcaacgacgatactggacgatctggcaaaaatatgacgtggatttag

SEQ ID NO: 26030 - DNA, 135 bp, Glycine max
  Peptide Sequence Number=SeqID_142808
atgaaatttcccgcacccgccgtcacccggctggcggtcgcgctcgccctgtcgttggccacgcccctggtcgcggcgcgagacgttcccgccggtttcgaggatctggtcgaaggccagaccgaacaacttgag

SEQ ID NO: 26031 - DNA, 988 bp, Glycine max
  Peptide Sequence Number=SeqID_142809
atgcgggccggcgcgggcgccttacgggctggcggtcttctgctgcatggcaatggtgacgatgccttcgtagctaccgcccttggtgatcggcgcctgggtggtctgcgcgatgcgcagcgccatcgggatggatgcgcccggcaacgcgccgtcaaacagatcagaagcggcgaaattctgcgcggccacggtcagcgccttgccgttgaggctgacggtcagtggtaccggggcgccgctgccatcggtattgagcagctgcggggcgctgccgacgcgcacttcgatgtccttgtcttcgtcgttggagtagatgcgcacctgctgggtccacggcaccaggccggtgaccgggttgtggaccatgttgaccaccgaatccagcgcggtgccatcggccttgagcagggccagggtcgggtcgacgttggcccagaccttgatgtcggcgtcgaacgcggggaatttgaaagcccccctccccaaggagaaagggagggaggcgccgaccgtggaggtggtcacgggcgacgagagaatggtaggattatgcaaatttcctcacgacttgaatgcaagaaacctcattgcgttgcatttgtagcgtcgagtgatactcgactatcgcttgaggcgcaccgtgtgcgcatgagtcgagcacggctcgacgctacgtgtagaaatcgcgaacgaccttcaacgcgcgggcaccacggcgacgtgctccacgtcgatgtcggtgggcttgaagcggtgcgtatccacctcaccgtgcagctccaccagggtggtcgcgctgacagcctggtggctgggcagatccttgtcgtcgatttccacatcgatctcgccggtggcgtccttgaagcggtagcgctcatggccgatcctgggcaccagtgtgccccgcagcaccaccgggtggtcgtcacgctgggcgcgcgcctcgggtaccgtggtgacggcactggtggcgcccgggccg

SEQ ID NO: 26032 - DNA, 328 bp, Glycine max
  Peptide Sequence Number=SeqID_142810
ccatctaactgagacaagtgtgcgagcggggaattctgatgtgtatggattcctcgagccacagtccattcagagatctaggcaatcacaatttgaatccgaaagttacatcaagagttggatacagagttcaaaaagagatgtttaccttggagcctacctgaatggtgctttgaatggacttgatgatactccacaaccgaaatccaaggttgctgctaggtggattgttattaagtgtaatagacaaaaaggaatcactgaatgtggctactacttgatgcactggatgtccacgataatcttaggatctttcaggaataattga

SEQ ID NO: 26033 - DNA, 472 bp, Glycine max
  Peptide Sequence Number=SeqID_142811
atgaaggtatttcgttattccgacgtgggcctggtcacaccgctacgcgacggcatgaacctcgtggccaaggagtttgtcgccgcgcaggaccctgaaaaccctggggtgttggtgctatcgcagttcgctggcgcggctaatgaactgacttccgcgctcatcgtcaacccctacgatcgcgatgaagtggcggcggcgctggatcgcgcgctaacgatgccgcttgccgagcgaattattcgccatggcaaaatgctcaaggcgatcgagagtaatgatattgataactggcaggcgcagttcgttgccgatctaaagcgggctctggttgtggttgccgcagatgaccaggtcgacgtgatgctgaaggcaaaaatccttcacgtggtggcaaagttcgccgctggcgatggtcattttgctgatagggtagtccgcctgggaggcgagttcattaagaaaactacgg

SEQ ID NO: 26034 - DNA, 1182 bp, Glycine max
  Peptide Sequence Number=SeqID_142812
atgaacaactttcaacaatatcgccatatctcggagcctgggtggtcgcttggatggacatgggcgaagaaggaggtaatatggagcatggtgggagggcagaccactgaacaaggggattgttcaaaatataaaggaaacatcccacattgctgtaaaaagaaccctgtagttgtcgatttacttcccggaacaccttacaaccaacaaattgcaaactgctgcaaaggcggtgtactcagctcgtgggcacaggatcaatccaaggcggtttcagcatttcaagtcagtgtgggtagtgctggtaccactaacaaaactgtcaaactgccaaaagacttcacactgaaagcgccaggacccggttacacatgtgggccggcaacaattgtgaaaccaactctatttatacaaccagacaaaaggagagtgacacaagcactcatgacatggaatgtaacatgcacatattcacaatttcttgctcagagaacacccagttgctgcgtctcgctttcatctttctataacgatactgttgtaccctgcactacatgtgcatgtggctgccagggcaactcatctcaattaggggaatgtgtagatccggactcgtcaccacatttgcaatcagttgtttccaaccctggacctggaaagagtagtattacacctttggttcgatgtactcgtcatatgtgcccaatccgagttcactggcatgttaagcttaactacaaggagtactggcgtgtcaaggtcactgttactaatttcaattacgggatgaattattctaattggaatttggttgttcaacatccaaatttcgacaatctgacccaacttttcagtttcaactacaaatcaattactccctacggatcaataaatgatacagcaatgctttggggagttaagttctacaatgattttctcatgcaagctggccctcttggtaatgtacaatcagaactactattcagaaaggataaatcaactttcacttttgacaagggttgggccttccctcggagagtctatttcaatggcgacgtttgtgtgatgccgccacccgattcttatccatggttacctaatgctggttccaagcaagaggtttccctgcttgctttggtgatgtcctctttggtagccttggtattatatgcatatgcttaa

SEQ ID NO: 26035 - DNA, 747 bp, Glycine max
  Peptide Sequence Number=SeqID_142813
atggggatgtgtactggtactaaatttgggtaccatgtagatctagtaataggagaaagccacgggttggggactgagacgaggataaagatatcttcccatatggggatggggattatttttcccatacccatattccgtgccatccttattggcagaacagcatatgaaacctcctatattgattttgaaaaattattttctgttgtaaatatgatgtttatgttgagatgggatgctgggaagacaagtaaatccaagatggaaggtggcaaggttgcaatggaagggaaagtagaacataagtttgatatgaagccccacggtgaaaacattgaagagtatggtaaattgtgccgagagaggacaaacaaatctatgattaaaaatcgacaaatacaggttatcgataatgatcggggagttctaatgaggccaatgcctggaatgattggtctagtttcatccaattccaaggacaagaagaagacacagccggtcaagcaatctgatacaaagagaacgagaagagataggggagagctggaggatataatgttcaagctatttgaaagacagcctaattgggccttgaaacagctcgttcaagagacagatcaacctgcacaattcttgaaagagattctgaacgaactttgtgtttacaataaaagaggtgccaatcaaggaacttacgagctgaagcctgagtacaagaaatctgttgaagatacgagcgccgaataa

SEQ ID NO: 26036 - DNA, 564 bp, Glycine max
  Peptide Sequence Number=SeqID_142814
atggtgcaaggattatcaggccatgcccaatatagtgggggtttggatgttgctcgtaaggtgttaaggtctgatggcatcaggggattatatagaggatttggtctatctgtcatgacttatgtaccatctaatgttgtatggtgggcaagctatggttcaagtcaacgctacttatggagattcttgggagataacagtgaggaatatactcctagtctaccaaagattatttttgctcaggctactggagggatcattgctggtgctactgcatcctgcattacaaacccattggatactatcaagacacgattacaggtgctgggacttgaaaagaaaatccctgtaaaacaagttgttaaagatttgatcgctgaggatggttggaaaggtgtatatagaggattaggtccaagacttttcagcacgtcagcatggggtacttcaatgatattggcttatgaatatctgagtaagaacttgctctctgatttcattgtgttgataatcctgtttgtttatactggtttggtgtatttaaatattgaaataactatgtaa

SEQ ID NO: 26037 - DNA, 279 bp, Glycine max
  Peptide Sequence Number=SeqID_142815
atgatctcagacctgacggggcaggaccacaaggacttcagctacaatgtgatcaaggatgtacaggtcatgtcgagcttcattggagagtggggtgacgttgtcataacgctcaaggatggcaccaaggtcgatctcaggagtgtccccaagttcagagagattgccaagtactgcctcaccatgactcaaaactccctcggaggagggtgtcttgtagccgtgagaggagtgtattcttgtgtggggagtgtgcaacgatgtgagggtaacaataag

SEQ ID NO: 26038 - DNA, 177 bp, Glycine max
  Peptide Sequence Number=SeqID_142816
atggtgagatttggaggaaaagggttttctgtccagattgacaccgaaggcgaagagtcgaacactatgatttcaattcctgccgtaatcatcacgaaagattgtatggtcaaaaagattatgggcttagtacacacgcaacttaattgcaagtttttatgtggaggcgctatctaa

SEQ ID NO: 26039 - DNA, 1332 bp, Glycine max
  Peptide Sequence Number=SeqID_142817
atgtgctttaatgaaaaatgccagtaccatggaggaactaactttggacgatcagctggaggcccgttcataactacaagctatgactatgatgctccaattgatgaatatggtttgatcaggcaaccaaaatatagtcatttgaaggagcttcataaagctatcaagcgatgtgaacatgctttggctcatgtattctctacagggactggaacatgtgcagcatttctagcaaactataatgcacagtcagctgctaccgtgacattcgatagcaagcactatgatttacctccttggtccataagcatccttcctgattgcaaaactgatgtatttaatactgcaaaagtgagagttcaatcttcactggtgaaaatgcttccggtcaaaaaaaagttctcatgggagagctacaatgaagatctatcttctctggccgaaaattcaaggattacagctcctggactcttagaacagctggacgttactagagataccagtgactatctatggtacataaccagcattggcataagttcatcagaatccttttttcgagggggacaaaaaccaagcattaatgtgaagtccgcaggacatgctgttcgtgtgtttgttaatggccaattttcagggtcggcttttgggactagggagcagagaaattgcacgtttaatggacctgttgacctccgcgctggaacaaataaaattgctcttctcagcgtggctgttggattacagaatgttggtcggcattatgaaacttgggaggcaggaatcactggtccagttttgatccatggtcttgaccaaggacagaaagatttgacgtggaacaagtggtcatataaggttggcctaagaggagaggctatgaatctggtatctcccaatggggtctcgtctgttgattgggtccaagagtcactagctactcaaagccggtcacaattgaaatggaacaaggcgagggaacagttacttgcttatatagcttgttttaatgcacccgagggaaacgaaccactggctttggacatggcaagcatgggtaagggtcaagtatggatcaacgggcggagcatagggagatattggctggcttatgcaaagggtgactgtaattcttgcacttattctgggaccttcaggcctgtaaagtgccaacttggttgtggacaacccactcaacgatggtatcacgttccaaggtcgtggctgaagccaacaaagaacttgatagtagtgtttgaagaattaggtggaaatccttggaaaatatctttggtaaagagagtggcacatactccggcagttcatgggtag

SEQ ID NO: 26040 - DNA, 1023 bp, Glycine max
  Peptide Sequence Number=SeqID_142818
atgctgaaatcgggcatgggaattgaggagagaaagcaagtgaagaagccagcacaagccagctcgagaaaagggtgtatgagagggaaaggaggtcccgagaatgctagttgcacctacaaaggtgtgaggcagagaacatggggaaaatgggttgctgaaatccgtgaacccaatcgaggtgctaggctctggctcgggacttttgagacctctcatgaagctgctttggcttatgatgctgctgcacgtaagctctatggctctgatgccaaactcaacttaccagagctctctatcaaatcacaatctcagtgtccaccaccaccttcttctgtttccaacaacactcagattcctcaaatggagaacctgcagcagcagattcaaaacaattacatggacatggctacatgttctaataatttcaacaacaacaccaataatccttcagaagtttccatggcctctcagcaggttggagttggagtaccaatttacaccagtgactccatcgtgtctcttcccttggacaccaatcccaagcctgtggagaatgatggtgactttcgtccttcgtggggtacaatgaatgagggtttgccagtttttgatgattctatttgggctgaagctgccatgtctctagattttcctcaaattgcagcagagactgcgatttattcatcgggtaacaacttggccgatgtgggtgtgtgggactctctgcaaaccccatggtgcatcaacctgttatccctccactgttgggagcctgaggtgttcgctgctctgttaaaccagcctcacgctgtgccctcaagtctaggagccacgaaacttgggccttcgctcaagactcgaggctcaactcccaacttggagcgggcaggcccgcagatagcagctacagtccaacccagcaagcccgaaagctgttctatcactctgaagcccccacttgggtcacaagctggagtaacccaactcggcaagcagaagtatttcccacaaggcttataa

SEQ ID NO: 26041 - DNA, 762 bp, Glycine max
  Peptide Sequence Number=SeqID_142819
atgttaagatatttgctgggcttctctttacattttaatatttcctcccccgcagtctgcagggcagagccacagaggagttgggaaatgctcctgacacctgagaagtttattgcctttttattggatcctattattagttgtgaagactttcttgatgataaatttcatttgtctttaggaatctttcactttgcactagagggaaatgcactcaaggctattgagcttactgaacagctggcaaaagatattctagagaacaataaggatttgcagtttgatctactaagccttcattttgttgagcttgtctgctcaaggaaatgcacagaagctttggagtttgctcagaccaaattgggccctttcggaaaggagcccaaatatatggaaaagcttgaagactttatggcccttcttgcttataaggagccagagaaatccccaatgtttcatctccttagcttagagtatcggcaacaggttgcagatagtttgaatcgagctattcttggttgcacacttgaatcttcccagttacacagcaatggagaggctaatacagcaggctacagttgtaagacaatgcttaagtcaagaagctggcaaggatgcacctccaccattttccttaaaggattttctcagaagttgatggaaaacagtaaaaaatggagagtcaattggggaatgaagctcgttgtttaccttgagctttcttgtctcattggattggtgtatggtttcatcatggtgtaa

SEQ ID NO: 26042 - DNA, 2919 bp, Glycine max
  Peptide Sequence Number=SeqID_142820
atggatgaaaagaccactacttttgtcagagatgattctttgtcggtagatatgccaatagacagtgacgtattccgtgtgcctcctggttacaacgctccccaacaggtgcatataacacagggcgatcacgtggggaagggtgtgatcatctcttggattaccccacatgaacccggttcaagcactgtcaaatactgggccgagaacagtgaattcgaattgaaagctcatggtttttaccttgcttacaaatacttcaattacacctctggttacattcatcactgcactattcacaatttggagtttgacaccaaatattactatgaggttggaatagggaataccactcgacaattctggttcaaaactcctcctcctgttggccccaatgttccctatacatttggtctaattgatgattttccatatcatgacaacaccaagtgggatacctggggaagatttactgagagaattgcagcttatcagccttggatttggactgcaggaaatcatgaaattgattttgctccagaacttggtgaaaccagaccattcaagccttacacttgtcgttatcatttaccgtacacagcatcaaatagcacatctccgttgtggtactctataaagagagcttcaacatacatcattgttttatcttcttactcagcttttggtaaatacacgcctcaatacaaatggcttgtaaaggaactgcccaaggtgaacaggacagagacgccatggctgatagtcctaatgcatagtccaatgtataatagttatgtgaatcactatatggaaggggagaccgttagagtattgtacgagaaatggtttgtggaatataaagtcgatgttgtatttgctggtcacgttcacgcttatgaacgatctaaacgggtatcaaatattgcatatagtattgtaaatgggttgcacaaccccatcaatgaccaatctgctccagtttacataacgattggagatggaggaaatatagaaggactggctactgctatgacagagccccagccaagctattcagcataccgtgaagccagttttgggcatggcattcttgatataaagaacagaactcatgcctattttagttggaatcggaatcaagatggaccacagtttgccgagctgggttacgccagcttgtcatccaagtgggggcatcagagtgatggaacagtcttcgggcttgctggggcacagcgtgaggctggtttaacagagcagcgaatacctcaggcttccaacagtggagggataacaggctgctgcaacagcagtccacaatggcctgccactgggattcgaatcaacagagaagagatgggattgaattggcatagatgggttgttagtgcttttctacttgttgcatgggctttaattcttgacactggagagatatgtttctgtatgggtggaaagaccagtgattttctgagaaatgattatttatcgttggatatgccaatagacagtgatacgttccgtgtgcctcctggttacaacgctccccaacaggtgcatataacacaaggagatcacgtagggaaaggtgttatcatctcttggattagcccacatgaacccggttcaagcactgtcatttactgggctgaaaacagtgaattcaaatggcaagctcatggctttttccttacctacaagtacttcaattacacctctggctacatacatcactgcactgttcacaatttggagtttgataccaaatattactatgaggttggaatagggaataccactcgacaattctggttcaaaactcctccccctgttggccccgatgttccctatacatttggtctcattggggatctaggccaaacttacaattccaacaggacgcttacccattatgaacaaagtccggccaaagggcaaacaatattatatgtgggggatctttcttatgcggatgattatccacttcatgataacataaggtgggatacatggggaagattcactgagagaattgctgcttatcagccttggatttggactgcgggaaatcatgaaattgattttgctccacaacttggtgaaaccaggcctttcaagccttatactgctcgttatcatgtgccatacaaagcatcagatagcacatctccattgtggtactccatcaagagagcttcagcatacatcattgttatgtcctcttactcagctttaggtaaatacactcctcagtacaaatggcttgaaaaagaactgcccaaggtgaacagaaccgagacaccctggctgatagtcctcatgcatagtccgatatataatagttatgtgactcactatatggaaggggagacagttcgagtaatgtatgagaaatggtttgtggaatataaagttgatgtcgtctttgctggtcatgttcatgcttatgaacgatctgaacgtgtatcaaatattgcatacaatgttgtaaatgggctgtgcagacccatcaatgaccaatctgccccagtttacataacgattggagatggaggaaatttagaaggactggctactgctatgacagagccccagccaagttattcagcataccgtgaagctagttttgggcatggtattcttgatataaagaacagaactcatgcccattttagttggaatcgtaatcaagatggatacgcagtcgtggctgattccgtttggttgcacaatagatactggaaccacccagaacaaacatctcttgctgcttttcggattctcaatatgatggtcatgatattccctattccttctatagcatatgaaccaagaggtgaggtcggcgataacgaaggtacgttgccaaccaaagtgtcaaacaatgaggaagaaagagttaacttggttgtgaactga

SEQ ID NO: 26043 - DNA, 826 bp, Glycine max
  Peptide Sequence Number=SeqID_142821
gaaggagagacctgccattacattaaacttcctcttacagttctttcttctggctcttgtcgggatcgagcaagtgcggctgaaccgaaaggatgggatatcgaaggtggcgggaacgatattctgtgtggctggggcaacggtgattacactatacaagggtccaacaatatatagcccaactccacctctacacagtgagagaccagcagtagttgactttggaacactctcactgggagatgcaaaggggaaaaactggacccttgggtgcctctacctcatagggcattgcttgtcctggtctgcttggcttgtgctccaagcacctgtactcaagaagtacccagctcgtctctccgtcacttcctatacatgtttctttggactcatccaattccttgtcatcgctctcatcgttgaaagggatgcccaggcttggattttccaatctggtggagaagttttcactattttatatgcgggagtggtggcatctggaatagccttcgctgtacagatatggtgcattgacagaggtggccctgtgttcgttgccgtgtatcagcctgttcaaactcttgttgtcgctattatggcttccattgctttaggcgaagagttctacttgggagggatcataggagcagtgttgatcgttgtgggactgtactttgtcttgtggggtaaaagcgaagagagaaagtttgcaaaggaacatgctgctattacgtccaccccagagcacagtggcatcaggtcctcaagccatgccaaaacatcactcactcagccacttctcccttcatctacggagaatgtctga

SEQ ID NO: 26044 - DNA, 324 bp, Glycine max
  Peptide Sequence Number=SeqID_142822
atggttcaaggaaatgggctcaccaggccattgtggactgctgttgcagcagcctgttatccctccactgttggaagcctgaggccagcagaatgcagccagagcccaacccagcaagcccgaagactgttccatcactctgatgcccccacttggatgacaagctggcgtaacccagctcggcaaactgtggtcttatttcaagaacatcaccaggatcatattgaaaatcctgcttatgcagttatgctcatagcctcatacaaagattgtgcttggaaattcgcagaacaaaaacaactaatgacagaatccttgcggtga

SEQ ID NO: 26045 - DNA, 315 bp, Glycine max
  Peptide Sequence Number=SeqID_142823
atggtgcgacaatggttgtggcgcactctagttaggaacttggttgtggctaacctcgaaccttctcaaaccaaaacgatgatgaagctaaacttacccaataggaagaacaatgtcgttgtgttgctgcagcccacctcgatccccttcaaattgcaaatccaccttttgttggaagtggtgaagctcatcgagaactggacttggccaacaacaccttcatggggtgcagatcttgaggccactcacggtgcattggggaggcagcagcagcagtggcaacaacaacctcatcacgctaaacttggggtttaa

SEQ ID NO: 26046 - DNA, 789 bp, Glycine max
  Peptide Sequence Number=SeqID_142824
atgagtagtagcggcgccaagaggagcggtcccccaaagcaccagaacaagaagttggaggaagattcagacccctctctgagatcactggggtgtgccctcgttgcaaggatcaaatcgaatggaaacgacgttatggaaagtacaagcctcttcttcaaccagccaaatgtcagagatgttccaagcgtgctgtacgtcaagcttaccatagcttgtgtcctgggttttggtaagtgggtggttttgaaattggtgcaatgcgggaaaaagaatagatttttggagtgtggaggtggaaagaggaaaagggttgtgccaaggagcatggtggatatatcagaagttgaggctgagcaaaagatgctagaggaggccattaagaactctcgggagagagaaaggagatccttattgcgtgctatgaacaaagacaaaactaagagttcaaatagtgtcccaacagatactaaaggtaacaaagttggacaattatttccaaatgcatcactcgaagactatgccatactgaatagagtaaacgtggagcatgatgatggtgcaatttgtaatgataaatatgtagataacgagggtgaagtttgtgaagatgaagataacagtgatgatgaagataacagtgataatgaagattgtgatgaagatggtaacagtgagaatgaagattgtgatgatgaagatggtaacaatgagaacgaagattgtgatgagaatgatgacaaaaatgatgaaaacattcctgatcataccaatgccaaaaatgaatga

SEQ ID NO: 26047 - DNA, 274 bp, Glycine max
  Peptide Sequence Number=SeqID_142825
atggaggtgtcattggcttgccaacacccttgtcattgctttgatcatcattttgatcatcgctttggtgatatcgatgtgatcaaagaactgttaatcctcatcctcactttgcaaagtgctcttttctcacccatagccatcacgatcggagagagacagaaaagaaaggccaaaggaagtgaaatcttatttctctcctctttcaaggaaatcaaagtgcactggagagaagttcctgaagagaaaggtacaagtcttcctatggagaaag

SEQ ID NO: 26048 - DNA, 141 bp, Glycine max
  Peptide Sequence Number=SeqID_142826
atggctatgggtgagaaaagagcactttctggtcaggaaggggaccttatttcacgaagcagcatgctcatctgtggatggaaagcagctgttagagccatcaaaaacagcttcagatccctttctcgggaaattttatga

SEQ ID NO: 26049 - DNA, 234 bp, Glycine max
  Peptide Sequence Number=SeqID_142827
atggttagaggagaatcctcatctcgggctccattcactatcccagaagcacccctaagctttgtgttgttttgtttgcttcaaatgtgggaggatctaattcggaaggccaaacacggaggacttgatgtcatagacacttatgtcttctgggatgtccatgaaccttctcctggcaattacaattttgaaggaaggtatgatctagcacggttcattaagacggtgcagaag

SEQ ID NO: 26050 - DNA, 258 bp, Glycine max
  Peptide Sequence Number=SeqID_142828
atgcagcacaggaacattgttagtgaggctggagaactttattcaaagaagcttgccaagtttgttggaaagcgtctcaaatcagaatgggctgcttctatatggactagtacactgcaacgaacaattctgacagccactccaattattggatttcccaagatacaatggcgtgcacttgatgagataaacgcaggggtgtgtgatggtatggcatatgcagaaatcaagaaaaacatgccagaggagtatgagtag

SEQ ID NO: 26051 - DNA, 209 bp, Glycine max
  Peptide Sequence Number=SeqID_142829
atggggaaaaagaagctagagctgggctttaaagatcagaaaattgattttgatttgtttgtcgaagacaagcctgctccagaacaaaatgtctgtttacaggtaatggaagtggacgaacttgctaagcgcacctatcgagctaagcaagttcatcttgtgaggatgaacacttatcctcttgctgaaatgcttgtggctaaacaaag

SEQ ID NO: 26052 - DNA, 315 bp, Glycine max
  Peptide Sequence Number=SeqID_142830
atggggatcgcacccacaaagacacccagtggacctgaagaagtccaacagggccctagggtttccagctctgggagtgcctgtcgcccccagcaaggtcatcaggtcccccctaccaatcgagctttcatcaagaagttctgcgtctccaggcaggcgcagggcgaaacaccacagcagcctggcgatggccggcagcgggcaatagacgcaccgccatcacctctagagttcacctctgctcatccacaaaaaggtttgagtattgcctacaccacatggccgaacaataggcgaccaagtccaaagccaaag

SEQ ID NO: 26053 - DNA, 201 bp, Glycine max
  Peptide Sequence Number=SeqID_142831
atggatttcgaaatctgccctattatgcagaaaaatgctgttgaattgtgcaacaaatttttgatgtgtgcagaaaaatgcttgtgcattgctggttatgggaaagagttttttgcctctgccctgttttcttggtttaggatagtttcatggtatttggaattgaattgcttggatattgtggaagcttggagggattga

SEQ ID NO: 26054 - DNA, 360 bp, Glycine max
  Peptide Sequence Number=SeqID_142832
atgaccaaacttggtctctgcttgtcatcgggcccgccggctctggatgacaaaggggtgcggataaccgtaagaatgaccaaacttggtctctgcttgtcatcgggcccgccgcctctggatgacaaaagggtgcgaataaccataagaatgaccaaacttggtctctgcttgtcatcgggcccgccgcttctggatgacaaaagggtgcgaataaaccataaggtatctccgcgggctacccagctcctggagtcatggcgacaaaaggcggtgtggttcgacaaaaagcgaggctcttgctcctacgtatcctccaatgaggaattccagacctccgtagttctggataacttgtga

SEQ ID NO: 26055 - DNA, 327 bp, Glycine max
  Peptide Sequence Number=SeqID_142833
atgaagaatgacgaagaacagcgaagaacttccacggaatcgctcatggaaacgtctcggaagcgttacagaagcaccttagcttggatttttttccttcttcctcttgtcctcactaatttcaaaactttatggattccatggggacgagtctcaagtgtttggaagtggtcaaacgaggtccgcatcctcgcaaacgatggttcctggatgaaattagggtatgacagttgccccttgtcataccctaatttcgtccggggacctttgcttgatgacatgcgacctttctttggtccttgtgaggtgcttggcacccatcattag

SEQ ID NO: 26056 - DNA, 594 bp, Glycine max
  Peptide Sequence Number=SeqID_142834
agagggctacacgccatcgccatcagaggactgcacgtcctcgccttgagaggactacacgtcctcaccatcagagggctgcacgccctcaccatcagaggactacgcgtcctcgccttgagagggctacacgccctcaccttggttaccctcaccgttgagaggactacacgtcctcgccttgagaggactacacgtcctcaccatcagagggctgcacgccctcacctccagaggactacatgtcctcgccttgagagggctacacgccctcaccttggaggactacacatcctcgccaacagagggctgcacgccctcaccttcagaggaccacatgtcctcgccttgagagggctacacgccctcaccttggggctgcacgccctcacctccagaggactacatgtcctcgccttgagagggctacacgccctcaccttgggtacaagttaccctcaccgtcagaggactacacgtcctcgccttgagaggactacacgtcctcaccaccagagggctgcacgccctcacctccagaggactataagtcctcgccttgagagggctacacgccctcaccttgggtactag

SEQ ID NO: 26057 - DNA, 449 bp, Glycine max
  Peptide Sequence Number=SeqID_142835
gagacgacgttagtctctgcgtgctatcaagcgtttcgtcttacagatagcaaaaaggtttatacggataaccactcgggtatctccgcccgtcagcgtgactcaaaagtcagtatgacagatcttgtgagcgcggaagatgacgcttttcgtcttacagattgcaaaaaggtttatacggataaccactcgggtatctccgcccgtcagcgtgactcaaaagtcagtatgacagatcttgtgagcgcggaagatgacgcttttcgtcttacagatagcaaaaaggtttatacggataaccactcgggtatctccgcccgtcagcgtgactcaaaagtcagtatgacagatcttgtcagcgcggaagatgacgcttttcgtcttacagattgcaaaaaggtttatacggataaccactcgggtatcgccgcccgtcagcgtgactcaaa

SEQ ID NO: 26058 - DNA, 159 bp, Glycine max
  Peptide Sequence Number=SeqID_142836
atgaagaagaaaaaggttgaagcagctggtgtcttgctaagcgaggcatatgctcttagcgactcgctcaacgagtcatttgtctcttctcatgctcagcgcgcccagctcgctaagcgaaaatccactaactcacgcttagcaggaaaatggcgctaa

SEQ ID NO: 26059 - DNA, 141 bp, Glycine max
  Peptide Sequence Number=SeqID_142837
atggcgatgtcggcagcaagtgaaagagaatctcaagctctacaagattcactacctccaatgttgccactgccacaaggagaagagcaacgatgcagcagacactatgatgacagtgctgatagaggcaaagtgacatag

SEQ ID NO: 26060 - DNA, 396 bp, Glycine max
  Peptide Sequence Number=SeqID_142838
atggcgataggagaagtggtggaggtggatgacgaaatggatgaactccataggctggacagggcgcggatattagtgaagacaccatggcagccattaattcagcacaaggtttccgcatggattaatggggacgcaaatggcgatcgaaggtataatgctagaacagacccgttggcagaggaggacattcctccgagcactgacggtgacgagcagagtcaacgaaacacggaggagcgacagactgaaggtcaaaatcgccacaaagaaccacaggttaataaccaggagtcactgacacgagctcaggaatgggtcacattcgatacctgcagcggacaaaaacaagttgaccgaagcaaccataggcctgataaaagtgaacaaacatag

SEQ ID NO: 26061 - DNA, 383 bp, Glycine max
  Peptide Sequence Number=SeqID_142839
atggcgatgggtgttaagccttctgaagcgatcaacaacggattacgcaacaatgctcttcttgacttctggaatgttgcggaactttacggattacgcaacaatactctttttgacttccagaatgttgtgagactttacgggttacacaacgatggtgacggtgtagcatttgaaggtgcactagatgatgattggaaatttgatttttctgtgcataatgcccgcctgttggtttgcactaaccaagcgggtatcaccagaaggctgcttgccggtttattggctattgaaagccacatccttcattatctaattgtccgtatcttactccctagatctttaaaccttgcacaggtttctgaagaagatctaatagtcat

SEQ ID NO: 26062 - DNA, 471 bp, Glycine max
  Peptide Sequence Number=SeqID_142840
atgcgttacttcaactggattggccgcaacacgctgcagatctacgttatccaccgcatttttattgagttcttcggcatgtcagcgattctgtttgcgcagcgccatcatctgtttgagcaggcgtggtttgcgctgctgtgggcgtgcttctatccgctggcaattgtcggcatctgttcgctgtgttcggtggcggtgtggtcgctgaccaaccgcgggctggggcagtcgctgtttgtgttcccgacgctgattggtttgaaacgcacgccgctacggccttattgcaacttgcggtgtccttcaccgatctccattacgccatccatggcgatcctgctttatttaaccaatggtcatcaggctggcgttgccgccggcggccgcggtattgacgctcagcgagcgctcaatcagcagacgttccagcagcagattggtctcgccgcgggcaaagccctgcactga

SEQ ID NO: 26063 - DNA, 163 bp, Glycine max
  Peptide Sequence Number=SeqID_142841
gattcatgacgtgcacagtgtctctgcaggattcatgacagacacaatgtcactgcgtctctgcaggattcctgacatgcacaatgtctctacaggattcctgacagacacagtgtcgctgcgtctctgtaggattcttgatgtgcacaatgtctttgcatga

SEQ ID NO: 26064 - DNA, 1335 bp, Glycine max
  Peptide Sequence Number=SeqID_142842
atgatttctttgggaaggctatgttgccaggctaatatcactgagaacattgataatggtggcaagagactcaaacacgctattgagattaatggcagttcttcctcatctcagtctgatcctcctgttcagtcagacttacctcagtctgtttctgttcagtcctctaatcctgaacagacagatcaacctattgtttctaatactgtcatatcatcaaattcagaatcctcatcttcatccagtaactcctctcctctcctcctcctagatcatccaatattcaccctatgcaaaccagatctaaatctgagtgtgaaacaagctttgacagatcccaattgcttttcagccatgaaacaagaatatgaagcattgatgaataatcacactagggatttagtgcctcttccaccaaacagaaaagcaattggcttttgtggttttgatttttctgcaactttctctcctgtggtgaaacctgttactattagacttattcttacattggctctcaccaatcagtggaaacttactcagttagatgtaaacaattcttttctggatggactgcttaatgagactgtatatatgtctcaaccacctggttttcaaagctccaattcttctatagtgtgcaaagtgaatagagctttgtatggtctcaaacaagctcttcaacagtggtttgaaagacttcagtctacccttattcagtttggttttgttgcaagtaaatgtgatccttctttgttcatctacaagactacctctcataccatttatctcctagtatacgaagatgacattataattactggtagttctgatcaactgattcagcatctcacatctcagctcaattcaaaattttctctcaaacaacttggtctactggactactttcttggaattgaagtaaaagctcttcctgataactatttggggctttgtgatgcagactgggaatctgatatagatgacagaaggtctacttcaggtgcagccatctattttggtcctaatctaatatcctggtggtctggcaagcagcaagttgttgctagatcaaccacagaagcagaatatataagtttagctcagactactgcagaaatatcctggattcagaccttattaactgaattaagagtctcattcagcactcctattatcttctgtgataaccaaagtgcagttgccattgctcacaatccagtccttcatgcaagaacaaaacatacggaaattgatgtcctttttgtttgtgaaaaaatcctgaccaaagccaaactcaatgtgcttgaggcctcttcaaagtctcaaccaccttga

SEQ ID NO: 26065 - DNA, 276 bp, Glycine max
  Peptide Sequence Number=SeqID_142843
atggaggattcaatcgggaaaataacaaagatcacatttcccagtcaagagggtccgctcttgacggtgaagaacacattggagaatggaggattcaatcgggaaataacaaagatcacatttcccagtcaagagggtccgctcttgacggtgaagaacacattggagaatggaggatccaatcgggaaaataacaaagatcacatttcccagtcaagagggtccgctcttgacgttgaggaacacattggagaatggattcaatcgggaaaataa

SEQ ID NO: 26066 - DNA, 102 bp, Glycine max
  Peptide Sequence Number=SeqID_142844
atgaagatagtgcttttcaattccatacaagatatgctagatgccatgggtttgttgttaggaaagatgaggaagttcaagcatatgaagtttgagaaataa

SEQ ID NO: 26067 - DNA, 186 bp, Glycine max
  Peptide Sequence Number=SeqID_142845
atgacttatcttggaatggatttcttcaacaagttattaccagtggaagacaaaatggaaggcgacgcgaggctcacaggtgcgtctttcaagaaaggagaaactcttagagttgccaccaacgtttattcgaggaaaacattaaaaaaaccaaactggaaaaggtcaagggtttgcatattttga

SEQ ID NO: 26068 - DNA, 381 bp, Glycine max
  Peptide Sequence Number=SeqID_142846
atggttatcgatgctacagtttggaaggtagtagctagactggatatgggtggagtccacaagtttgaagaatccgatgatggttacagcaagatgcagacttatagaagtatgctccttgacccatcaaggaatatgaggaatcacctaggtgtaggtggtttaactactaaagacaaaatgctcgtgtacctcataacctacattctcacaccgaggtccaacaaccacgcacagatcgtagacttcaccaaagcgtctaatgagataactgaaaggcatctcaagaagcttgggatgaggtttgttaaacacaaatggatcatggttggagcgccaccagcagcagcaaacatggaccagatggaagatgaagcttag

SEQ ID NO: 26069 - DNA, 279 bp, Glycine max
  Peptide Sequence Number=SeqID_142847
atggagaaggctattttggaagataagaaaaatccaattcccataattgacgaggctttggatgtcctagaggagctgaaagaggcacaacctcatgaaagtagtgtctatgctttgatgggtaatatctatggaaggcgtcacacgcatgagagagcaatgtttcattatggtgttgctttggatttgaaaccatctgtaacaaatgctgctacaattaaggttattgttgagaaattgattatacctgatgagttccaagacaaagatgattgttag

SEQ ID NO: 26070 - DNA, 210 bp, Glycine max
  Peptide Sequence Number=SeqID_142848
atgtatcaacctattgagagcagactaagagcactattcttacttcctcttggaggacttggccttcttctgagctctggaggggttgatagccatcttcagaagagggataaagggttcgaaggtggcgggagtaaatgttggagcaatggaggttttgatgaggtgaagacgaagaaatgtgatggattacacgcaacagacacataa

SEQ ID NO: 26071 - DNA, 2257 bp, Glycine max
  Peptide Sequence Number=SeqID_142849
aggctcctcgctatgcgaaggtatgggggagggatgttgtacgcagccttacccttgcatatgcaaagaggctgtttccggattcgaacccatgaccaacaactttgggttaggtttggaccgtgacttggatcggggttggctgggttctggaccttttgtcgtgaggttccttacgcagacattcatgaccttcagttatgttatgtgtagcagatctttggaatcaggggaattggaatttgcatcagctttacactctgcttcctcaatgcgtgatagatattattcagaacgtgcttattcccagaaatcaaactggtcacgatgtaattgcttggcttgggaatacccaatgttcttcttctggcaagcctttcgagaaaccttgccaactaacagtatgcggtttgcttgccatcttgctccaaatgcgttctgcatgagatgctcagcacacgaggagacaatgcttcatgccccatgggactgtcctcactcaaaagaggttgaggaatatcatcgtcattgtgttttccagtcagtgcctactactaaggtgtggtcccctcccactaaccaatttgttaaactgaatttggatgaatcttggttaccaaggatagatggagagggggcgggcaggtatacacgttcagctgctgagccatttgcaaagaggatgaagaagattaataaaaagatgaataagatgaagaggaaggtcactctacctttcgatttgatcgtagaaattctgttgaggttgtcagtgagatctttgttgcgtttcaaatgcgtctctaagtcatggtgtgctctcatttcggatcctgaattcgccaaatcccatattgacatggctgccgcacccacccaccgatttcttttcacatcatctaatgcttccgaattgaatgcaatagacgtagaggcagaggaaccactttgcgacgattccgcgaatgtggtctttaaagttccaccatcatccactttcaaatattataaacattcggtaagagttgtaggttcttgcagaggatttatactcttgatgtttacaggcttggattccattggtttcatcgtatggaacccatcaaccggcctggggaaagaaattctgcataagccaatggagagatcatgcgaatatttgtctggttttgggtatgacccatcaactgatgactatgtgatagtgaatgttatattgtcccggaggaagcacccgaagatcgaatgcttctctttgagagccaattcatggagttgcactaagagtaaggctccttatcgtgagaaccttacatttggggatggggtgttcttgaatggagctcttcattggttggttaaacccaaagataaagttgctgtaattattgcattcgatgtgacaaaaaggacattattagagattccactgccacatgatttagccattatgctgaaatttaacttatttcgtttcatggtgagacaaggatgtcttgttctctgttccttcggttggaagaatacaaggcttatgcctgaaatgtggacgatgaaggaatacaaagtgcagtcatcttggatcagatcactcgttccgtacaaaaactattataatctcttcgatcttttcttgccctcactcactcattcgttcttgtccaaaagccatctttcattttttgccacgtccactccaccatcctcctccccctcaaccctcaccctcaagtccagtactgccttcaaccttcccctccttgccacctctcttgacgcccatgacgacatcgtctaccgctacaacgttcatgccaacctaatcgaaccgaacctctctcttgggaaagggtgctttgaagataacgttgcggattgtgcgttttgggggaatagtttggtttgcatcacgaaggcgaatcagttgttctatattgttgatttcagaaaccctagcgcgatgaagctcttagatcccaagatcgaggaaatgccgcattatacgaccatgattaagttgcaatacacactacagtacacgaccttcatgctcaaactccaagaagatgagattgtggcaatcctcactgtcgttgagcatgaagagaacaaagacgaacttaaggaagcaaatttgcaacgtggtggcatagttgaagagcacaatgggtgtctcatgttgggatggcacactaagcccttgatttccaccttcgtgtggcaactcgcggcaaaaccggtgatggctgctcattga

SEQ ID NO: 26072 - DNA, 555 bp, Glycine max
  Peptide Sequence Number=SeqID_142850
atgggggcgcttatcgcctccgggctggccattgattatccgcagcgagtgagtcacgcggtggtgatgagcggcgtctaccgccgcaatgaacaggcgcgccgcgccgtactgcagcgggcccgtgaactggcggccggtgaggcgcagttggattcgccgctggcgcgttggttcagcaacgatgcgaaggaagcgattctgcgcgaacaggtcggcggctggctggcggaagtcaatctgcagggctatgccgcagcgtatcaggccttcgccggcggcgatcgggtctatgccgaccgttggcaggagatccgctgtccggttctggtgctgaccggtgaactggatgccaactccagtccacaaatggcgcgggaaatggcagcggcggcgccgctgggtcaggcgatcattattgatggcgcccggcatatggtcagtctgaccgatgccccacgcgtcaaccatgaaatgctgagcttcctgcagtgcggctcggcgcgacagagcaacaatgccaatacggcgggacttactcatgcaaatagataa

SEQ ID NO: 26073 - DNA, 165 bp, Glycine max
  Peptide Sequence Number=SeqID_142851
atgatcttgcaaatcccaacggtggagatgtgcggaattgaatctcgaacaacatatcaaaactttacgacaatgcaacggtttggtggtctacgggaaaaagagagggttttgggaggagaaggggggaaaacgaaaatgaggagaagagggtgtgaaaactga

SEQ ID NO: 26074 - DNA, 243 bp, Glycine max
  Peptide Sequence Number=SeqID_142852
atggatgacggtggcactgattatgtgaagcttcatgctaagcatagtgtcgcaatcactattggaacgagggcgtcgtgtgagataaaaatgattatgcttgtgtccggattagaaaagggagatggagtaatgaatgaaagggttttgtttgtgtttctggatagatgggataagatgtccacggctccatcaacacgtgacatgtggggtgatgccatgatgccatgtggaagctgttga

SEQ ID NO: 26075 - DNA, 771 bp, Glycine max
  Peptide Sequence Number=SeqID_142853
atggaattttgtagaataaagaatgtacttgatgaaattttgctgatgaacaaaacctctgagctcaatgacatattaaaacatttaattgaccccacatgggtggcaacggggctagaaattgactttgaaaccttggttgctggatgtgaagttgcatctactaagattggtgatataatctctctggatggtgggaatgatcagaaaatcaactctttctctcttattcctcatgaattttttgaggatatagagtctaaatggaaaggccgaataaaaagaatccacatagatgatgtatttactgctgtggaaaaagcagctgaagccttgcatatagcagtcactgaagattttgttcctattctttctagaataaaggctactgtatccccacttggaggtcctaagggagagatatcttatgctcgggagcatgaggcagtttggttcaaaggcaaacgctttactccgaatttgtgggctggtagccctggagaggaacaaattaaacagcttagccatgctttagattctaaaggaaaaaaggcaggggaggaatggtttaccacactaaaggtggaggctgcattaacaaggtaccatgaagcaaatggcaaggcaaaagaaagagttttggaaattttaaggggacttgctgctgaattgcaatacaatataaacatccttgtcttttcttccacgttgcttgttattgccaaagctttatttgctcatgcaagtgatatttattttgcggttcattga

SEQ ID NO: 26076 - DNA, 237 bp, Glycine max
  Peptide Sequence Number=SeqID_142854
atggatacttaccagggtaaagctgttggtctagatgatatccctgttgaagtttggatgtggatgggagaacaaggtttcatttggctccctatgcttttcaatgagattttgagatctaagaagatgccagatgagtggaggaagtctttcgctgggcatcctcagccaatgcaacttgatgaacaagttcttctcaatgtcgtacttgctgctcttcatgctgagctgagctga

SEQ ID NO: 26077 - DNA, 1038 bp, Glycine max
  Peptide Sequence Number=SeqID_142855
atggcaccccataacatggtacctacaatgtcatatgcggaggcggtggctacacgcatagagaacacaggacaacgaaggaacacaacgatctccctagccaggtatgggggatcacactcatcggtccaactcaagatcctggcgggggagaaaaaatggtacaccgacgcatgggtgggaaggttgaagaaacaagagattttcgaaagagtcgacgacgaaatcccatggatcttaggttcgaacgtggtgcctaagtacctaggagactacatggtcctccttcttaggctcttagatatcaaagcagaggagatgagcaatgaagaaaacaaccatggctcgtccctgttttactcgttagagaaatggaatccggcgatgaaaccgggaaacaggctggtctggattcaatgttggggcatcccaatagttgcatgggacattgggcacatttgcaaaatcgtggcagcaatgggagatttggtggaagtcgatgacgatgtagaagaattgcggaggctggacagggcaagggttctcatcaggaccccatggagaccaacaatccaacattcgatagatgttcacatcgacggggagatccacacagttcacattgtggaagaaaactcaagcgcagaaggtaagtgcactcaccagtgccgaagcaccccggggtcgtcggaagaaattgtttccgacgacagcgacaccggcacaccattgttgaggttgatcaacttttcgccaagaacaattgctagcgaacccaacaacgggatcattatcaacgagaacttgtcattacccagcggttatcgagacaatgtggacccaatgggtaaagaccgcggcaacttggcacactgccccatccatgtgacgtgtgaggcagaaatcgaaatggggaaagaagctgagcttgaatcaaggccattgtcagagacatctgcatgtagcggcgaaaaggaaacctacaatgtacaaacaaaagccaagcatggggacaaagggaaaaaagctatgaggtag

SEQ ID NO: 26078 - DNA, 366 bp, Glycine max
  Peptide Sequence Number=SeqID_142856
atggaacatacgaatttggggatcccacggtcatgtggctccgcatgccaccgggctcttgggtcacgaggaaacactgggtccaacaaaaataggagaaaatcactcaaagtgtatcaatctcacacagtgtgtggcgagaaagtcactagcgcacaggattttgtcggaaatcaaagggagaggaccactttaggtcgtgggctaggattgacattctcaccctgggtcaaggtttatgataagttgggattttggctcaaggcttgtagaacggctggtcatgatatatgtcagggtttggccagcggttcggggataaaggggatgtcctacattatttccatgatacacatgcaacaatga

SEQ ID NO: 26079 - DNA, 615 bp, Glycine max
  Peptide Sequence Number=SeqID_142857
atggcaaaatatcctagattgtaccaactttcaagccaacaacagcaactcatcaggcatatggggagccacaacaatgtaggttgggaatggaacttcagctggaggagacctctatttgataatgaagttgcaatggctgtagaatttctagaggagacagcacagctaacaatacaccaaaatagagtagatttgtgggtacagaaggctgatccgagtgggaattattcaacaaaaagcacgtatgagctattatcgggagcaacaatgggggaaaatgaggatgggacttttgtggaactatggaaacttaagatcccacccaaagcagcaatatttgcatggaggctcatcagagatcgactaccaacgaaggccaatttgcaaaggagacaagtggagataactaacacattgtgcccattgtgcaacaataaggaggaggacgcagcccacttattctttaattgcagcaaaaccctcccattatggtgggaatcattgtcttgggtgaatacaatggacgctttcccacaaaacgtgaaggaccattttctgcaacacagcagtgggattgctgatggaattaaagccacaagatggaagtgctag

SEQ ID NO: 26080 - DNA, 537 bp, Glycine max
  Peptide Sequence Number=SeqID_142858
atggcggattttcatggcggtttttcgaaaaaacgccaccgaatagcggtggcgtggcgggtttgggatggcggcgccatggcggtcgtggcggttatggcggggtggcggaaaatggcgttttttttttgctttttgtccgcggtaggagttgggctgacccgactcaaccctacccgaacaaccttccatctaagagagaacccaaccgcgagcctcccctgcaccagccgcgtccctcccgcaccccacacgcgcaacgagccgcgacacccgcagccgcacgcgcacgcagctgcgacgacctccggcagcgacacaccggcacaaacggcggtgacgagctccggcaacgacgcacctgtcacgaacggcggcctgcagcgagaagttctcgcggagaagacgaagctgtcgcgaagaagaagaagacgcagattttttactttccgccatgaaccgccatccgccattaacaacattggactgaccttacccattgggtatagttctaaccattcaatttatggccaatga

SEQ ID NO: 26081 - DNA, 495 bp, Glycine max
  Peptide Sequence Number=SeqID_142859
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgcagtggcttggttaagggaaaccaccggagccgtagcgaaagcgagtcttcacagggcaattgtcactgcttatggacccgaacctgggtga

SEQ ID NO: 26082 - DNA, 261 bp, Glycine max
  Peptide Sequence Number=SeqID_142860
agtaaggctgcaagaaaggaagaggctgaagctcctgaagaaagtgaggaggtacaagccctaaaggcggagcttgaaagaccccgagcagtcaaagagaagttcaagtcaatgaccatcaaagtccgaaaagagtatgatgaactaagagacgtcggccaccaccaaagtcttggaatgagaaaccaagaggacccgaaaggaagaacacggtcggaacaagttccaaggagctttatggggcagcaacaacaagcttaa

SEQ ID NO: 26083 - DNA, 1118 bp, Glycine max
  Peptide Sequence Number=SeqID_142861
cttggtcgtcgggtggcattcgtcgagcagcacggcatgaccgacgccaatatgcgtgtgcgcgatgtggtgaaactggggcgcattccgcatcattcgccattctccaactggagcgcgcacgatgacgaaaccgtgacggccgctctgcagcgcgtggacatgctggagaaaagtgagcagggatggctgagtctctccggtggcgaacgtcagcgtgtgcacattgcccgcgcactggcgcaaacgccgagcgaaattctgctggacgaaccgaccaaccatctggatatccaccaccagatgcaattaatgcagctgatcagcgagttaccggttaccagcattgtcgccattcacgatctcaaccacgcatcgatgttctgtgattcgctgatcgtgatgcagaacggtcaaatcatcgcaaccggcacgccgcaggatatcctgaccgaggcgctgctttggcaggtattccggtttgttttcaacattggcttttacgcggtcgttccctttctggcgatattcttacgcgatgatatgttgctctccggcggcgttatcgggctgattctgggattacgcacgttctcccagcaggggatgtttctgctgggcggtgcgctctctgaccgttacggcgctaagatcattatcctgtgtggctgtctggtccggattgcgggttatctgttgctggcgctggggcaatcgctgtggccgatcattctgggtgcctgtctgacgggcatcggcggtgcgctgttttccccgtcaattgaagcgctgctggccaaagcgggaacgcaaagcgaggcgcaaggcaagcgcggccgcgcggagtggtttgcgctgtttgcggtgtgcggcgaactcggtgccgtactgggcccggtggctggcgcactgctgaccggattcggtttccgccaggtggcgctggcaggggccgcggtctttgtcatcgcgctgattgtgttgtacttttttctccctgctacaggtaacagcaaacaggcgctgaaaattgtcccctggtggatgaccttccgccagccgcgttttgtcgctttcatcgtggcttacagctcgtggcttttgagctacaaccagct

SEQ ID NO: 26084 - DNA, 207 bp, Glycine max
  Peptide Sequence Number=SeqID_142862
atgggcagttcagatagaatcgaactttcgattgattcgggtacttggaatcctatggatgaagacatggtttctctggatcctattgaatttcattccgaagaggaaccttataaagatcgtattgattcttatcaaagaaaaacgggattaactgaggctgttcaaacagtttatggggggcagtatgggatccgcagtaggtga

SEQ ID NO: 26085 - DNA, 354 bp, Glycine max
  Peptide Sequence Number=SeqID_142863
atgcatcttaaagaccttctcaaggaagggaaatatcctttttacttcttcttcttccttttaccttcttcactcattcatttggtgctttctttgcattcattcattctcatgagagaagaggtccaatgtgtccactttgatcgaggtgcaagtgttacggtgatgtacggagatcaatggatgtatgacagcataacgtctaaagaagttgatatgaatgaagaaaatgaaaaagaacctagtgtaaatgaagaaaatggagagaaagctagtgtgcatcaacatgttgattgttctaatacctttaatacttctaaggtgtttgctacccatgatgatgtgttgcattga

SEQ ID NO: 26086 - DNA, 213 bp, Glycine max
  Peptide Sequence Number=SeqID_142864
atgacaatcaattcatggggctctggacttgatgttggagaacgcacgaacaacgctaaccaatcaattcgtggggctccggactcgatgataagatttgatggtggaggatgcatgaacaacgctaggcaatcaattcgtggggctccggactcgatggtggaggacgcacgaacaacgctaggcaatcaattcgtggggctccggacttga

SEQ ID NO: 26087 - DNA, 537 bp, Glycine max
  Peptide Sequence Number=SeqID_142865
atgacggaaggggtcggcggtgctgggttatggccccgtgctaagtttcggattggttggccccctcctcccccccgtgatcagttttgttgccaggattttgccaacttttggcttgcgccccgttggctaagtctgtgcctcggtggtggatcatcatgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 26088 - DNA, 279 bp, Glycine max
  Peptide Sequence Number=SeqID_142866
atgtttatagatgggctgagaccacaaaccaagcaactgttcgatgcttcactagggggaaaaataaagttgaaaacccatgaagaggcaactgagctaattgagaatatgtcagccagcaatcatgccattctgcatgacagagttcatcaatccacaaagaaaagcttgttagaactatcatcacatgacgctttattggcacagaataagttgctttctaggcaacttgagattttaatagaaacacttggttacaggttgtaccatctgtggtga

SEQ ID NO: 26089 - DNA, 234 bp, Glycine max
  Peptide Sequence Number=SeqID_142867
atgtacaattcaacgtccgccaagaatgatgaccgatcgaggtctaaaaaagaagcatcaccgaatgacgccgatcgaacatttccttaccgacatcatgcatatttcatgatgagaatcatgaaactggccaaatacaggctagaggcccaagtggagaaggacgaaggcctaagtggagaaggacaaagcccccgagtggagaaggatgaaggcccaagtggagaaagatga

SEQ ID NO: 26090 - DNA, 891 bp, Glycine max
  Peptide Sequence Number=SeqID_142868
ggtggacccttgactactagtaccctcaccttcagaaggctacacgccctcgccttcagagggctacacgtcctcgccttcagagggatgcacgccctcgccttcagagggctccacgtcctccccttcaaaggactacatgtcctcaccttcagaggactacacatcctcaccttcagagaactacacgtcctcgcctttaaaggactacacgccctcaccatcagagggttacacgccatcaccttaagagggctacatgccctcgccttcagagagctacacgtcctcgccttcagaggctacacgtcctcgccttcagaggctacacggctacaggtcctcgccttcagaggactacatgtcctctccttcggagggctacacgccctcaccttcagagggctacacgtcctcgctttcagaggtctacacgtcctctccttcaaagggctacacgccctcatcttcagagggctgcacgccctcaccttcagaggactacaggtcctcgcctttagagaactgcacgccctcgccttcagagggttgcacaccctcgcctttagaaggctacacgccctcaccttcagaggactgcacgccctcgccttcagagggctacacgccctcgccttcagagggctacacgcccttgccttcagaggactacacgtcctcgccttcagaggactgcccaccctcgccttcagagggctgcacgccctcgccttcagagggctgcacgccctcgccttcagagggctacacgccttcgccttcagagggctacacgtcctcaccttcagaggattacacgtcgtcgccttcagagggctaaacgtcctcgcttttagagggctcaacatatgcgcctttagagaactcaag

SEQ ID NO: 26091 - DNA, 517 bp, Glycine max
  Peptide Sequence Number=SeqID_142869
gactacacgtcctccccatcattggactaccgtcctcgccttcaaaggactacgtgtcctcttcatcagaggtttacacgtcctcgccttcataggcctacacgtcctcgccttcagagggctacacctcctccccttaaaaggactactcatcctcacctttagaggactacatgacctcaccttcagaggactatacatcctcgcattcagagtgctacacgtcctccccttcaaaggattgcacgccgtcgccattagaggactacacgtcctcgcctttagagggcttcattccctcaccttcagaagacttcacgtcctctccttcagaggactacacgtcctcgcattcgaagggttacacgtcctcgccttcagagggctacacgtcctctccttcagtgggctacatgtcctcgccttcagagggctacacgtcctctccttcagagcactacacgtcctcgccttcagagggctacacgtcctcgccttcagaggcctacacgtcctc

SEQ ID NO: 26092 - DNA, 639 bp, Glycine max
  Peptide Sequence Number=SeqID_142870
atggagaggaactttctgaatagaagttatcctcccatgggaggaaggtttagaaattcgggagacctgctacagagattgaagggagaggtaaccatcaccctcaatgatgtggcctttttgcttcatctgctcatcacaagcgcctttcatagcttcaaggctcttcatgttgacgaagtgatgttgctgttagtggaattacttgagcattgtccatctattgcagaggctattactactaaagactatcatgaaaggaaaccgcgtgaccaccatgcagttaaagattttgagctcatttcttgtttttctggacatatccgatggggtctcgttgttgtcatacaccaaccagagagagttgtgtggcagtttgggtatgttcaaaccattcctccacactctccaggttcaagattatgcttagaagatattgacgacagatggatgcacttctttgagtaccttacactagtgggtcagatttgtgttgtgcctagacaatgtgcattagactacatcaactggttctacatgatttcgcatcccttcatgaggtcggcacaacccgaggatccagccagacattcatctatcctgcaagatgacacatatgtcaaaccagatatgccttag

SEQ ID NO: 26093 - DNA, 580 bp, Glycine max
  Peptide Sequence Number=SeqID_142871
atgaatatcttgatagcacacgatcaaaggtgggagcaggagttaagtctttacaatcaatatgaaaaagaaagaactcataatcttgaaagtgtgtttgaggaattcatggcatatcatgctagctcaaaagccaatcaaaattcaatgaaaaataatgaaattcattttggcaagagctactcaatagaaaactttcaagggggactagagttacaacattactatcaaaacaaagcagaaagaggatccaatctagataaattgttgatgcaattcatggaaacaactaaatcaactcaacaagcactccaaagtgtagaaatccaggttggtgagctggcaaaagcagtaactcaatttatggtcagacaaaaaaaatcctttgtagagattgaagctcaaaagaaaagccctgtaaaagagcatgagtcaagagaaaaagatgatgagaaagatgaggaacaagcacaacaacaatgggagaagtactcaattgtagaaaaccaacaagaaaatattctccaaaccaataaccttcctaatcaactgattgacaagaaaggaaggcaagaagaac

SEQ ID NO: 26094 - DNA, 174 bp, Glycine max
  Peptide Sequence Number=SeqID_142872
atgacttcaaaagaattgaacgaggagccatatgaagtgaaaatctcatgtacgtttcgtaagggaactggagcaggctaccatgagacaaaagattttctttctaaagaaattcgattcggaactacgatatgtccaaggtccaatatggaaagaattcagaggtttccttga

SEQ ID NO: 26095 - DNA, 213 bp, Glycine max
  Peptide Sequence Number=SeqID_142873
atgagcatgatgggagaacttaagttctttctagggcttcaaatcaaacaagacaacaaaagtatctacattcatcaacaaaattatactaaggaacttctgaagaagtttaaaatggaagatgctaagcttatgaaaactccaatgcatgcttccaatcttctaagcaaagacgaatcagatttcagtttgatcctcgagaatcacatctaa

SEQ ID NO: 26096 - DNA, 150 bp, Glycine max
  Peptide Sequence Number=SeqID_142874
atgctgaattctaggaggacattgccaggaggcagtggactcaacttgcaacacccatggctaaggacaagcactcctgggtgcggggccaatgtgatggaagcttgcctgtggagcttttatggaggctggatctatgagcttcaatga

SEQ ID NO: 26097 - DNA, 276 bp, Glycine max
  Peptide Sequence Number=SeqID_142875
atggcgctagtgttcatcgctttagaactgtcattccctaatttcggccagggacgatcatttgcaaatgtttggatttttgccagccaaattgagctgcttaacaccaattgtcatgcaatccataaggctagcctctggctcgcctgggccaccataaaccttagggtcgaagtaaccagctcgcctgggcgagcaaggttgcttttggaggaagcaagcagctcgcctgggcgagctgttgtgcaacctccacccctcatttcctataaatag

SEQ ID NO: 26098 - DNA, 345 bp, Glycine max
  Peptide Sequence Number=SeqID_142876
atggcagaaatcaaccaaggtaagacgatgaccggtcacgattggtcgcatatcatttggctcttacttgcaggttcaagtgggaaaacgctaacccataaggaaggaggggacatggttaatgttcccctcaaaaaaaaatgtggcaggttagctcgcctgggcgagcaacccctgcattcaaaatataaaaacgagggaggggaacatttttgcatccaaacccccccccccccctcattcaaaagagaggacttacaaaggcttgcggttcttgctccctcaagccacttttggttgccttttgctttcatttttggtgttattgttcactccaacaagtaa

SEQ ID NO: 26099 - DNA, 504 bp, Glycine max
  Peptide Sequence Number=SeqID_142877
atgtctttctggagacaccaccactcattcagtaagaggagcagtatccctcatattctcttttctgcaggacgtgcacggatcctcaggagcttgcttccaagctctgtattccaagggacacacaaggcacgggctcaaggatctgagggtccatctgctcctgctcctgcttctacctctactccaactccctctacttcagcaccaccactaccatcagctctagttcagaccagcacctccgctcagagctcagacctcacagtactgatgctgcaaagcctccaccatgacttatgcctgccttctccttcggggggaggtgaggcttccacagcccaggagcctcagccagagctagaggtcacaagcgaggccacactagagacaactccacaggtttcacctgctacttcacctattatggatgtcgttgagggtgaagaaggcatcgaggacacagactatgcagtagatttacaggtggtgcagagtacctag

SEQ ID NO: 26100 - DNA, 336 bp, Glycine max
  Peptide Sequence Number=SeqID_142878
atggaggttaagtacctcgaggcagtcaaacgaaggttgcatgccaccaaacaatggtccccggacgaaattagggtctatgggataaagatggtcattgaccaacctctcttctatgatttgagccaattgtctagcaaaggtgtaccatttgaaggtacactggatgatgattggaaatttgatttttctgtgcatgatgcacgccggttagtttgcactaacctagcggatatgaccggaaggctgcttgccggttcattggctcttgaaagctgcatccttcactatcttattgttcgtatcttactcccaagatcttcaaaccttgcacag

SEQ ID NO: 26101 - DNA, 243 bp, Glycine max
  Peptide Sequence Number=SeqID_142879
atggcgaaatggtgcggaatgatcataatttgtctctacatgtcatcgggctcgccgtctcttgatgacaaaaggcgcagaatgaccataatttgtctctgcgtgccatcggacacaatcgtctccagatggcgaaaagggggctcgccgcctctggatgacaaaaggcgcataatgactataatttgtctctgcgtgccatttgacacgatcgtctccggatggcgaaaaggtgcggaatga

SEQ ID NO: 26102 - DNA, 252 bp, Glycine max
  Peptide Sequence Number=SeqID_142880
atgtcatttgggctgaagaatgctggggcaacataccagcgggccatggtgacattattccacgacatgatgcataaagagatcgaggtctatgtggatgacatgatcgccaaatcaaggatggaggaggaacacctagtcaatttgcggaagttgctcgggcgactgcgtaaatacatgttaaggctgaatcctgcaaagtgtacgttcggggtaaaatctggaaaattgcttggctttgtcgttagctag

SEQ ID NO: 26103 - DNA, 246 bp, Glycine max
  Peptide Sequence Number=SeqID_142881
atggcaagtggaagcgaagcatctgtgtatgaagagttcattctcaagattgacacaaatttggttcacactaagaatgaagtcaccatccacattgagcatttgttcgatgttttggttgtggaaggtattgggttgaacctcaatgaggccatgctctgttgtgttgagttcaaaactacctatgccatagtctccactgttcttggcaagaaaatgactttatccatggagatcatcgcttaa

SEQ ID NO: 26104 - DNA, 420 bp, Glycine max
  Peptide Sequence Number=SeqID_142882
atggctaagaccatacttaatgataattcttcccctaagaatttttgggttgaagacaacttgggaaagtttgcctctaagtgtgataatggaatatttctttggtactctgaaacattgaagacatatagggtatatgagtctagaaccttaatagtagaagaagttatccatgtgaagtttaataacaccaacgctgataaggaattattagaggcagatgagtcctttgcatatctaagactagacgatggaatcaaaaactttgtgtcgtccagttacaacacaaaaattgcagcatccaatccaccattggatagtcctcaagaagagataagggaaccaactggacacaatatgagaaagaaccatccagaaagccaaatcattggtgatctaacaaaacaaattccaaactag

SEQ ID NO: 26105 - DNA, 471 bp, Glycine max
  Peptide Sequence Number=SeqID_142883
atggagttcactcttcagtgggaaaaagactttgaagatgacaaattcatctctaggctaaataaacttcctatcatcttcaacaacattgtctatgatctaacaaagatggataagagagggacttcaaggatcatgtggtgcaacttcatgaaaagtagctctactgaaaaggaagcaagagttaagaagcaagtagtggacaataccaccaatattattaaggtctttatggatctcactatctctggtgcaatgcatgaagttgaagaacaagtaacatccccttttaagtccaatgcaatcaaggatgataaggttaatccaacatgtcaacctaagcatgcgtccaagcaagctgacacctcaaatgatgcctcttcattgcaaaacgaggttcctaatgttgtttttgtcttttgtagcaacttagatgttgcttcatctagctcatgtccaagcaatgcttga

SEQ ID NO: 26106 - DNA, 468 bp, Glycine max
  Peptide Sequence Number=SeqID_142884
atgcaaagcttgcaggaactagttcagcagagaccaattatgagtgtagagaagtttattgagaaggtggcatggccaggagcccgaccttcttttgtgggggataatgaaagttttacagcccaggcacctcaacaacatgagctagaaccagaaaatgatcactcatctgaagccaccatctctggagctgttgattttaaaaaaagaagattagagacaagatccaatgaggctgctcatcatggaccagtgccagcgtcagctgatgcaccatttctaggagttgatccatcttcacctcaacacgtagcagactcttcaattcctatcttagagatacatgagggccagaccataccagtcctgcctttggacacttctcttccagctactctagtatggcatctaacaaatgagaaggatgttcagatagaggacaatcaagaccagtcacaggaattttaa

SEQ ID NO: 26107 - DNA, 180 bp, Glycine max
  Peptide Sequence Number=SeqID_142885
atgaggaagagcacagttgaattcaaaggtctcccacaccaagcctgcttaggttgtgaattgacgaccatcaattatatgtccattaatgtaaatgtatgtcatatgagtagtatgggacagaaaatcaaagatgagttgggcacggatgcacgattcgttttgttagctaggttgtga

SEQ ID NO: 26108 - DNA, 339 bp, Glycine max
  Peptide Sequence Number=SeqID_142886
gagggtgttgaggctttggccgaagaagttccaacaaaggctgcttcttctaggagttcatctaaaagatcaagagctgctgaagttcataatttgtctgagaagcgaagaaggagtaggatcaacgagaaaatgaaggctttgcaaaacctaattccaaattctaacaagacagataaggcttcaatgctcgatgaagctattgaataccttaaacagcttcagctccaagtacagtatgtatgggaaactgcagaatataggaaatttgagaaaatcctagctggaactgttgttgtcttgacgccaagaaatgagcccgacttaacctcccggtaa

SEQ ID NO: 26109 - DNA, 579 bp, Glycine max
  Peptide Sequence Number=SeqID_142887
atgggtgacatgtaccactttgacaagaacctctcttcgcaagacgaaatctcactttttctgcgtcagattctgctccgttcatcaccaccttcttcttcttcatcttcccgccccatgcctactgtatcctgcacctctaacgttgctcaccaaaacgtaaatgcacacccttctttcacagcgtcgcagctccaagatgggaagatcttggcccttgattccaccgcttcttttgcctcgggttctgccgcttgcagccccttcaagggccagggtgcttctgctgcaaatgtgtcttcttcgtctgctggagtgagtgagaacaaaaatgatgactatgattgtgaaagtgagagacatcaacatacaccaacaacaaccaccacagtaggcatcaacaacccgagttcactacgccaaaccaccactaactaccatgcaaccaaacctaaccaccaccatcaatccaccactgcacaaccaaacccttacaacaccactgcatcgaagcccgagggcatggtcctcaacaccattgttttcatgaggcacaaatctactgtgtgtggcctttga

SEQ ID NO: 26110 - DNA, 181 bp, Glycine max
  Peptide Sequence Number=SeqID_142888
aaggacaaccattagtggttaaagagaagtgtaaggaggtaagtgtttcctccaagagacactttgctagcattgccacacctcttgggcttgagtttattcctcaagtaaagaagttgttggatgaggggtttggttcgcaagagcttaaatccttgtgcttttttggtgcccaaaatag

SEQ ID NO: 26111 - DNA, 183 bp, Glycine max
  Peptide Sequence Number=SeqID_142889
atgtctaaacatgcgcccaccaagtgctcggtgaaatgccccaatgacggacagcataggagattcaaaataggtgcccaaatgcaattccaagcttatgaacccaaacttgtagcttcaatgcaaggaaacatactcatggctaagaacccaaattttggttttagaattagaaaagcatga

SEQ ID NO: 26112 - DNA, 417 bp, Glycine max
  Peptide Sequence Number=SeqID_142890
atgaagggtttagatgctgtaggatattggtggcaaaggatcagggtggctgtagaggccaataaactgctgaagtataatcctaccattggtgtagaagttgtgattggagggacaagacttgctttagaacagaaacggatgcagccaaacccttgccaggtattgaggctggtgatcatatctgggcttcaagttgagggcttcaaatcatggttgttggacacgtggagtgcttgcactcacaagaagaaagtgatggcatcatcactcatggctttctggaatctatcttctaaaatagacaagttcgaggcatcaacactcatcagcactcacgtagttccttttcttctactaggagtggagtatggccacctaattgttggaaacttcatatgtctgtcaactttttag

SEQ ID NO: 26113 - DNA, 1222 bp, Glycine max
  Peptide Sequence Number=SeqID_142891
tatagagcaaatgaaggtcgatatggagaccatgaaggagcagatgacaatgatgatggaagcaataataagcatgaggaagatgatggaggtcaatgttgctacaactgttgttgctagtactactattgagagggacctgattcacacgcccgatttcaatcaagagagtcatccagtctcagatgtagtaggtcaaggaggtgaggcggtggcaaatggatatgggcctcattatgtccagctccagagcaagtcttcctttccaccatatggtttgcctcccaattatacactgcctattgttgtatacgctcctagtgagaatatcaataatttggtacccgtattcattgagaatcaacaacaccaatcagatcatactcatgcctatgtctctcaacccatgggggaaacacatgaagctccccaagaccacactctgacgaatttcaaggtttatctgggatataccactgaagggcatgcgttttctaatgtccccatgccaaacgctccggggggccctcagtatcgactaccatcacaaaccttacattttgtgatgggaggagggcctcctactatatttgaggaagaaaaattggatcaaatagaggagaggctgagggcattgaaggaggaggagattatggctttgctgacatatcagaattgtgcttggtatccgacgaagatggaggcatatgcgaaagatgaaaagttactgatgcagttcttccagaagagtctcgctggggaagctattacctgctacaaaacatgtgcaagagagataatgaatcattcaaagaatatgctcaaaggttacatgccttcaagttttgcaaatttagtgtttactggcaagaggatcgaagtgggtctgagaagaggaaaatttgattatgctgattgtgcgaattctagtaatagaagactagagatgagtggagggaaggagaaggagggagaagcccatgttgtgactattgttcctacaaggctaaattttccattagccccttataatcccatgtaccaatatgctacccagctatatcactactcagccaatatcagttttgcccattacccaccattctaccaaccaagaacacccaatcaaccacaaaggccacccgtaaatcgacttcaaaatccacctgctgctcagccaagaccaaacaccacccctaataccaaccaaaacaccaactag

SEQ ID NO: 26114 - DNA, 279 bp, Glycine max
  Peptide Sequence Number=SeqID_142892
atggggtcgaaccaagcaccctcttttaagaaaaggttctatcatgtcaaagccaagagcctagaggtagccagcttgcgagagctagggcagcagatggatcaagttcgacgtcaagccttccacaaaacatatgggaaaatctatgatttggctatgatagaagtttccattgaagtcattgcatcccttgctcaatactatgaccagctgctaaggtgcttcacatttggggactttcagttggtaccaaccattgaagagtttgaggggatctag

SEQ ID NO: 26115 - DNA, 586 bp, Glycine max
  Peptide Sequence Number=SeqID_142893
cataaatgagagttatgttgattcctcagggaacgatcgacacacgggtgactcaaacaaatgcgggttgtacatcaaagacaatcctccctgcctggtttccctaggaagactttatgagggatccacaaccgttcacaacattcatttgttgcatgatcaaatcaaggttggtgttgagggggttagagatgcagatgttctcattcctgtacccactaaagagggagttgtgggacccgtgaaacctgcagataggccggatcatgatgtcgatgatcctttatatctgatgacattgaccatcccacagctttttctgaagtcgttgcaggttatgtgggatgctactatgtttggggtgtttaatgagaacttccccttgtacataaagcatgaagatctgtctgaaatagcacacgatggtcaatgtctcagcatctctgttatacagttgtggattctgcatatgactgagacaagtatgcgagcagggaatgccgatgtgtatggattccatgagccacagttcatccagagatctggacaatcgcaatttgaatcagaaagttacatcaagaactga

SEQ ID NO: 26116 - DNA, 1173 bp, Glycine max
  Peptide Sequence Number=SeqID_142894
atggatttcggtggccatcccggtgtctttaccgttgccggcgaagaagttggcgacctgatccggtttctcgtcgagcgctttattgagcttggtgctgtcgacttcaagcttgccggttttgggattggtagagatcccgaggttgccaaggcctttcagctccgggttgtcctgagcggcgctgagcgcgcttttaatcgaggactgaatgccacgcagggtgttatcgcccagcagcgcgccgttcttggcgctttgcgcttcaccgcttttcaccggggtatatttggtcagcgagccgaaggtgtcgagcagcgaattgtagttatcgacccactctttgattttgtcggcggtgccgcttttatcgatgccgatcaccaggttttgcggttcgccggctttggtggtggttttcaggtcgatggtgacgccctgcagcgcatcggcaatcgagttggtgctgcgcttaattttggtgccgttgacgataatctccgcatcctgtccggcaacggtctgtttcatcgcgccgctgttgctgctgctgtcgtaattgaggatggcgccgagcttatcgtcgttattcacctgcaccgacacggtgtttttctcgccggtgctggtggagctcagcgccagctgatagtcattgtcgccgacgcgcatgatactggcggtgacgccggatttcgatttattgatggcgtcgcgcatctcgaccaagatggaacgatcgctgctgcccggcgtgcccagtttggcctgctggtcggcaatcggcgtctgagtggtcagcgtttgcggctgcgccagtttcaacacctcgatcgagtagttgcccggcaccgatttgtcggtggtggtcacggtaaactgatcgtgcttggtggcggtagtgttgttgaagaactctggcttggccaggtctttgctcagattgtcaaacttctccagcgagcttttcagcgtaccgtaagcggtcaactgggcgttatagctggtctgctgggtggtgtacggcgtcagacgctgttgttccgctttggtcagcttgtccagcaaaccgttaagaggatacgtcgataccagaagggacggtggttgacgccgtgggcaaacaagcccgaaccttttaaccacgttgcacagaacgcaactgactcgtaa

SEQ ID NO: 26117 - DNA, 276 bp, Glycine max
  Peptide Sequence Number=SeqID_142895
atgaacatacagatcaacaatccgtatggttcatacggatcatcaatccatacggtctatacggattgccaatccatattgccaatccgtatggtcatacggattgttgatctatatgaaccatacagattgctgatccgtatgttcctaagttttttcgcatacttcttcttcttctccgctgctgggtgccccagcaaaaatgctgggtgccccaagcaacagcctaaaaaggatgaagggtgtctacaatgggaaagtaacactgaccattag

SEQ ID NO: 26118 - DNA, 300 bp, Glycine max
  Peptide Sequence Number=SeqID_142896
atggaaatttttttccaacttaactcgtgtgactcagtccagactcgcgagtttacacgagtctacccgagtccaccgagtctgcccaaaaacgagtttgcttccgagtcgaatcgtagggaccaagaccgtcgtagaatgcattgcattctaagacggtctgtcacaacgtgcccttcgtgggcgagtgagggcgaggcttacgggtgcgctttccaaaggaggaaagatgcgcagagtcaccaccaacgtttatttgtgggaaacgttggaaaaaccgaaggaaaccggtcaaaatga

SEQ ID NO: 26119 - DNA, 258 bp, Glycine max
  Peptide Sequence Number=SeqID_142897
atgccactctggtttagggatttgctttgtgctcgtgcattttgtgtttctccctcagagcctcagacgataggagagttggagctacttagtgctcagagcctcaaacgacacgagagtaaaaatgcatgtattgatgcaatcctccttaggaagggactagtcactagagccatgagcaagaggctccaagaggattgggctaaagctgctgaagaaggccctagggttctcatgaacctcagggtagatttctaa

SEQ ID NO: 26120 - DNA, 330 bp, Glycine max
  Peptide Sequence Number=SeqID_142898
atgagtcctaaaaatgacataaatatcgttggaaatcgtgaagagattccaaaagcaattgattgcttaaagaaagagtttgagatgaaggatctaggaaggacaaaattctggttgggattacaaattgagtatttaaatagtggagtttttgtgcatcaagagacttatataacaaaggttcttaaaaggttctatatggacaaatcacatccattatgcactccaatggttctaaggtctttagatatggataaagatccttttagacaacaagaaaaagatgaagaacaacttggccttgaagtatcatatcttactgctatatga

SEQ ID NO: 26121 - DNA, 273 bp, Glycine max
  Peptide Sequence Number=SeqID_142899
atgaatgaccttgtgtctgagtaccagcagtaccaggacgccactgctgaggacgaaggggagtacgaggatgaggaggaagaggatggtgaagcagacgacccatatgtgaagagactaaaatgtgaagatgccttgtgtctttacttatgctatgtgatgctgagagtggagtttgggacctttgggtacatgttatgcggcacctatcgagcaacaaagattccaatgcaattagaatgcagaaggaaactgctacccggtgagaattaa

SEQ ID NO: 26122 - DNA, 585 bp, Glycine max
  Peptide Sequence Number=SeqID_142900
atgtcctcaccttcagagggctacatgtcctcgccatcagaggagttcatatcctcgtcatcagagggctacacgccctcaccttgggtactagttaccctcaccgttaagaggactacacgtcctcgccttgagaggactacatgtcctcaccttcagaggactacacgtcctcgccttgagaggactacacatcctcgccaacagagggctgcacgccctcaccttcagaggaccacatgtcctcgccttgagagggctacacgccctcaccttggagggctgcacgccctcacctccagaggactacatgtcctcgccttgagagggctacacgccctcaccttgggtactagttaccttcaccttcagaggactacacgtcctcgccttcaaaggatcatgtaccttcaacttcagaggactacacgtcctcgccgtcaaagggtcatgtgccttcacctttgtagggcatgccctcaccttcagaggattgcacgtccttgccatcataggactacactccctcgccttcgaaaggtgacacgtcctgaacttcagagggctacacgccctcgcctttag

SEQ ID NO: 26123 - DNA, 858 bp, Glycine max
  Peptide Sequence Number=SeqID_142901
tcaatctcatgctttctcacaagggtggacctttgggtactactaccctcaccttcagagggctgcacgcccttgccttcagaggtctacacgccctcgccttcagagggctacacgcccttgccttcagaggactacacgtcctcgccttcagaggactgcacgccctcaccttcagaggactacacgtcctcaccttcagagggctacacatcctcgccatcagagggctgcatgccctcgccttcagaggactacacgtccttgccttcagagggctgcacgccctcgccttcagagggctacatgccctcaccttcagaggactacacgtcctcgccttcagagggctgcacaccctcgccttcaaagggctactcaccctccctttcagaggactacacgtcctcgccatcagagggctgcacgtcctcaccttcagagggctacaagcccttgccttcagagggctacacatacttaccttcagagggctacacaccctcgtcttcagaggactactcgtcctcgcctttagtgggctacacgctctcaccttcagagggctacacaatctcaccttcagaggactacacgtcctcgccatcagagggactacacgtcctcgccttcagtgggctacatgccctgatgagggcaaggacccacttgaaggacttggaggacctatgacaagggctagagcaaggaaagccaaggaagctcttcaacaagtgttgtccatactatttgaatacaagcccaagtttcaaggagaaaagtccaagggcccaattggcaacctaagcatcagccttttgggagaccaaatgggggctgacttgatggctgttgggg

SEQ ID NO: 26124 - DNA, 171 bp, Glycine max
  Peptide Sequence Number=SeqID_142902
atggagaatgcctgcgctgacaaaaaagaagaaatagcagaagaaaacactgcaaacccaagaaagattaggcttgaggcagtaaagaccatgagattcatgtcctacgccaatcgtctgacccgtaccatgttcctgtatgacaaaggagttagcatcaaatgttactga

SEQ ID NO: 26125 - DNA, 332 bp, Glycine max
  Peptide Sequence Number=SeqID_142903
tccatgatgattggatgtggaattacctggattttgtggaagcttgggaggatttatggggacccgacgttgagaggaacgaggataagggctacgtgggagtgcgtgagctcagttggaggtgggcaacaggggatggtgggttatacgtgatttgtggatgtggagaatcgttttgcaccatcgcccgaccgccacctaagtggtaccctggagatatgtcgcgggggtcaggagaccttggggacgtcaggcgagctcctggcaatcaaccgataaaagaacaaagaccacaaagcagggaggcttgtgtggtggctggccagcaatga

SEQ ID NO: 26126 - DNA, 831 bp, Glycine max
  Peptide Sequence Number=SeqID_142904
atggccaaagaaacattccccatagaactaatagtagaaattctgtcatggcttcccgtgaagcctttgatccgattcaggtgtgtttccaagacttggaaatccctaatctcccatccaatcatggttaaattgcacctccaaaggtcgtccaaaaacccccacgtcctattaacatttgaggacaacaacaggaacaacgataactgttattccttcgctgcaacctgctctatacgtcgtttacttgagaatccatcatccactgttgacgatggttgctaccaattcaacgacaagaatcactttgtcgttggtgtctgtaatggcttggtttgcttgcttaattctcttgatagggatgactatgaggaatactgggtccgattttggaacccggccacaaggactatgtccgaagattcgccacgcttaagtctccattggcgcaaatataaaactgggcggaatgattgggtctgtgggtatccaaggtgtgggtttggctacgacggtttaagtgacacttacaaggtggtgataatcctttcgaatgttaaactacagagaacagaagtgagagttcacagcgtgggtgatactcgttggagaaagactttaacttgtcctgttttcccgtttatggaacaacttgatggaaagtttgtgggtggcactgttaactggttagcactccatatgtcgagttcttattatcgatgggaagatgttaatgttaatgagattgtgattttttcgtatgatctaaagacccagacatacaaatatttgttgttgcctgatggtcttgcaagaggttgcttggggtga

SEQ ID NO: 26127 - DNA, 165 bp, Glycine max
  Peptide Sequence Number=SeqID_142905
atgaaacgaagcaagagagaaagagaaggtgttgagcttgataatcctaaagaaaactgctcacgcgatcgagcctttgtcttcagtgagagagcaagagaaggtggcgacatgcagcggccaaaatcccttttatgggctgagttgcacaagctgaaagcttga

SEQ ID NO: 26128 - DNA, 165 bp, Glycine max
  Peptide Sequence Number=SeqID_142906
gaattggagtatggtaaaaaagttagccatggagaaatatggatagcaacacatgaacatgctaatggagaatttgtgaatatccttaggattgggacatgttcgggggttaggattgggaccttgttcatctcgggtgtttggacacgctgtacgattgtatag

SEQ ID NO: 26129 - DNA, 300 bp, Glycine max
  Peptide Sequence Number=SeqID_142907
atggcaatggcaatggcaatggcaatggcaatggcaatggcaatggcaatcacggcacgagcgctcgccgtcaactatggcctggtaggctatcagtctctgccgccgggaatcgctaagaaagtggcgcgtgggaaagcattgccgccgggcatcgctaagaaaaatttgccagcatcgatgataaatgcgctgcctcattaccccggctacgagtggcgcgcggtgggagatgatttagtgcttattgcgttgagcacagcagttgtgaccgccgtgattaacggtgtgttcaactaa

SEQ ID NO: 26130 - DNA, 213 bp, Glycine max
  Peptide Sequence Number=SeqID_142908
atggagaaagaagggggtggtttagaatccttaattatccacggtcaatacattgatgatgcacatgtttcatacttcatgctgtatagaaataggaaaatacttatacttggtggcatgtcactcaattttgaactcccttgtgactcggctgatcaccatgggagggagttgcatgtgcacgacagggtgacctcgacacttgctgcttag

SEQ ID NO: 26131 - DNA, 294 bp, Glycine max
  Peptide Sequence Number=SeqID_142909
atggaccatgaaacatttctctatcaaacaaaatactgcaaggaacttctcaagaagtttgacatggagaaaatcaaggaggttacaactcctatggctactaattgctacctgtcgcaacctacccttcggcgggagggcaacttgagggctcacgagtgcgtcttccaagggaggaaaatgcgcggagtcgccaccaatgtttatttgaggaaaacgttggaaaaaccgaaaagggtgtttccctcgctcctacgtatcctcaattgcgatgaggaaataagacctatgtag

SEQ ID NO: 26132 - DNA, 1062 bp, Glycine max
  Peptide Sequence Number=SeqID_142910
atggtggttgttatccaaatcttcatggcaagggagcttttcaatctactcaggagagctcatgaagataggcagctgccaggatttaggctattaaattggcattttttcttcactgcaatgttatttgtttatggacggattctgagtcaacgcctggttaacacagtaacttcagacatggttttatatcggctagtgagcaatcttattaagtatcatatggttatctgctactccctatacattgctggatttatgtggttcattctcacattgaagaagaagatgtacaagtaccaatttggccagtatgcttggacacacatgattctaattgttgtatttggccagtcctccttcactgtggcaagcatttttgaagggattttctggtttcttctcccagcaacacttattgtcattaatgacattgctgcttatatctttggtttcttctttggaagaacccctttgattaagttatctccaaagaaaacttgggagggttttattggggcatccgttaccaccatcatctctgcatttatgcttgctaacatcatgggtcgttctcagtggctaacgtgtccaaggaaggatttgtcaactggttggcttcactgtgatcctggtccactgtttaagccggaatcttatcccttacaaggatggatttcccactggtttgcttggaaagagatatcaatcctaccaattcaatggcattctttatgtcttggcttgtttgcttcaattattgcaccttttggaggcttctttgcaagtggttttaaaagggcttttaaaataaaggattttggtgatagtattccaggacatggtggaattaccgacagaatggattgccagatggttatggcggtgtttgcatatatatatcatcaatcatttgttgtgccgcaaactctctcagttgaaatgattttggaccagggggaaaggaaaagatactctgtacatgcgttttctatcttttgggtgagacgattcaaaggttcagaagctgtcaagatgtgcatagtgtatgttgaccgttag

SEQ ID NO: 26133 - DNA, 405 bp, Glycine max
  Peptide Sequence Number=SeqID_142911
atggaggggactgttttcactcctgcacttgaaggaattaagcttgtaaaatcagagcaaggagaaattttgacccagcctttcttggatgcttgcaagcatatactgcctgttatagacaagtttggagctgctatggcccttgttaaatctgacatcggtggtaacatatcgagattggaatctaagtattcctccaatccaaccaaattcaactacctgtacagtttggtacaagtagaggttgaaactaaaacggctaagtcatcatccagttgtaccaatggacttctttggcttacaaggtgtagcatgataattgataatgataggtacgggaaacttaagaaagaaagcacaaaggttcttccaacgacctccttccttcaacgccttaccacttaa

SEQ ID NO: 26134 - DNA, 2277 bp, Glycine max
  Peptide Sequence Number=SeqID_142912
atggctcccaccccttcttcgaaacaaaaccaccccactcaattgaagactccacagtccaagcaccgtctcaacttcaatggcctcaaatcagcaccttctccgaaccctaattctgttgcaaacaaggaacccccacctgaacacccaattgaagtcattgccagaatccgtgactacccagatcgaaaggacaagcctttgtccgttcttcaaaccaattccaactctagttccattcgggttcgtgccgattttgggtaccgggacttcacccttgatggggtatccgtgtctgaggaggaggacttggatgtgttctataagaagtttgttgagtcaaggatccatggggttaagctgggggacaagtgcaccatcatgatgtatgggccaactggttctgggaagagtcacaccatgttcgggtcgtcgaagcaggcagggattgtgtataggtctctgagggacattcttggagatggggatagtgcagatggagattctgggggtgggttggggacttttgttcaagtcactgttttggagatttacaatgaggagatttatgatctcttgtccaccaatggaggaggtgggggaggaggatttggatttggctggcctaaggggggtagtgcttcaaaggtgaaacttgaagtgatggggaaaaaggcaaagaatgcaacctatatatctggaaatgaagcagggaagatctcaaaagaaattcagaaagtggagaagcgaaggattgttaaaagcacactttgtaatgacagaagttccagaagtcactgcatggtaatccttgatgttccaactgtgggagggcggctaatgcttgtagacatggcaggatcagaaaatattgaacaagccggtcaaactggatttgaggccaaaatgcagactgcaaaaatcaatcaaggaaatatagcgctgaagagagtggtggagtccattgcaaatggcgattcacatgtgccttttagggacagcaaacttaccatgcttctgcaggattcctttgaagatgataagtcaaaaattctaatgatactatgtgcaagtcctgatcctaaggagatacacaagacaatctctacacttgaatatggggcaaaagcaaaatgcatagtccgtggacctcatactccagtcaaggatgatgaatcttcttcagctgtcattttgggatcaagaattgctgcaatggatgaatttatcttgaagctacaaatggaaaccaagcaaagagagaaagaacggaacgaagcccacaaaaagcttttgaagaaagaagaagaaattgctgcgttaagagctaagctggacatggcagaaggcaaaggaactcctccaagcgaggaggaaattaacctgaaggtaaatgaacgaacccggcttctgagacaagagttggaaaagaagttggaagagtgccaaagaatgactaatgaatttgttgaattggagaggaagagaatggaagagaggatactgcagcagcaggaggaagttgaaactctgagaaggagactggaagagattgagttgcagctgtgttcaaagcaagggtgttgtgtggaaaatgagtcaaaagacatggagtcgagtgggtttatgagaaggttattgcgtgtttacaaaagtgaggatgatcctggaatggtgaagtcaatggatttggacatggatgatcaagaaccccttggccacgaggtaaatatcgttggtggagttatgagcaggagtgattacaatgttaagcaggacttatcaaatcaaccttgtccgaatgctttgactggtgtaaaagaagatgctcatgttttttcaccaaactttggccaaagggtgtgccttagtacagtatatgaggaagaaggagaaggagatgaagacaaaggggaagatgaggaagtggagaaaggagtgatagaggaaaagagggtatgtagtgttgacaagcctagtgctgcaggttccttgggaaccttaaacctgtctaacacaagtccaaacaaagaggaattttgtttcaaggtaagttcagtggataatgactctagactcctgagaattcaaaatatattcactctgtgtggcaaccaaagagagctctcccagcacattggaaccccagtacaacctacaaaaaagaggtctgatgaaacttttgaggtttctcctgccaagacaagtgacaaggattccgttttcaaaatttccaacaaggagaactttgaaccacataatgttctaggaaattag

SEQ ID NO: 26135 - DNA, 402 bp, Glycine max
  Peptide Sequence Number=SeqID_142913
atgacgtcaggtgtggtgaaaggccagatgaaaggcctcctcaaaggacttagatacatatcccagatatttgggaggaaggggaggagcgtaaattatgcaagaaaagaaatgggtccctttggcggcaacatatatgtgtggaagttggttggatgggtctttggtgtggtcttgggcctggaggatggagttatttcagtggaaagtgcaattggtggagactcttatgcttataaggtgctcatggaggacaaacaaagtagtaggaatcatggtcgtatgatctggatgaaagtttcggataggggtggtttctttgaaggtggcagtctttgcatgaaagttgctacaaaaaatagattgcccacaaagaaaatctcaggcgtagagggatattga

SEQ ID NO: 26136 - DNA, 621 bp, Glycine max
  Peptide Sequence Number=SeqID_142914
atggctcgggggaatgggagtgtcgtccctacagacccgcaggcaatggcggttgtgaagaagaagacgcagtcttcgaggagttggattctgtttgaccccacaggacaaggctccttgctcgatgttgacaaatatgccatcatgcataggcatatcaaggcaattatctccgctgaagagccaccgtaccgtgttgcctctctgcaatctacagccaaaatgcctttcaagaggtacgttgagatcgggagggttgcccaaatcaactacggcaaggaatatggcaggctcgtcgtcattgtcgacgtcattgaccagaacagagctcttgtcgatgcccctgatatggtgaggtcccaagtcaatttcaaaaggctttccctaaccgatattaagattgacattaagagggtccctaagaagaaagatcttgtcaaagccatggaggatgctgatgttaagaccaagtgggagaagagttcatggggcaggaaactcattgtcagaaagagaagggcatccctcaatgattttgataggttcaagataatgttggccaagatcaagaaggcagcggttgtaaggcaagagcttgctaagctgagaaagagcgcttag

SEQ ID NO: 26137 - DNA, 552 bp, Glycine max
  Peptide Sequence Number=SeqID_142915
atggaagacgaggaggatgaaaaggagatacaaatcgggttcccaacagacgtaaagcacttggcacacattggagctgaaaatgccaaagcaagtcaaccaagctggttggccgagttcaaagaatcatcagaagcttcatctggaacagtcgtaaaccccacgaaggccacaacagaagataataatagtgatgctaatagtaaaggggaagggaagcgaagccacaatcgaaagtcaaggcctcgttctacagagagccagtcctcgacgagccgagacatctccaacgccgaaggctccaagccgagccgacgacaccattcggaatcttctagaaggatgaatcgccacttgtcggaagaagagaaagagaaggctccgacaacaacaaaacattcgcagcgcaatagaaagagcaagatgacgtcgtccgaggagaaggacgagaaagaaggttcctcgaggagggctcccagatctcaaagacattccaagggagattccttaactgacttctccttctcggattctgggcctgggcccacttag

SEQ ID NO: 26138 - DNA, 495 bp, Glycine max
  Peptide Sequence Number=SeqID_142916
atgaaagcaataagtccctccttcctctgccttataattcttgtgacccttttggctggtagcattgaaagtgcaccagcaaacgtgaagccaagccattatgctgcacccttcaataggagtgtttttccttctggttttctatttggaataggctctgcagcttaccagatagaaggagcagcagctatagatggcagaggaccaagtatatgggacacctatactaaacagcaaccagggaagatttgggatcatagtgatggaagtctagcaattgatttttatcaccggtacaagagaattaaactgcatgcccgtacaatttcacagagcgacataaagatggtgaaagaagttgggttggattcatacagattttccatctcatggtccagaatattccccaagggcaagggagcagttaacaccttgggggtcaagcttaaagccatttgtcacgctgtttcattgggacctcccacaagctcttga

SEQ ID NO: 26139 - DNA, 537 bp, Glycine max
  Peptide Sequence Number=SeqID_142917
atggccttcctaccttctcacggtttcacgtttaacactactcatgaagaagatcactgccacttccctccaacctctctcgaccccttcccctctttgccaccccagcactttcaagggggtgcacctttcatgttgaagcggtccatgtcgttatcaggcatagagaacaagtgcaatgaagtacatggagatgatgagttatccgatgatggggtcttccagagtggggagaagaagaagaggttgaatttggaacaggtgaaggcccttgagaagagttttgatcaggggaacaaacttgagccagaaaggaaagtgcagttagctaaggctttggggttgcagccaagacaagttgccatatggtttcagaatagaagggctagatggaaaaccaagcaattggagaaagaatatgaagtcctcaagaagcagtttgaagcagtcaaggctgataatgatgttcttaaggttcggaaccagaaactacaggcagagcagaatagggctgcaattctaaaattcgttctttga

SEQ ID NO: 26140 - DNA, 195 bp, Glycine max
  Peptide Sequence Number=SeqID_142918
atgtctaattcaaccccaaaagctagtttaaagggtgagagttattcctcacttatatactcgactagcggatgtggtatttttaaggatgacaagtatccaagctctgttggtcccatgaagagaattccaggacaaatcgagataagtgagtttgtggagattaccaatttcaggcgggatagtcccatctag

SEQ ID NO: 26141 - DNA, 135 bp, Glycine max
  Peptide Sequence Number=SeqID_142919
atggggaggagattgccgcctagcttgcccagattcttctgtcacactaagcgccctgaagctgcgcttagcgtggtatgcacgcttagtccaaatgctaagctgagcccaactgtcacttttagtactacatga

SEQ ID NO: 26142 - DNA, 834 bp, Glycine max
  Peptide Sequence Number=SeqID_142920
atgggattctatcttaatctcaaacgcaacgcgttccggctaaaacggtttctgctaggacatgaaggcagaaaaagaaaatacaaacagccaaaaaagccttcatggatgaggccaatggcatatggttatcaagtggtggagcataacatggccagagatggttctgatgattcagttgtggcacagagagaggaaatggatcaaacagaattatggtattttggaatctttgacgcactaattggagacaaagttaccaagtacatgcagtcttatttctttgacaagaagcttcaagagactcatataaggagaaaaagcaaggaagctctaaagagagcttaccttggtgtaagagcaacgatccgagaggaacacaaattagaggagacatgcagaatgggttcagcatctgttatgttgatcaacggagaaaaacttgtggtagccaacatgggagattacagaactgttgtctgcagagatggcatagctcatcagacaactggcacaaaccaacgatcaacgaaaatacattggtctcgcagactctttgcaggacccattctagcatgtcaatcaggaaatgcagcaggtgcaaagcattctagaggttctgctcttgtcattagaagtgaaaggatcgattctgatactgagtttttgatattagcaagcactggcatatgggaggtgatgcaaaaccaagaggccgtgaatctgatcagtcacatagaggatccacaagaagcagctgaatgcttggcaaaggaagctctaattaggatgagcaaaagcagcatctcatgcttaatcattcgctttgattga

SEQ ID NO: 26143 - DNA, 709 bp, Glycine max
  Peptide Sequence Number=SeqID_142921
agggctgcacgccctcgcctttaaaggactacacgtcctctcctttagagggctacacgccctcgcctttagaggactacacgtcctcgacttcagagggctgcatgccctcgcttttagagggctacacgtccacaccttcagagggctacacggcctcgcctttagaggattacgcgtcctccccttcagagggctacacgccctcgccttcgtagggctacacgccttcaccttcagaaggctacaggccctcgccgtcagaggactacacgtcctcgcctttagagggcttcacgccctcgcctttagagggctacacgtcctcaccttcaaagggctacacgtcctcgccttcagaggactacacgtcctcccttttatagggctacactccttcgcctttgtttctttactaaagcatgttcacattttagtgaaagaacaccgagactattttagtctcacacatcacaaaagcaagaactacgtagtccattggcacgcggagacgcctgacagtaacccgcacacaccctttgttatccagcgacttgagagtccggtagcatgcggagacaccttatggttatccgcacctcgtcattcggagacctcaagtccgattgacaagcagaaaccaatgtcgtcacctgcacccttcccggagatgtcagcgtcttccagccgaggctacgaaaaaatctaa

SEQ ID NO: 26144 - DNA, 966 bp, Glycine max
  Peptide Sequence Number=SeqID_142922
atgggtagcttattcctagggcaaataaaaaagcagacatcaactttcctacaagaaaagtacaaatctgctaggatggcgtttactgatgtttctgaagcagaaatgctggctgaggaagcaacaaataaggatgattgctgccctcatgccaaaactatgactagaattgcggaggcatcatttgacgtagatgaatattggaggattgttgatgttcttcacaaaaggttgtataacattgattgggatcaatggaagcaatcctacaaagcactagttcttctggaattcttgttgacccatggtactcgagagtttgctcaagaatttcaatgtgatgcagaaattattgaagaactaggaatttttactcatattgataaaaaagggtttaactggggatcaagaatgctaaaactatcagagcaaatactcaagcttttacaggatgaagaagctctcatagaagcacgtttgaaggctctcaaaataacaaatgaaatacaaggctttggaagttcactcaactctccaacttcatcatcaccatcaccttgctctttatcatctgaagcatcacaaggatcttcttgtttctattcactttctactacaagtacccctacttacatatttgattccaatgatcagctaaacaaacatcactcaccctccatagcaaatgatggtaatattaatatagtcctcccgccaaagaatgtgaccaaaaaccatgtttggaaacgtcttgcaggtgaagagaataatattttgattgattctgatgaggatgaagacatggaaaaaccaagagggtttgtaagtgaaatttgctcaaagattattggtggtagtcccataaaaggagataatcgtgaaaagattgaatttagatgcctctctgatgtggggagcaaggtgacccaaaagaaatttgatcgccaatattcaatttggttttaa

SEQ ID NO: 26145 - DNA, 585 bp, Glycine max
  Peptide Sequence Number=SeqID_142923
atgaaggtttctatggggtggagggccgaatcaaaagaaagttgcgtgggtcaaatgggagacaatctgtctaccaaaggaaaagggtggcttgggaataaaagaaatcaggatattcaacaaggcattgctagggaagtggagatggaacatgctgcagtagaactcagaattgtgggttggaatattggagtcgaagatctaatggaggtgacacacgaaaatcagttgaatagagtgctccaaaatgaaacaatatggaaggtcggatgtggggacaaaattagattttgggaggacaaatgggttggtgaaggggagacattaatgaggaaatatccaagactgcctttgtttgacaatgaagtggccgcaactattggctttttggaagacatatcacggttccccattcatcgacacctaacagattgctgggtatggaaatcggaacctaatggacactactctacaaggagtgcataccatttgatgcaacatgaagcagcaaaggcaaatactgatcctgcatttgaggagatatggaagctaaaaatcccagcaaaagcagccatttttgcctag

SEQ ID NO: 26146 - DNA, 561 bp, Glycine max
  Peptide Sequence Number=SeqID_142924
atgcccatgaatatcagcaatttttttaacaatagctatcagccgagttttttcaactctggacaagaccctcggcaaaacagccaaaatggttttagatgtagattgtgcaaccatgttttccctagctaccaagcactcaaagcccattttgagtctcattttactctagaaaaccctgccattagaaatctttattcatcaagccatgtcaactctcaaagaggaatgattcccaaccctttgcggcccaattttcctaggccaatggtgatgcaggaaacaagaaactttgttaacatgaatttccaggcaccaccccaacaacctatggtgatgcctcaatctagagcaaacctatttcctcttgttatccaacataatgttgctgcttcacaatcacttcaaggtccaccacaggctacacaatttgtcaataattatgttgaaacggctcatttgcttgctccaccaatccaccaaggggagatggaggtttctcctattgatggaactaagccatatatcgatctactggataaacccatcgacaacaattga

SEQ ID NO: 26147 - DNA, 330 bp, Glycine max
  Peptide Sequence Number=SeqID_142925
atggctagggtcaccttagggaggcgagatcacaactggaagtgcgtccggaaagggtcgcgcatgcgccgtcatgcaccgtggatagctgctgtttggctcgtcaaaggagcggtgcgtgagaactccgatggagacgtgagtgacagatttgaggaatcttcggctggaaatgggcttaaggaggttgaaccggatgcaagtggttcgccgaaaaaaatgaaaattatagccagggataatgggtctatcgaggtgcctctattaggctctaggtaccctgtgtctgaatacagcacgggactgagtttatataggcttattgcactt

SEQ ID NO: 26148 - DNA, 1305 bp, Glycine max
  Peptide Sequence Number=SeqID_142926
atttccgaggaaagtgtcaaacttgctgatgcaagttctgaaattcgaaaaagcattcaacaatattctccttcatacatgtcatctagtagtaaaccaaactttgaaagatctttacggtctcaagtgactcaagaggatagcatgactcaagaagatggcacaagagatcggagatttaataaagattctctggagaaagttagcggtgtttctaaaactggagttatggacgacaaagagaaaacgaaggagggaaggaaaggacaagaacagtttactatgaggaatgaacttttagaaaatgagcttgttaataatttatctgacgatgattctacaaagaaagggaaattcaatagtactactcatttgctaaacaagaaattacatgatcatccaacaagtattttgatgaatgataaaacagaggacgtgacaaatgtaaaatctcctccacaatctgctgagaactatgggctgttcatcagcagtcagacccataatcaggccgaggaaattaatactatgaatgatgttcatgttggtactgcttgccatgaagacgttaatgtgaatggaagctttcataacaatgaaactgaattgaaggctgaggttgaaatgcttcgagaagagctgagggaagccgctgctcttgaagtttcaatgtactcagttattgctgaacatggtagctcatcaaacaaggtccatgcacctgctcggcgcctttctagattctatttccatgcttgtagagttgggtccccagctacaatggctactgcagcccagagtgctgtctcgggatttgttttggtttctaaggcatgtggaaatgatgttccaagagcaattgtgagcaaagaagttgagaatatacactttggtgatggtccatccatcaacagtgaaagtgatggaactggtaacactcttcacaaagaagaaaaagacaatacagaaaaacattttcatagatgggaagatccagaaacatttttagttgcattggaaaaggttgaagcatggatattctctcgaattgttgagtctgtgtggtggcagactcttacaccatatatgcaatctgcagctgctaagaactctagctctaggaaagcctatgagagaagatatcgtgttggtgatcaagatcagggaagtttttctattgatttatggaaaagagctttcaaggatgcatgtgaaaggatttgccctcttcgagctggagggcatgagtgcggctgcttgctagtgatagctagattggtacaatttaacattgatattccttga

SEQ ID NO: 26149 - DNA, 767 bp, Glycine max
  Peptide Sequence Number=SeqID_142927
atggtactgggaataagatcaaagagtaaaaaaagtgtttcaatccaagttcactacatcatccatgttcaggagatcaagccatggcccccttcacaatcactgagatcagttcaaacagtactactgcaatgggaaaatggagatcaaaattctgggtccctaccatccactgctggcaatgggaaaattgaatttaatgaatctttcaggctttcagttcttatgtgtagagaagcatccaagaaaggcaaacaccgtgaaactttccagaagaactgcttagagttttacttgtatgacaagacagtaaagagtcaactgttgggatcagccacaataaaccttgcagattttggaattattaaggaaactaaagccttaagcattcagtttaactgcaagaagagttccaggatttcttcacagccatttctttatgttaatattcagccatttgatatagagagttccagctcatcaccaagcagcagcttgtcaaaagaattgtcactagagaaggaaggaagcgaatctgtatcacaatcactaaaagatgatgacaatcttgaaattgcctcttttactgatgatgacagtgatgacatcccttcaaatacctcccaaactagcagacctgcttcagagattactggaggtttggcctctctaaatgaaaaagtatgcatacatgcattggtatgcagtatgattgtgaagctccaacataaaatgtccaaatatttgaactccaaatctgttgacag

SEQ ID NO: 26150 - DNA, 174 bp, Glycine max
  Peptide Sequence Number=SeqID_142928
atggcttgtggactggtggtgttcctagaaacagtgctttggggtatctttggtattaccatggctaaggagatgaaatttcccaaatttattattgaaaaagattctaaggctgctcagcatctagtggttaaaaagagtgaaaggactcaccattgctacgagattatgtag

SEQ ID NO: 26151 - DNA, 1032 bp, Glycine max
  Peptide Sequence Number=SeqID_142929
atgcaaacgacatcgtatagtcatcctctattctgtttctcttgcagaaacatcagtacaaatgggaagagtaagggttctgtgaaattccgtgcaccatatccctctcaactgggtcggaaatgtggattcaatgggagacctcgtgtttatatttctcccagccccataaaaccaaacaggttgtatgtgcttcataacacaggtgacaaccatccatctgctttttcagtagatgatgaaatgaacacaaaccatgctccaaatggcatgtcaccgacatttctcagcaactggtcacctccaagggcaggtggttgtcaagactctaaagggaaagatcattggaggaacactcttcagcaactggagagagttggtcctaaatcagttggagtgtgtcttttaacttcggcttttgtgggcatggccttcaccattcaatttgtaagagagttcaccaggttgggattaaatagatcagtaggtggggttttagctctggctttctcaagggagctaagtcctgtggttacagcaattgtggttgcagggcgcattggaagtgcttttgcagctgagttaggaactatgcaggtttctgagcaaactgatacattaagagttcttggttcagaccctgttgattatctggtgacgccaagagtgttagccacttgtattgctttgccccttttgaccctgttgtgttttacattagggatggcatctagtgcccttcttgctgatggtgtttatgggttgagcatcaacattatcatggattccgctcagcgagctctcagatcatgggatattattagtgcaatgatcaagtcacaggtttttggtgctatcatatctattgtgagttgtgcgtggggagttacaactttaggaggtgctaaaggtgttggggaatcaacaacctcagctgttgttatttctcttgtgggcatcttcattgctgattttgctctttcttatgttttcttccaaggggcaggagatcagctaaagaattgtgtttaa

SEQ ID NO: 26152 - DNA, 201 bp, Glycine max
  Peptide Sequence Number=SeqID_142930
atgacattagctcaggcattttatcaaacaggtagtaggcaaatacgcaagttagataaatcacaagagctgccagaacccggccaacaaaagttatcaactacgactcaacgtgatataggaagattcaatcatcgatacaaactagaatatgattgcaaattggaaccaacaaagggaatgaactacacaaaccattaa

SEQ ID NO: 26153 - DNA, 411 bp, Glycine max
  Peptide Sequence Number=SeqID_142931
atggctcccaaaatgtgtgttattgtggcacttaatgttgttatgttctttgcacttgtctctggatgtgacaagtgtccacccgtaacaaacacgagtattactactacttctattacagttacttctactccttcgttgaatgcaacaacgggatgtcctcgtgacgttctcaaactaggtgtgtgctcaggtattcttaatggatggatgaacttttcgatgggtttacctttaaagacacattgttgctctgcgatcgaaggcctttatgactttgaagttgcattgtgtgtttgcactgccctgaaagcaaacattatgggcatcaaccttgatattcccatttcctttaccaagcttatcaacacttgcgacaagaaagttccaaatggtttcatatgtgactga

SEQ ID NO: 26154 - DNA, 351 bp, Glycine max
  Peptide Sequence Number=SeqID_142932
atgaatagatcaggaaatggccgacttacactgagggaattgaaacgtgggaacctaattgatgcaatactacatgtagatgaggaagaggatattaacaaagtactgaggtacttctcatatgagcatttttatgtcatttactgcaaattttgggagctcgacacagatcatgactttttcattgatagagagaaccttattaaatatgggaaccattctcttacctatcggattgttgatagaattttttcccaggtctgttggtattttacatctttgacaatgtgccttgttcagccctgctctactgtgtatggctatagcaagcctcatactgaaaattgttag

SEQ ID NO: 26155 - DNA, 336 bp, Glycine max
  Peptide Sequence Number=SeqID_142933
atggacacattggcacttggtttggcaattgtatctggatgtgataagtgctcagccgtgacaaacacgagtgtcgatactactgtagttattactgctacaactactctctcgtccgatgtggggtgtcctcgtaacgtgctcaaactaggtctacccccagagacacaatgttgctccgcaatcgcagacctttatggcttagaagttgcagtgtgcctttgcactgccctgaaagcaaacattatgggtatcaacctcggtattcccatttcctttaccaagcttatcaacacttgcgataagaaagttccaaatggtttcatatgtggctga

SEQ ID NO: 26156 - DNA, 558 bp, Glycine max
  Peptide Sequence Number=SeqID_142934
atggatgtggaggaaactgagaagttggtgtctttggacccagatttgttgctgcttccggaggtgtctccttttgcactgaaatcgagtccttacgttgttgaggagctattcacacagtggctttcgcttccagatacttgtcgcctggttttctacaaacctaagcccgtaaacccaatgctcacaaaccctaacaccaagagaaccgagaaaagcaactgcttgtattcattttcaacctctcacaaccctcctccaaaactactgcctgattctgctgcgtccagagctcttctctgttttaatccggttaagtcattgcttgctgatgcaaaggcaggagctcgtttgagtgcacttgagaactcaacaaatacaaatgctctgtcaatcaactctctaccttccttgtttcctgctgggagtacaccaccactttcaccacgcagctcatctggttccccacgtaccacaaaacagagaaatagtccttcattaggatctccactaaaattagccagtgaacctgtaagggagagggaggtcattccgcag

SEQ ID NO: 26157 - DNA, 989 bp, Glycine max
  Peptide Sequence Number=SeqID_142935
agctgtgtcttcttcacgttccgtacccttaccaagctttgtcgcgctctgtttcgtcgacgtggaacagagcaataacgcacccttcttttattttctccaagaagaccctctcccgtcctcacctcttcgttctcgcgtttcattcacaaactgggaaaatccagtggcaggcgctcgacccttcctcggggcgctggttcgttttaccgcagatgcccttgcaggaaaactcctgccccacggagttcgcgtgcgcggcgctgccgcaccaggggaagctcttcgtcatggccggcggcggcggcggttcagacaccctcgtctaccgcgccgccacgaaccagtgggctctggcggcgcccatgccgggagggaggaagaggggcttcttcgcggcggagggagtggagggaaagatcgtagcagtcgggagaagcggcacggacatctacgatccggagagcgacacgtggcgggaggggaagaagcaggggggggagctgaagaggtacgaggttgtggcggcgggagggaaggtgtacgtgagcgaggggtggtggtggccgttcatgtaccgtccacgggggtgggtgtacgaaacggagaaggacacgtggcgggagatgggggttggaatgagggacggttggagcggggtgagtgtggcggtggggggaagggttttcgtgatagcggaatacggggacgcgccggttagggtgtacgacgaggagcaggacacgtggcgctacgtgaaaggagggagctttccgagggacgttataaagagaccgtttttggcgacgggtttggacaacagaatctacgtggcatcgtacaatttaaacgttgcaattggaaagatgaagagtgatagaatccaagggaaaggtgattttgaggttagtgtgacgtgggaggttgtggaggcgccgtctgctttccgcgaattctcaccttgtacttgtcaagtgctctatgcttga

SEQ ID NO: 26158 - DNA, 552 bp, Glycine max
  Peptide Sequence Number=SeqID_142936
atggaggtgcatcaagctttcatgtcgatgaattcctataaagcattggggcccaatggttttcaaccaatatttttaaatatatattgggagattacaggtgatgatgtgtggcagtttgtggctagagtgtttcaaagtggtacgttcgatactagagtagtagaggcattaatggtgcttattccaaaggaggattctccaacaacatttaaacactcttggcccatcaatttgttgaatgtggtttacaggttaatgttgaaagtcctaggaaccaagggtaatgcttcagtgttacaggaagtaattcatcatatgggaatgtcgagaaaaagggatggagaggtgattctgaaattggaccttgagaaggcatatgaccagaggttaggagctatggtatctaaggaggtgaaggaagggcattgggaacctattcaagtaactagaaatgggcttaacatctcgcatctctttctcgcatatgatgtgtttttctttgcaaaagcaacacttgatcaggcttggaaattaagggagtggtcttga

SEQ ID NO: 26159 - DNA, 1260 bp, Glycine max
  Peptide Sequence Number=SeqID_142937
atggaatacctaaaagaggagcaagaagaaccagttagtcctatgggacaatacttcaacagttctgtgctatgcatatacatcattggagttttggaatttgaagttcccatacatgacttgcaaaccttcgctcttattaaagatgtttttcttcccatcaatccacgcttctcctccgtcatggtccaagataaagatggagagaaacgatggaagcaagttgatgtgaatttgaaagagcatgtccactttcccaaattccccaaaggcaaaacagtggaatcctacgacaagtttttccatgattatttatcaagcatggcaatggagcaattaccacaaagcaaacctctatggtccattcacataatcaattaccccacaaatgatgcatctagcagcataatatttaagcttcaccatgcacttggagatggttattctctcgttggtgcacttctttcttgtctacaaagagctgatgacccctctctacccttgtcatttccttctctaagaccatcaaagccacaatcatcaaccgaaaacttttggagaaggttttcttggatgtgttcctctgccttcaacactgtctcagattttggatggagtgtattgaagagtagcatcattagtgatgatgaaacaccaataaggtcaggagatgaaggaaccgagtttcgcccaatttgcatatcaagtatggacttctccattgaccatatcaaggacatcaaatccaggctcggagtgacaataaacgatgtgatcactggaatcgtgttctatgggactaggttatatatgcaagacatggactccaagtcaaaaacggcagactccactgctttggttttattgaatacgagaaacatcgaaggttaccaatcaataaatgaaatgctgaataataaagccaagggtccatgggggaataaaatctccttcttgcatgtaccaattccaaaattaaatcaaaacaaaatgtcaaacccgttagattttatctgggactcgcataatataatcaagagaaagaaacaatctttagctgttgccctcactgggattcttttggacacggagagcaaattcagaggacaagaggcagtagctaaacaccttcgagggacagtaacgaaatcaagtgcagtgatttcaagcttggttggaccgatgcaacaaatgtctttagctaatcatccagtgaaaggcttatatttcacattggctggtggaccagaggtatcctaa

SEQ ID NO: 26160 - DNA, 318 bp, Glycine max
  Peptide Sequence Number=SeqID_142938
atgggtgctactccaagaagggtgccacgggaggtggcaaatagtaaacagtatgatggctattccaaaagattttctttgggatgtggtggtgaggtgagaaaaagggattctttttgggtggagattcttgagtcaaagtatgaggggttgagaagactagagagaggatatggtggtttggagggatggagggtggatatggaacctacaatggagatggatcatgttcaaatgggagcgtgtgaccttttacaactacaacaactcttggtaccttgtgtgctgcggtatggggttgcggattcgtggatgtag

SEQ ID NO: 26161 - DNA, 765 bp, Glycine max
  Peptide Sequence Number=SeqID_142939
atggaacaccaaaaggaggagcaagcagaaccagtgagtcctgtgggacaatacttcaacagctctgtgctatgcatatacatcattggagttttagaattcgaagttccaattgatgacttgcaaacatatgctcttctcaaagatgttttccttcccatcaatccacgcttctcctccatcatggttcaagataaagatggagagaaacgatggaagcaagttgctgtaaacttgaaggaccatgtgaagatccccacattccccgaaggcaaaacagtggaaacctatgacaaatattttcaagattatttatcaagcatagcaatggagcagttaccacaaagcagaccattatgggatattcacataatcaatcaccgtacaagtgatgcatccagcactataatatttaaacttcaccatgcacttggagatggctattctcttatgggtgcacttctttcttgtctacaacgagccgacaacccttctcttccattgtccttcccttctctcaaacaatctaaaccagaaccttccactaaaagctttagcagaaaaatttcttggatgtgttcctctgccttcaacactgtctcagattttggttggagtgtattgaagagtagcatcattactgatgataaaacgccaataaggtttggagacgaaggagccgactttcaaccaatttctatatcaagcatgacattctccattgaccatatcagggaaatcaaatcaaggcttgaagtggtatga

SEQ ID NO: 26162 - DNA, 492 bp, Glycine max
  Peptide Sequence Number=SeqID_142940
actataaatgatgtggtcactggaattatcttctatgggactcgattatatatgcaagatattgactccaaatcaaagacagcacaatccacagcattggtattactgaatacgagaaacattgaaggttaccaatcaatcaatgacatgctcaatactaaagcaaagggtccatgggggaacagaattaccttcttgcatgttccaataccaaaattaaatgaaaccagaaattcaaaccctcttgaatttgtttgggactcacataatataatcaagaggaagaaacaatctctaggagttgtactcaccgggacacttctggagatagaaggcaaattgaggggacaagaggcagtggctaaacgcattcgtggcacattgacaaaatcaagtgcagtgatttcaaacttggttggaccaatacaacaaatggctttagctaaccatcctgtgaaaggcttgtatttcacattggctggtggacctgag

SEQ ID NO: 26163 - DNA, 408 bp, Glycine max
  Peptide Sequence Number=SeqID_142941
atgttttcctgcaaagtggaaattgtatgttttgcacctaaagaattgtgtaagttttgtccaaagaaatataccttgaaaccgagacacaatcgcagacggcaagaagcaaacctcattgaaggaatcatatccaaccaaaagacaaaccttcttcttcctacaaccacctctccaccgccactctccttgacctaccttcttcttttgacaatgacgatgatgatttcgatgatccctgcctctccttcgtctttgccctcgtctcttcagtcacaaaaaaatagagcccctccgctgatcgacactgctccagattccccgcctctcgttcgttctcgttccgagggagacatcgatttgttctttatgaagaggtcgaggaagaaaaatttcatcgggaagtag

SEQ ID NO: 26164 - DNA, 1475 bp, Glycine max
  Peptide Sequence Number=SeqID_142942
ttttattggtccaatacctgtggagattggtcaattgaacaatgtgaaacatctgtccctcggtgagaacaagttgaatggttccatacctttagaaatagggaatttgaacaaccttctgattctagatcttaatactaacagtctcaccgaagtgatacttcaagatttgcataatcttaccagtttgacagaactaaacttgtccaataatgagatttttaacttgatcccgcaaaagctttcccaattgacccaactgaagtatctgaatatttcaaataacaaattttttggtgaaatacctgctgacattggaaatttgtctaaaatcttggttctagacatgtctagaaacatgttggctggagaaatcccagccagtttttgtacttgctctaagctggagaagttgattttgagccataacaatataaacggaagcattccctctcatattggtgaccttgtttcgcttgctttaattgatttgagtcataactcaataagtggagaaataccttatcagcttgggagtgtgaaatacacaaggatcttggatctcagttataatgaactaaatggaaccattcccagatcccttgtatcattggggaggctagacttgtcttacaattctctagagggtgaaatcccagttgctctccaaaaatcttttccacctaaagcattcactggcaatgacaatttgtgtggcgacatcgcccacttcgcttcttgttattattcctctcctcacaagtcacttatgaaaattttccttcctctcactgctttgcttgctcttctgtgcactgcatacgtgttcctccgctggtgtaaggctgggaattgcatgtctgtatcaaaagaaacaaagaatggtgacatgttttcaatatggaactatgatggtaaaatagcatacaaagacataattgaagcaacagagggttttgacatcaaatactgcataggggctggtggttatggtagtgtctacagagcacagctacctagtggcagagtagtggccttgaagaaactctacaatttaggacccgacgaaccagccatccacaggattttcaagaatgaggtaagaatgttgacaaagataaggcatagaaatattgtgaagctctatggattctgcttgcataacagatgcaagtttctggttttggagtacatggagaggggaagcttgtattgcgttctccgcaatgacattgaagctgtggagttggattggaccaagagggtcaacattgtgaaaggcatagcacatagcttatcataccttcaccatgattgtaagccagcaattattcatagagatgtaacaacaaaaaatgttctcttgaatttagaaatgaaggcttgtctctcggactttggcatagcaagacttctaaaatccggttccttcaatcgaacagtacttgcaggcacttatggatatattgcaccag

SEQ ID NO: 26165 - DNA, 108 bp, Glycine max
  Peptide Sequence Number=SeqID_142943
atgacattaataagaagcttttacaagccagaatctgctgggaataggttgcacgacttatcaatgagaacttcgtcaggcactttgactccgcttcagttaaagtaa

SEQ ID NO: 26166 - DNA, 624 bp, Glycine max
  Peptide Sequence Number=SeqID_142944
atggatcatgttattggtggaaaattcaagcttgggaggaagattgggagtggatcgtttggagagctttacttaggtgttaatgtgcaaagtggggaggaagtggctgtgaagctgatattgtgcctgcttcttttaccatgtgttactgagaagaaagggctttttaggataactgttgagttggaaatgttgctggaatctgtgaagaccaagcacccacagcttcactatgaatcaaaactatatatgcttcttcaagggggaactggtataccccatctaaaatggttcggagttgagggtgactacaatgtcatggttattgatctccttgggccaagtcttgaagacttgtttaactattgcaatagaaaattatccctgaaaacagttctgatgctggcagatcagctaataaacagagttgaatacatgcactcccggggttttctgcatcgcgatataaagcctgacaactttttaatgggtttaggccgcaaggcaaatcagccttatccggtagggtgtttatgcatgacatctcacttgtattttgaagtagtttcagttgtgattcaagattatgatcaaaggtttctttcacattatggatatatgtag

SEQ ID NO: 26167 - DNA, 105 bp, Glycine max
  Peptide Sequence Number=SeqID_142945
atgagcatcaaaggaggaggccatcctcatccttcaaacattggtgatttgttttcagaagggtctcttaatccatatgcagaggatccctatgcatttgattag

SEQ ID NO: 26168 - DNA, 750 bp, Glycine max
  Peptide Sequence Number=SeqID_142946
atggataggtgctggtttaataagttcaagccaaaggataaaacaccatcttcaaaaaacaaggaaacaggcattgcaaaagggtcaaaacccccaacaaatgatgaagcaccttccaatgtgaccaaacagaaggttgcagctgcaaagcagtacatagaaaaccactataagaaacagatgcaggacttgcaggagagaaaggaacgattatgtgcaagaaacttctccagatggaaattgctacgtaatatgctagaaaaaaagttggctgatgctgaagtttctgaggaagagcagaacaatttgcttaaatattttgagaaaaaggagagggaatacatgcgccttaagaggcataaaatgggggctgatgattttgagcccctgactatgatagggaagggtgcatttggagaggtcagagtctgccgagagaaagcaaccggtcatgtatatgctatgaagaaacttaagaaatcagagatgcttcgcagaggccaggttgaacatgtaaaagctgagaggaatctacttgcagaagttgatagcaattgcattgtaaagctttattattcctttcaagatgaagagtacttatatctcataatggagtatctacctggtggtgatatgatgacgttgctcatgcggaaggatatactgacagaaaatgaggccaggttctatgttggggagactgtcctagctatagagtcaattcataaacataattatattcataggtaa

SEQ ID NO: 26169 - DNA, 624 bp, Glycine max
  Peptide Sequence Number=SeqID_142947
atggaggtaacaactctggagatgacaactctggagaagacaactttggggaagaccctccccacagcaatcaaaaatggttttagatgcatattttgtaaccttgtttttattactcttctggcacttatggcccattttgcgtcggttcattttgttgaaaatcctgctataagtagtttatatttatcaaatcatgtcaaccttcaaagagagatgattttgagccctttgcatcccaattttcctaggctaatggtgacacaggaaacaagaatctctgttaacaacatggttagggtttttcgggcaccaccagaacaacctatggcgatgcctcaaccaagagcaaacttaattccctatgctactcagtcgatggttgctacttcacaaccatttcaaggtccaggtccatcacagtccatgttgtctgcctcgaataatgttgctgaaagggcacaattatttgctccaccaattcaccacagggaaatggaggttagcccaattgatgaaactcaaccatatatcagtttgctggatatacccatcaacaacaacgagctttttaatcggtccatcattaatggtgacaatttggatcttgagttaaggctctag

SEQ ID NO: 26170 - DNA, 246 bp, Glycine max
  Peptide Sequence Number=SeqID_142948
atgtgggcactcaattgttgcattgtgagacctccaaggaacttcaggaagcatctcagagcttggttgatgcatgctcataactcgtttcaaatattacccccacaattaaaaatttctgaatccgttaaattcgagttgcatggagaggatcaaatcaaagaggatcgtgaggaggaagagacaaaggtaggaactctaaagactaaccagtatgtcaagtctgtggtaaatccggttacgtag

SEQ ID NO: 26171 - DNA, 138 bp, Glycine max
  Peptide Sequence Number=SeqID_142949
atggagaatggtgaagacaacgtaacaggaaagaggtgtcccaagcaaagagagaaagtgagagtgagagaccagaggggcttaattgagaaagaagcggtgttttggactttagggcttttgtggaaatggaaatag

SEQ ID NO: 26172 - DNA, 1067 bp, Glycine max
  Peptide Sequence Number=SeqID_142950
catcttcttctgggtttgtgaattgctctgatgttgagaaggaggaaaagattggaatatttgagctcaagaaaggtgacctttctttgagggtcaccaactggggtgcttcaattttgtccctggtgattcctgataagaatggaaagttgggtgatgttgttcttggatatgattctgttaaggattacagtgtgagtctactctctactactgttggccgggttgctaacagaattggaggagctcagtttactctgaatggaatctattacaaattagttgctaatgaaggaaacaatactcttcatggtggagccagaggatttagtgatgttctttggaaagtgaaaagatatcaaaaagaaggtccaagtcccagcattaccttcagataccatagtgttgatggtgaacaaggattccctggtgatctcctagtaactgtgagctacattctaacggggaaaaatcaattggttatacttatgaaaggaaaagccctaaacaagccaacaccagtgaatttggcaaaccatgcttactggaacctaggaggccataacagtggcaacatcctgaatgaggtggtacaaatctttggttccaaaatcacacctgtggacaacaaactcattccaacaggcaaatttgcttctgtgaaaggaacagcttatgatttccttaagccgcaaacagttggaagcaggatcaaccaattggctggaaccaaaggttatgacatcaactatgtgattgatggtgagaaggggcaaaagatcaagctagcagccatagtgcaggacaagaaatctgggagagtgttggagttgttcacaaatgctcctggtttgcaattttacactggtaactatatcaaggatttgaagggaaaaggtggatatgtgtacaatgctcatgcaggactatgtttggagtctcaagcattccctgattcagtgaatcatcctaatttcccttcaacaattgtgacccaagaaaagccttacaagcattatatgctttttaagttttccaccaaaaatccgtacattagttcaaagtga

SEQ ID NO: 26173 - DNA, 512 bp, Glycine max
  Peptide Sequence Number=SeqID_142951
atggctatgccattccccaattatatggtggtaggagcttggtatatactacttgttatctcttggaattgtttcagcatttcaattgcgtcaaatgcagcttctaaatctgaatcctcactgctagaagcagaagcacatgttcttcttgaaagtgagtggtggccgagtaattacactaaccatgtttcaagtcggtgccagtgggcaggcattacatgcaacaatgctggaagtatcacaaacattactttgcctgatgaactccaattgggaaacaagttgtggaggttcaacttttcttgcttccaaaaccttgttcacctcaaccttgctgcacttggaatcagtgggagtattccatatggatttggtaccctttccaaactcacttatcttgacttatcctttaatgatataatgggaactataccatcagacatttggaatctaaggaatttagtgaccctaaacttggctagaaacaagcttagcgggcttatccctccaga

SEQ ID NO: 26174 - DNA, 312 bp, Glycine max
  Peptide Sequence Number=SeqID_142952
atgaggcttcactgtcatcaagcgagttggagacccaacatgaccacagatagacctccactccttatggctcacatagacccgggtatagggcctaacatctcaatgtgtgcgcgagtccctagtggagtcaccaactgtcgcaacctgcccttcggcaggggcacaaaaaggtctctcagatgggccaaggcaaataatgccccaatgagaggggtgagcacttgctttctagggattgatttatttggggtttctgggctaagctctagcttctctaggaagcttctcaagatcaaggacgaggattaa

SEQ ID NO: 26175 - DNA, 324 bp, Glycine max
  Peptide Sequence Number=SeqID_142953
atgggtgaaatagaggaggtgcaagagcggatgaaggctgacatggaggccatgaaaaagcaaatgatcacaatgatggaggccatgatgagcacgaagaagataacggaagtcaatgtggctgcagttgcagctaccagcgccgttgctcaggtggacccgactcccctatctggcctcaaccaaataaatcatccaacctcaaatatggtaggtcaggaaggcaaagagttaggaagtgcaggcagtccccattttgtgcaagttcaaaacgagcatcccttcccgccttatggcttgcctccgaactatatgccacccaat

SEQ ID NO: 26176 - DNA, 1422 bp, Glycine max
  Peptide Sequence Number=SeqID_142954
cgtgtggcaggcataaagacgcggttatggtggacccgtgggccctaccgtggtggcagcagcagacatggtcgtcgtggaggttttagcaatggtgaagctggtgatgaaggatgtccaagaagagcatttaaacgccacagtgggactggacgaggaaatgaattcaaacgggaagggtttggacgagggaactggggtacacagaatgaggacattgctgaggtgattgaggaagtggtaaatgaaactgaaaagattcttgctgatgagaagcctgtaggagaggaagatgcagcagaaggaaacaaggacagtcctgctaatgaaaatgaagaaaaggagcctgaggacaaggagatgacactggaagagtatgagaaggtgctggaagagaaaaggaaggccctgcaggctcaaaagactgaagcaagaaaggtggacatcaaggaatttgcatccatgcagccactggcgtgtctcaagcttgcaggaaacagtgctgcttatagtagcttgaaaccttgtgagaaaaccatttgcactgcccctttcttgaaggcgtcatctgggtttgctgctactgagccattctgcatccttaacacaagaaggtatggttgtgaggtttataacttgggaacaggaaagggaacatcagttttggagatggtaaacgcttttgaacaggcctctggaaaggccgagtgcgacgccaaggtccgcggcgtcaccgtcatgagctctgagcaggatcgcgtgcgggcagacgtgctggagctcgtggcggagcagaaggagctcgcagcgcaactgcatgccgtggagagcgagattgcaaaggcgagcatggaggcgcaatttgtgccgacgatgaaggccgatatagaggccatgcaccatgagattcaacgaggaagtccccatttgctttttccgtttcttttgcttgtctcttttgcctttcccctctctcagtgccctcatttcttcaagctcaatgtgttagggtttccctccttttctcagagtttgcatttcccagctgcacaagaagaaccctttctggctgcacaatcgattggtgcgaagtcgatgatgaagttcgagagtgggtactctgtggaaatcgtgtttgatggaagcgagcttggaattgagccttatgcagttgagttgctaaatgaagcagaagtagcagcggttgcagaagagaaagaaactcattcatttgaaattgatccttctcaggcactttacgtgatgaatcctaataagttcagagcatgtgagtttctcataaatttccatgaaaggacatgtggtgataaaattatagtctttgctgataatctgtttgctctcactgagtatgctatgaaactccgtaaaccaatgatatatggtgttacaaggtgctga

SEQ ID NO: 26177 - DNA, 1101 bp, Glycine max
  Peptide Sequence Number=SeqID_142955
atggagcacaagatcagcgttgaaactttttcaaacctaagtttgaagtgggagttctatgcaggcaaagacataactgcaactccagcgattttcgatggcacactctactttccatgttggaatggggatattttcgcagtgagagcaaaatatgggtcactggtgtggaagcagaacttggggaatttaacggggctaagtgcaacagggtttgtggcaggtgttaactggacagtggctagggcaacaccaaccatagcagaggatgatcttctgatcgttggaatatatggtcctgcagtagttattgctgtgaaaagatcaacaggagacttagtttgggaaacacgtttggacagccataactccagcgttgtcaccatgtctggaacctacttaagaggcttctcaaagttagacattgaatctggtgccattttgtggcaaacctacatgatccctgataatcatggagaaaaaggagaatattctggagcagctgtgtggggaagtagccctcccattgatgcatcaaggaaccatatatacattgccactggaaacttgtatactgcccctttggacatacttgaatgtcaagaaaaagagaacaatgtgacacaacctactcaccctgatgatatcaaatggtaccacccattgggaggatttgatgtgtggttcgtttcatgcctcaatttgtcaatacctagtatcaattgtccacctggtcctagcccagatgctgattttggggaggcaccaatgatgctcacaattgatatcaatggaacaaaacaagatgttgttgttgctgtgcagaagagtggttttgcttggcctttgcaccgtgatgacggcaagctcatttggtctacggaaactggacgaggtgggattacaggaggaggaacatggggagcagccactgacaaagaaagggtatacactaacattgctaattcggaaggcaagaacttcactcttagaccttccaaaaagactacaactagtggagggtgggtggcaatggaagcatgtagtggcaagatcttgtggtccacagccaaccctagtaatgccaaagctaatggtcct

SEQ ID NO: 26178 - DNA, 201 bp, Glycine max
  Peptide Sequence Number=SeqID_142956
atgtcttcaagctccaccaccggtacccgtagtaggatgagaagaacagccacatgtcgcacaagtcatggctgcgctggtcccttcagctccataggccacgaactcgctgcagcgatccacaatatgtcctccaattctacatgcaagattcctgcagcactcacgatatttcacgtgcttcacaatcgtcactggtga

SEQ ID NO: 26179 - DNA, 246 bp, Glycine max
  Peptide Sequence Number=SeqID_142957
atgtggagagttattttgcacagtgatggaactgtaaggtgctggaataattcaccagtgacgattgtgaagcacgtgaaatatcgtgagtgctgcaggaatcttgcatgtagaattggaggacatattgtggatcgctgcagcgagttcgtggcctatggagctgaagggaccagcgcagccatgacttgtgcgacatgtggctgccatagaaactttcacagaaaggaagagcaaattcaattg

SEQ ID NO: 26180 - DNA, 420 bp, Glycine max
  Peptide Sequence Number=SeqID_142958
atggggccctataagttggtagccatagccactgccctcacgcctttgattaaacttttcgaacaaccatttcggtttcctccggagcaacttgacggtttgacagagcttagctgtgaagctcacgtttttggtcaagaccttcacatgaagacagttttcgaacaaccaccacctcaattcaatgaatttgttacatcggtttcagaaaagatgctcattcattctcaagcatgccgggttttaggtttaaaagctctctacatgccgggtttccggaagactttgatggttgggcaaatgaaacttaccaatgatgctcacgttttaaggcaaagagcttcacatatagacaattcctcagtggcatcctacgttatatatgtgaaccccacaaaaactatgttttactataagtaa

SEQ ID NO: 26181 - DNA, 258 bp, Glycine max
  Peptide Sequence Number=SeqID_142959
ggtttgaaggatagcttataccatgaggagatgccggcacaattcttggtgacaaatgtgaaatatcacgagtgccgatggaatcatgcgtgtagggatggaggatatattttggatggctgcagggaattcgtagcaagtggtgcggaaggcactgattcagctatgacttgtgctacatgtggctgccataggaactaccacaggagggaagacttttgtgattgtccttctcatcctgctgctaatggagcttga

SEQ ID NO: 26182 - DNA, 1398 bp, Glycine max
  Peptide Sequence Number=SeqID_142960
atgatcagccccaaaacagcaccgaacctacggttgaagtggaaattcaatgcaggcaaagacatcagtgcaacaccagcaatatatggtggtactgtttattttccaagctggaatggttacatctatgcagttaaagaagccgatggatctcttgtttggaagcaaaacttggagaatctaacaggactaagtgcaacgggatttgttagaaatgtaaattggacagtgtcaaggtcaactcccacagtggcaggagatgattcactgctaattggaatctatggccctgctgttgttatttgtgtcaacagaacaacaggtgagcttgtatggaagaccactttggatcaccatcctgcagcagtcatcaccatgtctggaacatactacaaaggagatttctatgtcggaatatcttcactggaaataactgtgccgactgttgaggaatgctgcacatttcgtggaagtttcacaaaacttaatgctcgaactggccgcatgcgttggaagacctatatgctaccagataacaataacagaacaggagaatatgcaggtgcttccatttggggaagcagcccttccattgatgttgaaagaaaccatgtctatactgcaactgggaacctctattctgccccattacgcatacgacagtgtcgagagagacaaattaatcgaactcagcctacccaacctggagacgagtgtgttgagcctgacaatcactccgattcaatgttagcccttgatttggattctgggaaaatgaaatggtaccgccagttaggaggccttgatatatggaccattgcatgtatcaatccttcaactcctaattgtcctcctcaagctgagcgtccagatgttgattttgggcagtcaccaatgatgttgacaacatatataaatcgaaccaagcaagatattgttgttgcggttcagaaaagtggcatagcatgggctttatatcgcaataatggcaacatcctttggagcacgaatgctggtccgtacgggctatctggaggcggaatatggggtgcagcaactgatgtaaagagagtttacacgaatattgccaatactggggcaagaaatttcactcttgcaccatcaaacgtaactacgaccgccggtgggtgggtagcaatggatgccagcaatggcagaattctatggtccacagctaaccctagtaacagaactgctaatggccctgttagtgttgcaaatggcgttgtctttgctggatccgcagacagaatgggatctgtatatgcaattgatgccatgaatgggaaaattttatggtcctatcaaactggagccagtgtctatggaggcatgtcaattagcaaaggttgcatatttgttggccatggatatggt

SEQ ID NO: 26183 - DNA, 1503 bp, Glycine max
  Peptide Sequence Number=SeqID_142961
atgattccacctaaatacaacatgctcttagctcttcgtttactattattatgtgttcatgtggtaatagtctttgcagcaagctctaatcataagatcagccccagaacagcacccaagctacgcttgaagtggaaattctatgcagggaaagatatcactgcaacgccagccatatatggtggtgccctttattttccaagctggaatggttacatctacgcagttaaagaagccgatggatcacttatttggatgaagaacttgctgatgttgacaggtctgaatgcaactgatggtgttgttccgaatgtaaattcgacagtgtcaaggtcgactcccacagttgctggggatttactgatatttggaacgtatagtcctgctgctattattgctctcaaaataaaaactggtgagcttgtgtggaaaatcactttggatgaccatcctgaagcactcatcaccatgtctggaacatattacaacggaggatactatgttggaatatcttcactggaagcacttgtacccattgagcgatgctgcacattccgtggaaagctttataacaacaataggagaggagaatatgcaggagctgctatttggggaagcagcccttccattgatgttaaaagaaaccatgtctatattggaacagggaacctctattctgccccattacacatacgtcagtgtcgagagagacaaaataatcgaactgaacctactcaaccagatgagtgtattgagccagacaaccactccaattcgatattagcccttgatttggattcggggaagatcagatggtaccgccagtgtggaggcttcgatatatttttcttagcatgtataaatgcttcagctcctaattgtccaccccgaggtctttggcaagatgctgattttggggaggcaccaatgatgttgaccatatatataaatcgaaccaagaaagatgttgttgttgcggttcagaaaagtggctatgcatgggctttagatcgcaacaacggcaacctcatgtggtttacgcctgctgggccaggaggtataacaggaggtggaacatggggtgcagcaacagatgaaagaagggtttacaccaacattgccaattccgaggccaaaaatttcactcttgcaccgtcaaacatgactacaaccgctggtgggtgggtggcaatgaatgccagtaatggtagagttttatggtcgacggctaaccctactaatggccctgttagtgttgcaaatgaagttgtcattgctggatctacggatagaatgggatccatttatgcttttgatgccaataatgggaaaattttatggacctataaaactggtgccactgtttatggaggcatgtcaatcaacaatggatgcatatacgtgggtcatggttacaatgttttcgtgtcgtctctcatcaacaactttacgggtggagcctcactctttgccttttacactgttaagaatttacgtggttaa

SEQ ID NO: 26184 - DNA, 264 bp, Glycine max
  Peptide Sequence Number=SeqID_142962
atgggtgaaggtagtgacattcgtgatgacaatgtttgcagtggcaacgatgtttgcaaagatcacaaggtaaagtgtgaggatcgaaggaagaggaaaaatgtgacaaatgtgttaagggaattagaggaagggtgtgacattaggattgggaagttgaggcaaatgatggatgccatggttgtggagaagcacgttgagtcaattttaagtgaaggaaaggattattttgaattaaatatagaagataaaggactaaagtaa

SEQ ID NO: 26185 - DNA, 231 bp, Glycine max
  Peptide Sequence Number=SeqID_142963
atggaggcaacacaaagaaaaagatcaaagagagaggatgattttgtggaggcggcaacacaaagaagattaaaaggaagatttgggaggttcaagaacaaaaaggttgaaactatgggtgaaggtggtgatgttcgcgatgacaatgtttggagtgacatcgacatttgcaatgatggcaaggcaaagtgtgaggatcaaaggaagtggaagaaagtaacaaatgtgtaa

SEQ ID NO: 26186 - DNA, 195 bp, Glycine max
  Peptide Sequence Number=SeqID_142964
atggttcagctaagcgcacatcgctgcgctaaacccaacatcttcactaaagcgctaagcgctgctgccacgctaagccccaaatgcttactggaagttacaacttccagttgggcttaccgcgaggctaggctaagcgccagtgttaaactcaaacgtcacgttggcacgctaagcgcgccatacgaattttag

SEQ ID NO: 26187 - DNA, 1077 bp, Glycine max
  Peptide Sequence Number=SeqID_142965
atgtctggaacatattacaaaggatattactatgttggaatatcatcacaggaatcacttctacccaaagagcaatgctgcatatctcgtggaagttttgtaaaacttagtgctcgatctggtgaaacgttgtggaggacttatatgttgccagataacaataacagaagaggagaatatgcaggagctgccatttggggaagcagcccgtccattgacgttaaaagaaaccatgtctatattgccaccggcaatctctattctgctccattacacatacttcagtgtcgtgagagacaaaataatcgaactgaacctactcaaccagacgagtgtatcgaaccagaaaaccactccaattctatattagcccttgatttggattctgggaagatcatttggtactgccagttaggaggatatgatgtatggactttagattgtaacaatgcttcaactcctaattgtcctccccgaggtctccggcaagatgctgattttggggaggcaccaatgatgttgacaacatatataaatcaaaccaagaaagatatagttgttgcggtccaaaaaagtggttatgcctgggctttagatcgcaacaatggtaacatcatttggtctacggaagctgggccgggcgggcttactggaggtggaacatggggtgcagcaactgatggaaaaacagtttacacaaatattgtcaattctgatgccaaaaattttactcttgcaccatcaaatgtgattacaacggctggtgggtgggtggcaatggatgctagaaatggtagagttctttggtcgacagctaatcctagtaacagcactgctaatggccctgttagtgttgcaaatgaagttgtctttgctggatccgcggatagactgggatacatatatgcaattgatgccaagagtgggaaaattttatggtcctataaaactggagccagtgtctatggtggcatgtcaatcagcaatgggtgcatatacgtgggtcatggatacagtgttggtcttgttttcagctatacgggtggtaccaaactgtttgccttctgtattgtctaa

SEQ ID NO: 26188 - DNA, 1539 bp, Glycine max
  Peptide Sequence Number=SeqID_142966
atggggcatggacacaaatcacaagactggttaaaccatggtggagatctgttcaacagaagatatgcttacaaagagcataagatcagcccaaaaacagcaccgaacctacgtttgaagtggaaattcaatgcaggcaaagacatcagtgcaacaccagccatatatgatggtaccctttattttccaagctggaacggtaacatctatgcagttaaagaagctgatggatcgcttgtgtggaagcagaacttgcagaatctgacaggtataaatgcaactggctatgttactactgtaaattggaccgtgtcaaggtcaactcccacagtagcaggggatagactgataattggagtctacggcccttgtattcttattgctgtcaaaagaacaactggtgagcttgtgtggaagaccactttggataaccatcctgcagcaatcatcaccatgtctggaacatactataacagacatttgtatatcggaatatcttcagtggaatattttgcaccctttgagcaatgctgcacattccgtggaagttttgtaaaacttaatgcccgatcaggtgccatcttgtggaagactttcatgttaccagataacaataacacgagaggagaatatgcaggagcttccgtttgggggagcagcccttccattgatgttaaaagaaaccatgtctatattgcaactgggaacctctattctgccccattacgcatacgtcagtgtcgagagagacaaattaatggaactgagcctactcaaccagacgcgtgtgttgaaccagaaaaccactctgattcaatgttagcccttgatttggattctgggaaaatcaaatggtaccgccagttaggaggcgttgatatatggctctttgattgtgtcgatccttcaactcctaattgtcctcctcaaggtatcaacccagatgctgattttgcggaggcaccaatgatgttgaccacatacgtaaatcgaaccaagaaagatattgttgttgcaggccagaaaagtggcattgtatgggctttagatcgtaataatggcaacctcgtctggtctaagcaagctgggccaggaggggtaacaggaggtgcaacatggggtgcatcaactgatgaaagaagggtttacaccaacattgccaattctgaggccagaaatttcactcttgctccttcaaacatcactacaactgctggtgggtgggtggcaatgaatgctagcaatggtagagttttatggtcaatagccaaccccagtaacagcactgctcatggccctgttagtgttgcaaatgatgttgtcttcgctggatccacggatagaaatggatccatatttgccatcgatgccaagagtgggaaaattttatggtcctatcaaactggagccagtgtctatggaggcatgtcaattagcaatgggtgcatatatgtgggtcatggatatagtgtttggggacctgatctctttaacttttccggtggaatctggctctttggcttctgtgttgagttctaa

SEQ ID NO: 26189 - DNA, 1317 bp, Glycine max
  Peptide Sequence Number=SeqID_142967
atggggcaagggcaatccaaagacgagttgctctaccagcaagtcagttatgggaacgccgaaggaatcaaaacccttcacagagaaggtgcaggcctagagtggagggacaaagatgcgaaaacccccttgattgttgcttgtatgaatcctcagctttataatgttgccaaaactttgatagaacttggagccaatgtcaatgcatttcgtcctggtcgtcatggtgggactccattgcatcatgcagctaaaagggactttgatagtattgttaacttacttcttttgcatggagccaatcctttagtcttgaatgatgattgtctaactgctcttgaggttgccagggccaaaggacacagcaatgttgttcgtacaattgagtcatctatgcttgttctccggttggttgcgcgagtttcatggtcctgggtttctagaagtagtagctcctcagttggtatcaaagaaagtgtggttggctcccgtactcttgccaaaccttacaagttggagcttgccatatattctaggttgcaggatgcacaaccacatactgttattggactgtggaacgccgatttacaagaaccaaagcttcaccagtctgatccgtcagtgacagttgttaatcacactactagtactctcttatactgtgctctttctccttgctctttctcctttcctgcaagtcctgcattcttgcaaaacaatgtgcctacaggtccacccacagcaccaccagatgcagaagacacagagttggctatggccatcagtgcatcccttcagtctgccatgcaggagagaccaccctttcctgatacacagccaagctttgatgcaagctcttcaagcagtgcagtgaacacagacaatcatggttttcttggcacaccaaatcccaatacaagtgatagtgagttggtacaagaagctaacccggatggcaatactcagcacctccaaagctgtgtgaatcctagtgctttggatttgaatccatccgctccgccaatcaccaatgagattccaggagatggccccattcagtatccatcaattgatttaagcccagttgatatggcatctccagatgctgagaagcttcttaaagaaggagaaaaaagtgccggtggaagtagttcatcatgcgtgatatgtttagatgctccagcagaaggggcatgcataccctgtggccatgttgctggatgcatgtcttgcttgaacgaggtgaaatcaaagaaatggggttgccctgtatgtcgagctaagatagatcaagtcataaagctatatcatgtttga

SEQ ID NO: 26190 - DNA, 495 bp, Glycine max
  Peptide Sequence Number=SeqID_142968
atgtctcgtctgagggtaggaaagaagcttgagcctgccaagaagacttggaagagcatctccaagaaagtgcaatcaaaagtccacaaactcaacattccaaaatccatcgaagccaccttcaaacacctccttgccatcttgcactcccttcatcatctcataacctcgagaggtcgtcgtcgtcgctctctcccttcgaataattaccatgttcatcattgcaagaagaacatgtctgccatacgcatagataacctctttactgagccttcttctgtgcatgcacatgatcaagggaaaacaagcagaggcaaagaggtgatcattgacagtagcatggatactatagaggatgcatggaaggctttggttgctaagacccccgagcttcacgttgatcagaaggtagaggagttcattgccaagttccgggaagaaatgaggcttcaaaaagagaggtctttgcaggaatttctggaaatgctagcctga

SEQ ID NO: 26191 - DNA, 618 bp, Glycine max
  Peptide Sequence Number=SeqID_142969
atgctggagctggatttctcgcagcagctgggcgaccttaatctcaacgtccgcgccgatttgccggcgcagggcatcaccgcgattttcggcctgtccggcgcgggcaaaacttccctgatcaacgccatcggtggcctgacccgtttgcagcaggggcgcatcgcgctcaatggccgcacgctggtggataccgccgcgggcctttgcctgccgccggaaaagcgccgtatcggctacgtgtttcaggatgcgcggctgttcccgcactatcgggtgcgcggcaacctgcagtacggcatggcggccggcatgcgcgcacagttcaacaccatcgtcgagctgctgggcatcgggccgttgctcaatcggctgccgctgacgctctccggcgccgctggcctcgctcgatctgccgcgcaaacgcgagctgctgccgtatctggagcggttggcgcaggacgtcaacatccccatcctctacgtcagccacagcctggacgagatcctacgcctggccgagcaggtgatggtgctggatcgcggcgaggtgcgcgcgtttggcgggctggaagctgtttgggccagcagcgcgctgcggccgtggctgcagcgtga

SEQ ID NO: 26192 - DNA, 348 bp, Glycine max
  Peptide Sequence Number=SeqID_142970
atgaaggttgacatggaggccatgaaagaccaaatggccaccatgatggaggccatgttgagcacgaataaaataatggaggttaatgcggctgcagttgtcgctaccagcgccaccgttgaggtggacccgactcacccatctttttttaatcaagtaaatcctccagtctcgaatatagtagggcagggaagcgaagcgttaggaagtatgggcggccctcattttgtgcaatttctgaacaagcattccttcccaccatatggcttgcctcctaacaatacaccacccaatgttgcacacgctcccaatgagaatgtcaataactccatctcccatactcattga

SEQ ID NO: 26193 - DNA, 1227 bp, Glycine max
  Peptide Sequence Number=SeqID_142971
atggtttctgagtggatgagtagcaaagggctcccaatttcctcacgtgaccaagcagtgcagctggatctcattggtagagttcatggagtggagagtgcagagaggtatcttcagagtttgagtgatggagacaaaacttggaaggttcatggtgctcttttgaattgttatgtgagagaagggttggttgataagtcactctccctgatgcagaaaatgaaggacatgggttttgtttcctttctcaattacaacaacataatgtccctgtacacgcaaacccaacaatatgagaaagtccctggtgttctggaacagatgaagaaggatggtgttcctccaaacattttcagctacaggatatgcataaactcatattgcgtgagaggtgacctcgcaaatgtggagaaactgttggaggagatggagagggaaccccatattggcatagattggattacatactctatggtgaccaatttctacataaaagcagacatgagggagaaggctctggtgtgcctaatgaagtgtgagaaaaagacacacaggggcaatacagttgcctacaaccatctgatttcacacaatgcagctcttaggagcaaggggggcatgatgagagcttggaagctccagaaggccaactgcaagaagcagcttaatagggagtatataacaatgttgggttgcttggtgaagctgggggagcttgataaagctgaaaaagtactcggtgagtgggagttatctggtaacacttgtgatttcagagtgcctaacatccttctgattgggtattgccaaaggggattggttgagaaggcagaagcacttctccgaaaaatggttgcggaagggaagacgccaattcccaacagttggagcatcgttgcatctgggtatgtggccaaggagaacatggagaaggcatttcagtgcatgaaggaagctgtggctgtgcatgcacagaataaacggtggagaccaaaagttgatgtcatttccagcatattcagttgggtcactaataacagagatatagaggaagcggaagattttgtcaattcatggaagtctgtgaatgcaatgaataggggcatgtatctgtctttgatgaagatgtgtattagatatgggaagcatgtagatgggattttagaaagtatgaaagctgataatatagagatcgatgaagagataaaggaaactcttaactcataa

SEQ ID NO: 26194 - DNA, 774 bp, Glycine max
  Peptide Sequence Number=SeqID_142972
atggggcctcttgtgatttcttcaagttttctttggtatcttagctttgttctaagtgctgcagttagagtagtccacgtccaagctaattacggttggcttaacgctcatgcaacgttctatggggccaatcaaaatcccaccacccttgggggagcatgtggctacgatgatacctttcatgcggggtttggtgtgaacaccgcagcggtgagcactatgctgttcagagacggtgaggtttgtggtgcatgctaccaagtgatgtgtgactttagggcagacccaaaatggtgccttattagccgcggcgtgacagtaaccgccacaaacttttgccctccgaataaccatggagggtggtgtgacccaccttaccatcacttcgacatgtccatgcctgctttctttcgcattgcacgacaaggcaatgaaggcattgttcctgtcctttatagaagggtgacatgcaagagaagagggggagtgaggttcacactgaagggtcaatccaacttcaacatggtgatgatatcaaatgtgggtggaagtggggatgtgaaggctgtgtggatcagaggatcaagaagtggagcatggctgccaatgcacaggaactggggtgccaactggcagagcagtgcagatctaagaaaccaaagactctcattcaagatgacattggttgatggcaagacactggtgttccttaatgttgtgccttccacttggagctttggacaaacattttcatccaagagtcagttcttttag

SEQ ID NO: 26195 - DNA, 546 bp, Glycine max
  Peptide Sequence Number=SeqID_142973
atgaagcttgcatctacagttgtcaaagtattgacaatcaaaatttctattccttggattatggggtcgaaccaagcacatgcttttaaggaaaggttcatcaagtcaaggaaagaatgtgctttacggtgcctttaccgaacgtgtgccaaagctagagtgatgagtgaaataaaggaggtacaggaacagatgaaggccgacatggaggccatgaaagagaaaatgaccacaatgatggaagccatgatgagtatgagaaagatgatggaggtcaacacgactatagtcgttgccgccactgaggtggacccgactcacccatctggccccaatcaagtaaatcctccagtcttgaatatggtagggcaaggaggcgaagcgttaggaagtacgggtggtccccattttgtgcaggttcagaacaagcattccttctcaccatatggcttgcctcctaactatacaccacccaatgttgcattcactcccaatgagaatgtcgacaactctgcacccatacccactaagagccaacaaccctaa

SEQ ID NO: 26196 - DNA, 240 bp, Glycine max
  Peptide Sequence Number=SeqID_142974
atggaggagattgagcttaggcattgggggaggggggatgtctcattcccttttgaatttttgaaaggcgtagaaaactttcttcatttgtcagatgacaagtggtttgtgtttaagcatgacaatgttgaggctgagaaggtagttgagactatgaaattcaagtcctggatttggctatcttccaaactaggttcttttagatactcagtccatgaatggtcaaatttttttacctaa

SEQ ID NO: 26197 - DNA, 244 bp, Glycine max
  Peptide Sequence Number=SeqID_142975
atgtcgcccttgtatccgtacccatatcaaagcggaacttcatcagatgcatattttatgggaacgcaacctccgctacaaccaggatatgttatggctgacttatttgggtctccttctcctgcgggaaccccttcatttgcacatggttgtcagatatcaatgcctaatgccccaatggatcctccatggagtgtgtcgagaaacatttctaacattactgatttattaggggtagatttag

SEQ ID NO: 26198 - DNA, 312 bp, Glycine max
  Peptide Sequence Number=SeqID_142976
atgaagcatgatcagtttctttggatgccatatcttctttatgtccaaacaatgccaccacaagcatttaacgattcacacatatggactgcattggttcattatgcagtggtcgtctacaacagacagaccagacaagaaaaagtcttggtaaggcaacatgtgcaaggacttctacatcagacccctaaataccttcaatggtaccatattaattcggtacagccaaggaacataactccacaacccaacaacaatggtccgtacgacatgttgaatgaagaccttgaagcacatcatcatcaacaatag

SEQ ID NO: 26199 - DNA, 258 bp, Glycine max
  Peptide Sequence Number=SeqID_142977
atggccaaaatacaaggcctaaaagaaggaaaaaactattctaatatttacaaagaagagttgacccaaccttggcctatgggctcagaaatctaccctgagatggaagaattggagagagttcaatctgtagtaaaacttgtagcacaaattctctctctagatgtttctcaaagtcaagctgaaatagacattgccactactcttaatgacatggactctattgaaagggaagctcttgaaaaggccatcctttag

SEQ ID NO: 26200 - DNA, 360 bp, Glycine max
  Peptide Sequence Number=SeqID_142978
ggtttgtgtttttctttcttcctcactccatctcggctattccgtcactccatcacaatggtgggactatgaaagtgaaggtaaggtgctccatgcttgtgcgtggtggctgcggggactgtgcaaagcgaaagtgcaagtggtcgagactccaagtgcgcctttcttttgcgagactgcgagggtgtgagtgcgtggtggctgcggcgacggtgaagtgcgtgattgtgataatgttgaaggaatctcactcttttgcttaccttgatgtggccaatccgatgacactcgacctcattggtcttctctttgagtttacgtttttgcttccttctttggagaaatggaacatcatttcag

SEQ ID NO: 26201 - DNA, 378 bp, Glycine max
  Peptide Sequence Number=SeqID_142979
atggtttcaaaggatacaaagttcttgagtggtagacatgacacaaagtctagaaaaaaaattgatattgggactcactcttcattcagagatacaacaattagatatggaaaaggtcaatctcttcaagctttggaaggaaggtttttcaggtgtatcctcttagtgcaagcatctggaaaagtaaagaggctgagtttgctaaaattcctttctctactcccttggatctacaatagttgttggttctcttatgtaccttcaatgttgatgcaatcctaccccccaagggtattggatagaagactccaagaggattgggctagagcggctaaagaaggccctagggttctcatgaacctcaaggtagatttatga

SEQ ID NO: 26202 - DNA, 252 bp, Glycine max
  Peptide Sequence Number=SeqID_142980
atggatacgtttgttgacctgaatcgtaaaaccttgtctgcacatggtcgaaacccaagctcggtttggaatatctccgatcctagcttaagttgttccttgttattgttaatagtgggctattgttttggtgtgagaatatggtgggtggaagagaaatgggcgttggaatttagaaaatcctcctttatgggtgatggatttgagtgtagtgtgcaggaaaaacattacgccattgaagagggattatga

SEQ ID NO: 26203 - DNA, 168 bp, Glycine max
  Peptide Sequence Number=SeqID_142981
atggaggatgagttctttctagatatcatgggagtgatggatgaaaaggtggttcgtataaagatagtgatgaatatccttgtaggagaacacaatcaatttttacaaagtgtaatgcttaaggcagataagcattgggagatgatgaccacacctacaacaatttga

SEQ ID NO: 26204 - DNA, 228 bp, Glycine max
  Peptide Sequence Number=SeqID_142982
atggtggagacaaatgcttgtccggacaattatttggatggatacatggaggcacctggttggagcatcaacaatcctcgagactttctcaaaactagacgacatagcttgaagaaaaatgtcactactaaaaaaatgagttttaacatcgtcctatttaacatcagttatttaaaaatcgatgtcgttaagcacttacaacatcggttttcaaataaccgatgttaa

SEQ ID NO: 26205 - DNA, 1743 bp, Glycine max
  Peptide Sequence Number=SeqID_142983
atgctgcagaaaactgatggaaccttgcttgaaaaccagtctgagatagaggatgagatcatggatttctacaagaaactcatggggactgaggatagccagctgcaccgtattgacatagatgctatgagaaatggcaaacaagttaatatggagcaaagaagatatcttagagcccttgaagggataggtgatgataaaagcccagggattgatggttttagggctaagttttttaaggccagctggtgcatagtaaaagaggatgttatagcatctattctggaatttttcaacataggaagattgtatagaggctttaataatacagtggtaactttaatccctaaaggtgataatgctaggtatgtgaaagattatcgtcccatagctggctgcacaactgtgtataaaatcattgccaaaatcataactgagagattaaggaaaattctgcctagcatcattagtcatagccaggctgcctttgtgcctgggcagaatattcacaaccatatccttttagcttatgagctcctcaatgggtatggcaggaaaggtggagggccatggaatggggatagtaaatctgtatctatgatgatggaaaccattagaaaattttctgattctacagggttaaaggtgaatccagcaaagtgtcagatgttctttggaggaatggatggttgtagcaaagaaaatctgagaaggataactgattttgcagaaggaaaactccctgtgagataccttggcgtgcccttatcttgcaaaaggctcactattcagcagtacatgccactgatagacaaaatagtggacagagtgaagcattggactagcaaattgctaagctatgctgggagaatccagttggtgaagagcatcactagtgccattgcaatgtactggatgcagtgcttcccactgcctcagtttattcttaggaagattaatgctatttgtcggagttttgtttggacaggtaaacaagagattagcaagaaaagcctagtagcttgggatacaatgtgtaggaataaaagccagggtggtgttggcattattaatttgcagggcaatgatgctattactgcttttgtcaggcctaatagttcttggatccttaagaacattatgaagcaaagagataaactgggtcagatacaacaacattgggaccaagctctcagtagacagaagtttcctatgagtgctatgtatcatgggctgacagaggaacaccaaagagtgtcgtggaggtctgtgatgtgtgggaacaaggctagaccgcgagctgtcatttgcttgtggcttgcttgtcacaaaaagctctctactaaagatagattaagaagatttggaatgatccaaagtagtgattgcagtatttgtaactgtgctgatgagtctataaatcatcttttcttcaactgcagtggcactagagaaatttgggggaacattttggattggctgggtagaagacatgatccgagggagtgggatatggagcttgcttggattattgagaacaccaaaggtaaagattggaaaagtgctctgctgaaaatggcaacagcggagacagtttataatgtgtggcactatagaaatagcatgtgctttggcacagttgtggataaacaggttatagaaaggaatatcattgacaacatagtgtatagaagttggcaatatccaactcttagaagtcatgttgcaaagctaatgatgtag

SEQ ID NO: 26206 - DNA, 1149 bp, Glycine max
  Peptide Sequence Number=SeqID_142984
atggcgaaacgggggcgagggcggccaccgaatacggtgcctccgccaccggtgaatcatcctcaaccggcgactaatctggtagtggagactgagaatcacgagttacagaagcacgaagaaactattgaggaatttgaagcaacaacgaagagtcccgaaaccctaattgaagaaccgaaggaggtcactgatcgaaaactgtgggtagatgttctaaacaacaatcgtaatccgtccaacggcgtaacaatggagtttgtagcacccaaactgatcaatggtgaagtggaagtggaaattgaagcggaggacattgcgtcagaacttcaattttgggaaaacgcgatgatactgtatgtgctgggaggtagtttgagcatgactatgttgaagaactacatggtgaagatgtggaatttcgttactcttccagatatgttgtatcacgatgacggttacttccttctccatttcaagaatcgcgaagacagggaaactgtgatgatgagaggaccctacaccatccgccacatgccaatcatactgaaggaatggacgccagatttcaatctaagcaaagacctggagagaactatgccgatttgggtaaagttaccacaattgcctctatgcctttggggattgaaaagcttgaacaagataggcagcgcaataggcaatcctttgatgactgatgaatgcacaactcagaaacttagagtttcttatgctcgcatattggttgaggttgatattacccaaaaattggtagaggaaatcaccatatctgacagaactggaggaaagataaagcagattgtggaatacgagtggaagccagaattttgtgagaaatgtcaaaaggctggtcatcaatgtggaaagaagaaagttgtcaagaaatggatacctaggaacaagcaagcagatgaggtaaaggcagatccccttccaaagacacctgtgcagaatactgaaactgaaggagaggacaaaccagaaggttggattacagtgggcaaagctgcaagacatataggcaaagctatagaggtaattggtacatctaatgttgattgttctaatggtttcaaggctctagaggttttgaatgactctctaggaggcctaggggtggttacatga

SEQ ID NO: 26207 - DNA, 147 bp, Glycine max
  Peptide Sequence Number=SeqID_142985
atgtcaagtgcatcttctgcacgtgccaacacacatgggatctccaatccgccttctgcctcaaacgtggctttggagagtatcatctatgtagttttctccaacatattgaagaacactcagattcacttacttgctgatttatga

SEQ ID NO: 26208 - DNA, 294 bp, Glycine max
  Peptide Sequence Number=SeqID_142986
atggggttcaagggattacatgcttacaagtattttaatatgcacagatttgatccaactagtttcaagacaatcttttttagtcaaaaccaattcaggaaagctttctttcatcacttggaggagtctgtcagcaccaccaaggaattgagcattataagatgttgtgatagttctcttagttttgttcccaacagtggctggttgaatgatgactctgatgaagagatcctcatcaatatagggtgccacttcctgccatcagtggagaatcctggttgcatcttgctctag

SEQ ID NO: 26209 - DNA, 455 bp, Glycine max
  Peptide Sequence Number=SeqID_142987
tgacttgctcaaagaaacttggaattcatctgagaattcgtagcggtggccatgattatgaaggactctcatatgtttctgaagttgagacccctttcataattgttgatttgtccaagcttcacgctgtcaacgttgatatagaagacaacactgcttggattcaagtcggtgccactattggggaggtctattacaaaatatatgagaaaagtttggttcatggtttccctgcaggcctttgcacaagtttaggtgttggagggcacatcacgggaggtgcatatggatccatgatgagaaagtatggccttggagttgacaatgtcctagatgcaagaatagttgacgcaaatggccaaatccttgatagggaagccgtgggggaagatctcttttgggctattagaaaaggtggaggagcaagctttggtatccttctttggtggaaataa

SEQ ID NO: 26210 - DNA, 429 bp, Glycine max
  Peptide Sequence Number=SeqID_142988
atggagatggcctcaaactatggagcattcatggagacaaagacagaggacactgaaagtacgaatgcgagtgctaagacggaggagactgagactacgagtgaggaaactgagagtatgagctccgagagtgagaagctcaggcgcctcctcatcgagatggttgtggaagccacatttgaggcgctcaacatcgatcttccttatcttccttccgctgatgcttctccaaatcccactctctttgaagttatggagaaaccctcagaagagtatgtagttgcacctctggatgctagtgtggtgaaggcctgggtagcacatgacgagcttgaggagggaggacaaggtggaaggggaatcagaggcaaggaatgggaaggtttgggagcagaagaggtgaatgagggtggagaatcgattttttaa

SEQ ID NO: 26211 - DNA, 1560 bp, Glycine max
  Peptide Sequence Number=SeqID_142989
atgacccaagaaaccgtggaccacgaccaccaacaagacgacgacaccgagtcttgctttttccacgactccaacgaccgtttactctcctcttcttcctcctgctccacttccacctccgacgacgacactcccactacccaaaacgacaccctcactcaccgaaacgacgcctccatcaatgccctcccacaattcccttttccaactatgtgcaagtacgacgcttggatctccgaaccctcctccctctccgaacgccgctcccgcctcctccgccagttcggcctccccgcgccgccgccttcctccgccgcaatcccccgatcagcctcctctcaccattgcaccgacacttcctccaccgccgcctcgattccccgatcgaaatccgacaacacctcggatcgcggcaccaagcattgcaagtcttctgttgttccaatccacgacaatgacgacggttttctcgtaaataatagtaataatcgtggtggtggtggttctgtttgtgtgaataataataggatttgtgtgagtgtgtatgaggatgatgacgacggtggtggtggaattggggagggtaatgttaatgtcagtaatgtggtggatgaaactgtgcaagcgtgtacgattagggatttggataatggaaaggagtttgtggtgaaggaggatggggtgtggaatgaggtgaaggaggtggggactgggaggcgtttgactgtggaggagttcgagatgacagtggggcattcgccaattgttcaggagctcatgagaaggcagaatgtggaggaaggtggtaatggggagggtgtggatggtgatcgggatggggatggtggtgttggtggtgatgatgatgagggggatggtggcaaggtgaagaggaaaggagggtggtttaagtttatgagtttgaagagtgttgtggtgggtcagaaggagaggcggagtggggacgagaaggatacgtctttgtcggagaaggggggtggccagaggtcgagttcggccacggatgatagccaggatggtggtggtttggttcatgggggtgagagagtgagggttaggcagtatgggaagtcatttaaggaggttacgggcctttataggagcccggagattcaggctcatgagggttccatttggtgcattaagtttagtttggatgggaggtatcttgctagtgcgggtgaggattgcgtgatccatgtttggcaggttgtggagtcagagaggaagggcgagttgctggtggagaaaccagaagatgggaatttgaacatcatgtttcttgtgaatgggtcgccagagccttcttctcctggcatggacaataattcggagaagaagagaagggggaggttgtctgttagcagaaaatcattgagcttggaccagttagtggtgccagaaactgtgtttgcactcactgaaaaacctgtttgctcctttaagggtcatctccatgatgtgcttgacctttcttggtccaagtctcagataaaatcacttagaggaaacagctggacttttcaacttattggttaa

SEQ ID NO: 26212 - DNA, 408 bp, Glycine max
  Peptide Sequence Number=SeqID_142990
atgacgacggtaaagatatcactggtggaagtggcgatagtggcaatgacggtggtggaggtgacattggtggtggtggtgatgtttgatggtggtggtagtgatggtgacgttggtgatggcggtggtattagtggtgatggtagcaatgtcagtggtatcagtgatgatggtggtgacaatgatggtggtggtattgttggtagtggtgatggtggtggtggtggtaataacaatataaatgacaacgatggtgcaatgacgatggtgcatggtggcaatgatgatgtgagagtagcagtgttggtgtttgtggtggtgacaaacagtaatgacgatgataaagatgatgatgatggtgacaatgacaaaagtggtattagtggtagtgacgttggcaggcaatga

SEQ ID NO: 26213 - DNA, 402 bp, Glycine max
  Peptide Sequence Number=SeqID_142991
atggcaaggaaaagtgtgattcagagggagaagaagagacaaaaattggaacagaaatatcatttgattcgccgatcctcaaaaaaagaaataagcaaagttccgtcgttaagtgataaatggaaaattcatggaaaattagaatcactaccgcgtaatagtgcacctatacgtcttcatcgacgttgtttttcgaccggaagaccgcgagctaattatcgagactttggattatccggacacatacttcgtgaaatggttcatgcatgtttattgcccggtgcaacaagatccagttgttatcaattcttctctttatcgcggagtagagcaaccttggtagctcgcaaggctcataaccttgaggtcacgggttcaaatcccgtctccgcaacattttga

SEQ ID NO: 26214 - DNA, 138 bp, Glycine max
  Peptide Sequence Number=SeqID_142992
atgtatcgggggccccgtggctcgttcggtgtagaaggtcgatcgaaagtcggcccgtccgggcaggcagaaggaatatacactaatgcaccggatcccatcaaaactccgcatttaagcgtgcttgggcgagagtag

SEQ ID NO: 26215 - DNA, 978 bp, Glycine max
  Peptide Sequence Number=SeqID_142993
atggtttttccagaattacaaggcatcaaaaaagatatagattacccatggaagcaagacatcataggtgatccatcaacaaatgttataacaaattggcaaataagagatggtgagttaatccaatcggaattacctcccacgaccaaatatcaacttccgaatatcaaagacagtaacaataaaccagtaatggcaaccccatttaaaacaaaagatattaatgaggaagtaacctctgaagatattaaaagcctaatggaacaggaaaattacaccaataaatatttacaagttttaggagaaaccattaagactaaggtagttcctaaacaaaaatcggttgaagaagcctctccaagtattcccattgaaaaaccactgttcaaacctttcaaagttagtgaaaaggctaaacgaaaaattagagaacttaggaaaactaaatccttagttgaaggagtaggtgacaatcatagtgaattactaaacaagattggtagtttacttaaggtcattccagatacttcccaaacatcggaaaatacttccaaaatggtaacaagaagtacctccaaattaattaatgttattaatgaagatagtgaccaaaactcagataacataactgagttaggatcagtgtcagaaaagaatataaatccaattaattccaaacattggaaaacaccttccaaattatattatcaacgtccagctgcctttgaccttctattagaagaaagaggagaaaacaattttaagatttttagtgcaaacaacatctatgaatggaacatagatgcacaaatggagtataatatcacgaatacactccaacatatgaccatggtagctatggcttaccaaacctcccacgaatgttcaaaagaaaccattatagatatcttagtggcaggattttctggacaactaaaaggatggtgggataattatctcactaatgaggagaaataa

SEQ ID NO: 26216 - DNA, 267 bp, Glycine max
  Peptide Sequence Number=SeqID_142994
atggcaatgggatggggcggggacgagtattgtctccccaatccccgaccccgactccccaacatgtccccatacacgtacccaatactcgacgggtccgggttcggggtcaaggcagatgcattaatctcatacccgtacccgtacccgacttttggttgtcgaggaaaacccgaactcatgcccggtcaactcgggtattacccatcaaagtcaggacagatttggacgggtacccacgggtacaggttttcttgccatgtctaa

SEQ ID NO: 26217 - DNA, 376 bp, Glycine max
  Peptide Sequence Number=SeqID_142995
atgattgaaggttgggacaaggaagggacaaaggagaacacacatcttttagaagaaattgaaaagatcttatgctatgtatgtgatgaagtctgcatatgcttgctgcattcgtatggcttgctacattcgtatgaccatagagtggtgacagtgaagtgccttaagaatgtcacaagtggagatgctgagttttgggcagaagtcacaatcattgccagaatgcaccacctcaacttggtgaggatgtggggattctgtgctgagaagggccaaaggatacttgtctatgaacacatccctggtggatcattggacaagtacctcttcagggtcaataagtctcataacaataaccatctcaaggagcaatcaa

SEQ ID NO: 26218 - DNA, 1091 bp, Glycine max
  Peptide Sequence Number=SeqID_142996
taacttgcatccagtttaatcctgttgatgatagatacttcattagtggatctttggatgctaaggttcgtatatggagcattcctgatcgacaagttgtagattgggctgatttacatgagatggtcactgctgcttgttatacacctgatggtcagggtgcgctagttggtacatacaagggtcgctgccatttatataatacatctggtatcatcagcgagattctctttacctgtatatacacgattcttatgattgcagggccactgattattgttattattatcattttttccccatttcattcagaaaataagttgcaacagaaaagtcagataaatttgcagaacaggaaaaagagatctaaccacaagaaaattactggcttccagtttgtgcctggaagttcatcagaagtacttatcacttcttctgattctcggattcgacttgttgatggtattgaattagttcataagtttaaagggtttcggaatgcaaatagccaaatttctgcctgcctcacagcaaatggtaaatatgttgtctcagcaagtgaggattctcatgtatacatctggaaaaatgaagctgattgcagacctagcaggagtaaaggtgtcactgtgacaagcacatatgaacattttcactgtaaagatgtgtcagtggccattccttggtcaggtatggatgatacatgggagatgcatgattcatattttgcagaagaacctgagcttgatgatgatggggatgaggatgaggtctcatcggccaatcatcctcctactcctgtagaggaaaatctaggttctgagggttcacaatttgcttcaggttgcaacaacagtccacttcatggaaccattgcaagtgcaacggatagttattttcttgatagaatttctgccacatggcctgaggaaaaacttctaacaacaagggaccgaagccctcgggtaagtgtggatttatctaatggggtgaatcaaaacatgtcagcctggggtatggtgattgtaactgccagccttcaaggggaaattaagattttccaaaattttggattgccacttggtatataa

SEQ ID NO: 26219 - DNA, 201 bp, Glycine max
  Peptide Sequence Number=SeqID_142997
atgagaggcgatgacattgacaatggcagtgacatcgaacaggatttgagacatttgggttttatcgacatcattaataagcctcttatggaagcactcgacctaaatgatgttgagataaaacaatacttatcagaagtattgggatcaatccttaagtgtcaaatgcattattttggcatcaatgggttcaattcttaa

SEQ ID NO: 26220 - DNA, 951 bp, Glycine max
  Peptide Sequence Number=SeqID_142998
atggcattaggggtcatggcagctcgcccaggcgagctgttgcttcaccctgaagtagccttgctcgcccaggtgagctcaactcacccaggcgagctggttacttcacccctaagctatttaggggtccttttgtcggggttcaggaaaaagcttagaatgacccttttgccctcccctttggacttggctagaggcaatgggtgggaaaaaacttattctatcataactgatcaagatttagcaattggagctgctataaaaaaagtatttccagaaacaagacatcgcctttgcttgtggcacattaggaagaagtttcctgaaaagttagctcatgtataccataaaagatctactttcaagtgtgagtttaaaagatgcatccgagagtcaccttgtattgatattgttgaagaagaatggaagcacctaatgaaagagtataacttggaaggaaatgaatggtttaagggcttatacaggattaaagaatcatggatacctattttcaataggagtatattttttgctgatttagactcaaaggttgctaaatgtgacggccaactttttgaatttatggggatattgtggagacacatattagtaatttttcaagaaaaaggggttgttcaaattcctgatcattttgttttgcaactttggacgaaggatgcaaacaaatgtattgaggttagtgatattggaaataactttgatggtcagtccactacatctaggattttaagaaggatgcacacacaacaacaagcaaacatattagttgatcttgctgaagaattggaagagatatataggttcattgttttggagttgggtcaaactcacaagttagcaattgtaatgaaaacaagtttacctactggtgacaacataccacttttggagtcaagtctcaccattgggaacaaactctgcatgccataa

SEQ ID NO: 26221 - DNA, 135 bp, Glycine max
  Peptide Sequence Number=SeqID_142999
atggccattgttgcaatgacattgggatcattgggttcagatctggacgaaggtgatggcgcgcggcattggtgcgatggagatgggttgtgtggggtgaaaataagtctaggtcgatggcttattcaaacctag

SEQ ID NO: 26222 - DNA, 1298 bp, Glycine max
  Peptide Sequence Number=SeqID_143000
ctggatggattggaaatgatgcgatttctcccatcattggtgagcatgacccatacattagtgtatatgggagggagctgactcatatacgagttgtcactatacttatgacctttatcatggttgttgccattcttacatcaattgccattgttcgccgcatccttatggcaacatctgtcctgaaagttgctgcaaaagtgataggagaagttcaagccctcattattttccctctcataccatatactgtccttgcagtcttttacatgttctggatttcagctgctctccatttgttcagctctggccaggttgttcagaataattgcaactctaactgctgcacatatgatcttattgcaaaacgggtaaactgtgatcgttgttgtggttatagcattcattacacaccacatattggagttgccatccttttccacctatttgggtgttattgggctacacaatttttcatagcttgctcctcaacagtgattgctgggtctgtcgcctcatattactgggcacgcggtgaaacatctccagaaattccttttctttctgtcttttcctccatgaagaggcttatgcgttacagtcttgggtctgtggctcttggctctctgattgtatcattcgtagaatcaatccgctttctgcttgaagctattcgtcgtaaactgaaagtctcaagtcatgggcatgacagctgcttaggcaaggctgcataccaattttctcaatgttttctcaggtgtattgaatggaccatcaagtcagtaaaccgaaatggttacatcatgaggctgaaattcatttccctgctttggttgtgtattcatagagagcaaaacatgtcccagagctgtattctaattgctataactggcaaaagtttctttagcgcttcttttattgcaacagaactgatcatgaataacattctaaagattggccggcttaacgtgataggagatgtcattttgttccttggaaaactgtgtgtcagcctctcatgtgctttgtttgcgttcctcatgttggacacacacaagtacaactctgctcataacaagacctcatctccactcttacctgttgtggtttgctgggctcttggatacattgttgcaacccttttctttgcagttgtggagatgtcaattgataccatagttctctcattctgccaggattctgaagagcaccaagggacagcacagtatgctccaccccttctcgttgagacactcagtgaccaaaatgagatgcagagactcacacaaggaccctaa

SEQ ID NO: 26223 - DNA, 162 bp, Glycine max
  Peptide Sequence Number=SeqID_143001
atgggaagcagaggaatagttccggacaagtggtccatgagaattctttgggcttgtgctattggaagtgccgtcaaaagacaagcacagaacagacagaggatgcttgctgaagaattgaaagcaatggagtcaggggaaagcaacggcgaagatggctga

SEQ ID NO: 26224 - DNA, 486 bp, Glycine max
  Peptide Sequence Number=SeqID_143002
atggtgcctattgttgtaagcacgcatgaggaaatgtccacaatgatgactaccttgtttatttgccatcaaataggcttggagacacatgatatcatgtaccaactacctggacagttggtcgaaatagtcaaacccgtggtgcaaaataagatgcaacaatctaaggaattggaggcaaaaaaagtgcatgtcagtgagaattatgcttcgatcaatcccattggtctaggcgaatatggttttatgtctacatggcaggaaactctatcgaatatggcatcgacaggtgtagcctttacttggtattcaaatttaccaccgaattcaatacaaaattgggtagacatggataagtgtgatagattttacaggtctcaacctgaagtaactatagtcaatttgatgaacatgaggcaaatggttgacaaattggcaatagacttcacaaaaaggctggaagtcactgctcaatgcaattgctag

SEQ ID NO: 26225 - DNA, 942 bp, Glycine max
  Peptide Sequence Number=SeqID_143003
atggccatgcaaatatggttgaggagttggcgactattatcagatgctataggtgatctagccaacttggcaaatgatagtcgaattgacttcaacatggatggatcggaagctaaagcctccttaaaaggcatggcaaaagacacaaaaaccgtattggaagctggtaaaggattaatggtgattctagcttatgagctcttcttctttttagctgaaacagaagtcagacaagaagaaggttggggttggcttggagtttgggcaataggatatgaacatcctaggtcttcaaaaggttggtcgaataaggaaggaatctcatcaccaacaatagggagacccaagatggtagctatatcttgcagtgtgatggtcatgaagccaaaaagaaacataaaagtgtttgtggcagtgaaccaaaagctcaagaagctaaagattgaaagcaattactcttttgagccacctataataagggtcaaaacccctaggacaagtgcccaaattggaaggggtagatcttatctaaaaccaagaagtaatgcgaatcagatatctatcatggtgaaggtaatgcccaagaaaagtgacaacatctatcacatcataagtgcaagaaagaaagtaataatgtccttcaaaatccttaagaggattaatgaagctaccaagagctacaggttgttctttatcttgattgttcggaaactagaaaagaaggacgaaagaactattggtggtagacatggtgaaatcaaaggaaagattatcagaggtgaaagaagaagaaagcaaggattgggagccaacaaaaagtcaagaggcatatttcctgatgtagctccatgtggagcttgtaggccttggatcttcttcatcaatggagtcctttatttcttgaagatcaatggtagtggaatggagaaggaagaaagatga

SEQ ID NO: 26226 - DNA, 903 bp, Glycine max
  Peptide Sequence Number=SeqID_143004
atgtctgtacttgttgaggagaacatgttactagctgttaacattactggtagcgatacatggtatcgtgtacagagtgataaaaaagttgctgtctgtagcatacatccatctgagcaagccaccctgcaatgcctaggctgtgttaaggccaaaatacctgtttccaagagttaccattgcaccacaaagtgtttttcggatgcatggcagcatcatcgtgtcttacatgatcgtgccgcaagtgctcttaatgaaaatggaaacgaggaggaggaggtatttgggcgctttaatagtactgggtctggggcaaccaattccagcttatctgcctctgcatcaagtgctagcttgacaaatgggtctgcaacacctttgtatccagcagctatcacacaaagaagtggtgaaacttggtttgaagttggacgatccaagacttacacccctactgctgatgacgttggtcatgtccttaagtttgagtgtgttgtagttgatgcagagacaaaactgcctgtggggcatgccaacactatactaacttcacgtgtcattcctgctccctcgcctattccacgccgaataatatctgttgatgggatggcacatttagatgtggatgggagaatgacatcttcaggaacttttactgttctatcatacaatgtattgtctgaagcatatgcctcaaatgatctatacaattactgcccttcatgggctctttcttggccatatcgcaggcaaaatttgttacgggaaattgttggttaccgtccagacattatttgtcttcaggaggtgtacagtggcaacacaaatacaattgatgggtgtgcaacatttttccgtagagacagattttcacatgttaagaaatatgacgctgcgacttga

SEQ ID NO: 26227 - DNA, 540 bp, Glycine max
  Peptide Sequence Number=SeqID_143005
gcaaatacacatgtaaatgtcccccaagatctaaaggatgtgaaactctggcaggttcatactctcttaaaagggttggaaaaaatagctgcaagcgcagacattccgatgttggtttgtggagattttaattcagttccaggaagtgctcctcatgcacttcttgcaatggggaaggtagatccttcacatcctgatttagcagttgacccgcttaacattctacgtcctcacagcaagttggttcatcagttaccactggtcagtgcatactcatcttttgctagaacagttggccttggatatgagcagcataaaaggagaatggatggtggaacaaatgaacctttattcacaaatgtcactagagattttattggcactctagattacatattttacacagcggattcattggttgtggagtcattattggagttactggatgaggagagtttgaggaaggacacagcacttccttcacctgaatgtgcttgggttgagactaaggatgcaatggatgaaaataacgagatgtga

SEQ ID NO: 26228 - DNA, 177 bp, Glycine max
  Peptide Sequence Number=SeqID_143006
atggggttccgttgttgtgatacaccgaccagagagggtggtgcaacaatttgggtttgtgctgtgcctagacaatgtgcatcggactacatccactggttctacatgatttcgcatccattcatgatgccgaaacagcccgagaatccacctagacatccacctatgatgcgatga

SEQ ID NO: 26229 - DNA, 255 bp, Glycine max
  Peptide Sequence Number=SeqID_143007
atgaaaccaacttctatgacaggtctattcaaggcatcaacaaagcataaagtaatagtaattgcaaaggaaactcagaaggcaatcaaggacttcgtaccccaacaacaaaaggaagccacttcggtcccttcagaccattttgaagaagagacagacgaaattagggttgaggagagagagacagcgagggcatcgagcggaaccgaggccagggttgatggtgggatcgtggtggagatttccggtccttag

SEQ ID NO: 26230 - DNA, 555 bp, Glycine max
  Peptide Sequence Number=SeqID_143008
atgggtaagagacaaaaagggcagaagggctcgatcccagaccaggctccgctcaaggtgatgggaaggagaggagttctggaagggcccatgaccccaaagaatgattgttattgggtagtaatgacaggatgcccaagtttgggagagtttaccaaagaaggaagggaatcaagggaagaatcaagtaaagaggggagcagagctgcgtctctgcaggagccttttgatctagtttatagctccaggaatccttcaaggctgcaatggctgaaggcattgtttgatcttgcttgtagccatcaagatgacagagaagcagggactaaagtaagaaacccctacaatgttggggacaaaagtgggaatttacaccctgaatcatggagaggctgtacaccggtggacaaggcagttcaagaggagggaagtgataaggcccatgaatctgaaggagagttattgggtcataatgatagaaggtccaaaatttggagggtttaccgaaggataaagaaagggaatcaagaggagaatcaggaaatgtttggctga

SEQ ID NO: 26231 - DNA, 309 bp, Glycine max
  Peptide Sequence Number=SeqID_143009
atgcagagataccttatggttatccgcaccttttgtcagctagaggcaagcgagcctgttgacacgcagagaataacatcatcatctgcacctttgtcatctagagacggcaagtccaatgacatgcggagataccttatggttatcctcaccttttttcagctagaggcaagcgagcccgttgacatgcagagactagcgtcatcatctacaccttcctcggagatgtcagcatcttccggtcgagactgcaaaaaagtctcatttgctatccgtaagactcaaagctcgatagcatgtagtgactaa

SEQ ID NO: 26232 - DNA, 519 bp, Glycine max
  Peptide Sequence Number=SeqID_143010
atgggggaagagaagtgtcagacaatacgacaagaagtggccaagttgatggctgcccggttcatcagagagtttgactactcgacttggctctccaacgtgatcatggagaagatgacattcatcaccaaatccgcaaactttggttacaaagtcaagccctttggattgaaaaacgctaaagcaacgtatcagcgtttgatggacaaagtgttccaaggccaacttggacgaaaactggaaatttacgtgaatgacatggtagtcaaatttgatgacttgacaacccacttgacggccttagagaaatttttcggccaacttagaaagtataacatgaggctgaaccttgaaaagtatgtctttggggaggctcaaagactagccgacaagatagcctctttgttaaggtttttgccaagaattatcgaaagggctagacccattatgaagctcctcaagaaggccaaaaaatttgtttgggatgaaaaatgcaaagaagcctttcggcaactgaaa

SEQ ID NO: 26233 - DNA, 258 bp, Glycine max
  Peptide Sequence Number=SeqID_143011
atgtcggtccagcttccttggtctacatgggtcttcttgactgtgcagttggctatctcaagaatgataaccacaaggtcgtcctacaccaggatagatgccttgaagtcatctgttgtgaaggcaggggccccactcccaatgaaacctctaacaatggtgtttataacctaccttgttggtcgagaggagtgtattgggtataacgtggctctcgaggcgaccgatccctcctcccgtcgtcatgagctttgttag

SEQ ID NO: 26234 - DNA, 1107 bp, Glycine max
  Peptide Sequence Number=SeqID_143012
atgactcgtgaaaattcattcaaaacatggattgcttttatgcgagccttagagacagaatttggcccatcaccgtgtgaatgtcctagatctcagttgtttaaactcactcaaattggttcagttcagtcatattacgtgcagttcacggctttagctaatcgagtacaaggaattacacaagaagctctattggattgctttgtgggaggattaaaacctaatatcagaatggatgtcattgcgcaatcacctacatcactcctcagaacagtttcgttggccaaactctatgaagagaaatatacacctaaactcaaacctttttcttcgagtttttcttccaaaacacaaacctcaaacacaaactcaaacctaaacacaaaccaaaacagccctcaatccctaaaatccacaagcttacccccactattacccacaccatacaccaaacctatcaatgttaagaaaatgacatcggcagaaatgcagttgagaagggaaaggggcctaagctttacttgtgatgacaagttttcccctagccatcgttgtcctaataagcaacattttgttctacagtgggaagaagaggatgatcctgcattacaaccagatccactagacgaggttgagacagttggtgaccccagtttgcaaaatcatcatttgtcttataatgctttaaaaggctcatcaggtcttggaataatgaagtttcaaggatcaataaatggattgggagtgcagattctactagatagtgggagttcagataacttcctccagcctagactagctcaatgcctgaagttacctgtagaaccaattcctaatttgcaggttttggttggaaatggaaatgccttgactgctgaaagattaattcaagacttggaggtgaaaatccaaggtcatacactgaagctaccagtttacctacttccaatttctggtgctgatctagtgcttggggctgcatggttggcaacaattgggcctgatctttttgattatagtactctgacgttgaagttttacttgggtaatcaatttatcaccttacatggcttttttatcctccctaccacaacaggcttaatttaa

SEQ ID NO: 26235 - DNA, 204 bp, Glycine max
  Peptide Sequence Number=SeqID_143013
atggagaattgcactaagcaatcactacgcatcgctccaagctcgtgggtggaggatgcaagaacgaaaacacaattcatggggctccgaaaaagggttgaggatggagaatcgcactacgcagtcactatgcatggctccaaattcgtgggaaaaggacgcatgaacaaaaacgcaattcatggagttccgaaaaagggttga

SEQ ID NO: 26236 - DNA, 414 bp, Glycine max
  Peptide Sequence Number=SeqID_143014
atgatgatatcgggcccaagacaactaggaaatgacattgatgtttatcttagttcgttgattgaagacttgacaaagttgtgggacgaggaggtttcaatgtttgatgggtttcaaaatgagacttttgatttgcatgcaatgcttttttgtatcattaatgactttccaacatatgggaaattgaacgggtacaatgttaagggccatcatgcatgccccatttgtgaagaagacacaagctacatacaactgaaacatgagaaaaatgtctatgatagtgtcattgggaagctccttaacattcaaggcaagacaaaagatgttttgaatactcgtcaagatctagctgagatgggtatacaagcccagttacatccaaggtctgatggtaaaaaatatacttgcctctaa

SEQ ID NO: 26237 - DNA, 405 bp, Glycine max
  Peptide Sequence Number=SeqID_143015
atggcggttccaaagtcagaaaatatgcaaagacaagttgaaactaacaaggaacaagcatataaccatgaaagtgcttgggacgttagaaatggttttggaagaaagaaggagaagaaaatgatgtttttcctaagctacttggactacaaggctcaaaacgcacaagtgagcaatgctctcgggaacggaaacttagcacacactccaggcatcttttcaacgatcccaacggccaaatttcgagaagatccaacggttaacgaaggctggacaacatttttactgaggcagcttcatgtagcttccttgagaagcttcattaagaggcttcctcaagaagcttcctcgtggcttctttcagaagctttctcaagagtcttctttgagaagctaatgctttaa

SEQ ID NO: 26238 - DNA, 363 bp, Glycine max
  Peptide Sequence Number=SeqID_143016
atggtgaaaaacttaaaagaaggagcaatggcaggagactttgaagaaggactagccacacaaggggggtgcattgaccttgtcagatgtccttggtgggggaaaatagagtggttaaagattttaaacatctttgagaggatgtttaggatctttaattcatccatggtctttgtacttgatggtgctcacgaaatagagtggttaaagagtttaaacatctctgaggggatgtttaggatctttaattcatccatgatctttgcacttgatggtgcccatgatgatcaccatgggggaggggggagttatggtgcacgacagggtggcctcgacacttactgcatagtttccctaagtgag

SEQ ID NO: 26239 - DNA, 579 bp, Glycine max
  Peptide Sequence Number=SeqID_143017
atggatcgttcaagagtgtttgtagctattgtggacatgaataagaggcttatgggtctgaggtgcaaccagaagcaattctcggtgctctctgatctgaggacatgtgagaagcactgtggggatctcaagtggcagtgcacgtgtggaacctcgttttctagaaaagacaagcttatgggtcatgtggctttgttcatggggcaccaaccagtagcagctatcaacaataataatgctctctcttactcggccaaattagagcagcagcacacattgaaaatgcagattgaggtcgaagaaaaccctacactgctgttggaactgtgtgggtcgaaaaaaccctacactgctcttggaacagtcgtgggtgctcaaagctcaaagctttctacgttgccagttaacaagttgattgtgctttttctggttttcaagcttgatgagagttacacgccgagcaaagtttccatccgtgccgatgatggttttcacaacttgaaggagaataagaccgtggaactcgtgaaggcaactgggtgggtttatctatccttgtttggagctgatcctaggtaa

SEQ ID NO: 26240 - DNA, 165 bp, Glycine max
  Peptide Sequence Number=SeqID_143018
atggtgacaaccccgtcttgtgacaaaagtggaatgaggaaaggtcttgcaagatgtgggaaaagttatagatttagatggatgaattatctaaggcctaatatgaaaagagggaacttcctaatactagggactataggactactggactatatgctcctttga

SEQ ID NO: 26241 - DNA, 1047 bp, Glycine max
  Peptide Sequence Number=SeqID_143019
atggctcccgaagacctggagcagctgatgcaacaaattagggaccaactggaggagtcgatcatagaaaaagtgactcgacagctaatgttatccttcagccagatgcagttccagtttcagtcacagatgcaatcacagggactcgcactgcctcctgagcctgaggttggtccttcaactgctcgtgtcagcacaaaggagagttgtgttaatccctcagggaatgatccagacacggatgactcagacaaatgcaggttgtacatcgaagaaaatcctccccgcctggttgtcctaggaaaagtttatgagggatccataaccattcacaacattcctttgttgcatgatcaagtcaaggttggttttaaggaggttagagatgcagatgctcccattcctgtacccactaaagaggttaagttagtggagcagacacttaacaccttccttgcttggtcgacacatcttgtcaagcatttatcagaacagggagctatgggaccggcaaaacctgcagataggccggatcatgatgtcgatgatcccctatatctaatgacattgaccatcccacaactttttctgaagccattgcaggttatgtgggatgctactatgtttggggtgtttaatgaagacttccccctgtacataaagcatgaagatttgtctgaaatagcacacagtgaaagttacattaagaactggatgcagaattcaaaacgggatgtgtacctaggagcctacctgaatggtgctttgaaaggacttgacgatactccacaaagtaaatccaaggctggtgctaggtggattgttgttaaatataatagacaaaaaggaagcactgagtgtgggtattacgtcatgcactggatgtcaactatcatcttaggaagtttcaagaataattgggaaatatatttcaatgatgctagaccattggaactagagagattaaaggcgcttcgcatccagtggttttcaaaaactgatgttaacgataatactttcaacgtcaacactttcaacatcagttaa

SEQ ID NO: 26242 - DNA, 330 bp, Glycine max
  Peptide Sequence Number=SeqID_143020
atgccaatgccatcacgtcagctcagcggctcctcaccagaatcttactccctgcaccctgacactatcattctgctcccacgaacaatgttcgcgatcatcacagcaagtgccaaagaccctagaaggtcagtgcacttcgccccccacgaacatacacaacatccaatgtatgaacgtgaccctaagcaagtgccaaagaccctggaaggtcagtgcactttgccccccacgaacatacaaaacatgcacatgccaatgcatttccaacatcaatcaacattccattttcacatcattcttaacatagacatcatctcgtctcaatga

SEQ ID NO: 26243 - DNA, 297 bp, Glycine max
  Peptide Sequence Number=SeqID_143021
atgaagagaggcaagccttttaggtttctggttctaccaaagcctaatgtagcttctggttttctgttgtcgcttgatggtggaaatcaaggggggacactagaagacagcaacggtgagggtttcgcaactgaccttggagacgtcaggggcggtgacgagtttttgtttagggaaattgcttcacttgctcattgtgatgatcatgagtacaaacatatggttaatgttctcacgagtgaactatcaagcctaacattgaaacatcaaaatggaactggtgaaatgaaccactga

SEQ ID NO: 26244 - DNA, 654 bp, Glycine max
  Peptide Sequence Number=SeqID_143022
atggccagcccaaggcatttcaacacttcttctcatgtcatgtatgctgatgatgttctaatttcctgcaaaggcactaaaagaaatataaagcatataatgctcctctttgataaatatgttgaagcttctggtcagttgatcaacaaagaaaaatctcatttttactccagtagcatctcccctggccgaatttctatcatttcagatttaatcagtttcactcatggagtgcttcccttcacctacctgggagttcctttattccaaggaaaatccaagaaggttcacctccaacctattgctgataggataatgctgaaacttttttcttggaaggtggccattcctatatctcatgaggatgatcacttgatttggagcaagtcccatgctggtgatttgcaacttaaagattcttatatgtttctttatcctaaactcaaagctcgcttcgagaatcttcagaccaagttcgattcgattatctttgagatttctactagtgttcatttagctggttccatctcttcaagtatcatgtcaaactttgtttctgattttggtatccttgagcgtttctttatttcttctcatccgcaacagcaccagcccatcaagcaagtcatttggaggccgccgagagccaactag

SEQ ID NO: 26245 - DNA, 210 bp, Glycine max
  Peptide Sequence Number=SeqID_143023
atgaccaccgcaccgaagagcgtcggggacttgtcggtggccggggccgccgcgactcgcaccgcgggggagatggtgcgcgcgaaacggtgtgttttggcggcggtgagaggggagaataagaaaaagaagaaggaaaagaagatgagggaagaggggaggaatgttgggaagggattggccatttgtgagaaagtgagaattgcttga

SEQ ID NO: 26246 - DNA, 210 bp, Glycine max
  Peptide Sequence Number=SeqID_143024
atgagcatgcacaagcaagtcaaggtggctatggaagctaacaaacagctcgaacatgaaactccaacccctgctttggaagtagatcaacaaaatgctagtgcgagtgttggcttttctatgcctaacttcgatggtgtttatcaccaggtggcagcactgcaaactacgatcatcaatgcagtgcttaaggagttaggcattctttga

SEQ ID NO: 26247 - DNA, 912 bp, Glycine max
  Peptide Sequence Number=SeqID_143025
atggtgagaacactgtcttgtgacaaaagtggaatgaggaaaggtacttggactccagaggaagatatgaatgatgttgttggcaacaactccactggatgcatgattatggtatcctggcctttcgggatagcgaggatgcctaggaggttgtctgtgcttgctgtaacaaaacaagctaaaacatgttttataactaaaggtagcgatgttctgaagctcaacgtggagctctatgaagcaattgcaccacttgaccgagagcttaaatacttgtgttttgttggtgtccaaaataggtattatgaggcaccaaatccctatgataggtgggactcattagataggtttgttcttatttttggtttcaatacaaacctaggtgctcatataggacaccttagtgatcaagggattcctaaggaccctaagagaataaaggtcattcctgagtggcccactccagcaagaaccatgttccctcatgggaagatgcccaggaaagggggaataagcccagagtttcaagaacctctggatttgaggtcaaatccttttcaatggggaggtatgatgcaatcctaccccttaagagcattgaatagaagactcaaagaagattggactagagatgcaagagaaggccctagggttttcatgagccttagggttcctaactccccaaaacggcgtggcaaagggggaaccaccaaggagggtggtgcccccctcccggcaccactagtgcaaggcccagtgacacaaggccaccacgggggcaatggcacgggagagccaaggtgctcactgacgagaggaaacgaagggagagcaaaggggaaaagaagggagcaaggaagacgagatagtgagggaatgagggataactggagacctctctcacttctctga

SEQ ID NO: 26248 - DNA, 201 bp, Glycine max
  Peptide Sequence Number=SeqID_143026
atggagcatgaaacattccttgcaacttggttggcagagattgatttctctcccaatggcttgagattctcaaatttggaaccacagcctaggttgatcaaccatgaaaaacctatgctatgtgggtggcacaagctaaatcccttgaaaattgagggtacgagagttgccctggattcacctagggactactttccttag

SEQ ID NO: 26249 - DNA, 183 bp, Glycine max
  Peptide Sequence Number=SeqID_143027
atgaagactcatgttagttccgaagttgtggttctttcttgttgggggtttgaaaacaaaaggtcccaactggctcttcacttagtctacacagtttacactaagctattacacacaaatagaggtttgggtggtctcttggagacttcccatacacccctgaagaatgtccaaatacaataa

SEQ ID NO: 26250 - DNA, 378 bp, Glycine max
  Peptide Sequence Number=SeqID_143028
atgagggagacacatgaaataccccaccacagcctagccaacttcgagccttgcctcgaatacgccactgaggggcatgcaattggtggtgttcccctgccaaacactttggagggccctcagtttcgcccacaaccacatcccttgcattttgtggtgggaagagcccctcctgctacggctgaaaaggaaaaattggatcatatagaggaaaggctcagggccattgaaagaggcggagacatacttttgctgacatggaatcacatgaaattgtactgttggaagatgggggcgtacgcgaaagatgaaaaactgttgatgcatttcttccaagaaagccatactgggacagtcgtcaccggtgttctactatga

SEQ ID NO: 26251 - DNA, 276 bp, Glycine max
  Peptide Sequence Number=SeqID_143029
atggctccgaggaagctttccgcaaagagatctaggagggacgccgcggccgaaggaaccagtgccgctcccgagtttgatagccatcgtttcaggagcgccgagcaccagcagcgtttcaaggccatcaaaggatggtcgttccaccgagagagacgcgtccagctcagggacgatgagtacacaaattttcaggaagagatagctcaccggcattggacgtcgctggtcactcccatggctaagtttgacccagagatagtcctagagttttaa

SEQ ID NO: 26252 - DNA, 120 bp, Glycine max
  Peptide Sequence Number=SeqID_143030
atgaaggaggcacgaggaggagctttggctgcgcagcaagactggtttcataggctgcctgttcttgtgtatttgattacactgaatggtaatcgagtaccagagcataaactaggctag

SEQ ID NO: 26253 - DNA, 689 bp, Glycine max
  Peptide Sequence Number=SeqID_143031
atggccaggccattgacaaagcccagcatgaccgggtgcgggaccatgcggataaatttgcctaacctggcgacggcaaacaggatttgcaacagccccatgaggacaatggtggcaaacaggtattgcacgccatgttgtacgaccagagccaccatgaccaccgcgagtgcgccggcggcacccgaaatcatgccaggtcgaccgccaaaggctgaggtaataaaagacacaatcacggcggcgtataagccggtcagaggtgaaacatgggcaatcagcgcaaaggcaatcgcttctggcaccattgccagtgcgacggtcagtccgctgagcagccatcatcactctccggaaattggcaggccggcaggtatcgaatatctgggcaactgcaaaggttggtttcaatcagcggcagacagggatgttacccgtctgtatgttagggttcactcgcgcggcgcatggtttgtagtcaaggtcggcgtatacaaaccaggcgcctattatagcatgtgcctgttatcgctccggtacggtgctggcgtccgctggctccacagagtcctgcgaaaaatgtatggtttgggtggggagggcgatttttgcaccgtgctggcggatgatgtcagcaactttcaagagcacatcctgcttgatatgatgatagtccaccccatacccgg

SEQ ID NO: 26254 - DNA, 339 bp, Glycine max
  Peptide Sequence Number=SeqID_143032
atgacttggaacaagaatttgctcagagtttttcataacaaaaagtcttattctctcaaagagcaaaaacattttatcctcttaagaattccttggccaatacacttgcaattcaataaggaattaattgagtcctcaaattgtacaatcgatctctttcaagagagatttattcttctcttcttcctaaattctcaaaagggattgagagaccgagggtctcttgttgtagagaaatctgaacacaaaggaacgattgtccttgtattttcagaacttgttaagggattttacaagatagtgaaactctcaagcggtgtgcttggggactggacgtag

SEQ ID NO: 26255 - DNA, 364 bp, Glycine max
  Peptide Sequence Number=SeqID_143033
ccagcccgcatcaattagaccttgcaccttatgcttcagggccctacaatgctcaagggaacgccctagggcttctccatgacaagcaaacatcgtgttcgagtcgtattctcggagaaatggaggttgaggaactcttggttggggtggtgttcgccattggaagtgcggtagacagactttgtggtagatttagggatggcctttgtggatacctgggtggtggcatgggtttctccctctttctcaccctcttcatttgccccagttttctcagtcgtcctagtaggatgatcaaatttgcctcttttcggactcacatcgatcctttcactggcgaagaccaaatccgcaaagctttgag

SEQ ID NO: 26256 - DNA, 330 bp, Glycine max
  Peptide Sequence Number=SeqID_143034
atgggtcaagactcttggtcggtgttccgcaaccatctgcttaaagaacttgccaatttctcagaagactatatcaagctctttggtggcacggagagatctgaggaattaaggatgtcactacttgttgatgggttaaccaaggtgacaacggataagtggatgaatataacggacatgagacatgtcattgcatcaaggattgagttaacatttttttcgcatacacaacaggcgaagtcgtggccaaatccatatattagcagaatgcagcattacaagagtttcgtgatgttcaagaaagactatgttgacataaatgatgattga

SEQ ID NO: 26257 - DNA, 499 bp, Glycine max
  Peptide Sequence Number=SeqID_143035
ccagcaacaacggaagcttgtccttcatcttttgataatgaagagggatatgctaggtgcacccagcaatattgctggtgcacccagcaatttattgaaagcaagcttccttggaggtcttcttctccgcgagacttcttcgccttcatcttctccgcaaggcttctctcttccatttgcattcaagatgaatcttagggtagaagacgccggaaaaaatggcggaagcttggtgacggtgagccttccggaagacccgttaggggttcttccagaacttccggaagaagatcttccggaagatttccggaagaagggttctttcggaagtaatgaaacgaattccggaagaacaggtcttccgaaaagctcttggacaccttcttccggaatgtttccggaagatgtacttcttccggaaacattccggaagagggttcttccggatgaccttttagttgttccggaagacccttcttccggaatgtttccggaagaa

SEQ ID NO: 26258 - DNA, 676 bp, Glycine max
  Peptide Sequence Number=SeqID_143036
atgaaacgcatcgcggtgatcggcgccgggctgggcgggcttgccgccggctcgctgttacagaaagcgggatttcatgtcacggtttatgaacaaagcccggctttctcccgtctgggtgccggcatccacatggggccgaacgtgctcaaggtgtttcgccgcatgggcatcgaacagcagctggaggatctggcttcgcaccccgatttctggttcagccgcgacggcgagaccggggagtatttgtcacgtattccgctgggcgcttatgcgcgcaaagagtacggtgcggcttatgtcacggtgcaccggggcgatttgcaggccatgcagatgaccagtctgcagccgggcagtgtccagttcggcaagtgcctgagcagcgtcgaggacagcggcagcgatgtggtgctgcgttttcaggacggcagcgaagcgcgcgcggatatcgtgattggcgcggatggcatcaactcaaaactgcgtgagcatctgctgggggtggaagcgcccacttacagcggctgggtggcgcaccgtgcgctaatccgtggcgaacaactgcgcaaatacaacctcagctttgaagattgcgtcaagtggtggtctgaagatcgtcatctgatggtctattacaccaccaaagcgcgcgacgaatattattacgtctccg

SEQ ID NO: 26259 - DNA, 931 bp, Glycine max
  Peptide Sequence Number=SeqID_143037
atggcagtaaatcagagccagttaggccagatgttcgagcaggttttacggctgtcgaaagtcgacgccagccagagcgtcgccattctgaaaagtcactattccgatgcacgcaccgtgcaggccgccactgatgctgcactacgattgggcgcgaaggtgtattgcgttgagctgccggccttcaatcacccgacggcgatgggtaacgacatgaccgcctactgcggtgataccgcgcttaccggcaacattgccgcacagcgcgcgctggaagcggcggacctgatcgtcgataccatgatgctgctgcattcgccggagcaggagcaaatcctgaaaaccgggacgcgaattttgctggcggttgagccgccggaagtattggcacgaatgttgcccactgaagaggacaagtcgcgcgtgctggccgcggcggcagtgctggaaaaagcgcgcatgatgacggtgaagtcgccggtcggcagtgattttcgcgccccgctcggccagtaccccacggtaacggaatatggctacgcggatgagccgggccgctgggatcactggccgagcggcttcctgttcacctggccgaatgaagatcaggctgaaggcgtgctggtgctggacgtcggcgacatcctgctgccgtttaaatcttacgcgcgtgaacgtattacgctggagatcgagcagggctttgtcacccacatccacggcggctttgaggctgagtatctgcgcgattacatgcgctacttcaacgacccggaagtgtacggtatttcccacatcggctgggggctgcagccgcgcgcgcagtggacagcgatgggattacacgacaaaaacgacggcatgtgtatggacgcgcgcgccttttacggcaacttcctgttttcgaccggaccgaacaccgaagtgggcg

SEQ ID NO: 26260 - DNA, 195 bp, Glycine max
  Peptide Sequence Number=SeqID_143038
atggccgtccgaatatgcatgggaattcgatttccgcattcgagcgccatgatatattatggggctcaatcagacatccgagacaaaacttccgcctgtttccagctttatgttgagatccagaggtacggttatggccgtttgtatttgcgatgggcttcatttatcaacaatgagggtctcaatgtatcataa

SEQ ID NO: 26261 - DNA, 519 bp, Glycine max
  Peptide Sequence Number=SeqID_143039
atgaagattcaatcggatattcctaaactcggaacacaaagaggcaacaatatcgaggtgcatgggctcttggtgtggggagggttggagatgcatatggagcttaacattgaggagggaatggttccaatggaaacatcgtatgggaagtctacaaggatttgcttgtcaggagaagtgcggaagaggcaaaattcttcgagctcatatgggaattaccggtacgtaccctctaagaataaaggaaggatttggagattgacacataaccggcttcaaacaatggataacttgaagaagaggaagatcatttctacaggtacggatgattgcacacttttgacaacactcggggatgatctaagagaggaaggcgcgcttggcatggtggactgcttggggtgctgtgatttgctctatttggaagctacagaatgcatcaaattcaatagcagcttatgtaatcagaaggaggtggtaacgttgatgctttcagctaggtgtagagcaaggttttaa

SEQ ID NO: 26262 - DNA, 684 bp, Glycine max
  Peptide Sequence Number=SeqID_143040
atgaaaggaatatcctatcgagggaatcatatttgcttcggaagatatgctcttcaagcacttgagccagcttggataacatctagacaaatagaagcgggacggcgggcaatgtcacgaaatgttcgccgaggtggacaaatatgggtacgcatatttccagacaaaccggttacagtaagacctactgaaacacgtatgggttcaggaaaaggttctcccgaatattgggtagctgtcgttaaacctgggaaaatactttatgaaatgggtggggtaccagaaaatatagcaagaaaggctatttcaatagcatcatccaaaatgcctatacgaactcaattcattatttcaggcggagcacgcgaactgatgtgtattcgaatcctaggagctagtaatcgacgatatgcttatattggtgacattgttgttgctgtaatcaaacaagcagtaccaaatacgaacttagaaagatcagaagtgatcagagctgtaattgtacgtacttgtaaagaactcaaacgtagcaacggtataataattcagtatgatgataatgctgcagttgtcattgatcaagaaggaaatccaaaaggaactcgaatcttttgtgcaatcgcccgggaattgagacagttaaatttcactaaaatagtttcattagcacccgaggtattataa

SEQ ID NO: 26263 - DNA, 210 bp, Glycine max
  Peptide Sequence Number=SeqID_143041
atggccatgctacgttcaacgcacgatatgtgttgtcttagcatggctcgtgttggtttagcatggctcgtgctatcccatatgaaaaaatcatcatcaatgtcactacttcttgagaatggtcatgctaccttcaacatggctcgtgctgacctctatgttgttgttttaactgtctttagtataaatagaaaaatggaggtgttttag

SEQ ID NO: 26264 - DNA, 534 bp, Glycine max
  Peptide Sequence Number=SeqID_143042
atggcaaccaagtttgctcatgcactcactttatttgttctagtggcctcaatgctttcaatgagcatggccaataaggattggtcctttggttctaattctaactactctgattggtggtccagattccgcaaccgtcaccaaaacaagacagaacaagaacccagaaagatcattgtgggtgggtctgagggttggcacttcggttttaactacacagattgggctttcaagaatggcccattttaccttaacgatacactagtgttcaagtatgatgctccaaacgctaccagtttcccacacagcgtgtacatatttccaaacctgtggagttttttgaattgtgatgtgaagagtgctaagatgctggcaaatcccacacaaggtggaggagagggctttcatttcgtgttaaataggtggcagccttatttctttgcctgcggtgagagaaatggtttccattgcaacagtggacagatgaaatttgctgtgatgccaataattcgtcccttctggccatggccatga

SEQ ID NO: 26265 - DNA, 270 bp, Glycine max
  Peptide Sequence Number=SeqID_143043
atgatgttgaccacatatataaatcgaaccaagaaaggtattgttgttgcagtccaaaaaagtgcttatgcatgggctttagatcgcaacaatgccaacattgtttggtctatgtttctttttcaggaagctgagctggatggggttcaaggaggtggatcattgggtgccacaactgatgaaaagacagtttacacaaacttcgtcaattctgatgccaaaaatttcacttttgcaccatcaaatgtgattaccacggctggtggatga

SEQ ID NO: 26266 - DNA, 521 bp, Glycine max
  Peptide Sequence Number=SeqID_143044
atgggaaatcgaaagtcgattattattgtatgcgagggagccattgatcgtaatctcaaacccattaaaccagaagaagttaaacagattctggaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 26267 - DNA, 1617 bp, Glycine max
  Peptide Sequence Number=SeqID_143045
atgtctagccccaatggtccagagatagaagagaagagagttacaaaggaagataaattcaaatctgctaaaactgaaatgggtgaggtgaaggaagaaaatgagagattgaagatgatgctggaaagagtagaaaaggactatcactcccttcaactccgtttctttgacatccttcacaaagatgtttcaaagaagggtttagctgtttcatctacttcccttgatcatgaaactgcagagcctgagcttgtgtcactttgccttggaaggagtccaatggagcctaagaaagaattagcaagaattggatactccaacaaaccaaaagaagaagacgttggacccaaccttactcttggattagactccaaacaccttttgtcaatggaggttgtgtctgatttgagtcccacgaatagctcagaagaaccaaaggaagtagaagctgagggaacaaatcaatcagcaaaagtgataaatgtaaatgatgacgtttcagatcaaatgccagccaagagagccagggtatctgtgagagcaagatgtgatactcccacgatgaatgatggatgccagtggaggaaatatggacagaagatagcaaagggaaatccatgtccaagggcatactatcgttgcacagttgcaccaacatgtccagtcaggaagcaggtgcaaaggtgtgctgaggacttgtccatcttaatcaccacatatgaaggaacacacaaccaccctcttgcagtttcagccacagccatggcttcaaccacttcagctgctgcttccatgctgttgtcaggttcttcaacatctcaccttacaagccacaattctgcatcttttggaaatgctcctaccacactactcaatggtgtgagtttcagtcatcagtttgatgaactaagagccaaacaaatgttgtcaccaccaaaccatgtctcaccaaatctgttttcaacaatcactttagacatgacttcttcagcttctaattcctcctcatcaactcaattccatcatcgcttaccttcgacgatagcttcaatttcaaacccaaaattttctccagctagtctcagcttttgttcccaagataataacttcataccatccatttggggtaaggggggtgacacttccacaacaccaattgacaaaatccccatgactaggccagttatcaagggaaatcaatatttccaagaaaatttctatcaacaaagcataacaaagcaaactccttccaaagaagctttggcagaaacaataacaaaggcaatcagcacagacccgagtcttcgttcagtaatagctgctgcagtttcatcaatagtggggaatggatcaagcagtgggaaccaagaggaatcagacaatgttcttggttcagggttgaacttaaaacttggggagcattttcaattggcttcacccaatcccttgaaccagaataggaaagaatgcttaacaagctacttcaaaagtttgtcctcaaagaattctgaggcaggaagcttcatttttctccaaccaccattgccattttctttctccaagagtagcacaaatcaggtcaaccattatgttcaagaaatgaactcacatcattag

SEQ ID NO: 26268 - DNA, 411 bp, Glycine max
  Peptide Sequence Number=SeqID_143046
atggacctacgcaagcgccaaccaactgtgtttgcattatggacggctgttgacccagaggagcctcgccgaaatagaccttgggatcctggaagacttggacggactcgtaacaccttgaggacaaggtgttacttgatgggctcgggaatgatacagttgatactggggtctgcaagaaacaagggctacaaggcccaaaaggaagggtgtacaaccagcttacttgaaagagtatgtgcagaatggctagcaggagcaaaacgtgctaataagatattacttgctatgctattcaatgttggacaaaagctcaactattatactcccaacagctgcaaaaagtatgtggcacaagatcaagtccccttgtgggcagttataagctacttcttgacaggtgtagaataa

SEQ ID NO: 26269 - DNA, 1071 bp, Glycine max
  Peptide Sequence Number=SeqID_143047
atggtaaaaggttattatgttggaacatcttcactggagtctcttgtaccccttgagaaatgctgcacattccgtggaagttttgtaaaacttaatcctcgatctggtgccatctactggaggacgtatacgttaccagataacaaaaacacaaaaggagaatatgcaggagctgccatttggggaagcagcccttccattgatgttgaaagaaacctcgtctatattggcactgggaacctctattctgccccgttgcgcatacaacagtgtcgagagagacaacttaatcaaactcagcctactcaacaagacgagtgtgttgaaccagacaaccactccaattcaatcttagcccttgatttggattctgggaaaatcatatggtaccgccagtttggaggctacgatgtatcaatcttaccatgtagtgatacttcaacacccagtcctgattgtcctcctctaggagacaaaccagatattgattttggggaagcaccaatgatgttgaccatatacataaatcgaaccaagaaagatattgttgttgcggtccagaaaagtggctttgcatgggctttagatcggaataatggcaacctcatttggtataagaaagctggaccctacggccttgcaggaggtggatcatggggtgcagcaactgatgaaaagaggatttacaccaacattgtcaattctgatgccaaaaatttcactcttgcaccatcaaataagattacaacagctggtgggtgggtggcaatggatgccaacaatggtagagttctatggtcaacagctaaccccggtaatagcactgcttatggccctgttagtattgcaaatgaagttgcctttgctggatccgcggatagaatgggatacatatatgcaattgatgccatgagtgggaaaattttatggtcctataaaactggagccagtgtctatggaggcatgtcaatcagcaatgggtgcatatatgtaggtcatggatacaatgttgcttatgggtattccttgaacttaacgagtggaaagtttctctttgccttctgtgtctaa

SEQ ID NO: 26270 - DNA, 201 bp, Glycine max
  Peptide Sequence Number=SeqID_143048
atgggtaaggaagaaaagtcagggaaaaaacatgtaggaagagggtactctagaagaagcaaaacagaggaaaacaggggaaggtgtgttataagatgtagtgaaaagtggggtgagattctaagagggtttaacgcaggtaggggaatgaatgcaagtgaaattgaaatggagagagagaaacagtggtttggaaagtaa

SEQ ID NO: 26271 - DNA, 312 bp, Glycine max
  Peptide Sequence Number=SeqID_143049
atggagggcttactcgaaaccctagactcagcaaaccaccaccacgacacgtctctcggaacaacgatattagaaggaaaagagattccgtatgtggagcgttctgacgatgacgaggtcatcccgcttgtgtttcttgaggtccttaagtcatgtgagatggaggttgtcatcctcagggagcgtgaggaaatgggaggagtggaggaagttgatgagtgtgcgcttcatcttccattcattgattgggtgggaaagtgtgagaggcatggaagggtacatcgtgaggttgagcttcacacgcaggactag

SEQ ID NO: 26272 - DNA, 315 bp, Glycine max
  Peptide Sequence Number=SeqID_143050
atgtataatactaacctcattgccctcatccatatatgtccaatacacacaaattcaattggggaatacattttgcgaggagcatcggcagttgttttgtcagatgcgatatttgataaagatgcaattgcacaacatgatttcgataagatacaaaatcttgcacattctgctgccttgctgggtaacaaatctgtgaatagtaaaagcatgttcattgcgatcaaatttgtagctcaattgccatcagcccaagtctttatgattttttggtgttctgttgatgttgaaggttccatttcaacttggtattga

SEQ ID NO: 26273 - DNA, 246 bp, Glycine max
  Peptide Sequence Number=SeqID_143051
atggttggaactgttctaaggattgaggatgcaaaaagtgcaattaatgctggagccaaatttctaatgagtcctgcaacagttaaggacataatggtaatggattatgttcagagtggtgaaattttatatattcctggcacaatgactccaactgaaatattgtcaacatgggatgaaggtgctaaaattgtcaaggtggggctttgcattttctttaatgtttactatgttgaagagtgttga

SEQ ID NO: 26274 - DNA, 426 bp, Glycine max
  Peptide Sequence Number=SeqID_143052
atgggcactgcaactgcaaccttatccctgtgccaatggctttcttcttcttcttctatgcgcatgcatgtgaggttttcatgcagaacccctcaccttacagcatctgcagtgccaaatcaacaattctgtgcagaagtggccatggaagctgcaaaagctgcaatagcaggtggcatttcagttttggagattgtggtgttgaccccaggtgtgtttgaggttgtttacctaaatttttctactccctcgcttgtcttgttcttagattttgaattcatatgcttctggtcgatctgtgctggttctacagcagctggtgaaggagcatcctacaatggccctagggatatgctttcatcttttaagtttctatctagtttctcacatggtatcaatgttctttttaaggtgtatacaatgtga

SEQ ID NO: 26275 - DNA, 483 bp, Glycine max
  Peptide Sequence Number=SeqID_143053
atgtcaatctccccctgcagatgtatcggttgggattgcgcccacaagacgcccagttggcccgaagaagtccaacagggccctggggtttccagctctggttacgggcctctattagttctacagggtgcccgttcccccagcgagaatcgcacccacaaagacacccagcggacccggagaagtccagtagggccctggggtttccagctctggttacgggcctctatagtcctacagggtgcccggcaaggtcacgtcatcatagggatcgcgcctgcaagacacccagtggacccgaagaaagtacctgtcacctccagcaagggcatcaggccccctactaatcgagctttcatcaagaagtactacgtctccaggcaggcgcagggcgaaacaccacagcagcctggggatggccagcagcgggcaacagacgcaccgccatcacctctagagttcacctcagctcatccacaataa

SEQ ID NO: 26276 - DNA, 1170 bp, Glycine max
  Peptide Sequence Number=SeqID_143054
atggtaatgatgaaagagaatattattgaagagaagcttggaaggagccaaatgtctatggtagaaggtgagttccaaggaacatggggtgtcaagagacgacgaagagaggttgctgcagcagcaagcagcggtgatgataaccaccaccagcagttaccacagcaagaagttggtgaaaattcttcaatcagcacaacaaagagaagctcaagatttcgcggtgttagcagacatagatggacgggtcggtatgaagctcacttgtgggacaaactctcttggaacataacacagaagaagaaagggaagcaaggggcttatgatgaagaagaatctgctgccagagcatatgatttagctgcacttaagtattggggaaattcaactttcaccaattttccaatatcagattatgagaaagagatagaaataatgcagactatgactaaagaggagtatttggccactttaaggagaaagagcagtggcttttcaagaggtgtatcaaagtatcggggcgttgcaaggcaccaccacaatggtagatgggaagcaagaataggaagggtttttggaaacaaatatctctaccttggcacctacagcacccaagaagaagctgcgcgtgcttatgacatagcagccattgagtacagaggaattcatgctgtaacaaactttgatttgagcacttacataaaatggttaaagccttcaggaggaggcaccccagaagaaaatcttgaatcacatgcagtactagagcatcaaaagttggcatccccatctaattatgctctaacagaagagtctaagtctttggtccttcccaacagttttatcagtccagattctctggattcacctgtaaagcatgaaagttttggaaacaaaacctaccaattctcaagaaataagtcatcttctcccactgcacttggtctccttctgcgctcttcattatttagagaattggttgaaaagaattcaaatgtttctggagaagaagctgatggggaagtcacaaaagatcaacagccacaactagctagcgatgatgatctggatggaatcttcttcgatagctttggcgatattccatttgtgtgtgatcccactagatacaacttggaattgcaggaaagagacctgcactcaatattttga

SEQ ID NO: 26277 - DNA, 460 bp, Glycine max
  Peptide Sequence Number=SeqID_143055
cagcaacttcatcccctaagggaggacacttggatttggaaacctgaacctacaggagactactcaacaaaaagtggatatgatttgatatggggagagctgatggaggaggaggaggatgaacacttgttcttcaattgtagcaaaaccctcactttatggtgggaatcaatgtcctgggttaatcttatcactgtaatgccacaaaatcatagggaccattttctgcaacatggaatggaggtagcagatggagtcaggtccaaaacctggaaatgctggtggattgctttaacttggacaatatggcaccatagaaataaggtggtgttccaagatacaacttttcatggaaccaaactgttagaagatgccctattcctactatggtcgtggatcaaagcaatggacaaggattttactcttcattttaaccaatggtcctctaatcttaaggaag

SEQ ID NO: 26278 - DNA, 516 bp, Glycine max
  Peptide Sequence Number=SeqID_143056
ctaacaacattggggatgtgtgatactaacttatatgccttgtcaaaaacattgactgctgatgaactctattatctgacagggcaatttgcactgctagaaccaagcaaaaatggtagcatatctttagagaacgttaacaaggccttgatgaaatacgcaacagatgccatgaaagagtctcgcatccctgacttcctttcatcgctgaactcgttacaatatagaaggatggattttgaagaattttgtgcagctgcattgagtgtgcatcaacttgaagctcttgatcgttgggaacaacatgcccgctgtgcatatgaactctttgataaagacggaaacagggctattgtcattgaagagcttgcttcagaacttggacttggtccctctatccctgttcatgtcgttcttcatgattggatacgccatactgatggcaagttaagttttcttgggtttgtcaaattattacacggtgtgtctagccgaagccttgcaaaggttcaatga

SEQ ID NO: 26279 - DNA, 507 bp, Glycine max
  Peptide Sequence Number=SeqID_143057
atggccgatgatctctcttccttagccaaggatgttttgcttgtgaagggtttgaagagttccactttggtgtggaggcttgttgttttgacccttgcaatgataggcactagcagcaagattggttttctagatatcaaggttgttcaaaagccatgtccagaacctaatattgaaccttgggagattccttatgtgcactaccctaaccccaaaacttacagcagggcggaatgtgcttgccaccctgtgcgctatttcgctattttgtcaatgcagagatctgggagtggatggtttgagacgtttttgaacagtcacgctaacataagctcgaatggagaaatcttttcggttaaggtgagaaggagtaacatgtcaacaataacagagactcttgatacaatttataatctagactggctaagtagtgcttcgaaaaatgagtgcaccactgctgttggtttgaaatggatgcttaatcaggtgacaacttgtgtcgcttga

SEQ ID NO: 26280 - DNA, 1323 bp, Glycine max
  Peptide Sequence Number=SeqID_143058
atggcaggaagtgcaagtaaggttacctttatcttcttggttgcttttgccatttctattccatgccttgaggcgggcattgctgagtttgacgattttctgaaagcacaagctgatgaggcccatgagatcgctcttcgctcctacgaacctgaccctataaacgttacagccgagttcaatatccatgttcatagggcattaatggaggaatcaaacgacacaaggagggaactaaagcagaaataccgtggaccatgcttggccacgaacccaatcgatcgttgttggaggtgtaggaaagattgggcacaagaccgttataggttagccagttgtggcaagggtttcggaagaagggccgtgggaggactccacggcaaaatctacgtcgtcaccgattcctccgatgacgaacccattaaccctagacccgggactctcaggtacggtgttctccaaagggaaccactgtggatcatatttgcacagagcatggtgatcacattgaagttcgagctgttgatttcttcggacaagaccatcgacggccgcggcgccaacgtggtgatcaagggtggtgctggccttgccatgcagtttgtgaacaacattattattcacgggattcgcatcaacaagatcaagtccatggaaggtaccatgcttagggacctgtggaaccacgttggaataagaacaaggtgtgatggggatgctgtgtccatttttggttcttccaacatttggctcgatcatctttcgctgtctgaatgcgaggatggtctcattgatattgtccagggctccactggaatcaccatctcaaattgtcacatgaccaaacataacgatgtaatgctgtttggagctagcgacacctacgccggtgacaagataatgcaggttacagtggcattcaaccactttggtcaggggctgatccagagaatgccaaggtgcagatggggtttcgtccatgtgataaacaatgactacactcactggctgatgtacgcaatcggtggcagctcagagccaacgattctgagccagggaaaccggttcattgcgcccaacaacaacgctgccaaggaaatcacacacagggactatgctccacctgaagaatggagcaaatggcagtggaaatcagagaacgacctcttcatgaatggggctacttttcttcagtcaggatcacctcttgggaagcttccattcaacaaagggctcatgatgaaacctagacctggggccgaagccaacaggctcacacgctttgctggtgccctaaattgcaaggtgggtaagccttgctag

SEQ ID NO: 26281 - DNA, 195 bp, Glycine max
  Peptide Sequence Number=SeqID_143059
atggcacgaccaacattgcttcagggagacggagcgaggtttcagggagacacaatccttcaaagcgccgggtgcagtgcttcagggagacatgctttcagggagttagggcacaaaatgtgcaggttcgagctgcggttagaatgttctattttaagacggttctttgaaaccgccttagaatgtgcaacgtaa

SEQ ID NO: 26282 - DNA, 138 bp, Glycine max
  Peptide Sequence Number=SeqID_143060
gttatgcatacacggagaagatgcattggcaacatcttggggatatccgtgcgaataagccaagtacagctgaatgacttgatcaattaccgaaataaaaatgggtacaatgcttcgatgaggggaaacgttgtttga

SEQ ID NO: 26283 - DNA, 447 bp, Glycine max
  Peptide Sequence Number=SeqID_143061
atgcatccagaactccctgatgaggatatcatggccatgtttgaggaagagggtgaggataaagacaaagataagtggactatatggtttgatggcgcatcaaatgtattggatcaaggaattggggaagtgttggtttcaccagataaaaaatctttagtaattcatcagatggaaggtgaatgggaaaccagagaccataagttgataccttatcaggcttacatcaaggaattgatggagctcttcgattatatatcatttcatcacattcctagaaaggaaaaccaaatggctaatgctcttgccacactatcgtccatgttcaaaataagtccttatggagacttttcgtgcatagaaatcaaatgtcacattaagcctgcatactgttctttaatagaagaagagcaggatggtaagccttggtattttgatatcaaatga

SEQ ID NO: 26284 - DNA, 114 bp, Glycine max
  Peptide Sequence Number=SeqID_143062
atggagtggtgtgtgcaacatgaagattttggtgggaaaaagctagcttgggcaagttttgggagaaggagagcgaggttttcctgcaaaagggaagaaattataatcttgtaa

SEQ ID NO: 26285 - DNA, 165 bp, Glycine max
  Peptide Sequence Number=SeqID_143063
atggctccaaagaaactcacctctaagaaagctaggaagaccactacaggagaagggtctaacacaactacacctgtagaaattgaattcaatggacattgctttgaagtgatcaaagattggtcttttctcaaggaaagaagggtccaattagctgaggcctaa

SEQ ID NO: 26286 - DNA, 201 bp, Glycine max
  Peptide Sequence Number=SeqID_143064
atgcttggaagtgcgcttagcgcacctattgcgctaagcctgaactactctctgttagggtttctagctttagggtttgctattttaggatttaggttgagttgtaagcccattaggggcaatgctgataaaaggggtgagaacccctgtgtttgtgctggaaatcatgatgaacgaactaagcatgcctactgcgcttag

SEQ ID NO: 26287 - DNA, 318 bp, Glycine max
  Peptide Sequence Number=SeqID_143065
atgaacgtcgaggagtttcttcagaagatggcctggctaggagtccagccttctcctttgggagggggtgaggcctctgcagcccaagagcctcaacaggaccaggaggacaacattctagaggcctcgaagcctattccgcatgagcctttcatttttgagaatgatccagttattgttcaagaggatgttgcaataccaaagccatctcctcagcctaagcctgagccatctgcatcagtgttggacctgcctctttctcaagatccatcatctgcaccaacacgagacctgaatgagtatgcacaagatcattga

SEQ ID NO: 26288 - DNA, 445 bp, Glycine max
  Peptide Sequence Number=SeqID_143066
atggaggaaccatcgaagaagcggaaaggcacttcgagtcggagtcaacggcattccggggcacaggaaaccccaattccttcctccattccctctggatcattgttctcatcagagaaacaacgtaacctaatgtctgaggtttatgggactaagatggtcattgaccagcccctattctatgatttaacccaattgccaagcgaaggtgtaccatttgaaggtgcactgattgatgattggaagtttgatttctctgtacatgatgtctaccgattggtttgtaccaatcaagcggatatgaccggaaggcttcttgccggttcattggcttttgaaagccgcatcctccattaccttattgtttgcatcttgcttcctagatcttcaaaccttgcccaggtttctgaagaagatctcattgtcatgtgggcctttcataaag

SEQ ID NO: 26289 - DNA, 290 bp, Glycine max
  Peptide Sequence Number=SeqID_143067
atgttgaatctctagtggaaggtcttggatctataattcctataggaaacactattgcaacatctactgaatctgatattctaacactggcatctcaagttgggacgtctaactcgagtgggagagaagacatgttctgccccaagcatgaaggatatcaacaaagaaaaggaattccttgcaaattatactccagcacaattgctaacaaagattatgaatcaaaagatgatgaaccaaaagaagaacaagggaatgaagggtctatttttggatcaatagatgtgtaa

SEQ ID NO: 26290 - DNA, 210 bp, Glycine max
  Peptide Sequence Number=SeqID_143068
atgatgatttggaaacaacgtgcaaaattagtcatggctacagccaggtgggcactcaagcatcctgtttatggcattgtgatactacggacgatgttcctaaaggaaaactgtcgcaacctacccttcggcgggagggcgacgcgtgactcgcgggatgcgtgttccacgaaaggaatacgcgcggagtcgccaccaacgtttatttga

SEQ ID NO: 26291 - DNA, 318 bp, Glycine max
  Peptide Sequence Number=SeqID_143069
atggcagatagaggtagaggtggtggtcgtagaacatttaatcgtggtacaaaacgtggtacccacaatttgagagctccaattaccaccaacccttccccctcatccattcacatatcaacctcagagtcgatgattcatgttgttgcacagactccaaacacacttcctaccgctcaaggccaaccaaatcctacctttgtaagggagtcaattcccactaccactactagaaaatacactttcaacatctgttatttagaacattctacatcggttctaaaaccgatgttgaaagtgacgatgttgaatgtatga

SEQ ID NO: 26292 - DNA, 915 bp, Glycine max
  Peptide Sequence Number=SeqID_143070
atggactcaacaaccgccgccaacgaggttgtccacgagtttctccccctcctccgcgtctacaaagacggccgcatcgagcgccttctaggcaccgaaaccaccccttccggcacggacccccgcaccaccgtccaatccaaagacgtcaccatcaacgcccaaaccggcgtcgccgtccgcctctacctcccacccgccgccgcttcctccgccacaaaaaaactcccccttttgatatacatccacggcggcgcgttctgcgtatgcaccccctacaaccccgcctaccaccaccacctcaacgccgtctccgccgccgccaacgtcgtcgtcgcctccgttcactaccgcctcgccccggaacaccccctccctgctgcctacgaagacgcctgggaggtcctccagtgggccgccgccggcccggagccatggcttaactcccacgccgatctaaacaccgtcttcctcgccggcgacagcgccggcgccaacattgcccacaacgtcgccatgcgaggaaccatggaaggcttcacagggctaaccctccaaggcatggtcttgctccacccgtacttcgggagtgataaaaaagatgagcttttggaatttctttacccttcctacggagggttcgaggactttaagatacactctcagcaggatccgaaactgtcggaactggggtgtccgaggatgctgatcttcttgtcggagaaggattttctgcgtgagagagggcgcagctattacgaggcgctgaagaatagtgggtggaaggggaaggtggagatggtggagttcgagggcgaggaccatgtgtttcatttgttcgaccctactaaggataaatctgtggacctcgttaagcagtttgtcgctttcatcagccaaaggagtcaattgtaa

SEQ ID NO: 26293 - DNA, 171 bp, Glycine max
  Peptide Sequence Number=SeqID_143071
atgtggtggaaagggtctaatgttgattatgaaaccgtaagggatttttccaatgatcaagatgccatggacttggcaagtatacctgatccaccctatgaggaaccttatacaaattttaaggagatgcatgatttggagactggctatgaaattgaggagatgttatag

SEQ ID NO: 26294 - DNA, 384 bp, Glycine max
  Peptide Sequence Number=SeqID_143072
atggagataccattttttcactcgtggacgtggctgaggaagcaattcgatggagcaaggaaacagcgttttcacaatctggattcttcaacaaatgaagaacgcgtccttcatatccttcagcacatcattctcagcaacaaaaaccaacacgcaattgcaagcaagcctcagacccaattctctccacttcccaaaagtaaggatgcaccaaaaacaattccctcaacgttcacacccggaagcccgtgggccccggcccgagaatacccatgtgctgtgcgatgttcgctgatacgtcgtcgtttttggaaatcactacgtctttggagatggcgtttgttgcgggatcgtgacccggcggaacgacgtcgcagcctctga

SEQ ID NO: 26295 - DNA, 393 bp, Glycine max
  Peptide Sequence Number=SeqID_143073
atggactttaggtccattccaccccttgccatcaatccaaacatacccgaagggttaggtggtgaacttaggagggttatattacaaaaagaagaatctgatgtgcggaggtggaaggggagcatgaatggggaattttcagggaaggcaacatatttgcatttgcatggcaagatttttggcaactattttgatgtcgattttcaagagatttggagaatcaatgttccatcaaagatcaacatatttatttggagggtgttcagaaacagaatgcctactgcggataatttgaggaagataaatttgctgacatcggagatggatggtaaatgtcccttttgcaaggaggatgatgaatctttatcccatgggctcttcacttacagaatg

SEQ ID NO: 26296 - DNA, 238 bp, Glycine max
  Peptide Sequence Number=SeqID_143074
cgtcgaaatcctctgctgcgcggagcaagagatcgttgcgctccttctcgcggttccgcatttcaaggaacaaagcgagctcgtcgtccctgtccatgacgcgcggagaggaggacctgagagccgccaattggtgccgcctctgattaaacgcgtcttgcatttgcaattccaccgctctgaagctccgattcatcgcaaggaacgaacgattagggatggatcgatggagcgatga

SEQ ID NO: 26297 - DNA, 420 bp, Glycine max
  Peptide Sequence Number=SeqID_143075
ctttagcttttgtgtcccgtgaccacaaggctatcatcattaatggacagagaatgatacttctttctggctccattcactaccttagaagcacccctgagatgtggccagatcttgttcagaaggcaaaggaaggaggtttggatgtcattcaaacttatgtttctggaatggacatgaaccttcacctggaaaacaagcaggcctctatgttaacctcagaattggtccttatgtttgtgcttaatggaacttcagatctaaccattgtggagttcttttcaaataggaatttggagagtgttgatatagcaagttcaacatttgccaaaactgctagtcctttttctctgagcccaaatccagcaccagccccggcaccagacttcctaaacctcactgagttactcactgttgctg

SEQ ID NO: 26298 - DNA, 327 bp, Glycine max
  Peptide Sequence Number=SeqID_143076
atggctgcaacagtgagtaactcagtgaggtttaggaagtctggtgccggggctggtgctggatttgggctcagagaaaaaggactagcagttttggcaaatgttgaactgaaaagtagcataatgttgctaacaatgaaaatcatagaaaactccatatcttccttggctactggtttatcctaccttgctatatcaacactctccaaattcctatttgaaaagaactccacaatggaaattcatctttcattacctgaagttccattaagcacaaacataaggaccaattctgaggttaacatagaggcctgcttgctacactag

SEQ ID NO: 26299 - DNA, 258 bp, Glycine max
  Peptide Sequence Number=SeqID_143077
atgccttgccacatttctattctctggctgagttcacaaccggtccaagagcatgggttgtgggaagttaaacatgatgttgcttcaggaaacaccatgctccagtgcaagaaatccgaggatgtcagtgtgaaaaaagaagaggacataaaagacacaaacacttcaacctctgaagcagggacaataaagaatcaagcaaccagcgaagatgtgaaagacaacaggagattaagggcaattgcaattaatacataa

SEQ ID NO: 26300 - DNA, 567 bp, Glycine max
  Peptide Sequence Number=SeqID_143078
atggaacatcttcaatcaatggatggttgttgtcggttacccagttgtagtaattacccaaatcaatattcatactcacttctccttcttcctaggccttacccatggattctcttcccaaattgcgccacccttctccatttcccactcccatatccccttccctctttatcgccaccccattttccttcgttgtcatttaggttatccttcattagaacttcttcctcctcctcacaaaacaacctcgcattttgtaccccaagaaagacacctcctttctctcctcaaaaccacctgcatcgtcatcgccgatattgccttcttcttcatgcgcttccaccacacgctcgccatcatcgttgcctagctcacttcctcgtcgtggaaactgacacctccttcaccaaggaggaagccgggaggattctcaaagagtgtctcagcaccaacccgtgtgatactgacgcgctccacacactcatggaggtcaaaatcaaaccacgtaagatggacgaagtgttcggggttttggaccgtctgattgagctcgaaccggagaagtaa

SEQ ID NO: 26301 - DNA, 375 bp, Glycine max
  Peptide Sequence Number=SeqID_143079
atgggtgaagcagaggaggtgcaagagaagatgaaggccgaagtggaggccatgaaagagcgaatggccacaatggtagagtccatgatgagcataaaggagatggtggaggtcagtgcggcttaccaaacccgtgctagagctaaaataatgggtgaagtagagaaggcaaagatttgggaagtatgggcggccccccattatgcgcaaattcaaaacaagcatgccttcccaccatatggctggcctcccaactatacaccacccaatgtggcatacattcccaatgaggatttcaataactctgatcccatactcattgaaatgtctctcaacccatgggcgaggcacatgaaattccccaccacaatctag

SEQ ID NO: 26302 - DNA, 696 bp, Glycine max
  Peptide Sequence Number=SeqID_143080
atgaagaaaagtaaagtaaggtttgcagacaacagagttatacaagctgaaggagcggggaatgtggctgttagaagactagatggaagacaagcaatgatcacatatgtactctatgttcttgggatgaagagtaacctgataagtatgggtcagctcctagagaagggattttcaatggagatgagtaatggatctctggaagtctatgatacaacaaagaaaatgattatgaaagccccattggccaaaaataaaacgtttaagaaaaatctcctacataacttttggggagaagcagccatgactgctacccatgtccttaatagatgtcccaccaagaggttgaactcaatggttccagaagaagcatggtctgacagcaagccctcagtcaaacatttcataatcttcgattcattgtgttgcaaacatgttccagaccaaaagagaaaaaagcattatgataaaagtgaaccaatgatctttgtaggctataactctaaaggctcatacaagttgtacaatcccaacactatagaagttctctttagtagagatgtttattttgatgaatcaaaatcatggagtgaaccacagtccataactgaaacaattccaagattacaacttgattgggaagaaattgacataggaaaagaagccacacagggtacattgaatactaagcagtag

SEQ ID NO: 26303 - DNA, 354 bp, Glycine max
  Peptide Sequence Number=SeqID_143081
atgggtgagtgtaaacgctgctctctcacaattgccgccatagaacaaccttcttcaagccaacattccatttccaagaaaagaaaaaccaccgcttccttccagttacgctcttccgatacgcagtttcccgacactatcgtctcgccggaagcttccgtcagttctaccggcacggttgtttccggcgatttttgctccgatcgctcttgctgcagctccagccactttaaggacctccactccgtgccgtcagatctgcagaccaagggtttccaaacggtagaggactcaaccaaccgctacttcaaaccgttcagtgaaagtagagtaaataatgtcatttgtagatag

SEQ ID NO: 26304 - DNA, 777 bp, Glycine max
  Peptide Sequence Number=SeqID_143082
atgtatggctgtgatgcttctgtacttcttgatgatacaccatattttacgggcgaaaagaatgctcttcctaatcgcaattcacttcgggggtttgaagtcattgatgacataaaagaacatcttgaaaggatatgtccatcaacagtttcctgcgctgatatattagccttagcagctagggaagctattgatcagattggagggccttcttggcaagttcaattaggccgaagagatgcaacaacaacaagtaaggaagcagctgagcaacaaattccctcaccaattgagcctctagaaaacattactgcaaagtttttctccaagggtcttgacatgaaggatgtcgtagccctttcaggagcacatacaattggttttgcccgatgcttcaccttcaaagggagacttttcgactttcaagggtctggcagacctgatcccgcgcttgacttctcacttctctcaaaattgcaaaacacttgtccaaatgaagatgcttcaaacagcaatctagcacctcttgatgctacaagtactatgatgtttgacaatgagtattatagaaatatcgtatacaacacagcgcttctagaatctgaccaagcactacttaaggatcgaaggactgctcctacggtttattattacagcaacaaccggttttccttctacaatgattttgccaaatccatggtgaagcttagtaatgtaggagtacttacaggagcagaagggcaaattagatataaatgtggctctgtaaactattga

SEQ ID NO: 26305 - DNA, 408 bp, Glycine max
  Peptide Sequence Number=SeqID_143083
atgtcacctggtttgcctaacaactgtacttgtatgttacaggttccacatgaaggaccaatgtgtgatctcttgtggtctgaccctgatgatcgctgtggatggggaatatctccacgtggtgcaggatacacatttgggcaggatatagctgctcagtttaatcataccaatggcctctccctgatatcgagagcacatcagcttgttatggaaggattcaattggtgccaggacaagaatgtggtgactgtatttagtgctccaaattactgttatcgatgtgggaatatggctgccatactagaaataggagagaatatggatcagaattttcttcagtttgatccagctcccaggcaaattgagcctgacaccacacgcaagactccagattattttttgtaa

SEQ ID NO: 26306 - DNA, 321 bp, Glycine max
  Peptide Sequence Number=SeqID_143084
atgtccacaccatttgttcaacagccaccacccatagaagtgacccaacaagcctacacgacccattcgggtcacgggctctgttcgggtcgtcgggtcatgggtcacggcgagtttgacgtcgaaacctgggtcgaaaccaaatgctcctcctgcgtcgacggcagaatcgcccctccgccgccacgaccacgtcctccgccaccgccggaacacaactccggcgaggaatcgccaccggaggaaccccctcaagagatcaaagaacaacaacaacagcgagaagaagagcaacactcacattcccccagtaatagttaa

SEQ ID NO: 26307 - DNA, 540 bp, Glycine max
  Peptide Sequence Number=SeqID_143085
atggtgaagttaatgtgtaggagtcacaatcatgatttggccaagtcattagttggacatccgtatgctggtcgactgactaaggatgagaagatcattattgttgatatgacaaaatcaatgatgaaaccaagaaatatttttctaacgttgaaggagcacaatgtaaatagttatacaacaatcaagcaaatatacaatgcaagaaatgcttaccattcttccataagtggcgttaccacatactcctcagacatgataacactgcaacatactgaaattaagcggaggctaagtttttcagaccaatggttatctgagcccgaagtcaacataaccaaagaaatggaaaccatatccaagcggtttgaagagtttcatgtttgtggcaaagttaccctaaagagtaaactttgggaaattgtttaccctgatctaaactctatgtgtgctcctctagaaaaggtgaaaataaaatgtgctcagaagaaactgatgacaaaacatcaaagatcaacaaagcgtgatccgtcttactaa

SEQ ID NO: 26308 - DNA, 294 bp, Glycine max
  Peptide Sequence Number=SeqID_143086
atgccgtctcacgcggatctggagcgacagatcgagcagctgatggactgcaagcctctgtcggagtcggaggtgaaggcgctgtgcgatcaagcgaggacgattcttgtggaggagtggaacgtgcaaccggttaagtgccccgtcaccgtctgcggcgatattcacggccagttctacgatctcatcgagctgtttcggattggagggaacgctcccgataccaattatctcttcatgggtgattatgtaggtcagtcattcttcttcaattccatttctccttctttatga

SEQ ID NO: 26309 - DNA, 222 bp, Glycine max
  Peptide Sequence Number=SeqID_143087
atgggtgcctcgatcagtaacgatggctctagggactccaaacctgcaaaacagattagatctaacaaaatctataacaactttagcatcgttagttctggtggggggggtctatttttgaaggggactcgccagtggggttggcgagttggacacgtggcggcgtctggtggactcaccagtggagttggcgagttgctgtggtcccgccactcgtactga

SEQ ID NO: 26310 - DNA, 883 bp, Glycine max
  Peptide Sequence Number=SeqID_143088
gactacacgtcctcgccttcatagggctgcacggcctcacctttagagaactgcaagttctcacttttagaggactgcacgccctcaccttcagaggaccacacgtcctcgccatcaaagggctgcacgctctcaccttcagaggactgcacgtcctcaccttcagaggaccgcatgtcctcacctttagaggacttcacgccctcaccttaagagggctgcacgccctcaccttcagagggctacacgccctcgcctttgtagggctacatgccctcaccttcaaaggactacatgtccttaccattggaggactgcacgccctcgcctttagaggactacacgtcctcgccatcagagggctgcatgccctcaccttcagaggactacacgtcctctcttttagagggctacacgccctcgcctttagaggactacatgtcctcagcttcagagggttgcacgccctcgcctttagagggctacgcgtcctcactttcatgcggatcatgcacaccaacatgaccactcttacacagatatggatgacgttgctacttagcaacattcctcccggcgaccacaatgccgatctccccctacggaaggatcgcgcccacaagacacccagtggacccaaagaagtccaacagggccctggggtttccagctctagttacgggcctctgtcggtcccacaggggatcgcgcccgcaagacacccagtggacccagagaagtccaacaggctcttgaggtttctagctctgattacaggcctctgtcagttctacggagtgcctattgcccccaacaaggtcatcaggccccctattaaccgggctttcgtcaagaagtactacgcctcccaagcaggcgcagg

SEQ ID NO: 26311 - DNA, 309 bp, Glycine max
  Peptide Sequence Number=SeqID_143089
atggatcagtgcagttttgagcatcctgagcattctgttattggtgagtctgagcattctatggttgattatagttttgaacattctgagaacatggcacaacctccaccccgtgagaggactcaaagggaaatggttgcacctgatttcacctacgaaagcttgtgcatccaataccctgatgaggatttcccatatgttcttaaaactggactgatccatttgcttccaaagtttcatggccttgcagggagtggcaaaggattggctatattaccttgctccaaggtccatcacgagctgggatga

SEQ ID NO: 26312 - DNA, 131 bp, Glycine max
  Peptide Sequence Number=SeqID_143090
atggtgaagaaaccaacttgtctgggcaagctacaactgccccaaagtgaccctttgcctataaataggcgtcctagaggtgttttaaatggctccaaggttcagaagttgagggaattgagagaagaaag

SEQ ID NO: 26313 - DNA, 210 bp, Glycine max
  Peptide Sequence Number=SeqID_143091
atggcgtctaccctgatttatcttccttcaccggaagtggcgtctaccctgacttatcttccttcactggaagtggcgtcatccaaaatcaaacaatccgctcctagtcaggttcacatcatctggaacttaagagggaacacgagtggtaaaaggcaagagggaatacattacacaaaagcatatattgagagcattaaacgcgagtga

SEQ ID NO: 26314 - DNA, 258 bp, Glycine max
  Peptide Sequence Number=SeqID_143092
atgtcatcactgtcgacagtggtggtggcgacagacaatcatgttgatgacgataacaatggttatgataacaaccacgatagtgatagtggcattaaatcatttgtcgttcatgttaacggtgatagtgacaaactgacaataacgatgacaactgcagtcatggtagtggtaccggttgataatcatggtggtgattgttatgatggccatgatagttgtcgtgaaaacggtaatgatagtaatgataagttttaa

SEQ ID NO: 26315 - DNA, 486 bp, Glycine max
  Peptide Sequence Number=SeqID_143093
gtcgttgagggcggccgagctgccgcggtacggtatgtgtacgatcggggcctgggaggcggtcttgtagagttcgcctaccatgtgtaccgaagagcccacgccggccgagccgaagtgcagcgtttccggcttggccttggcctgcgcggtaagctcggcaagggtggtggcctccagcgctggattggccaccacaacgtgcggcatctcggcgacgatggtgatgagcttcaggtcgtcggcggggcggtagttcagggttttgtagacgccgtaggtggcgtgcaggccgatggagccgagcagcagggtgtagccatcgggcccggaatcggccacgtatttgccgccgatatggccgccggcgccgggccggttctcgaccacgacggactggccatagagcttgcccaggtgttcggcgagcaggcgcccctggatgtccgaactgccgccggccgtgaacggtacgatgatccgtaa

SEQ ID NO: 26316 - DNA, 561 bp, Glycine max
  Peptide Sequence Number=SeqID_143094
atggtcgggccgcatcacgcagaccgccgcgctctcgtgcaggctgtgcagcgccaggtgcgcgccgtccagcggcaccgtcgtcaccaccacgtcgtaggtgccatgcagcaggccttcgcgcaggtactggctgccaacggtctgcatgttgatgtgcacgtcgggatagcgctgcgcgaattcctcgaccgcgcccggcagcatgcccaggcccagcgccggcgtgcaggccagccgcagcacgccgctgccgctgcggcgcatggctgccacgcggtcctcgatgcgctccaggcccacgaagtgccgcttgacggtgtcgaacaggtccttggcctcgcgtgtcggacgcaggcggccacgctccatgtcgaacagcttcaggccgctggcctgctgcgcctgcgccagcaggcggctgatcgacggctgggtggtgcgcagcatctgcgcggcacccgtggtggtgccggccagcattaccgcgtggaaggcttcgatctgacggaaattcagcggtcggctcatggcgtcacagggtattgcaaacctgcatag

SEQ ID NO: 26317 - DNA, 321 bp, Glycine max
  Peptide Sequence Number=SeqID_143095
atggaggatttccttgagggtcctctcttaggcaatcatggaacacagctccagactcaaaaatggaggacacatgaaagacaacgcaattcattcatgcggctgcggaacaagatgagaatggaggatagccttgagggtcctttcttaggcaatcatggaacacagctccagactcgaaaatggaggacacatgaaagacaatgcaattcattcatgtggctccggaacaagatgagaatggaggattgccttgagggtcttctcttaggcaatcatggaacacagctccaaactcgaaagtggaggacacatgaatga

SEQ ID NO: 26318 - DNA, 534 bp, Glycine max
  Peptide Sequence Number=SeqID_143096
atgacagcagttgcatctgatatcacaaggtcggcgaaaatatctgtgcccccaacatgccacacaatgtcaacagtagagaagagaattttttgtaaatgtctacgaaatgtaaaagttccacaaggatactcttcaaatatcaagagccttatagccctcaatgatctgaagttggttggcttgaagtctcatgattgtcatgtcttaatgcaacaactattgcctgttgcgattcgcgggatcttgcctgataaagttagggttgccataacccatttgtgctttttttcaatgccatctatagcaaagtcattgaccctcaacaataggatgatttggagaatgaggctgccattgtcctttgtcaattggagatttcaagctttcggggtactcgaaactcgtcatgactggacacgaggaggtaaagggacacgaggatacaatgttgtaaccatgactcaacaagatgtctcacaagcgcatttttatatcttgaataacacacaggaagtcattccctacatatga

SEQ ID NO: 26319 - DNA, 315 bp, Glycine max
  Peptide Sequence Number=SeqID_143097
atgtccaccttatcacgcgccacaatccccaaatatgttgttaatttcttcctatggggaccgtcggccttgccaatagcaggatcaacatggaccactggtctcttagcaccaagtggtctagtagacaacgatcgtagacgtgaggcttttcatgttcgcttcacggcagacggcgaagccgatgtgtcagaaataggaggaggtcgaggaggtgaaggaggtgaaggaggaggaggaggaggaggagtactggaggcagaaaagaaagaggggagcgaccaacaatttgaaggttgtacattcaggaactaa

SEQ ID NO: 26320 - DNA, 213 bp, Glycine max
  Peptide Sequence Number=SeqID_143098
atgagagttccactccgattaaaatgttcctcttggtgtgaggttcggcggcaagcaacgacggctcgtggtggctaccggtggtcgtgggtggtggagaagaaggtgttaagcaagctcgtctcgctaagcgggagtccacttttcgcgcttagtgcgacaattcgcactgagcccaactccctctgcactaattctcacttagtgcactaa

SEQ ID NO: 26321 - DNA, 1017 bp, Glycine max
  Peptide Sequence Number=SeqID_143099
ctgcgcgtcggtgattacaccgtggctatcggtaacccgtacggcctgggcgaaacggtcacgtccggcatcgtctcggcgctggggcgcagcggccttaacgtcgaaaattacgaaaactttatccagactgatgccgccatcaaccgcggcaactccggcggtgcgctggttaacctgaacggcgagctgatcggtattaacaccgcgatcctcgcaccggacggcggcaacatcggtatcggctttgccatcccgagttccatggtgaaaaacctgaccgcgcagatggtggagtatggccaggtgaaacgcggcgagctgggcattatgggcaccgagcttaactccgagctggccaaagcgatgaaagtggatgcgcagcgcggtgcctttgtcagccaggtgctgccaaactccgcggcggcgaaagccggcgtgaaagcgggcgacgtggtggtctctatgaacggtaaagcgctgaccagctttgctgccctgcgtgcggaagtcggctcgctgccggtcggcaccaaactgcagctgggcctgctgcgcgacggcaaaccgctgaacgtgacggttgagctgcagcagagctcacaggataaagtgcagtccgcgacgatttacaccggcattgaaggcgccgatctcagtaacgttgacagcaacggccagaagggcgtgcgcgttgacagcgtgaaagccggcagcgctgcggcacgtatcggcctgaagaaaggcgatgtgatcctcggtgtgaaccagcaggcggtaagcaaccttggcgagctgcggctcgccttttttattgcctgtatgttgctgcgcccccagtcatctgtgccttcccagtgtgaccgctgccgcaattccggtaatcgccctgcggctatgtgcagttgcacaatgccaggggcaatcgggatgcgtattctgtcgtggcgatcgcgagcgtattggcgaattgcacgagggcgcgctgctggtgctgtcacagggcagggtggttga

SEQ ID NO: 26322 - DNA, 1093 bp, Glycine max
  Peptide Sequence Number=SeqID_143100
ccggatgccgcgcacagccagtttaccgctgtgccacagccagcggcggagagcgtcagcgacgacgcgttcttactgtttgccgccgacggctttgcgccctctgctgcactgttgcaggaagtggcaacgctcagccatcagcgcccggagctcaactgcatgctggtttcactggcaccgcgcgcactgagcagcggcctgcagccgtcgctgcagctgtttcagcagctgcaggcgcagcgcctgtggcagcagaataactatgcggtcatcctgcgcgccgcgctggtgaaaaatgccgctccgctggtgcgcattcaggatgtgatgctggccggcctgttaaatacgcaaacggtatggctgctggatgcccgcgcggagcatcaagtcaccacggttaatccgccgcccagctatcagcaatttatgacggagtatgaaaaggtcaccccatttaggtatggaagcttacggtctcgtgggcttcttttctatattgctgacctggctgcagctgctggacgcgggcgtttcaaccacgctgatgcgcgaggcggcacgctaccgggcaaatcaggcagaatttgtctggtttccggcgctgtttgccacgctgacccgcttctttctgttctccaccctggtgctggtggtgctcggctggctggcgacgccatggatcgccacgcactggctggatgcgcagcacttgcccgccagcgatgtggtggtggccgtggcgatcatggtctggctcaacggcgtgaacctgatcattaccacgctgcgtacttttggcgcggtactggtgatccagctgttcccgaatccgctgctgaccttctttatctggcaattgctggtgtcgattgccgaggccgcctgctgtatctggaaatcctcgccgccttctccagcgccgtgtggacctttatttcgcaaattgaccggctggtgctgtcaaaaaccctgccgctgagcgagtacggctcgttcaccgtggtcgccacggccgcgaccgggatcctgctgctgagcagtccgattatgcaggcgattgtgccgcgcatgaccggcatgaaaaccc

SEQ ID NO: 26323 - DNA, 387 bp, Glycine max
  Peptide Sequence Number=SeqID_143101
atggtgagaacaccgtcttgtgacaaaagtggaatgaggaaaggtacttggactccaaaggaagatatgaagttaattgcttatgttactagtgatgttgttggcagcaactccattggatgcttgattatggtatcctggccttttgggatagcaaggatgcctaggaggttgtccgtgcttgctgtaacaaaacgagctaaaacatgtggactagattggtttggttttggaagcagaattactatcacaactacagatatacatctgctgcatgttcatggtgttgaaagagcctatgaagtagaagaactaaatcatgaagaagcccttgaattgttcaactggagggccttcagaggaaacaagttaatcctagttatatag

SEQ ID NO: 26324 - DNA, 240 bp, Glycine max
  Peptide Sequence Number=SeqID_143102
atgtctctctgtggatctcctcctactagatataaatttggtgatggtgctattgcctttggggtaggaggagtttttgctggggcttttggtgctgctgcaggtgctggtgaaatggccatggtggtggagaaaaggagtaggaagagtgagaaggagaaaatagttgcttgcttcatcttccagttgccaagtcaagccctttggatggctttgatgattctggatgaatgtgaatga

SEQ ID NO: 26325 - DNA, 1210 bp, Glycine max
  Peptide Sequence Number=SeqID_143103
atggaggaaggcacgctttccaaatggcttaaaaaggaaggcgacaaggtcacctccggcgacgtgatcgcggaaatcgaaaccgacaaggcgaccatggaagtggaagccgtggatgaaggcgtcatcggcaagctgctgatcgatgcaggcaccgaaggcgtcaaggtcaacaccccgatcgccgtgctcatccaggaaggcgaaagcgccgacgacatctcttcctctgccaagaaggaagagccgaaggccgaagctgccaattccggttctgatgccgctggcggcaagacccgcgaagcgaccgaagagccgagcgcttccaaggaagccgcgaaggttccggcagcgcccaagatcgaggttgccgctgacccggacattccggaaggcaccgaaatggtgatgacgacggtgcgtgaagcgctgcgtgacgccatggccgaagaaatgcgcgccgatgaaaaagtcttcatcatgggtgaagaagtcgccgaatatcagggcgcctacaagataacgcagggccttctcgatgagttcggtcccaagcgcgttgtcgataccccgattaccgagcacggttttgccggcgttggtgttggtgcggctttcgcaggactgcgcccgatcgttgaattcatgactttcaattttgccatgcaggcaattgaccagatcgtgaactccgctgccaagacgctttatatgtccggtgggcagatgggcgctccgatggtcttccgcggtccatccggtgcggctgcgcgcgttgctgcccagcactcgcagtgctacgctgcctggtacagccatattcccggtctgaaggtcgtcatgccgtacacggctgctgacgccaagggcttgctgaaggctgctatccgcgatccgaatccggtgatcttcctcgaaaatgaaatcctttacggtcaccatttcgatgtgccgaagcttgatgatttcgttctgccgatcggcaaggcccgcattcacaagcagggcaaggacgcgaccatcgtttcgttcggtatcggcatgacctatgccgtcaaggcggcagaagagctggccgagcagggcatcgatgtcgaaatcatcgatctgcgcacgatccgtccgatggacattccgaccgtcatcgaatcggtcaagaagactggccgactggtgacagtggaagaaggtttcccgcagtcgtcggtgg

SEQ ID NO: 26326 - DNA, 450 bp, Glycine max
  Peptide Sequence Number=SeqID_143104
atgaagttccaaaccttgacaagtgaaatcgtaattgtcaaggtagaccaaaagcaagcccgacaatgctatactgaaattttaaaggtggctccttatcttcccatcaaagagttgggcaagcctcaccccacctctaggggcaatgacaatcaggccaatgcgaagtggcgtatgtgcactaactataccaacctcaatagagtatgccccaaggactatgctttgcccaacttcgataggcctttggatggtgcattcgggttccaattattgagcttcctagacatttgttcagagtacaaccaaatcagaatgcaccctctaggtgaggaaaaaaccgccttcatcactaaagacacccatttttgttacagggtcgtgcctttcagacagaagaacagaagggctacacaccaaaggcttatggatcaggtcttcaaacaatag

SEQ ID NO: 26327 - DNA, 360 bp, Glycine max
  Peptide Sequence Number=SeqID_143105
atgaaggtgctgccatacatagtagatgaaagtaacattgttggaggggtacgtagcggagggagaatgacaaataagttagagatgcctaatattgccatttgcccgtttttcagtgacaaattattgttaaatctgctttccatccctgtttcagggaagggatctgatccatatagaggaaaagcatgttgtgcaactgcttcttgtaagcactgtttcaccccagaaaagaaggacacgtttttgttgaatactgagtatctcagtttgcttcgggggactgagtttgtgtctatggcttctattggtgttctgcttggtattgcttctagggagttgctacttgctattgtctga

SEQ ID NO: 26328 - DNA, 385 bp, Glycine max
  Peptide Sequence Number=SeqID_143106
atgtcaggacatcgtgtccgacatcgtggatcctgcagcttcacttctgcacttgacttttatcttgcattgtacagcaactccagtattctcgggcaggatcaactccagtattctcgggcaggatgtcaggacattgtatccgacatcgtggatcctgcaacttatcttgccttgtgcatttccccagtagagtcgccaactgtcgcaacctacccttcggcgggagggcgacacggggctcacgggtgtatcttccaagggaggaaggcgcgtggagtcgccaccaacgtttattcgaggaaaacatcggaaaaaccggaaaggtgtggtctacgaactttaatcgtgaaaggttcaggagttgtttttatgcacggggaag

SEQ ID NO: 26329 - DNA, 318 bp, Glycine max
  Peptide Sequence Number=SeqID_143107
atggcatgtagcaaaaatacttggatgtgggtacatgtaatttttggtagcaagaatacctcacagaaatgcatgttaggtagcaaaaatacctcacaaaagaaatggccccaagaaagcttccatcaaagaggtccaggaaggacactgtcggagaaggctccagagctgcccagccagctgacacatattttgacaggcaccgattctggagagcagagcatcagcagcgcttcaagaccatcaagagatggtcattcctcagagagaggtgatggaagcttgcttgtggggcttctatggaggctggatctttga

SEQ ID NO: 26330 - DNA, 417 bp, Glycine max
  Peptide Sequence Number=SeqID_143108
atgcagtacaccgacctactaccatccttacttagcaaccaactagcagtagtgagcctgggaagggtttatcaacctccatttccccgatggtacaagcccaatgctacatgcccctaccatggtggcatcccgaggcttacgtttcaagaggatagtcccaatgttttccgtaaggctggcatggttgaatacaacggtgataagggggatcggtccccgctgcatccatgggagttgcatgatgtagagacgtgcttagtatccaaggagctgttgcagggattgatagatgaagggcgaattgaaattggccgcgtaatgagggaggaaggagaggtgttcatgcagtcaagtgacaccaacctggagatgttaccactcaagtgcctcgaggtttccaacccgttgtggtga

SEQ ID NO: 26331 - DNA, 144 bp, Glycine max
  Peptide Sequence Number=SeqID_143109
atggagaaaggtacaagtcattctatggagaaaggtttcaagatcctgttgtttcctatcattgatagtctaggaaaccccttaagaatttttacatgtcgtatcagagcatgtgttatgaaatttatgattctcgaagaatga

SEQ ID NO: 26332 - DNA, 153 bp, Glycine max
  Peptide Sequence Number=SeqID_143110
gaaaccgctggtcaaattggcgagttccaagttgcagaagttgcagtcgtaggctcaggtggcaggcttgctttttcagatggcaggccaaaggcaagttgcaactgccattggcgagttaagggcaagttgcaactgccattggcgagttag

SEQ ID NO: 26333 - DNA, 285 bp, Glycine max
  Peptide Sequence Number=SeqID_143111
atgggtcatctctcacacttcaaccagacacatgccgaagtcaatgtttggagaattgcatattcatatgatgctgatattggttttatgtcttggggtgggaatctaattgacatacaacaattctcaaacggaggaattgatctatatgtttgtgtagcctacatagaactcgatataaattatatatgtgagagagagttttttagaggctgcataacagaggagttgcaggaaattcaaaaagttcttaaaggaggtagtgagctaggttctacagcttag

SEQ ID NO: 26334 - DNA, 324 bp, Glycine max
  Peptide Sequence Number=SeqID_143112
atgaagttgaagaagcttgttcttgctggaaactatcttactggtagaattccaaatgctttttatgggctaaatgagttattaatctttcagttattaatctttgagttaagtagcagttcattatctggctctttgcctttgacacttgggaggttaacttcagcgttgaagcttgatgtcaacaacaaccaccttgaagggaatcttctaaatgaatttgctaatcttaactatttgacccttatggaccttaggaataataggttcactagagggttgacccttatgccaccactacacaaggctttgctctctggttga

SEQ ID NO: 26335 - DNA, 198 bp, Glycine max
  Peptide Sequence Number=SeqID_143113
atgggtattttgtacggtggtgacaacaattataataataacaataataataataataataatgacggtgatgatgctcgtggtggtgttgtgataatggtggccattggtaacgatggctgtgacggtggtaatgacaattacaagaatgactattatcaaatgatcatgaatggagaatgtgtttttcaaaactaa

SEQ ID NO: 26336 - DNA, 203 bp, Glycine max
  Peptide Sequence Number=SeqID_143114
ctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 26337 - DNA, 486 bp, Glycine max
  Peptide Sequence Number=SeqID_143115
atgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 26338 - DNA, 228 bp, Glycine max
  Peptide Sequence Number=SeqID_143116
atgtatgtaaatctcccaaattatggttatttttgcttgctaagcgaggcagttgtctcttctgcgctaagcgcaagattggcgctaagccaaatatcacttactcatgctaagcgcaagaatggcgcaagcgcaccttcaaggaactttagcattgacaaatgtactgtttccttggaacttgatagagcagggctagataactgtagtgctagacatagtgtgtag

SEQ ID NO: 26339 - DNA, 612 bp, Glycine max
  Peptide Sequence Number=SeqID_143117
atggaaaacaacaatattcaaccatgccatgatgaccttgatcgtagagaagccaacaaccctccaaagatgttaaacttggaggtggaaggacagagagagggttttgactatgcaaagagaccaaaatggcttagagctgctgttttgggtgccaatgatggttttgtctcaacaacatccctcatgatgggagttggaggtgtgaggaaagatgttaagagtatgctgctgactggggttgcagggatggtggctggagtatgcagcttggccattggagactttgtttttgtttactcacaatatgctattggtataggggtgcaactacttggtgctgcctttttcaatacctataaggcaaggttaggggtggtggtagctgttgtcacccttgctttgatcatctttggagattttggggcctttttagggaaagcacccagggttaagtccactttgaggagtgctggagtgcaatttgctcaaagggatcaagtggtccaaccaaataatcctatttcacaacctagtatgactactaatgtaccaaacagggagcaagcctcagctagacaggaagcagttgctcagctagcagagtcctaa

SEQ ID NO: 26340 - DNA, 171 bp, Glycine max
  Peptide Sequence Number=SeqID_143118
atggtggatgtggatgtagttaaagaacaagttccacaaaatcttgaacctaccaagtgtgatggttgggattggtacgagtgggatcatttgtcacaccctctgcttgggcctcttgagaaaatggatgcacgtaaatttgtaaaacgtctaattcagaagcaacattga

SEQ ID NO: 26341 - DNA, 540 bp, Glycine max
  Peptide Sequence Number=SeqID_143119
atggatagagctaggttggtctatggcttggtgactaacatagacatgaacatcggagcccttatctcagttaacttcagaggggcaaggaaggcaagggttcgaccaactgatgttccttcttcttctactccaccagctccttccacttctactactcatataccaactcctccaggcctatctgctcaggactctcaacgctttaagtccatgcttcagagtcttcatcaaggacagattttgttaatgcagagtttgcaggttgtagctcctctaggatctattctgacagtggaacaattcatagagaaggtatcctggccaggaaccctaccttctctcgagagagaaggtgggggtccaagtgctcaggtacctcggcaggtacaagatgcatcttctgaggccaccatccctgagccattcatttttgaagcagatgagacacaggtaaggcaggaggctgctactccagagagatcaccacatatttcactagatccaccctctccagtggtggatcaatcttctctttag

SEQ ID NO: 26342 - DNA, 267 bp, Glycine max
  Peptide Sequence Number=SeqID_143120
atgaggaaaacatcaacaaattcaagagtcagtaacagtgagagggttaagcaagagcaactaggagggtgttctgcagcacaaatcttcgacgtggttggcagcacaagcccagatctacaatcgcgaccaaaaacaagggtggatatgtgtcatcgggtggttgggcagtggatacatgtgaccaagaacaagcatggttgggcgatggcctggtggaagctagcaccgttgaacgaagcaaacgctgtcaatgcagtgaaatag

SEQ ID NO: 26343 - DNA, 201 bp, Glycine max
  Peptide Sequence Number=SeqID_143121
atggatcttcgacgtggttggcagcacaagcccagatctacgatcgcgaccaaaaacaagggtggatatgtgtcatcgggtggttgggcggtggatacatgtgaccaagaacaagcgtggttgggcagtggcctagtggaagctagcgccattcaacgaagcaaacactgtcgacgtggtgaaatagatttaggggttact

SEQ ID NO: 26344 - DNA, 312 bp, Glycine max
  Peptide Sequence Number=SeqID_143122
atgatgaaactagacttgtacaaatatggtaagaagtttgattcttctctaccaaagtcgctttggggaaagacattaaagaatacaatttatatctttttaaggtaccaattaaagtattcactaagaacccttataggtttaagccaaggaaatcccaacattaggcatatgcacatttggggatgtccagccgaagcaatgccttataagctgcatgaagataagttggatttaaaatcaagcttatcgataccgtcgacctcgagggggggcccggtaccagcttttgttccctttagtgagggttaa

SEQ ID NO: 26345 - DNA, 309 bp, Glycine max
  Peptide Sequence Number=SeqID_143123
atgaggattctttttataggccaaggttcaaagtggtctaaggtcgtgtctcaacagggtcttttttcgtgggagcccgatcttgatatctggggcacaacaaattcgtgtgtcaaggcacgcgtaacattgatgattcggaaacaacgtgcaaaattagtcatggccacagctaggtgggcactcaagcatccagtttatggcattgtgatactacagttggggatttacacaaacagacccaacgtttccaaattatgttctttcatcggttcaatgaaaccatccattcttatctcggtcatttag

SEQ ID NO: 26346 - DNA, 825 bp, Glycine max
  Peptide Sequence Number=SeqID_143124
atgagcattctctctaccggtactgactatgacacgctggcggcgcacttccgaccgctgtttgcccgcatcgcggcgggcgcggcggaacgcgagcgtacgcgtaccttgccttatgaaccactgcagtggctgaaggaagccggctttggcacggtgcgtattccacagcaaaaaggtggctggggcgcctcgctgccgcagctgtttcagctgttgattgagctggcggaagcagattccaacctgccgcaggcgctgcgcgcgcattttgcttttgtcgaggaccggctcaaccagccggacaatgcggagcgcgatgcgtggtttcgccgctttgttgatggcgagctggtgggcagcggctggacggagattggcaacgtcaggctgggcgacgtgatcacccgcgtcacgcctgccgccaatggctggacgctgaatggcgagaagttttacagcaccggtgcgctgttcgccgactggatagatgtttacgcgcgtcgcgatgacaatcagggtgacgtgatcgcgctggtcaatacgcatcagccgggcgtcacgcgtgaagatgactgggacggatttggccagcgcctgaccggcagcggcacgacgcgcttcgagcacgcgcatgtggagacgcagcacgtgtatgattttgccacgcgcttccgttatcagaccgcgtattaccagcacgtgttgctggcgacgctggcgggcattgcgcgcgcggtcgcgcgggacggcgcggcagccgttgccgcacgcaaccgcgtttacagtcccggcaacggagctgcctcgcggcaggatgcgcag

SEQ ID NO: 26347 - DNA, 653 bp, Glycine max
  Peptide Sequence Number=SeqID_143125
gcttttcgtcttacagacagcaaaaagtttatacggatagccactcaggtattttcgcccgtcagcgtgactcaaaagtcagtatgacagatcttgtgagcgcggaagatgacgttaatctccgcgtacagctaaaagtttatacggataacaacacgggtatttccgcccgtcagcgtgactcaaaagtcaatatgactgatcttgtgagcgtggaagattaccgtgactcaaaagtcaatatgacagatcttgtgagcgcggaagatgacacagcaaaagtttatacggataaccactcgggtatttccgcccgtcagcgtgactcaatagagagtatgacagatcttgtgggcgcggaagatgacgtatatctccgcgtgtcaacgggcttttcgtcttacagacagcaaaaagtttatacggataaccactcgggtatttccgcccgtctgcgtcactcaaaagtcagtatgacagatcttgtgagcgcggaagatgacggcacagaagacgacgttagtctctgcgtgctattaggcttttcgtcttacagacagcaaaaagtttatacggataaccactcgggtatttctgcccgtcagcgtgactcacaagttagtatgacagatcttgtgagcgcggaagatgac

SEQ ID NO: 26348 - DNA, 534 bp, Glycine max
  Peptide Sequence Number=SeqID_143126
atgagtgacaccttttcccctgatgacgtgaaatttatgcaactggctcttgagcttgcggcaaaagggcagtacaccactacgcctaatccatccgtaggatgtgtgttggtaaaaaacggtgaaattgtcgggaaagggtttcattttaaagccggtcagcctcatgcagaacgagtggcattagcagatgccggtgagaaagcaaaaggcgcaaccgcttatgtgacgcttgaaccttgttctcattatggacgcacaccgccttgtgcattaggtttaattgaagcgggtgtcagtcgagttgtcgcagccatggccgatcctaatcctcaagatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaaagtgtaaagtctggggtgcctaatgagtga

SEQ ID NO: 26349 - DNA, 457 bp, Glycine max
  Peptide Sequence Number=SeqID_143127
ccaagaggtggctgcactcattcaaaggaaacaacttaaagacttgggaagaggttgtagaagcaaaggctttgcatttgatgttttgatgatgccatatgatcgtgatgatttgatgtcttatgaaaatgcgcttatcaagtttaattcaagacaacaatccaagaatacaagatacaacatcaagaagatctctagtattttaggaagggaattccaaattgaaatagcaaaagggtctcttgttgtaaagaaatatgaacacaaaggaagggttgcccttgtgtggttcagaacttgtaaagggattttacaagatagtggaactctcaagcaggttgcttggggactggacgtaggcacaaggggaccagtcactagagtcatgagcaagaggctccaagaggattgggctagagctattgaagaaggccctagggttcttatgaatctcagg

SEQ ID NO: 26350 - DNA, 192 bp, Glycine max
  Peptide Sequence Number=SeqID_143128
gttgttaaaattgcaaacacttgaccagacacttgtgagcagagagaaacaccagctttgtaaggaaatgcaaagaggccagtcaaaggatcaaggaattgaagtcatggagagtgttggaatgcttggaacttacttgagaaaaattttgcttaagaatggaataattttatttgcttggggacaagcaaa

SEQ ID NO: 26351 - DNA, 417 bp, Glycine max
  Peptide Sequence Number=SeqID_143129
atgtatacggataaccactcgggtatttccgcccgtcggcgtgactcaaaagtcagtatgacagattttgtgagcacggaagatgacgtaaatctccgcgtgtcaacgggcttgtcggccgcgattgacgaagggcgcaggagacgacatagcaaaaaggtttatacggatgaccactcgggtatctccgcccgtcagcgtgactcaaaagtcagtatgacagatcttgtgagcgcggaagatgacgtaaatctccgcgtgtcaatgggcttgtcgctcgcgattgacgaagggcgcaggagacaacgttactctctgtgttctatcaggcttttcgtcttaccgatagcaaaaaggtttatacagatgaccactcgggtatctccgcccgtcagcgtgactcaaaagtcagtatga

SEQ ID NO: 26352 - DNA, 111 bp, Glycine max
  Peptide Sequence Number=SeqID_143130
atggcggttttaccaagtagctcctcaagcttggaattgaccatatctgtacctggttttgcttcttcaccaacccttcttccctcatcatctgttgtttctatgatataa

SEQ ID NO: 26353 - DNA, 351 bp, Glycine max
  Peptide Sequence Number=SeqID_143131
atggactcacactgcctcctgagcctgaggttggtctttcaactgcttgtgttagcacaaaggagagttgtgttgatccctcagggagcgatccaagcacgggttggtgttgaggaggttagagatgcagatgctcctattcctgtacccactgaagaggttaagttagtggggcaggcacttaacaccttccttgcttgggcgacacatcttgtcaagcgtttaccaaaacaaggagctgtggaacccgtgaaacctacagataggccgaatcatgatatcgatgatcccctatatctgatgatattgaccatcccacaactttttctgaagtcgttgcaggttatgtga

SEQ ID NO: 26354 - DNA, 474 bp, Glycine max
  Peptide Sequence Number=SeqID_143132
atggtcattcccaagttcaaggtgccagactttgacaagtacaaggggactacttgtcctaagaaccatctaaagatgtcttttcgaaagatgggggcatacgcaaaagatgaggaactgttgatacatttcttccaagaaagtcttactggagtagttgctacttggtacactaacttggagccttcccgagtccattcttggaaggacctaatggtttccttcgttaggcagtatcagtacaattttgatatggttccggataggatgcaactacagaacatgtgcaaaaaggggcatgaatctttcaaagagtacgcccaaagatggagagacctggcagctcaagtggcacgaatctttcaaagaatacgcccagagatggagagacctggcagctcaagtggcacctccaatgacggggaaagagatgatcacaataatagtagacacattaccagtgttttactatga

SEQ ID NO: 26355 - DNA, 159 bp, Glycine max
  Peptide Sequence Number=SeqID_143133
atggcttataccgccatcttattggttggtttaggtccagctcacactactgaaaaaacagtaggatcggcgatatccgaaacaggtaacctcacagcttgcttaggtgcaagcaatctcaatgcaatgagagagggaggtctccggttccatgaaagg

SEQ ID NO: 26356 - DNA, 393 bp, Glycine max
  Peptide Sequence Number=SeqID_143134
atgaagagaatgagaatgagggaaacccttgctatgactgccattcctacacgcccttctcattacccaccacctagtcatccacaaaggctatccctaaatcatccacaaagtttgctggctgcacatccgatgccaagcgcaaaccaaaacaccaaccaagaagtgaattttgcagcgaaaaagcctgtagaattcaccccaattccggtgtcctatgctgactgtggaagcaatgttttccaagtttattttgatgatgccaaagactcaagtcaagaatcaagagtcaagagtcaagcaattttcaagaatcaaagagtcgttcaatcaaagcaaatttcaagaatcaagattaaagtgaagattcaagagaagactcaattaagataa

SEQ ID NO: 26357 - DNA, 557 bp, Glycine max
  Peptide Sequence Number=SeqID_143135
atggaggaatccaatcggaaaaataacaaagatcacatttgccagtcaagtgggtccgttcttgacggtgaagaacacattggtgaatggaggaatccaatcgggaaaatcacaaagatcacatttccctgtcaagaggggtccgctcttgacggtgaagaacacattggagaatggaaaaatccaatcgggaaaataacaaagatcacatttcccagtcaagaggggtccgctcttgacggtgatgaacacgttggagaatggaaaaatccaatcgggaaaataacaaagatcacatttcccagtcaagaggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaatgctgcaccg

SEQ ID NO: 26358 - DNA, 461 bp, Glycine max
  Peptide Sequence Number=SeqID_143136
atgggatcaaatcaaacacctatgcctaagaaaaggttctatcaagtcaaaatcaagagcttagaggtcgccagtttacgagagttagggcaattgatgggtcaacttcaacggcaagccttcaccaaagcctatggtaagatttgggacctagctacgatagaagatttccagctagtgccgacggtggaagagtttgaagaaatcctgagatgcccgctgggaggaaagaagccatatcttttctcggggttctatccctccatggctagagtttccaaggcaaaggccttggcaaatcaaggtgaatgggcttcctttgttgacatcttggcgcttttgatcttcggagttgtcctctttccaaatgtgaaaggggtagtggacctagcagtgattgacattttccttgcctttcatcatggcaaggaaagcccgatcgtcgccattttggctgacat

SEQ ID NO: 26359 - DNA, 897 bp, Glycine max
  Peptide Sequence Number=SeqID_143137
atgcgacagtttggaatgcaacaacctattccggtcccagtaatgcaacccgaaaacatacatgatttgaccttaaagggaaaagaaggaagaaattggatgcgactaatgcaacccgcgcttaatgaatggaatagtcgctatgaaaggagagtagaactaacgccgccacaaacagggacccttagtctgaactctgaatatatgaggtggtacaggcgtaagacaaaaggtgaaattgtgaaaacactacattttatggtgtcgcctgttgggagaagggtttgtacttttgacgatttactaccatgtatcgagaagatcactcttctatctgaagaagaggataggatacttgaggcacatcaagatgctcccccttctcagccacaatttgaacatcagcagtttaatatactacagcgaagtgtggagactcgaggcttagggcgacgtcggcaaactgtggatgcagcaccgtacagtttgccttcgatgccagaacgagaacatggaatgtattacacaccaccggtattcacccaagaaccatcgcagatggcgccgatgtattcatacccacatgatttccaaccagggtacagtatgacaggcatatttggatcctctcctccttcaggggggactccttcattcacccaaaataatgaactaccgaccccaaatgctccacttggtggtccgtggaatgtacctggaaatatacctgacatgaatgacttattgggggtcgatttacgtcatgatttctctgccgaggctgacgaagtggatgaaagggggaatcttagaagaagaaaccctgatagggcagctaggaattgggatcggccatgtgggacatcgtcgcggcatcacagacatagtcatgattga

SEQ ID NO: 26360 - DNA, 889 bp, Glycine max
  Peptide Sequence Number=SeqID_143138
atggcggcaaaagacctgtattattacccgaaacaaacaacaaacaaaacaatgttgacgactcgtcaatttaaatgtatgctggagaagcataaattatttttacttccggttcgatttcaatctacttctaactggatttctcactttgcaaatacattggatatgccggaaaataaaagcgagaatcgtgctaaaatagaaagtttctgggaaggtgctttaaaggatatttacgaagaaacactaatgtatgataataatgatgtggtccacagtccggatgaatgcgttgatcctgaaacacgaaaaataaaagtccctaaatcagagtttgttaagacatataaaaatagcgtcttttctcttctggactgttatagatatgaaaataatgatgcacaaacattagaatcgcttcagagagaaattgaggatctgactttgaacttctctgaagatagtatttataaaactagtcctaacattatggtaatgttaactaaaaacaacttgccaagtgctaaggaattccttcgtggaaagtatcttatggataaagaatatcccggcagaatgaccatttatgcagaaagtcgaagtggtgatagtctagaaaccagcggctcagagctatccgatgaggagaataaaaatctaagatgtgtactatctgaaagtgataagtcgttgttggtagagttaggcgagcactccattgagtgcctactggttcacaccctaggccatctgtttaatctggaaaatattgtcagtcttgctagtttggttgatcgtatagaacgcaatgtaagggattatgcctcatcgtcaacattgtattataatagtagggtatgtaatctaagtatggatgctgttgataaag

SEQ ID NO: 26361 - DNA, 151 bp, Glycine max
  Peptide Sequence Number=SeqID_143139
tcacctgccattagctaataaaccagcattacaggttacttcaagctctgtcagactggtcagctccacaactagagatcttcggaatgaatggcatgcaccatcaggctattcagtaaatgtagctacggcaaacgctacccaggtgtga

SEQ ID NO: 26362 - DNA, 306 bp, Glycine max
  Peptide Sequence Number=SeqID_143140
atggaaaatcctcactgcagagtcctgaatggccagttcacaactctattcggagtcatttctttcttaccgctcataatctctaaactattttgctatttaaaaaggaagaatgtaccagccattactttaggtcgtcacatgaaaataaaagtggtcgtgggggtcgggtacgataagctcgatgatgaggatccacttctggaggtggattctcccgaagaagtcatgccggcatctaaggcagactctacggcggaaggtggccctggggcgatggcgatcagcggaggctcttcatcctag

SEQ ID NO: 26363 - DNA, 411 bp, Glycine max
  Peptide Sequence Number=SeqID_143141
atggaaaagggcgcagaattcctctatgcgcatttaccactcgactcgctactcctgaatgataaaagggcgcagaattcgtctatgcgcgtttatcaccctatttgcgaaatctgtatggcaaagggcacagaattcgtctatgcgcatttaccactcgactcgctactcctgaatgataaagggcgcacaattcgtctatgcgcgtttatcacccaatttgcgaaatctgaatggcaaagggcacagaattcgtctatgcgcgtttaccactcgactcgctgctccttaatgataaagggtgcagaatctgtctctgcgcgtttaccacccaacttgtcgttcgtgaatgatacagggcgcagagttcatctatgcgcatttaccatccaacttgttgttcctcaatga

SEQ ID NO: 26364 - DNA, 156 bp, Glycine max
  Peptide Sequence Number=SeqID_143142
atgtctgatatgccttttagaggcttgaaaagtgtgagaaaacgagttgtgttttctgcgttttttggaaaacgcgatgaactcgcaaagcaagcatgctacgctaagcgagttcatcaatactcattgtatgaattaatgaaacattgggcttaa

SEQ ID NO: 26365 - DNA, 531 bp, Glycine max
  Peptide Sequence Number=SeqID_143143
atgccatttggaatcactattgcccctgctacatttcagtctctcatgaatgaggtatttcagtgctatttaaggaaatttgtactagtcctatttgatgacatacttatatacagtccaaactggtcagcttatttacaacatttggaaacagtgctgaaagtgttagaacaacataagttgtatgccaaattatccaaatgttcatttgggttacaagagatcgattacttgggccacatagtatcaggcaagggagtaacaatggatcaagaaaaggctcaagcagtcctgaattggccatatcctataaatctgaagcaattgagaggcttcctcggtctgactggatactacaggaaatttatcaaaggttatgtgtcaatcgcaactcctttatccaatctgttgaagaagaaaaaccttcattggaatgaccacacttccatggcttttgacaatttgaaagctgcaattaccaaggcaccagtactggcattgcctgatttttccaaagcctttacattttaa

SEQ ID NO: 26366 - DNA, 1317 bp, Glycine max
  Peptide Sequence Number=SeqID_143144
atgtcaaacacatctccctcttcgcacagcagtgaggtttacgatctgcgttctgccatcgaactgctgaagcaatttgatggtgagtatattgagaccgatgaaccggtgaatcccgaagcggaactgtccggtgtctatcgttacgttggcgcgggcggcaccgtgatgcgtcccacacagaccggaccggcgatggtgtttaatcacatcaaaggttacgacaactttcgcgtactgattggtttgctggcctcacggcagcgcgtggcgcgcctgttaggagtaccgaaagaaaagctggcgcatttgctgcgttcatcggtacacaacgccattgcaccggtggaaataagccagcagcaggcggtttgtcaggaagtggtgcacctcgccacggatgacggttttgatatccgccgtctgctgcccgcgccaaccaacacgcctgaagatgccggcccctatttcaccatggggatgtgttatgccgccgatccggaaaccggcgaacatgacgtcactattcaccgcttgtgtgtgcagggcaaagatgagatctcgatgtactttgtgccgggccgccatcttgatcagttccgcatcaaggctgagcaggcgggcaaagcgttgccgattaccatcagtattggcgtcgatccggccatcgaaattggcgcctgtttcgagccgccgactacaccgctcggttttgatgagctggcgatagccgggggcttgcgcggtcgggcggttgagctggttaagggtgtcgccgttgatgcccgcgccattgcccatgcagagatcgtgattgagggtgaactggtgccggattatcgcgtacaggaagatcagcatacccatagcggtaaagcgatgccggaattcccgggttataccggtgaagcgcaggcggcagtgccggtgattaaagtcaaagccgtgacgcaccgcaaaaatcccatcctgcaaacctgcatcggaccgagcgacgagcacaccaatctggccggaatcccgaccgaagccagcattctcgatatggttgagcgtgcgttaccgggtctggtgaagaatgtacattgcccttcgccaggcaccgggaaatatgttgcggtgctgcaaatcaataagcgcggcccgcaggatgagggacgccagcgtcaggctgccctgctggctttctcggccttttcagagctgaagcacgtgttcctggtcgatgaggatgttgatgtgttcgacttaaatgacgtgatttgggcgatgaccacgcgttatcagggcgacgcagatactatctttattccgggc

SEQ ID NO: 26367 - DNA, 460 bp, Glycine max
  Peptide Sequence Number=SeqID_143145
atgactaatgaatcctatacttgtatgcttatgtgttcacttcactgttcagctcaagattctctggaatttgttatacaatggctagaaagattccctcgttacaaaaaccgggaactttatatcactggagagagctatgcaggccattatgttcctcaattagccaaggaaatcttgacctacaacgcaaaaaccaagcaccccatcaatctcaaaggaatcatggtaggaaatgcagtgacagacaactactatgataacttgggcacagtgacgtattggtggagccatgctatgatctccgaccagacttaccggcaactaatgagtacatgtgattttcacaggcagaaggaatctgatgagtgtgagtctgtgtatagctatgccatggatcaagagtttggtaatattgatcagtacaacatctatgctcctccatgcaacaactctgatg

SEQ ID NO: 26368 - DNA, 549 bp, Glycine max
  Peptide Sequence Number=SeqID_143146
atggctcaaagacagatctttgctcatgtggtgattttgttgcttatggtcttagttggagccaggtttgctaaagcagaaggaggaggagaagctgctgataggattttggaactccctggtcagccaaaagtgtcatttcagcagttttctggctatgttactgttaacaaggttgctggtagagctctcttttactggctcactgaagctgcccaaaatcctctcaccaaacctttggtcatttggctcaatggaggtccaggatgttcatcagtggcatatggagcatctgaagagattggcccatttagaataaacaaaacagcttctgggctatacattaacaagttttcgtggaacacagtggccaacctattgttcttggaagctccggccggcgtaggcttctcctacgccaaccgctcctctgacctcctcaacaccggtgaccgccgcaccggtagggcccacatccctcccgtccccacattaattgcctccacccttcacggatcatatatgtttcttggtgatgatttttttttg

SEQ ID NO: 26369 - DNA, 2124 bp, Glycine max
  Peptide Sequence Number=SeqID_143147
atgcaagagacgctcctcagtctttccgaacaccaccaccaagacgacagcaacaacaaagacatcgagctgcttctggttccgccgccgtgccgccgccagccgcggatggcgcggcgcgtgtctccgggcgcggtggaaaaagccctcccctgcggcgacatctacagcggaagcctctccggcaacgtccctcacggcaccggaaaatacctctggtcggacgggtgtatgtacgagggcgagtggaagaaaggcaaggcgtgcggcaagggccgcttctcgtggcccaccggcgccacctacgagggcgagttcgccgccgggagaatgcagggccacggcaccttcgtcggcgtcgacggcgacacctaccgcggcgcgtggctctccgaccgcaagcacggcttcggcgaaaagcgctacgccaacggcgacgtctacgaagggttctggaggtgcaacctgcaagaaggggaagggaggtacacgtggcgcaacgggaacgagtacgtcggagagtggaagaacggcgccatctccggtaatggcgtgctggtgtggaagaacgggaaccgttacgaagggtgttgggagaacggtgttccgaaggggagaggggtgtttacgtggcgcgatggaaacacttcttctgggaattgggggaaagagtttgtgaacgagaaacgtgtgtcggtggatgagtgtagtaataataataataataataacagtaatagtaataataagagtgtgagttttcccagaatttgtatttgggagcttgatggtgaagctggggatatcacttgtgatattgtggaggcttctatgatttatggtggaggaggagtgtgtgaaagtgatgtacagttgcagaagagcccttgtggttctgttgatggggatgttaagaaaccgggtcatacggtttctaaaggacataagaattatgatttgatgcttaatcttcaactgggtattagatactctgttgggaagcacgcttcggtcttccgagagcttaggccgggcgattttgatcccaaggagaagttctggacgaggtttcctccagaagggtctaagtttacacctccacatcagtctgtggatttcaggtggaaagattactgtcctgtggtgtttcggcatctaagggaattatttgggatagatcctgcggattacatgcttgctatttgtggcaatgacacacttagggagatgtcttctcctggcaaaagtggaagcttcttttacctcactcaagacgaccggttcattatcaaaaccttgaagaagtcggaagtcaaggtgctcatcaggatgcttccaagttactatcaacatgtgcgtcagtacaagaattcgctggtaacaaaattcctgggggttcattgtgtcaaacctattggaggtcagaagactcgatttattgtgatgggcaatgtattttgttcggagtatcggatccataagcggtttgacctcaaaggttcttctcatggccgcacaaccgataaaccccaggaggaaattgatgagactaccactcttaaagaccttgatctttgttttgtcttccgcctggaagagtcttggtttcaagagcttaaatggcaacttgatagagactgtgaattcctggaagcagagggaataatggattacagttttttgattggccttcattttcgtgatgatagctcagttgatgaagtagtaaagagtttaccggacgagttgtgttcaggcaagagagacatgcaaaatgatgacgtacaggatatgaaatggatacccatagaccggggacctctaattcggctgggaacaaacatgccggccagagcagagagagtgtgtaaagctggattggatcagcacactggtactggaagtagcaattctatcccttcagagagtggtggtgaggtctctgatgtaatcctttactttggtataattgacattctccaagattatgatataagcaaaaagctagagcacgcatacaagtcactgcaagtggatccctcctccatctcagccgttgatcccaagctatactccaaaaggtttagggatttcatacacagaatctttgtggaggacaaatga

SEQ ID NO: 26370 - DNA, 546 bp, Glycine max
  Peptide Sequence Number=SeqID_143148
atggcggtggcttgggggatggatgtcaactttgacgtgatggaaggtggtaatatggtgtttgggtcatgtaggtcttggtggtgtttgatgattgttatggttgaagatgtgaaagagtcacaatttcaatggccgcagaaatttgtggcgggtctctattcttatccgttaaaactcaactgcaacagcgaaaccagcaaaatgtgttcttccatgctcaacgtagcagaacgcgaagaagcactaccagattccactcatccaaatgctgctttagttcttccgcctttccaaatgcgtccccgtttcgccgcggcgcagtgtgccgggtcgccagcaccgacttcgaatcctccgccaaagcaggcgaggatcgtctctctaaggaacttctgcatcattgcgcatattgaccacgggaaatccacgttggcggataagttgcttcaggttaccggcacggtgcagcagcgagaaatgaaggatcagtttctcgataacatggatttggagagagaaagaggcatcactattaagctccag

SEQ ID NO: 26371 - DNA, 282 bp, Glycine max
  Peptide Sequence Number=SeqID_143149
atggggatcaacttaagaaaaatggggttgaaggaaataaattacccaagtgttgaacgacgttattgtgcaaagggagtgcaggctatgaaaatggatagcatgtgtttcgccaatgatgctggcgaaacacatgtggacagggagcattttgccaatgcatctggcggaaccaatggtggatggtggatggcgggatgtcaagatgcatgcatgggcatgcatgccatgcatggagtgtgtttcgccagtggtgatggcgaaacacacatgacgcagtga

SEQ ID NO: 26372 - DNA, 1653 bp, Glycine max
  Peptide Sequence Number=SeqID_143150
gtttctcggtcactcgctgcatgtgagggtgctcttctagtagtagacgcttctcagggcgttgaagcacaaacactagctaatgtttatttggctttggagaacaacctagaaattatccctgttttgaacaaaatagatctcccaggtgcagaaccagatcgagttatcaaggagattgaagagattgtaggtctagattgtagcaatgcgattctctgctctgcaaaggaaggaataggtataattgaaattctcaatgcaattgttgcaagaattcccccacctgaagatacatctaaaagaccattgagggctttaatatttgacagctactacgatccatatagaggtgttattgtatactttcgagttgtagatgggactataaagaaaggtgacagagtttattttatggctagtgggaaggattattttgctgatgaaattggagttttatctcccagtcaactacaagttgaagaattgtatgctggtgaggtgggctatctatctgcatcaataagaacagtagctgatgctagagtgggtgacactattactcactatggcagaaaggctgacaattctctccctggatatgaggaagccactcctatggtgttctgtgggttgtttcctgttgatgctgaccaattccctgatctgcgtgatgcacttgaaaagctacaactcaatgatgctgcacttaagtttgaacctgagacatcaagtgccatgggatttggctttagatgtgggtttctgggccttcttcatatggaaattgttcaggttgaatgctcaaatccatctttacttcctgagcctggaaaaaggaaatcaattgaggagccatttgttaagattgagatgcttacaccaaaggactacattggtccacttatggaactggcacaagaaagaagagggcagttcaaagaaatgaaatttattgctgaaaatagggcatcaatcacgtatgaattaccattagcagagatggttggtgatttctttgaccagttgaagtcaagaagtaagggttatgctagtatggagtatacctttgtcgggtacattgaaagtaatttaattaaacttgacatacggataaatggtgactgtgtggagccattggctacaattgtgcacaatgataagaaaatcaacagaggcttgtattttcaggcatattcggtgggaagggctttgactctaaagttgaaggagctaataccacgacaaatgtttaaagtaccaattcaagcgtgcataggatcaaaagtgattgctagtgaagcgatatctgcaataaggaaggatgtactagccaaatgctacggtggggatatttcaagaaaaaagaaattgcttaagaaacaggctgaaggaaagaaaaggatgaagtctattggtaaagttgatgtgccccaagaagctttcatggcagttttgaaacttgaaaaggagttgcgtacaagattttggatcattgataggattcctttaccattaaaaattgaaaatctagttaatgccttaatggtcaagacttcgacttctgtattggcagaattcgagatcttcaattggaggtctgtctgtttcaacatcatcaaattatatgccagttggtcaattcagttttag

SEQ ID NO: 26373 - DNA, 201 bp, Glycine max
  Peptide Sequence Number=SeqID_143151
atggtcatcaaaagtgcctctagaggtttgattatcacagggattgtttacaagcgagctgagaaggtgggggagcgtgaagagattcagagggcgagccctggtgcagcggtaaagttgtgccttggtgacttgttagtcatgggttcgaattcggaaacagcctctactagttttatgtgtgttgcgtgtcagttgtag

SEQ ID NO: 26374 - DNA, 879 bp, Glycine max
  Peptide Sequence Number=SeqID_143152
atggagaagcttgtagacattgtccattttttgcatttggagataagcaatgcctttggcaatgcagatgaccacaaaccattcattggacacatgagcaatcgccaaagattgggccctgcaggccttgctttgcattatgcaaatatagtgcttcaaattgatactcttgtggctagatcctctatacctgcaaatacaaaggatgcattatatcaaagcttgcctcctaatataaaattagctctgcgctccaaattaccatcccttcgtgttgtagaagagctaactatagcagatatcacagatgagatggagaaaacattacattggttgtcccccatggccactaacacatccaaagcacatcatggctttggttgggtaggggagtgggcaaacacaggctctgaggtaaggaagaccggtgtaatgcagattgagacattccaccatgcagacaaagacaaagtggaatattatattcttgaacttctcttatggcttcatcgcttggctatcagaagtaaggctgtcagtgatgctggcaaagtaaggcctgccatcaagtctcctgttggcactgctttgcaaaatacaaatgagcaaatatcattgttaacaattgacgagcaaaacatgctgctggatttaaataagaaaataccaattagacggatcagtaaaagcttggattttgacagtttgaatatcagattcagggagaactgcagattggccaagagtagaagtcattcatcaagtagaagcaaggagatatcttttaataggattttctctaagcttccagtcattgattttgatattgacaaagaaagagcattgaacgtgattgacagactggatgtggtcagataa

SEQ ID NO: 26375 - DNA, 1347 bp, Glycine max
  Peptide Sequence Number=SeqID_143153
atggttgaaactcattctatttcttctcccatggtctctaattgcaagttatctcgacatggtgctgatctctttcatgatccaactttatacaggtgtgtgattggtgccttacactatgcttcccttactagacctgaaatcgattttgctgtcaataaaggcactttgtttcatggcctactccttcagcctacttctattacaaagcccttggttcttcatgtgttctgtgatgctgattgggcatccgatgtggatgataagcgctccacctcaaaggttgctatatttcttggtccaaacagtgttatgtctattgctcacaatcctatgtttcacaatcatacaaaccacatgaaaattgatgtcttcttcataagagaaaagattctggccaaacagcttttcattgtgcatattctagctcaggatcagtgggttgatgcactgacaaaacctctttctgtagcaagatttgaagttctcaaagacaagctcaatatggcaggggattcaaattcaaagaggcgtgtcagcagaagcactgaatccaaaaacacacaggacataaacataaacataattgaagggaataataacccaaaagcgcaggtgcaagaacgtgctgcagtttttgaccaacatttctacgatggaatcccattctttgctgataataagccttctagaaccaacgagaaggcttctaccactgcgggtgaagagttctacgacggaatcccgcgcttccccgaggactccttgccgaacaagcctaagtcaaaggtctcagaggtgagtttacgcttgggcaaagctgttactactggaattgctattggattagagaaagcagtagaggttttggacactcttgggagcagcctgacaaatttaaatgtgagcagtgggttttcttctggagctgcaataaaggggaataaaatttctatcttagcatttgaggttgcaaacacaattgtcaaaggttttaatcttctgcaatctctttctgcaaaaagcattaggcatttaaaagaagaggtgcttctttctgtggctgtgcaaaatttagtatcaaaggatatggatgaacttcttaggattgttgcagcagacaagaggcaagagttggaagttttttctaatgaggtgattcgttttggaaatcgttcgaaggatcctcagtggcgcaacttagactgttactttgagaaacaaacccacatgctcaaagatggaaatcctagtaggattagcagagaaataaatgttcaaaggctgtcaagagacgagccagaattaataatgctacagttgatgactttggctgattttacagtt

SEQ ID NO: 26376 - DNA, 714 bp, Glycine max
  Peptide Sequence Number=SeqID_143154
atgaaaatatctgctgagctcttttcgattcaggtctccgaggtgagttttcgcttgggcaaagctggtactactggaattgctattggattagagaaagcagtagaggttttggacacccttgggagcagcatgacaaatttaaatgcaagcagtgggtttgtttctggagctgcaataaaggggaatgaaatttctatcttagcatttgaggttgcaaacacaattgtcaaaggttttaatcttctgcaatctctttccgcaaaaagcattaggcatttaaaagaagaggtgcttctttcacatgccgtgcaagatttagtatcaaaggatatggatgaacttcttagaattgttgcagcagacaagaggcaggagttgaatgttttttctgatgaggtgattcgttttggaaatcgttcaaagaatcctcagtggcacaacctagaccgttactttgagaaggttagcaaagaattaaatggtcaaagattgtcaagagacgaggcagaatcaataatgcaacaattgatgactttagttcagtttacagctgaattgtaccatgaattacatgctttggatagatttgaacaagatattcagcgcaagggtgaggaggaggaggatcaaagagcggtaaagttgtgccttggtgacctgttggtcatgggttcgaatccggaaacagcctctttgcatatgcaagggtaa

SEQ ID NO: 26377 - DNA, 420 bp, Glycine max
  Peptide Sequence Number=SeqID_143155
atggcttctgctccttcgaatttcatttctcagtcattcctaaactctatcgctgagaaacttgatgatttaaactacctccactggcgccaacatgcttcatacgaagtcccgtgttcgacagcttcgcaccgcaattattcgggtaaaatcaaaggacatgttgatgaactcgccgacgtcgaagttcttgttcatcacgaggagtatgtcgatgcacttctcgaaggactctcatctgattatgcatcgacaatctttgtaattaagagtaagaagcacactccatccatcactaagatcgaaactctactctatggccatgaaactcgtcttactcgctacagtaaagatgaactggtgattagttctccgtccttgaactacactcaaaggctacttgcaccaaaatacttataa

SEQ ID NO: 26378 - DNA, 666 bp, Glycine max
  Peptide Sequence Number=SeqID_143156
atggctagtgctgtgttggcgcatttcatgttgaacgagaagctgcagaaaatgggcatgctggggtgtcttctgtgcattgtggggtccactgtgattgtgctccatgcacctcaagagaagcctcttagttctgtagaagaaatttggcagttagcacttcaaccgggtatgctgttgcttgaggtcatgagcataaaagccattggcattgctataagacttacaattgagggtgccgatcagtttgttcagtttcagacatggatttttacgatggttgctatttcctgcatcattacgcagttaaattatcttaatatggcattggatacttttaacacagcagttgtttctccgatctactatgccttgttcacatcttttacaatattagctagtgcaatcatgtttaaggactattctggtcaaagtataagcagtattgcatcagagttatgtggtttcattactgttttatctggtacaactgtattacacagtacaagagagccagatcctccagtcaatacagatttgtatagtcccttgtctccaaaagtatcgtggtatatccaaggcaatggcgaaccttggaaacagaaagaagaagatgggccaccctttaatttaattacagttatccggcaagaccatttcaagtga

SEQ ID NO: 26379 - DNA, 264 bp, Glycine max
  Peptide Sequence Number=SeqID_143157
atgaaaagaacaacttacctcatcatgatggtcatcaccggcatcagcaaacctccaacaaagcccaaattgcttctctactttcgtggcggccatgagattcttccactgcgggaagccgacatcagcgatcatggctgtaagggagcactttggaaagaggatttagtgaaagaggaggtgagatttggtgttgatttgaagggcacggagttttaccctctggtaaacgattaccagaaggcagtaatcgattaccagtag

SEQ ID NO: 26380 - DNA, 957 bp, Glycine max
  Peptide Sequence Number=SeqID_143158
atggccaactcaagctcttctctcttgccacttgctaataacaacaccttcaacctaagccttcaacttccacccattaccataaaattagacagagacaactattcactgtggagatccacaataatttctgctcttgagacctttgaacttgagtctttcatcctttctcctgcacctccgaacgagacacgcatcactacaacctccgatggtgtttcaatactggaacccaacccagattttcttctgtggaaaaagaaagatcgccttgtttgtagaagcaaagcttcaagtcacgaatcaagattcaaggttcaagatctcaagaatcaagatcaagattcaagactcaagattcatgaatcaagagaagggtacatctacttaggtttgactgagaacaagagagggtacatctcttgtggatcagttctagtggagggtacatccactaggttcaaagagaacaagggaggggctctctccatcgtggtctgtgcatcatcttctcacatggcatggactgccattgataaaacctttcaagcccaaatcagagctcgttgtatggctctaaaagcacaactccaaacccttaataaagaccttgttgactctaagctactgcacgtttcatatgtctccttggtggaccaaatggccgatatcttcaccaagcctttatcaaaggaaaggatgaatctcttacgttttaagcttcaagcaatgtccaataaattccgtgccctactcaataacaaaacgtggtctcttgtcccacgtcctccccatgtgaaccttgtgggttgcaagtggattttccgtattaaacagagatcagatggttctcttgagcatcataaggcacacttggttgctcagggttatagtcaggaacatggtattgactattttgacacattcaaccctgttattaagccaactacaatctag

SEQ ID NO: 26381 - DNA, 330 bp, Glycine max
  Peptide Sequence Number=SeqID_143159
atggcttatacttccactgagcttctatggataaatcaactgctgcaagaacttcatgcaacactgccccatcctccacgaatgttatgtgacaatgttggagccatcttcatgacaaataacccagtcattcatacaaggtcaaagcatattgccttggactttcattttattcgagaccttgttgactctaagctactgcacatttcatatgtctcctcggtggaccaaatggccaatatcttcaccaagcctttatcaaaggaaaggatgaagcgcttacgttccaagcttcaagttcgtcctgaccttttgcttgcggggggctaa

SEQ ID NO: 26382 - DNA, 189 bp, Glycine max
  Peptide Sequence Number=SeqID_143160
atgtcatgctgtgataacattgctgaaagttcggttgttttaccttttcagtacaacgtctttcagattgcatttgttgcattggctggattgacttttgtatattatgctgccttgggttttaaatttggaaatatcagggatggagaagaaagaagcctagtggtgggtgcttgtggtgccacttag

SEQ ID NO: 26383 - DNA, 846 bp, Glycine max
  Peptide Sequence Number=SeqID_143161
atggtaggaccagcgaggcctcaatttgtgctgtttggttcgtccatagttgagttcagttatagtgatcaaggttggggagctattcttgccaacttgtatgctcgaaaggctattcactcactttcatttctagcttcagttgtgaacgatgattgcaagagggcagatataattttgcgaggatatgctggttggaattcaaggcgtgccctgcagaatctggataaaatatttcccaaggatgccaccgatcaaacatcactggtaattgtgtactttggtggtaatgattctatgcacccacatccatctggccttagccctcatgtacccctccaagaatacattgaaaatatgaggaagatcgttatccatcttaagagcctttcaaagaagactcgcataatatttctcagttcccctcccatcaatgaggtgcaaatgcatgaaactctcagtgatctattggggccactaaaaaggacaaatgaagcttgtcgaatatactcagaagcgtgtttggagctgtgccgtgagatgaatgtgaaggccattgatctctggtctgcactccagcaaaggcatgactggttagatgtttgcttcacgaaaagtgtaaatgcactattgattcatttgatgggggtggtgattgatagggatggaattcatttgtcaaatgagggaagcaagatagtggcaaaagagatattgaaggtcctcggggaagcagactgggaacctagtctgcactggaattcaatgccaattgagtttgcagaagattcactatatgaaccaatcagtgcggatgaaaacactcctatagatgtctctaactag

SEQ ID NO: 26384 - DNA, 120 bp, Glycine max
  Peptide Sequence Number=SeqID_143162
atggagagtttagagacaactgaaatagcttcgcaatttctgcacaagaatgaagaaacttcaccagctttctcgttggtggcacaggtagcccaagatgcatattttagacacttttaa

SEQ ID NO: 26385 - DNA, 1569 bp, Glycine max
  Peptide Sequence Number=SeqID_143163
atgattgaaaagggagaccacaccaaaggtgccaggttctccgatagagatgcaaagctgatgatacttcgtactaataagagtgttgggaagcggattaagagcgcgttgttgtggatggtgaccactgccattgtgtgcgctcttgttttggggattttgtatgctgtactttctttgttgttttgctttgtgtttgtgtgtgaggtgggggcaaggtgtgtctgtgagcagtgggatgaaaatttggaactagagagagtggaattggctgtgttgaaattgaaattcagaaccattcctggcctttgtcttagaggttgtgtgagaggacttattgggaaggtggactttactgttaggcatctctcttcttccacaagccaatttcctagcacatgggacttcaatagtggtcaacaatgtattggaaacacccatcagtgttctgcattcactgccagtccttcatcagaaaaaacatggaccatgcgtactacctttcctgaatatgtcgttgctcttgccactattgttggatctgtgctttttgctatatttggtggtgttggtattgcttgtcttccattgggacttatattttcattcattcggcgtccaaaggctgttatcactcgttcacagtatatcaaggaagcaaccgaactgggtaaaaaagcaaaagaactgaagaaagcagctgagtcacttcatcaggaagaaagaagtggttcgaagggaaggaaatttcgtaaaaatgtgaaatcagtagagaaggagttgtttcaattggaagaagatgtcaagcttcttgaggagatgtatccacaaggggaaaaggctgagacaacatgggcactaacagttctagggtatctggcaaaatttgttttgggcattttaggtgaatacagctgcataactattgctcagtgttatcaaatagcagccatggcggcagaatggcgttgcgggaatttgaaaaaacgccaccaaatagcggtgacgttgcgggttgcggatggcagcgccatggcggccgccatagctatggcgataggtgttgggctgacccgacccaaccgtaacctgactttcgcatgcaaaaggggtgagcagcgcaagcaggaacggcaccacgcgaatgcgacgcggcacgccggcatgccggcaccccgcaccaacacgacggcaacgacggcgaactcggcaccccacaccagcaccacgcacacgacaaacggacggcgacggcgctacagtctgcgacggacggcaattgtggtgttgtgtctcccgtctcatgtattatctaacctaagttttgaaaactgtgccaggtttatcgtttctgtggcatgggttgctcatatcattatctatctattaattgatcctcctctttctcctttcttgaatgaagttttcatcaagctggatgatatctggggtcttctgggtacagctgcatttgcatttttctgcttctaccttctccttgctgtgattgccggagccatgatgcttgggctgagactagttttcattactatacatcccatgaagtaa

SEQ ID NO: 26386 - DNA, 198 bp, Glycine max
  Peptide Sequence Number=SeqID_143164
atgggaattggggaggaagaggaagaaggagaaaggttttggttggttggctccgttgttgggaatgtggaattactgtcttgcccttgtgagaggagagtttgtatgtttgttgttgggtgtgagctgtgtgggaagagaagcagtttccaaagttcttcagaccataccaggctgtactgtactagtgggatgtga

SEQ ID NO: 26387 - DNA, 534 bp, Glycine max
  Peptide Sequence Number=SeqID_143165
atggcttcaagacccggaattctctctgattggccatggaagcctcttggaagctttaaggagtatatgttactagctccttgcatcgttcatagctcgtattctatgatggtgaaagataacagtgagaaggacatgtttaactttctcatattaccctttttgctatggcgtatgcttcataaccaaatatggatcactttctctcgttaccgaactgccaaaggcaacgcaagaattgttgacaagggaattgaatttgatcaagttgacagagaaagaaattgggatgaccaaatattgtttagtggcttaatattctacttggcaaactatgtatttgctggggcatcacacattccattgtggaaaacagatggagcagttatggcaatactgcttcatatgggaccagtggagtttctttattattggttacacagagcactgcatcatcactttctctattcacgataccattctcaccaccattcttccattgtcacagaacccattacttgtgagtcacattaa

SEQ ID NO: 26388 - DNA, 219 bp, Glycine max
  Peptide Sequence Number=SeqID_143166
atggggacaaatgatgtgaaagtggatatgaagctgaacaaggttgtgtggagccacgggatccgaagcgtctcgaggagaattagggttcgcattgcccataagaggaacaatgatgaggatgcaaaggaagagctttattcccttgttattgtcatcaaaatcgccaaggatgagctcaaaggtttgggaaccaaggttattgatgatgaagattga

SEQ ID NO: 26389 - DNA, 3705 bp, Glycine max
  Peptide Sequence Number=SeqID_143167
atgacaacttttcaaaaggttcatgctcttctttttcatatactcttgctatctctgcttccattgaaaatcacttcatcaccaacaacagaggcagaagcccttatcaaatggaaaaacagtttatctcctcctcttcctccttctctaaactcatcatggtccctcacaaaccttggcaacctttgcaactgggatgccattgtttgtgacaacactaacacaacagtctcacagataaacttgtctgatgccaatctaactgggactctcactgccttggatttttcttccctccctaaccttactcaactcaacctcaatgccaaccattttggagggtcaataccatcagcaattgacaaactatccaagctcactttattggactttggtaacaacttatttgaaggcacactgccttatgaactgggccagctaagggagcttcaatatcttagcttttacaacaacaatctcaatggcaccattccttatcagctcatgaatcttcctaaggtatggtacatggaccttggatcaaactactttatacctcctcctgactggtcccaatattcatgcatgccttccttaactcgccttgctttgcatctcaatccaacactcactagtgaattcccaagtttcatactggggtgccataacttgacataccttgacatctctcagaatcaatggaaaggcacaataccagaatccatgtataacaatttggtcaagctggaatacctcaacctctccagttctgggctagaaggaaaactgtcttccaacttgtccaagctttctaatctcaaagatcttcgtataggtaataacatctttaatggttctgttcccactgagataggattgatatcggggcttcaaattcttgaattgaataacatttctgcccatggtaatattccttcttccttaggcctactcagggagctttggcatcttgacctaagtaagaatttttttaactcatcaatcccttctgagcttggccaatgcacaaatctatccttcctgagtttagcagagaataatttgacggatcctttgcctatgtcattagttaatctggctaaaatatcagaattgggattatcagataatttcctttctggtcaactttctgcttcactcatctctaattggatccggttgatctccttgcaactccaaaacaataaatttacaggaaggattcctacacaaataggcctgttgaaaaaaattaacatcctctttatgcgcaataatcttttctctggtcccattcctgtagagattggaaacctgaaagaaatgacaaagttagacctttcactaaatggattctctggtccaattccatcaacactttggaatctgacaaacattcgagtcgtgaatctttatttcaacgagctctctggcaccattcctatggatattggaaacttgacctcattggaaacctttgatgtcgacaacaataaattgtatggggagttgccagaaaccgttgctcaactacctgctttaagtcatttttctgtgttcaccaataacttcactggcagcattcccagagaatttggaaagaataatccttctttgactcatgtgtatctttcacacaacagcttctctggagaactacctcctgacttgtgcagtgatggcaagctagttattttggcagtcaataacaacagcttttcagggccagtgccaaagtccttgaggaattgttcatcactgactagacttcagcttcatgataaccagttaactggagacatcacagattcatttggggtactcccaaatcttgattttatttcacttagtagaaattggcttgttggggagctctccccggagtggggcgaatgtatcagtttaactcggatggatatgggaagcaacaatctttctggaaaaattccatctgagctaggtaagttgagtcaattagggtatctgagcctgcattccaatgatttcaccggcaatatcccacctgaaattggaaatctaggcctgcttttcatgttcaacttgagcagtaaccatttatcaggagaaatccccaagagctatggcagattggctcagctaaattttcttgatttatcaaataacaagttcagtggaagcattcctagagagctcagtgattgcaatcgcttactgagtctgaatttaagccaaaacaatctatctggggagataccatttgaacttggcaatctgttctcactccaaatcatggtggacctcagccgcaactctctttctggagctattcccccaagccttggaaagttagcatcgttggaggttctcaatgtctcacacaaccatcttacaggaacaatcccacaatcactgtcaagcatgatcagccttcaatccattgatttttcttacaacaacttgagtggttcaatccccataggtcgtgttttccagaccgcaactgccgaagcctatgttgggaactcgggtttgtgtggtgaggtaaaaggattaacttgcgccaatgtattttccccacacaaatcccgaggggttaacaaaaaagtactttttggtgttatcataccagtttgtgtcttatttattgggatgattggtgttggaatcctactttgccggcggcattccaaaaaaataattgaagaagagtccaaaagaattgaaaaaagtgatcagcctattagcatggtgtggggaagagatggaaaattctcattttctgatcttgtcaaggccaccgatgactttgatgacaagtactgcattggaaatggaggatttggaagtgtttatagagcacaattactcacaggccaagttgttgctgttaaaaggctcaacatatcagactctgatgacattccagcagtgaaccgccatagctttcagaatgagatagaatcacttacaggagtgaggcaccgcaatataataaagctttatgggttctgttcttgtaggggacaaatgttcttggtttatgaacatgtagacagaggaagtttggcaaaagtattgtatgcagaggaaggaaaatcggagctaagttgggccagaaggctgaaaattgtgcagggaatagctcatgcaatttcatacctgcacagtgactgctccccaccaattgtgcaccgggacgtaacactgaataacatactactagactccgacttagaacctcgtgttgcagattttggcactgcaaagctgctaagctcaaacacttcaacatggacctcagccgctggatcctttggctacatggctccagaactagcacaaacaatgagggtgactgacaagtgtgacgtgtatagttttggagtggtggtgttggagataatgatgggaaagcatcctggagaactcctgactacaatgtcttcaaacaagtatttgccatcaatggaggaaccacaggtgctactgaaggatgtgcttgatcaacggcttccacctccaaggggcagattagcagaagcagtagtgttgatagtgaccatagctttggcatgcacacgtttgtctccagagtccagacccgtgatgcgttctgtggctcaagaactgtcgttggctactacgcaggcttgtcttgcagagccatttggcatgataaccttgagcaagcttgcagggttccacaaatactgtgtcatgtag

SEQ ID NO: 26390 - DNA, 123 bp, Glycine max
  Peptide Sequence Number=SeqID_143168
atgccaagggtaagttatgttcaccctacatgtaacgttgttctctcccctataacttcatcaatcatcagcttggaagagaatgcggagacagtgcacagtgcacagataaaaactacatga

SEQ ID NO: 26391 - DNA, 133 bp, Glycine max
  Peptide Sequence Number=SeqID_143169
atggcggtggtagaagaaaagggccttgcaagtggaagagaggattacacccaagatggcacagtggacctcaaaggtagacccgttttaagatcaaatactggaagatggagagcttgttccttcatagtag

SEQ ID NO: 26392 - DNA, 2173 bp, Glycine max
  Peptide Sequence Number=SeqID_143170
atgacaacttttcaaaaggttcatgctcttctatttcatatattcttcttcatatcgttgcttccattgaaaataacttcatcaccaacaacagaagcagaagcccttgtcaaatggaaaaacagtttatcccttcttcctccctctctaaactcatcatggtctctcacaaaccttggcaacctttgcaattgggatgccattgcttgtgacaacactaacaatacagtcttggagataaacttgtctgatgccaatatcaccgggactctcactcccttggattttgcttccctccctaacctcaccaaactcaaccttaatcacaacaattttgaagggtcaataccatcagcaattggcaacctctccaagctcagtttattggacttgggaaacaacttatttgaagaaacactgcctaatgagctaggccagctaagggaacttcaatatcttagtttttacaacaacaatctcaatggaaccattccttatcagctcatgaatcttcctaaggtatggtacatggaccttggctcaaactactttataactcctccagactggtcccaatattcaggcatgccttccttaactcgccttggtttgcatctcaatgtcttcactggtgaattcccaagtttcatacttgagtgccagaacttgtcataccttgacatctcacagaatcactggactggcacaataccagaatccatgtatagcaatttgcccaagcttgaatacctcaacctcaccaacacagggctaataggaaaactgtcacccaacttgtctatgctttctaatctcaaagaacttcgtatgggtaataacatgtttaatggttctgttcccactgagataggattgatatctgggcttcaaattcttgaattgaataacatttttgcccatggtaaaattccttcttccttaggccaactcagggagctatggcgtcttgatctcagtataaattttttgaactctacaattccttctgagcttggcctatgtgcaaatctatccttcttgagtttagcagtgaatagtttgtctggtcctttacctttgtcgttagctaatctggctaaaatatcagaattgggattatcagataattccttttctggtcaattttctgcttcgctcatctctaattggactcaattgatttccttgcaagtccaaaacaatagttttacaggaaggattcctccacaaattggcctgttgaaaaaaattaacttcctctatctctacaataatcagttctctggtcccattcctgtagagattggaaatctgaaggaaatgatagagttagacctttcacaaaaccaattctcaggtccaattccattaacactttggaatctgacaaacattcaagtgctgaatcttttcttcaatgatctctctggaaccattcccatggatattggaaacctaacctcactgcaaatctttgatgtcaacaccaataacttgcatggggagttgccagaaaccattgctcaactaactgctctaaaaaaattttctgtgttcaccaataacttcactggaagccttccaagagaatttggaaagagtaatccttctttgactcatatctacctttcaaacaacagtttctctggagaactgcctcctggcttgtgcagtgatggcaagctaactattttggcagtcaacaacaacagcttttcagggccactgccaaagtccttgagaaattgttcgtcactaattagaattcggcttgatgataaccagttcactggaaacatcacagattcatttggagtactctcaaatcttgtttttatctcacttagtggaaatcagcttgtcggggagctctccccggagtggggtgaatgtgtcaatttaactgagatggagatgggaagcaacaaactttctggaaaaattccatctgagctaggaaagttgattcaattagggcatctaagcctacattcaaatgaattcactggcaatatcccacctgaaattggaaatctaagccaacttttcaagttgaacttgagcaataaccatttatcaggagaaatcccaaagagttatgggagattggctaagctaaattttcttgatttatcaaataacaacttcattggaagcattcctagagagctca

SEQ ID NO: 26393 - DNA, 468 bp, Glycine max
  Peptide Sequence Number=SeqID_143171
atgttcagctctaaaccaagtttcagcttagctgccaataagctacaaggaaatattcctccagggcttggaaaattgcaaagtttgccaaatcttgacctgtccgaaagcaatctcaaaaatatcccagtggagctttttagctcatcttcaaaactacacaagctaaatttgagcaacaatgatctctcagcaaacaatctgactggtccaattccaaaagaactaggaaattgccggaaacttatattcttgaaactaagtatgaacaacttagatggacatatgtcacacgagcttcggaatttggtgaacttgcagcgactgttagatctcagtcataactcactaaccgggcagataatcacacagctggaaaatttgatatcactggaggtcttgaatctttctcataatcagctttctgggacaatacctcctagtctcaaaggactaatcggcctttag

SEQ ID NO: 26394 - DNA, 1125 bp, Glycine max
  Peptide Sequence Number=SeqID_143172
atgggttgttttcttcattgctttggttcctccaagagcacaaaacctaggcgcaaggcacaccatcaccatcgactcgctagagacaggttagagcaatgctctattcaggattactccgaaacggtggtaattggcactgcatcacaagaagtccaggctaaacctttggagcagataaacgtgagccccaaaaagaaagtaacttttgatgtcaatgtgaaaacgtacgagcctgatgaagttgctgatttccaacttgagaaaagtgaagagggtggagaggaaagtgctttggttgaaaagttaagccgaacaaagtcttactctgaagaaagttcggtgacttcagcggggtcttacactacaaaccataggtaccacaattgtacgtgtagtgatgatgaagatggagcaatggagtattgggatagtgatgttactgatgaggatgaggatgaggatgatgatggtggtgatagtgacatgggagaagagtatgatgaagtggaagaggactttgaagatggaatagtgtactcaaggtcaagaaatggtgataatcaagtggttgttggagaggtggaaagtccaattctaatgcatgataaggatttgaagtcaattgggttgaacccaaatgttcgagataggagtgtgtatgttctttctgtgatgaaccctgtggagaacctcactcaatggaaagcagttaaggctaaaagggcacccccattggcgtctcagaaggagaatttggttttgaatcaagagtctagatctgcatttgctgcagaaactcctaagaagttgaaccgagaaatcgcggttgatgctagcctttcaaattggctgggttcatcagaaactacacctgttagcaaaggtttgtacgtgggtaccctggagaggagcagctcacaaggctcaaattcagtggtgagccatgaaaataggcctattttaggtgcattgacagttgaagagctcaaacatttttccgcttcttcttcgccaagaaaatcaccaaaggatgagatgcccattataggcagtgttgggggctatgccgaggattctggctcagcaaatcgagtaagatcaagaagggtacatttgaagtga

SEQ ID NO: 26395 - DNA, 1296 bp, Glycine max
  Peptide Sequence Number=SeqID_143173
atgatcagtcttcaatctattgatttttctcacaacaacttgagcggtttgatccccacaggtggtattttccagacagcaacagctgaagcctatgtagggaacacaggtttgtgtggtgaggtaaaaggattaacttgtcccaaagtgttttccccagacaattctggaggggttaacaaaaaagttcttcttggtgttatcataccagtttgtgtcttatttattgggatgattggtgttggaatcctactttgccagcggctgaggcacgccaataaacaccttgatgaagaatccaaaagaattgaaaaaagtgatgagtctactagcatggtgtggggaagagatggaaaattcacattttctgatcttgttaaggccaccgatgatttcaatgaaaagtactgcattggaaagggaggatttggaagtgtttatagagcaaagttactcacaggtcaagttgttgctgttaaaaggctcaacatattagactctgacgacattcccgctgtgaaccgccagagctttcagaatgagataagatctcttacaggagtgaggcaccgcaatataatcaagctttttgggttctgtacttggaggggacaaatgttcttggtttatgaacatgtagacagaggaagtttggcaaaagtattgtatggagaggaagggaaattgaagctaagttgggctacaaggctgaaaattgtgcagggagtagcacatgcaatttcatacctgcacactgattgctccccacccattgtgcaccgggatgttacattgaataacatactactagactcggacttagaacctcgtcttgcagattttggcactgcaaaactgctaagctccaacacttcaacatggacctcagttgctggttcttatggctacatggctccagaactagcacaaacaatgagagtcactgacaagtgtgacgtgtatagttttggagtggtggtgttggagatattgatgggaaagcatcctggagaactcttgactatgctgtcttcaaacaagtatttgtcatcaatggaggaacctcagatgctactgaaggatgtgcttgaccaacggcttcgactaccaacggaccaattagcagaagcagtagtgttcacaatgaccatagctttggcatgcacacgtgcggctccagagtccagacccatgatgcgtgctgtggcacaagaactatcggctactacacaggcttgtcttgcagagccatttggcatgataacaatgagcaagcttgcagggttccagaaatag

SEQ ID NO: 26396 - DNA, 300 bp, Glycine max
  Peptide Sequence Number=SeqID_143174
atggtgcatcgtgctcgctcaaacaccatgtgttggcagctcgtgccccactttgtcattgttcctgtcctcggtcctacacctcgtgcaccagtttactgtccagttcgtgtgtgtccccgatgtcgtgtccagccatcgtcagccagagtgaagccattatataccaatgatattaagaggctctatgctatcattcaagataagaccattgctaatgctgctagcattgggaataagatcgtgacgcttaccctcacacatagatgttgtcacaagattggctacacttgcatatga

SEQ ID NO: 26397 - DNA, 147 bp, Glycine max
  Peptide Sequence Number=SeqID_143175
atgattggtattgagatcactgaagctctgaggctgcagatggaggttcagaagcggttgcatgaacagcttgaggcaaaacccccaaaggggctgcaactaaggcgggctaaggagtttccacaattaaggtggcttttccaataa

SEQ ID NO: 26398 - DNA, 126 bp, Glycine max
  Peptide Sequence Number=SeqID_143176
atggctccggattcagtgggaaagattgagaatattttgagacttggagattccaatgagtccttggggaacagccatgtgttgagccttctagctgccctaggcgttatgcgtaatatcacttga

SEQ ID NO: 26399 - DNA, 117 bp, Glycine max
  Peptide Sequence Number=SeqID_143177
atgagtctagggcctctgggcatcatagactttagtttgatttcagaaagtattggtggcacttggcattacaggatccatgagatcgtcaagttcatgatggccattctctggtaa

SEQ ID NO: 26400 - DNA, 162 bp, Glycine max
  Peptide Sequence Number=SeqID_143178
atggttaaagcacgtcaaaagtgggggaaaagagggaggtggttgccacctagctcgcccaatcgagctgggttgcttccaccagaaggcagtgccttctgttggaacaccctggaaggtccaaatgggcctcgttgctatttgcacacccctttttactaa

SEQ ID NO: 26401 - DNA, 357 bp, Glycine max
  Peptide Sequence Number=SeqID_143179
atgacgttagtctctgcatgctatcaagcgttctgtcttacagatagcaaaaaggtttatacggataaccactcgggtatctccgcccgtcagcgtgactcaaaagtcagtatgacagatcttgtgagcgcggaagatgacgcttttcgtcttacagattgcaaaaaggtttatacggataaccactcgggtatctccgcccgtcagcgtgactcaaaagtcagtatgacagatcttgtgagcgcggaagatgacatagcaaaaaagaatgtttatacggataaccactcgtgtatttccgcccgtcagcgtgactcaaaagtcagtatgacagatcttttgagcacggaagatgac

SEQ ID NO: 26402 - DNA, 491 bp, Glycine max
  Peptide Sequence Number=SeqID_143180
atggtcaacgtcgattctgctaccggcaaggtcgacggtccccacaagaagaaattaagaacatatttggtgattgtcgctcgtgataaggtcgacgtgacatatgacactggaaggaagtccctactggcagaatttgaaatccctgaagcttctgacaccgacaaggacggtgtggacgacattgtctgtgaaaaatatggcattagcaaggagaaatgggcccagttttgtcagacccacagagatccctcatgggaggatgtgcggaaaaaggcacaagtcatccagaagcaaaacactgccccccacgtattgtctcgtgggggttataagtatttagaacaaaagctcatggctgagaagacaaagaaaagactggaagaagctgcccagtctggaagcactgagagcatcattgaccctccatctcccatcagacgccacgtgaagtggaagatggcccgcacgaagaaaactggacagatgac

SEQ ID NO: 26403 - DNA, 384 bp, Glycine max
  Peptide Sequence Number=SeqID_143181
atggcagagccatcaaagaagagaaagggatcatcctctaccgctaccgctgctgcccatcgccgtcacggcccatccggagcacccacagcacctattcctccttttttgtcatctccaagatcatcaacactgttttcatccgatgatcaacgtctacgtttaaaaattcaggatggtattattatgtctgaggtgcatggtacttctatggtcattgatcagtcacttttcttttctttgactcatttacccagtcaaggtgcaccttttgagggcaccattgttgatgactggaaatttgattattcgagtcatgatgctcgtcgcatggtctgcaatgatcaagctgaaatgaccgtagattgttggccgggtcattaa

SEQ ID NO: 26404 - DNA, 723 bp, Glycine max
  misc_feature (690)..(690): n is a, c, g, or t
  Peptide Sequence Number=SeqID_143182
cccatcctcggcgtcgtctcggtgttcgcgatcatcgccgcgtggaaggactacctctggccgatgctggtgctgccggaccctgccgtgcagccgctgtcggtgcgcctgcccgccgtgcagtcgcagaccgagctggacgtgttcctgacggcgttggcgatcgccacgctcatcccgatcgcgatgttcctggtgttccagtcggtgttcctgcgctcggccggcctcggaggttcggtgaagggcgcctcgatgagggcatccatgatcccgggcatgtcgacggtcgggtcgatcatccactgcagttggagaccgtcggacgctgcctggatcacacgggccagggtgtcggcgtcgagcgtggagtgtcggttcccggtgccgaacccgtctgcgatcgattcgcgcaggcgcgcgctgcggtcgaggaaggcgacgagtcctgggacctcggtgttgtggcggatcacgtcgatgaacgcgctcttcgcctcggtgtcgtcgaggctgcgagggtcgagtccgtcgtgctcgtcgcgcttgcgcagcacctcggtgaagagctcctccttggatccgaagtagtgcagcagggcggcgggggtcactccgacgacctcggcgatctccttcagcgaggcgttctggtagcccttgcgtccgatcacgtcgagggcgctctcncaggatctcctcgcgtcgcgcaacacccttcgc

SEQ ID NO: 26405 - DNA, 408 bp, Glycine max
  Peptide Sequence Number=SeqID_143183
atgacgttttgtagatcgccgcaccagagctccaccgccgttggagtcataaatccaaactcaatcacgtttctcgccaatcttagatctatgaaaaaaaaaactagctctagaattgcgcaagcaccagcaaacccaaaacccgacgaaggctccggggccaaaagcaacatgttacagttctacaccgatgatgccttcgacctcaagatctcgcctccaaattggtctagcataatccatgggcttcaccaccacgagctcgccgatgagggtgttggagaaaaagttgtcattgtatttgacgacagttataaggaatatgacgacaaggaagcttgggataagatgttggaggtttttgagagatgggattcgtccttagtgtatgttgatgtcggagaatga

SEQ ID NO: 26406 - DNA, 933 bp, Glycine max
  Peptide Sequence Number=SeqID_143184
atggcgcccaatccaagagtggtagcggcctttatggcaatgtcgaatctcgggattcatgaatcaaaagttaaaccagtgttgaagaaactgcttaaattgtatgataagaactgggcactcattgaagaagagagttatagggctctggctgatgctatatttgaggaggaagaaaataaggtgaacgagccagaccagaatattaaaaacaagcctatgactgctgaaatgtgttctggcttttcaaacattcaggacggagtagtggacgatgtagaagctcatacgcatgaggaacctgtgcggcctttgaagaggttgcgtttgagaggccaagagggtcaatctttgcgccctctgactagcagtggccccagctcagctgcatttccattgaaaatgcctaaattagaagacgggacagtgcctgagagtagttccagactgcagcctcaaagcctggctgcattatctgatggaaatgcaaggattggtgctcatcatgttcccccacaagatgctgttgtcgacaagggaaagaaacctatatcacctcaagttactcccagaaggagaaggtccctttctgaaccacttaaagagtcaacagttgaaggccgagctgctctgttggcaaataacaaaatgcctcatccatttattttgatcaaacccaaggatgagcctgttgatgatataccagattatgagattccccttgcagtgattcctcctgactctccaatgggtgcagttgaaaagcaagatgtccatgacactgttgtatcacaatgcagagatgaagacgttgaacatgaagatgtttttccttcctcaaatgaagaagcaacttctaatgtatatgtagctttgtcatctatgggagaggtaaaaatttctctgagctgcagctcagttcttgggaagtga

SEQ ID NO: 26407 - DNA, 1323 bp, Glycine max
  Peptide Sequence Number=SeqID_143185
atgggtatactaaaagtaaaacaccacattcccacgctcctctttctcagtatttcatttcctctgtttcttcttacacctacctcctcagacaacacaaacttgatctacaaaggttgcgccgaccagaaactccaagcccaatactcccagaacctcaaaccgctgttggactccctagtctcggcgtcggcacagaagggtttcgccgcgactacccaaaacgcgctcaccggcgcgtaccaatgcaggggagacctctccaactccgactgctacacctgcgtgagcaagattccggggatggtgaagcgcctctgcggcggagatgacgtggcggcggcgcgggtccagctgagcgggtgctacctgcggtacgaggtggtcgggttcaaggtggtctccgcgacgcagctgctgtacaaggtgtgcggggcccgcaaggtggtcgacggcggggggttcgaggcgaggagggacgcggcgtttgggatggcggagaacggcgtgcagagcagcggaaatttgttctacacggggagctaccagagtctctatgtgttgggacagtgcgagggtagtttgggaaatgaggattgtggaggttgtatcaagagtggtgcggaacaggctagggatcagtgtggtgactctatctcagcgcaggtttatctccagagttgttttcttagttatagcttttaccccaatggtgttcccaccgcctcatcgtcttcctcagggggaggaggggggcatccacacactgagaggacagtggcacttgcggtgggaggggtggcggctcttggattcttgattgtttgtttgttatttctcaagtcggtgttgaagagaagaggtgatgatgttggcgatggtgattctgaatgtgggtgggatgcgtgtgatctcatgatgctcaaaactagattggcactcagatttggactggagtggtgcagtggtggagttgtttggggtgagaaaatggtttatgagctgagaggggaaggggaggggtgtgggaaagggtactcgagtaatttccaacgttttggtagtgcgaatatcaactctcatccaagagtcacttgtcgcggcccatttcagcagcctcggcatgatagccacggacggttcagatcgcatcattatcgatcacggacggcacctgatctaacagcagcatcatgcgccatggagccgccaactcccacttctccgctatataaaaacggcacctcatcctcatgtttttattaccctacttcgctagttccaattccaattctcgatttaccaccaaaaacagccacctga

SEQ ID NO: 26408 - DNA, 1557 bp, Glycine max
  Peptide Sequence Number=SeqID_143186
atgggagatagcgaaccggtggtcactgaagcatctgctgctgaggcatatgcttcggctggttatgctgagactgggtcaaatcctactcccgaggcaggtgctgctgttgatcaatccgctggagaagctgctcaggccagctcaacttacggatatggttattctaatgttggtgacacgaatgcgtatgctggagatccgaattccgtcctacagcaagctcatttcagtgcaactggtgattccaagccagctggtgcagcggctgatgctaacgaggcctctgctggggttggaaccacagccgccgagtctactatggtttccgactacaactcgtccgtaaatggcggtgttgttggtgcagtggcaaatgccgtgggacttgaaaacgggaatgcgttggagaatgctgatgggtcggctgatgagaaacagcttgcagatggttatgctgccttgtctgctgaagaagaccgactgtggaatattgtaagagctaattctttagatttcactgcctggacttccttgattgaagagacagagaagacagaggacaatattttgaagattcgaagagtctatgatgcttttctagcagaattccccttgtgctatggttattggaagaaatatgctgaccatgaggcacgtcttggctctatcgataaagttgttgaagtgtatgagcgtgctgttcaaggggttacatattcagtggacatgtggttgcattattgcatatttgctataagcacatatggggatccaaacactgttcgtaggctttttgaacgaggattagcttatgttggaacagattatctttcttttcccctctgggataaatacattgaatatgagtacatgcagcaggactgggcctgccttgctgtgatctacaccagaatattagagaatccaaatcaacaattagatcggtatttcagcagcttcaaagagttagctggaaatcgtcctttatcagagttacgaactgctgatgaagctgctgcagtggcaggagttgcttcagaggctactggccaagctactgagggagaagttcatcctgatggtgcagagcgttctcctaaatctgtaagtgctggcttaacagaagcagaagagttggagaagtatatcgccattagagaagagatgtataagaaagctaaagagttcgattctaagatcattggttttgaaacagctatcaggaggccctactttcatgtacggcccctcaatgttggagagcttgagaattggcataactatttggactttatagaaagggaaggggacttgagcaaggtgtcttcttatctttctaatcttctgtcgcaggctaggagggtccctcctttcatatttgagggtcctctctgtcccgctaaggaattgtcaagttgtatgagagatgtgtcattgcatgcgccaattatccggagtattggatacgctatgttttgtgtatggaagccagcggaagcatggatcttgcaaataatgttcttgctcgagcaacccaagtctttgttaaggtag

SEQ ID NO: 26409 - DNA, 156 bp, Glycine max
  Peptide Sequence Number=SeqID_143187
atgcggaaattgattaaggaaaggatggaaaataaggtggctaatttcgtgggtcttaataaggtggttcttggcataaaatggatgaatgggatggaaggaaagaatcactctttccagcgagggcaacacacaaaggttgtgaaagtcctttga

SEQ ID NO: 26410 - DNA, 954 bp, Glycine max
  Peptide Sequence Number=SeqID_143188
atgggggcagtaataatttatattggcaatcagagacaaccagagatacatcttttttgtgctcggttcaaggagcagactggagatatagatggtgctagagctgcgtatcaacttgtgcatactgaaacttctcctggtcttcttgaagcaattatcaaacatgccaatatggaataccgactgggaaaaatggaagatgccttctctttgtatgaacatgccattgctattgagaaaggaaaagaacattcacaaacattgccgatgttgtttgctcaatattctcgatttgtatatttggcttctgggaatgcagagaaggcaaggcagattctagttgaggggcttgagaatgttttgttgtcaaagccactacttgaggctttattgcattttgaggctattcaacctttgccaaagcgtgttggtgtcgactttttggagtcatgggttgtcaaattcataatgcctaactcagagagtgctggtgtagctagtccaacagagcgtgaggaactttctagtatttttctggaggacttaggagtgtgggtatctgcatgcatttgtgcctgtatgtgtggagctaatctagatcataatgatcaagataggttttatttaaacttaatattgaccatccattttttaaatctctttggtgatgttcaatctatcaagagagctgaagataggcatgccaaattgtttttgcctcacagaagcatgtcagagttgaaaaaacgtcatgctgaggatttcttagtttcggacaaaacaaaagtgccaagatcgtattctgctcagtcacctgcgcaatctgcgatgggtgcatatccaaatgcgcagaaccagtggactaattatggagttcaacctcaaacttggcctccagttactcaagctcaagggcaacaatggactgctggctacacccagcaggtagagtag

SEQ ID NO: 26411 - DNA, 465 bp, Glycine max
  Peptide Sequence Number=SeqID_143189
atggttaaggaaaatcctggggatccattgtttctgaggaattatgctaattttttgtatcagtacaaacaagactgtgaaggagcagaggagtattattcccgcgccatacttgcagacccggatgacggagaagttctatcacagtatgggaagttagtttgggagctacatcatgaccaagaacgtgcctccagctattttgaaagagcagtccaagcctctcctgaagacagccatgtacaagcagcatatgctagtttcctttgggacacggaggaagacgaggatggtagcaacgaaccacaatgtttgccgccacattctcttcaaggagctatagctactgcagcaactttacacggtgctattaagatggaatcagaacatgttccaaaagccagcttgaacgctcgagaaaaggttctagaagacctaaatatgaacggaaatttgacaggctaa

SEQ ID NO: 26412 - DNA, 576 bp, Glycine max
  Peptide Sequence Number=SeqID_143190
atgagtctcaagtctaaagagtcttgttcaccacgccactcttcttcttgttgtagatattccctcacttcacaacttgagacaagagcagagaagccgcttcaatgtctaaagatgacaactcttcttctcaggattcttcatctgaccttgaattttctctctccctatgcccccgctaattcctccttcacttctcttcccattaccgctcccagtcaagttgttggatggcctccccttggagcatatagaatgaacagctataatagccatgcaaaatcaccagccacagaagtattcaattctacacttgacaaaagagcaagcaatagtgctggggttaggaagagtgcagatggtggcagtgatagtagcaacattatttccaaagaaaaaggaaacctcaggacttccctgtttgtgaaagtaaaaatggacgggataccaatcggaaggaaggttgatttgggtgctcacgattcttatgaaaccttagctcaaaccttggaggatatgtttgatgaatcaactacagtcctcactcacaaaggtgatttttttctgtcttcatga

SEQ ID NO: 26413 - DNA, 3069 bp, Glycine max
  Peptide Sequence Number=SeqID_143191
atgaagaacaagatgcaaatgaaaatccagattttcattttctggtacattggttgtttctcttatggttttgccgctgctgtcacaaatgaagtatcagctttgctttctataaaagcaggtctcgttgatccgttgaacgcccttcaggattggaaactgcatggcaaagaaccaggacaggatgcatctcattgtaactggaccggcatcaaatgcaactcagctggagctgtagagaagctcgatctctcccacaagaatctcagtggcagagtatccaatgatatacaaagacttgagagtcttacttctctcaacttgtgttgcaatgccttttcaacaccattgccaaaatccatagccaatctcaccacactcaacagccttgatgtaagccaaaatctcttcattggtgactttccattaggccttggaagggcattgagacttgtggccttaaatgcatccagcaatgagttctctggttctcttcctgaggaccttgcaaatgcctcttgcttggagatgcttgatctcagaggcagcttctttgtagggtcagttccaaaatcattcagtaacttgcataagttgaagttccttggtctatctggcaataatctcactggtaaaattcctggcgagctgggacaactttcatcactggagcatatgatccttggatataatgaatttgaaggtggcattcctgatgaatttggaaacctcaccaatcttaagtatcttgatttagcagtagccaatcttggtggtgagattccaggcggattgggagagctcaagttgttgaatacagttttcttatacaacaacaactttgacggcagaattccaccagcaattggcaacatgacctctttgcagttgctggatctttctgataacatgttgtcaggaaaaattccatctgaaataagtcagctgaagaatttgaaacttctcaacttcatgggcaacaagctgtctggtcctgtgccttctggctttggagatttgcaacaactggaggtacttgagttatggaacaattccttgtcagggccattgcctagtaaccttggcaagaattcaccattgcaatggttggatgtatcatccaattcactctctggagagattccagaaactctttgcagccagggcaatctcaccaagcttatactattcaacaatgcattcactggtccaattccatcaagcctatcaatgtgtccttcactagttcgtgttcgaattcagaacaattttctttctgggacggttcctgtgggtcttgggaagcttgggaagcttcaaaggttagagttggctaacaatagtctttctggtggaattccagatgacatttcctcttccacatccctttcctttattgatctctcaagaaacaaacttcattcttcgcttccttccactgtcctttccattccagacttgcaagctttcatggtctccaacaacaacttggaaggtgaaatcccagaccaatttcaggactgtccatcacttgcagttcttgatctctcatcaaatcatctatctggaagcattccagcaagcattgcttcatgtcagaagttggtaaatttgaacctccaaaacaaccaattgactagtgaaatcccaaaagcattagctaaaatgcctacattggccatgcttgatctttccaacaattctctgacaggtcaaatacctgaaagctttggagtttctccagctctggaagcactcaatgtctcatacaataagctagaaggtccagtcccagcaaacggaatactaagaactataaacccaaatgatcttctcggtaatgctggcctatgtggtggtatcctccctccatgtgaccaaaactctgcatactcttcaagacacggaagcttgcgtgcaaagcacattattacagcatggatcactggaatatcttcaatcctagtcatcggaattgcaattttggtagcaagatctttgtacataaggtggtacaccgacgggttttgcttccaagaaagattttataagggtagcaaagggtggccctggagattgatggcttttcagaggcttggttttacaagtactgacattctagcttgcgtcaaggaaaccaatgtgattggcatgggagccaccggggttgtttacaaggccgaggtaccgcaatcaaatacagttgtggcagtgaaaaaattgtggagaacaggaactgatattgaagtaggaagcagtgatgaccttgttggagaggtgaatgttttagggaggctaaggcataggaacattgtcagattattaggatttcttcacaatgacatcgatgtcatgatagtttatgaattcatgcacaatggcaacctgggagaagccttgcatggtagacaagcaacaagactacttgtagactgggtttcacggtacaacatagctctaggagttgcacaaggacttgcttatctccatcatgattgtcatccacccgttatccatcgagacatcaagacaaataacatattgcttgatgcaaatcttgaggcaaggatagcagattttggtttagccaagatgatgatccggaagaatgaaacagtctccatggttgctggatcctatggctacattgcccctgaatatggatatgccttgaaggtggatgaaaagattgatgtttacagttatggagtagttttgttggagcttctcacaggaaagaggccattagattcagactttggagagtcaatagacatagtagagtggattagaatgaagattagagacaacaaatctctagaagaagcattagaccccagcgtaggaaacaacaggcatgttctagaagaaatgcttttagttctaagaatagcaattctttgcactgccaagctcccaaaggacagaccaaccatgagggatgtcgtaatgatgcttggagaggcaaagcctcggcgaaagagcagtggcaatagcaacgatgtagctaacaacaaagagacaccagtttttagcacgtcaccagttaatgataataaccttgtgtag

SEQ ID NO: 26414 - DNA, 2475 bp, Glycine max
  Peptide Sequence Number=SeqID_143192
gatcctcgtgatgaagagctctcatatttcacgagcttcgtatcaagaacgcttaccttgttcagttttgaattcttctcaacaccttcaaatacccctccaaatcatccatcacccaacatcaccaaccaacaacaacaagacatcctcgtactacaacaacaaccaatggaatccaaatccaaaattcaactctttttcctcacccttttcctcttcactctcaccctccatgcagaaactcttggaacttacatagttcagctacaccctcatggcataaccagcacttccttcacctccaggctcaaatggcacctttcattcatccaacaaaccatttcctctgacgaggacccttctttgcgccttctgtactcgtaccgttcggccatggacggtttcgcagctcagctaactgagtctgagcttgagtacttaaaaaacttgcctgatgttatctcaattaggcctgacagaaagctccagcttcagaccacttactcttacaagttcttggggctcaaccctgctagagaaaacggttggtaccaatccggtttcggccgcagaaccataattggggtgcttgatactggagtgtggccagagagtcctagcttcaatgatcaaggaatgcccccaattcccaagagatggaagggtgtatgccaagctgggaaggcctttaactcttccaattgtaaccgaaaactcatcggtgcaaggtacttcaccaaaggccatttttcagtgtcacctttcagaattccagaatatctctctccaagagactcctctggacacggcacacacactgcgtccaccgctgcaggagtgcctgtgccgctggcgagtgtgttcggttatgcgtctggcgtggcgagaggaatggctcctggtgctcacattgcagtgtacaaagtgtgttggttcaatggctgctataactcagacatcatggctgcaatggatgtggcaatcagagatggggtggacattctgtccttgtctctaggtggctactctttgcctctatatgatgatagcattgccattggaagctatagagcaatggagcatgggatttcagttatatgtgcggcaggaaacaatggccccatggaaatgtctgttgccaatgaggctccttggatttccacaattggtgcaagcacactagacaggaaattcccagctacagttcacatgggaaatggacaaatgctctatggagaatccatgtacccactgaatcatcacccaatgagcagtggaaaagaagttgagctggtttatgtgtctgaaggagacaccgagagtcaattttgcctcagagggtctcttccaaaggacaaagttagaggcaaaatggtggtatgcgatcgaggagtaaacggaagagcagaaaagggccaagtggtgaaggaggcgggtggtgttgctatgatccttgcgaacacggagataaacttgggagaggattcggttgatgtccatgtcttgcctgcaactttggtaggatttgatgaagcagtcaccttgaaggcctacataaactctacaaaaaggcctcttgctcggattgaattcggaggaactgtgatagggaagtctagagctccagcagtggcaagattttctgctagaggcccaagttatacaaacccttcaatcctcaaacctgatgttatagctccaggagtgaacatcattgcagcatggcctcagaaccttggtcccaccggccttccggaggatgctagaagagttaacttctctgtcatgtctggtacctcaatggcatgccctcatgtcagtggaattgctgctctcattcgctcagctcacccaagatggacccctgcagccgtcaaatctgcaatcatgacaacagctgaggtaaccgaccacaccggaaggccaatactcgatgaagaccaaccagcaggagttttcgacatgggagctggacatgtgaatccacagagagcattgaaccctggactggtgtatgacattaggccagatgactatatcacccacctttgcagccttggatacacaaagtcagaaatattcagcatcacacatagaaatgtgagttgcaatggaatcataaagatgaatagaggcttcagccttaactatccctcattctcagtaattttcaaggatgaggtgaggagaaagatgttcagcaggagactaacaaatgtgggaagtgctaactccatctactcagtggaggttaaggcacctgcaggagtaaaagtgatagtgaaacccaagagactagtatttaagcaagtgaatcaaagcttgagttacagggtgtggtttatatcaagaaaaaaggttaaaagaggtgatggtttggtgaaccattcagaagggagtttgacatgggtgcactcacaaaatggttcctacagggttagaagcccggtagcagtgacttggaagtcaaagtag

SEQ ID NO: 26415 - DNA, 1985 bp, Glycine max
  Peptide Sequence Number=SeqID_143193
atggaaggtgtgaatgctttcatagtgtggtggctggagcttaagatagttcaaaagttgaatcaggaagtgatgccacccttgcatgtcactgctgcattcggggcatgcatagagacacgagatggaaacaaacaaaataaaagggagaggaagaggtggctcgttctcacactcttcagtgatgactctgtcatggactcaaatttcaagcatgactcgttcgaatacatcaacttggacggcaaaaacgtgggtgcaacaatgcgcttgcagcatagaagctcaaagggtgagtcaaaagattgttgttgcatcaacatttatgtaaacaacaacgttcagggtgtctcaaattcagtgttgcatggtagtgagactttgctttctcgcttccctctccgtattcttctggttcctcctcctctacttccacttcgccgtcctccgccaccacccaccaaccctaaccccgtagtccccatcactctccaacctcaacaacctcgtaaaaacctcggcttccccgagaaaatttcccaaccggagaaacccactttccccttcgaccgtgccctccgaaccgccgacaacaagagcgacccatgcggggggcgctacatctacgtccacgacctcccctcgcgcttcaacgaggacatgttaaagcattgcagaagcttatctctttggaccaacatgtgcaagttcaccaccaatgccggcctcggtccgccgttggagaacgttaacggtgtgttctccgacaccggctggtatgccaccaaccagttcaccgtcgacgtcatcttcagcaacaggatgaagcagtaccaatgcctcactcgagatccttccgtcgccgccgcattcttcgtccccttctacgccggctttgacatcgcccgctatctatggggttacaacatctcaatgcgcgatgctgcatcgcttgacctcgtgaattggctcatgaatagaccggagtggaagatcatgaatgggagagaccattttcttgtcgccggtaggatcacatgggattttcgaagactcactgaagaagaatcggattgggggaacaagcttttgtttttgcccgctgcgaagaacatgtcgatgcttgtggtggagtcaagtccttggaatgccaatgatttcgggattccgtatccgacttattttcatcctgccaaggatgatgatgtgttcacctggcaggagaggatgaggaggctggagaggaagtggttgttttcgtttgccggagctccgcggccggataacccgaaatcgataaggggccagattattgagcagtgtaggagatccaaagttgggaagctgttggagtgtgattttggggagagtaagtgtcattcccctagtagtataatgcagatgtttcaagggtcgcttttctgtcttcagcctcaaggggattcgtataccagaagatctgcttttgattcaatgctggctgggtgtataccagtgttcttccatccgggttcggcgtacacccagtatacatggcatcttcctaagaattataccaagtactcggtgttcattccggaggatgatcttaggaagaggaatgttagtatagaagagaggcttagtcagattcctgaggaggaagttaggatcatgagggaggaggtcattggtttgatccctagattggtgtacgcagatcctcgatccaaacttgagactcttgaggatgcatttgatgtttcggtgcaggctgtgattgacaaggttaccaacttgaggaaggacattatggaaggtcgcacggacgagaacttcattgaggagaacagttggaagtacgcgttgttggatgagggacagcgcgaggttggacctcatgaatgggatcctttcttctccaaaccaaagccgggtggggattccgatgatttgtcagctgaggctgcgaagaattcttggaaaaatgaacaaagaaatcagtc

SEQ ID NO: 26416 - DNA, 3648 bp, Glycine max
  Peptide Sequence Number=SeqID_143194
atggccgtcgatgaaattgaaatattgtcttcgacgttgttttcttcttcttcttcgggatcgtttgagatcctttggagtgcgatcctcggattgcctttgttggaactggtggcaatctgtgccaacctgacactgtttattctctttctcgtcgttgtttcggcgaggaaggtgcttgtgtgtgtatggggaggagttagattcggtaaggagaacggaaccggcaatgccagccccggttgtgttagtgttgatttggaaacacgtgacattcggattgaaacgtggttcaagttgtcggtgttgtcttgtttctatgttctgttggtgcaagttttggtcttggggtttgatggggttgctttgattagaggaagggatttggatttggatttgggtttggctcttctttctgtgcctcttgtgcagggtttagcttgggttgtgttgagcttctcggctttgcaatgcaaattcaaggcgtgtgagaggtttccagttttgcttagagtttggttatttgtggtgttcgttatttgtttgtgtggtttgtatgttgatggaaggggggtttggatggaaggttccaagcacctgcgttctcatgttgtggcgaatttcgccgtcactcctgctcttgcctttttgtgtattgtggcaattaggggtgttactggtataaaggtttttaggagttctgaggagcaacagccattgcttgttgatgaggatcccgggtgtctcaaggttactccttatagtgatgctggactttttagcttggccattttgtcttggttgaatccacttctttccattggggcaaaaaggccgcttgagcttaaggacattccccttgttgcgccgaaagaccgatccaagacaaattataaggttttgaattctaattgggagaggttgaaggctgaaaacctatccgggcagccttcgttggcttgggcacttctcaaatccttctggaaggaggcggcttgtaacgctgtgtttgctggtgtcactactcttgtctcgtatgttggtccatatatgataagttactttgttgattacttggttggcaaagagattttcccacatgaggggtatgtccttgcaggggtattctttgtggcaaagcttgtggagacctttactactaggcagtggtatcttggggtggatatcttgggtatgcatgttaggtcggctctaactgcaatggtatatcgaaaggggctaaggatatcaagcttggccaagcaaagtcacacgagcggggaggttgttaactacatggctattgatgttcagagggtaggggactactcttggtatcttcatgacatgtggatgcttcctctgcagattgttcttgcccttgcgattttgtataagaatgttggaattgcttctattgcaacactgattgctacaataatttccatcgcggtcactgttcctattgccaggatccaagaaaattatcaagacaaattaatggctgctaaggatgaaaggatgagaaaaacatctgagtgcctgaggaatatgaggattctcaaacttcaagcttgggaggatagatatagagtgaaattggaggaaatgcgaggagtagagttcaagtggcttcggaaagctctctattctcaggctttcataactttcatattctggagctcccctatatttgtttcagcagtcacttttggtacttccatattgttgggtggtcagctgactgctggtggtgtactttctgctttggctactttcaggatcctgcaagaacctttgaggaattttccggacttggtgtcaacaatggctcagacaaaggtttctcttgaccgattatctggtttcctgctggaggaggaattgcaggaagatgcaactattgtcttgccacaaggcattactaacattgctatagaaattaagggtggtgtcttctgttgggacccttcttcatcttctagacctaccctatcagggataagtatgaaagttgaaagaaggatgcgtgtggctgtttgtggtatggttggttcagggaaatcaagttttcttttgtgcatccttggagagattcctaaaatttctggtgaagttagagtgtgtggctcttctgcatatgtctcccaatcagcatggatacaatcaggaactatagaagaaaatatcctctttggaagcccaatggacaaagcaaagtacaagaatgttcttcatgcttgttcactgaaaaaggacctagaacttttctcacatggtgatcttacaattattggggatagaggtataaacctgagtggtggccagaagcagcgggttcagctggctcgggcactctaccaagatgctgatatttatcttcttgatgatcccttcagtgcagttgatgctcacactggatcagacttgtttagggagtatatattgacagcacttgcagataaaacagtcatttatgtgacccatcaagttgaatttcttcctgctgctgatttgatattggttctcaaagaaggatgcatcatacagtcaggaaagtatgacgatcttttacaagcaggaacagattttaatactctggtttcagctcacaatgaagccatagaggccatggatatccctactcactctgaagattcagatgaaaatttatccctggaggcatgtgttatgaccagtaagaaatccatttgttctgcaaatgatatagacagtttggcaaaggaagtgcaagagggatcatctatttcagatcaaaaagcaattaaagagaagaagaaagcaaaacgatcgagaaagaaacagcttgttcaggaagaggagaggattagaggtagagtcagcatgaaggtgtatttgtcatacatggcagcagcatataaaggcttattgattccactcataatcattgcacaaacattatttcagttccttcagattgctagcaattggtggatggcttgggctaatcctcaaacagaaggagacctgcccaaagtaactccctcagttcttcttcttgtttatatggcccttgcttttggcagctcatggtttatatttgtaagggctgttctggtggctacgtttggtcttgcagctgcacagaagctatttttgaaaatgcttagaagtgttttccatgcaccaatgtctttctttgactctacaccagctggaaggattttgaatcgggtatcaattgatcaaagtgttgtggatcttgacattccttttagacttggtgggtttgcttcaacaacaatacagcttattggtattgttggtgtaatgacagaagttacgtggcaagttttgctcttagttgtcccaatggctgttgcttgtttgtggatgcagaaatactacatggcttcctcaagggaactggttcgaattgttagcatccagaagtctccaattatacatctttttggtgaatctattgctggagcatccaccatcaggggttttggacaagaaaaaaggttcatgaagcgaaacctctatcttcttgatgctttgcacgaccattcttctgcagtctttctgcaattgagtggctctgcctgcggatggagttactgtcaacctttgtatttgctttctgtatggtattacttgtga

SEQ ID NO: 26417 - DNA, 249 bp, Glycine max
  Peptide Sequence Number=SeqID_143195
gtagcattgcattccatgctcctctccctatggcttgacaagtttgcgaacagtctgtgcaaaaaataccccgatagcatggacgagttgcgggaacaagccaagggctacatccagatggaagaaatgtccacattcaggaacgaggtcaaacaagccagacagaaatgcgacaagcaagaagcaaacaccaagactgacttacacaagttgaacaagagtgatcaaggccgtacccgaatcaattaa

SEQ ID NO: 26418 - DNA, 1362 bp, Glycine max
  Peptide Sequence Number=SeqID_143196
atggagattgtcaggaggggtgtgtggaatgtcttcaaactcttggcatcgtttgcacctcctggtaaagtcgagggcgtctaccctgagtgttggccaatagtaaccagctcgcaccactttggtggcaagggagcatcctctagtatggagatcacaaatccctttatgaaggctttctctagggtgatattgccagggccttcaaggatgattcatgccccgcctccttttatgttggacgcaccgtcaaggctttcacaaaacttgcttgatggggtagttcattttgacaaccactttatgactttagaagcagggcctgagtcgtcgggccaagtgcttctcagcatcatggagtatgcggctgagatatacaagagtaagggtactcctggcctgggtcgactcaaaacttgcggcgtgcctatggttttcttgaaagccatgaaggcttattcgcagaggaacctagacaaggatgctagcctaacattcagtttctcaacttcttggacggtaggcatcaatcccccgatgagtgatcatgaagccgagaaacttgtctccgcctaccttaaaagtacatttttcggggttgaggcacatgtcatatttgcgaaggtatacctctttggggcatgctctgttcagattagtgtagtcggtgaacattcgccatttgccattgacctttttgaccatgacgacattggcaagctcggtggaatacgtgatttctctgatgaagtttgcattgaggagtttgtccacttatatgatatcggtttggcatggggacaaatggcaatgctcatggctggtggggtccttaatgagccgcgtacactgcccagggttaggttcgagttgcatcttaacgagctcttcgatggattttgggcctctgttagaggtgtcatctcacgaatctatatcgaattcatcatccaggcttgcttggtagacgatcaaggctcagattggagacccttcatccatgctcatgacttgagtaccttcagccgttatggggtgaggcttgtcaggctccttggtgggaggataggatgctaccttcaggctctttgcatagcactatcgtgcttgcttttggtttgccttgacggttacaatctccccactcaagctcttggagagctttccttgactaaaggtggtcattacgtccacgatatcagtggaattgccttggtcgatgagaaccttggacaccatgaagtttgcaatgatgatggagataacaacaaggtcgtcctggttgatagggttgatacctttgaagtccttatccatgatgatgcgtcgacaaaattgatgttgatgtcccgaataacgtga

SEQ ID NO: 26419 - DNA, 186 bp, Glycine max
  Peptide Sequence Number=SeqID_143197
gaatcgaaaaaacagaatctgaaggaagaaggcaccgaaaaacaaaataaactcacctgggttgttctcagaataatcgcttcgcttgttatgacttatgacggtgatgattcaagctcttacaaagcagcacgccaatacagagaagagaacgacaagggtggcggtgatgagagacagctataa

SEQ ID NO: 26420 - DNA, 144 bp, Glycine max
  Peptide Sequence Number=SeqID_143198
atggagcaagttagcatgggacaccagaattggggtgaattttacaagctttttgctgcaaaattccttccttggttggtgttttggttcgtgctaaaggtggtgttaaacattggttggatggcctttgtggacaactgggtg

SEQ ID NO: 26421 - DNA, 584 bp, Glycine max
  Peptide Sequence Number=SeqID_143199
atgggggataagcttcatcgtcgagagggaaacagcccggatcaccagctaaggcccctaaatgaccgctcagtgataaaggagggaaggacccgcgcgagcagtgctggacgaagcggaagcgagaatgtcggcttgagtaacgcaaacgttggtgagaatccaatgcctcgaaaacccaagggttcactccgcaaggttcgtcccacggagggtgagtcagggcctaagatcaggccgaagggcgtagtcgatggacaacaggacgcaaggtgcccctgctttttcagggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcgg

SEQ ID NO: 26422 - DNA, 401 bp, Glycine max
  Peptide Sequence Number=SeqID_143200
ggtacatcctttgtggtacaagtagagggtacatctacttgggtttgactgagaacaagagagggtacatctcttatggatcagttctagtggagggtacatccactaggttcaaagagaacaagggagggccactcgatccaacaccaacgacaaaccatcccaccaccccctcatcctgtcaacaactccttcaaaccccgccactactgggacaagcctcctctgacgaagctgtgatgttcaagctcaagacctttgtcaagaagatgttgagggaattggggaactatccttcggggagcatagtggacgagtttggtgctacaattcttgcacgaatttgtgtgtttcatagtcttgatttggtatttctagaagagggtgaaaaaaacatttga

SEQ ID NO: 26423 - DNA, 246 bp, Glycine max
  Peptide Sequence Number=SeqID_143201
atgggctcgaaatctaccctaaggctcatgagaacccgagggccttccctgggatctctggcacaatctacctggagtcttctatccaatgcccttgtgggcaaggaaagtccggtcattgctgttttggccgatgcttatgacaccttcgaccggagatgcgagaagagcagtgcgaggattgtttgttgcacacctgctctttatgtatggttggtctctcacatttttcgtcatgaaagttaa

SEQ ID NO: 26424 - DNA, 111 bp, Glycine max
  Peptide Sequence Number=SeqID_143202
atggagaaaggtacaagtcttcctatggagaaaggtacaagtctttctatggagaaaggtttcaagatcctgttgtttcctatcattgatagtctaggaaaccccttatga

SEQ ID NO: 26425 - DNA, 177 bp, Glycine max
  Peptide Sequence Number=SeqID_143203
gaagtttgtgatgacattgctgagaggttggagcgccatttgagtctaggggtggtcacgcctgactcatcgacatatgaggtgatcgaaaaatgcctcagattggccaggagtgtgacacaggaccatctagtatacgttaggtgtagacgcaggtggcgcactgatcagacttag

SEQ ID NO: 26426 - DNA, 339 bp, Glycine max
  Peptide Sequence Number=SeqID_143204
atggcagcccatttgagagcctcttcatcatcctcttggtggagagagtttgagaagatcttcgcgtcactgcccctccaaatcgatgaactaccaatcctgaaactactgccaccttccatgccaccatacaaggaaggaataagaacacgcattttgagtggagtcaaatatggctggcgggttgtgaagtgccaacgtagctgcacacgttttgcagatttccttagtactgggggatatgtcgaaaatggtagccgaatcacgaccatgatatctgctccacatgctgaagatacgatactattttattacttccaacgagccaatattgaatga

SEQ ID NO: 26427 - DNA, 798 bp, Glycine max
  Peptide Sequence Number=SeqID_143205
atgcatggatttttttcttactcattgaatggcaacagggttggagttgatattcctacaattgaagttcgatttgagcacttaaatgttgaagcggatgttcatctaggaggcagagctttgcccaccctcaccaactatatggttaatatagtagagggattgttgaagtctatccttagaagtggaagacaaaatatgaatattctccatgatgtcagtggaataataaagccttcctggatgacattgctttttgggtctccaagttctggaaagaccacactcctcttggccttggctggaaaacttgatccaaacctaaaggttattatatatatactaactgaggtgtgtagaagagagaaggaagcaaatattgtccctgatctaggtattgatatctatatgaagtctgtagcaactgaaggccagaatgcaaatctgttaacagattatattttaaggattctaggactggagatctgtgcagatatagttatgagaaatgcaatgataagaggtatctctggtggacaaaggaaacgtgttacaacaggagaaatgctagttggtccttctagagtattattcatggatgaaatatctactggtttggatagctcaacaacatttcaaattgtcaaatcaattaagcaatatgtccaccttctcaaagggactgctgtgatctcgctcttgcagccaccaccagagacttacaatctttgtgacgatgtaattttattctctgatccacatattgtgtaccaaggtccctgtgaacacgtgtgttga

SEQ ID NO: 26428 - DNA, 4290 bp, Glycine max
  Peptide Sequence Number=SeqID_143206
atggaggacgggggtagtgtcaaagcaggtagtactactaatactatgagtagtttcaggattgggagtagatcagtttggagcaacagtggtgtggaaatctttgccaactctttccaccaggaagatgatgaagaggctcttaaatgggctgccattcagaaacttcctactttcgcacgtttgaggacgggattgatgacttcacctgaaggggttgccaatgaggtcaatgttcatcaacttgggttgcaagaaaggagaggtttgcttgagaggctggtcagagttgccgaagaggacaatgagaagttcatgctcaagctcagggaccgcattgatagagttggaatcaccattcctacaatagaggtccgatttgagaacatgaacattggagcagaagttcatgtaggtagtagagctttgcccactttcactaactacatggttaataaagtggaggggctattgaacttccttcatgtactcccaagtagaaaacaacgtataaacattctccagaatgttagtggaatcataaggcctgccagaatgacattgcttttgggtcctccaagttctgggaagaccacactcctgttggctctggctggaagacttgattcaaaattaaagttcactggaaaggtgacttataatggtcatgggatgaatgagtttgtaccccaacgaactgctgcttatgtcagtcaaaatgatcttcatattggagaaatgacagttagagaaaccttggccttctccgcacgggtccaaggagttggagctcgttatgatttgctagcagaggtgtccagaagagagaaagaagcaaatattaaacctgacccagatatagatgtctatatgaaggctgtagcaactgaaggccagaaagcaaattttatcacagattatattctaaggattttgggattggaggtttgtgctgatactattgtgggaaatgcaatgttaagaggtatatctggtggacaaagaaaacgtgttacaacaggggagatgctggttggaccagctaaagctgtattcatggatgaaatatccactggtttggatagttcaacaacttttcaagttgtgaattcactcaagcactttatccactctctcaaaggaactgctgtcgtctcactcctacaaccagcaccagagacctacaatctttttgatgacattattctactctctgatggccaaattgtgtatcagggtccccgcgaacatgttcttgaattctttgcttctgtgggtttcaaatgtcccgagaggaaaggtgttgcagactttctgcaagaagtgacgtcaaggaaagatcaggaacaatattgggtacacagagatcagccttacagatttgtcacaaccgaagagtttgtagaggcatttcaatcatttcatgttgggagaagccttgctgatgaacttgctactcaatttgacaagtctaaaagccaccctgcagctttggcaaccaaaatgtatggattaggaaaatgggaactgttgaaggcttgcttgtcaagagaatatttactcatgaagcgtaattcatttgtccacatcttccaactttgccaacttgctatagtggcctttatagccatgaccgttttcttccggactgagatgcacccagattctgtgaccagtggtggtatatatgcgggtgcattgttctatggccttcttgtaattttgttggatggatttgctgaccttaccatgacagtttcgaagcttcctgttttttacaagcaaagggactttctcttcttcccttcatgggtatatgctcttcctgcatggatcctaaaaatccccatgacttttgcgcaagtgggaatctgggtgttcctcacctactatgttattggttttgatccatatgttggaagattcttcaggcaattccttcttctgttatttgttaaccagatggcttctgccttattccggtttattggagcacttggtagggaactgacggttgctttcacaattgggtcatttgtattggccatccttattgccatgagtggtttcatcctgtcaaaaggcaatatgaaaaaatggtggttatggggcttttggtcatcacctatgatgtatggactgaatgccatgataaacaatgaattccaagggaagagatggagacatgttctacccaactcaactacaccgctaggagttcaagttctaaaatctcgtgggttcttcacccagtcaaagtggtattggataggtgttggggcactgattggatatacgatagtgttcaatattgcttacatccttgctctcacttatttgaacccaattgtgcagcatcaagctgttaaatcagagaaatctcaaagcaatgagcaggatggtggaagcacttctgctaggtcttcatccagaaggaaagaagctgacagaagaagaggaatggctcttccctttgaaccacattccatcaccttcgatgatgtaacatattctgttgacatgccacaggaaatgaagaatcagggagttctcgaggataggttgaaccttttgaagggtgtcagtggcacttttaggcctggtgttctcacagctctaatgggttccactggtgctggcaaaacaactctgatggatgtactagctggaagaaagactgggggatatattggtgggaacatcacaatttctggctatccaaagaagcaagaaacctttgcaagaatttctggatactgtgaacagaatgatatccactctccttatgttacagtatatgaatccttgctctattcagcatggcttcgattatcagcagaaatcaattctgagaccaggaagatgttcattgaggaagtcattgaacttgtggagctgaaccctctaaagcatacaattgttggattgccaggtgttaacggactatctacagagcagcgcaaaaggttgactatttctgttgagctagtggctaatccttctatcatattcatggatgagccaacttctgggctagatgcaagagctgctgctgttgttatgagggctattaggaaaatagtggacactggaagaacagttgtctgcaccatccatcagcctagcattgatatatttgaatcttttgacgagctttttctaatgaaacgaggaggacaagagatatatgtggggccacttggacatcattcttatcatttaatcagttactttgagggaattaaaggtgtccgtacaattgaggatggctacaatccagcaacctggatgttggaagtcacaacttcagcaaaagaaatggaattggggattgatttcgctgagctgtataaaaattcagacttatacaggagaaacaaggaacttattgaagaattgagtactccagccccgggttcaaaggacctttatttttcttcaaagtactctaggtcctttattacccaatgcatggcttgcttatggaaacaacattggtcttactggcgcaataatgaatacaccgccctaagatttctctttacaattgctgttgccttgttgtttgggagcatatattggaaccttggctccaaaatcaaaaagcaacaagatcttttcaatgccatgggatccatgtatgctgctgttcttcttcttggtattaagaattctaattcagcacaaccgttggtggcagttgaaagaacagtgttttatagggaaaaagctgctggaatgtattcagctttggcatatgcttttgctcaggcaatcgaactacctcatgttcttctacaaactgtggtctatagtgctatagtgtacgcaatgattggttttgagtggtctgtcactaaatttttctggtatctcttcttcatgtacttcaccttcctctactttacctattatggcatgatgtctgctgccatgaccccaaacccatccttagcggttataatttcttctggattctatgaagtatggaatctcttctcagggttcataatcccacgaccaaggatgcctgtctggtggagatggtattattgggcaaatccagtagcttggactttgtatgggctggtgacatcacagtttggagatatacaagaccatattgagtttaatggtagaagtacgacagttgaagactttttgagaaattactttggttttaagcatgattttttgggagtagttgcagctgtacttataggatttgcagtaacttttgcattgatctttgccattgccataaagatgttaaatttccaaagacgttaa

SEQ ID NO: 26429 - DNA, 1845 bp, Glycine max
  Peptide Sequence Number=SeqID_143207
atggaggaggaaggtgacatatacgacggtgttcgagctcagttccctctctcattcgggaagcaatcgaagcctcaaacccctcttgaagccatccacaatgcgacacgtcgttccaattccaatcccaaaacagccaacgaccttccttctgtctcctcctcttccagggattggctcaattccctccgccctcccaaaacccctactcctcctcctccgctgccgccgccagatcacgacgacggcccaatggtgggaccgccgccgcctccgcccacagctgccgacgaagaagaagacgacgacgacgccgagatgattggcccgcccccgcctccgccgatcgcgtcggagtccgaagacgattcggatcaagatgaggtaggaacccgcttccggattcccctcagcaacgagattgtactcaagggccacaccaaggttgtgtcagctcttgctgtggaccacacgggatcaagagtgctttctggaagctatgactatatggtacgaatgtatgattttcaaggaatgaatgctcgtttggaatcgtttcgacagctggagccatttgaaggtcatcaagttcgcaatttaagctggagtccaactgcagatcgctttttgtgtgtgactggatcagctcaagcaaagatttatgatcgtgatgggcttactttgggagagtttgtgaaaggagacatgtatattcgtgatctaaagaataccaagggccacatatctggattgacatgtggagagtggcatccaaaaactaaagagaccattttaacatcatcagaggatggctcactgcgcatatgggatgtcaatgacttcaaaagtcagaagcaggtcattaaaccaaagcttgcgagacctggaagagttcctgtcaccacatgtgcatgggatcatgatggtaaatgcattgctggtggtataggagatggttcaattcagatttggaatattaagcctggatgggggagtaggccagatgtacatattgagaaaagtcatgaggatgatattagtggtctgaaattttcaagtgatgggagaatcttattgtcaaggagttttgatggttcattgaaggtttgggatctgcgcaaaacaaaagaaccattaaaagtatttgaggatctgccaaatcactatgcacaaacaaatattgccttcagtcctgatgagcgactctttttgactggaacatctgtggaaagggagagcatgacaggaggtttattgtgcttctttgatagagtaaatcttgagcttgtttcaaaagttggcatatcacccacttgtagtgttgttcagtgttcttggcatcccaaactgaatcagatctttgcaactactggtgataaaagccaaggtgggactcacatactatatgatccaaccgtaagtgaaagaggagctcttgtatgtgttgcacgtgcaccaaggaaaaaatcaattgatgactttgaggcaaaacctgtcattcacaatcctcatgctttaccactatttagagatcagcctagccgtaagcgtcagcgagagaaagtactaaaggatccattgaagtcccataagcctgaactacctatgacaggtcctggctttggtggacgagttggtactagtcaaggaagcttactgacccagtatcttctaaagaaaggtggtatgatcaaggagacatggatggaggaagatccaagggaagctatcctgaaatatgctgatgctgcagcaaaggatccaaagttcattgctccagcatatgcagaaacccaacctgagccagtttttgcaaagtcagattctgaggatgaggagaaatga

SEQ ID NO: 26430 - DNA, 348 bp, Glycine max
  Peptide Sequence Number=SeqID_143208
atgaagattgacgcgggagtttggtggattccattgctgagggaaagagttgggataaaagatgttactgctgcgaaaaatggcaaagaagccgtggatcttcatcgcattaatggtcaaagttttgacctgattctcatggataaggacatgcctatcatgaatggaattcaggcaacaaaggaacttcgctcaacggggatcagtagcaagattattggtgtgtcgtcatcaagccgtgaagagagtaatgtacaagaatttgttgaagcggggctagatgactactacatgaaacccttgaccgaagaaatgcttagagaaattcttgataagatcaagccttga

SEQ ID NO: 26431 - DNA, 249 bp, Glycine max
  Peptide Sequence Number=SeqID_143209
atgcttggactcaacagaattgaacgggtacttccagttggaacttccttgactgttgttggtgaggtaatctcagatgaacattcatggaagaaatccagagatttgcttgagaaggttggtagacaaggagatctaactggttatagagtttcttgtctccttattggcgcaaaggattatttaactccatatccaagggcagtacaagattcagttaaggtattgcatatcaactcagtgtcatga

SEQ ID NO: 26432 - DNA, 291 bp, Glycine max
  Peptide Sequence Number=SeqID_143210
atggtgaattccatggtggaacgtgccacgagcgacatgctcatagggcctgattgggccatgaacatcgagatctgcgacatgctcaatcatgacccttgtccgtctcagagactcataggagccgaacaaatcgtcgctcagagaggaaaattgtgtgtcgtttcgccttcttctgggatctccgtcgtcgatgtggcgacagtgccgccacggattttgccgatttggctgccggaagagttcgagccagtggtcgttcacatcttaaacatctttgctctattttga

SEQ ID NO: 26433 - DNA, 582 bp, Glycine max
  Peptide Sequence Number=SeqID_143211
atggagagtggcggtaatgggaagagagcacatgaagaagcggggccttcatctgggattgatggaaggaaacttgaaatgactgaaaaagcgagtgatgatgataaagaagaggaggaggaggaggaggaggaggaagaaggagccattgaagatagcaaaaatggtttttttgttcctgggcctcttctttctctcaaggaacagatcgaacgggacaaggaggacgaaagcctaaggagatggaaagagaagctgttgggttgcttggaaagtgatatagatggtcaattggatcctgaagtgaaatttcactccataggaattctctctgaggattttggtgaaattgtcactcctctacctgtggatgaaaatcgcaatggctgtactctatttactctcagggaggggtctcgctatcagcttaagctaaaatttagtgttctgcacaacattgtgtctggcttgacatactccaacactgtgtggaaaggagggcttcaaggtttcaatttcaaaaatttgtctaacacctcaaacaggaagagtatccatgcttcaaggttttggtatgcttga

SEQ ID NO: 26434 - DNA, 2016 bp, Glycine max
  Peptide Sequence Number=SeqID_143212
atggggtcgggttctgggaacatggatgaagccgaattgtccttgcgtgagagtggcatcatggacatcatggacaatgaggaagcaagagctttgttaggaaaagatgaatatcaggaaggaaatatagaagctgctttacatgtttatgagaggataaatataagtgctgtgacttccaagatgaaaatttcccttgccaaaagcagagaacaccgtaagaaacattaccattattatgctactcctccgatgtccatatacacggctggattactgttggaagcaattttcctaaaagcaaaatgtttgcaggttctggggaggtttaaagaagctgcccaaacttgtaaagttattctggacatagttgagtcttctttacctgaaggcttgcctcaaaacttcggtgatgagggtaaattgcaggagactttgagtaaggtagttgagctacttccagaattgtggaaacttgctgattctccccgtgatgttattttgtcttaccgtcgtgcactccttcaccgacggaatcttgatgcaaaaaccatagcaaagattcagaaagaatttgttgtttttcttctatatagtggaggggaagcaatcctttcaaatcttcgttcccatatggacagctcgtttgtacccagaaacaacttagaagaggctattcttcttttaatgattttgctgagaaaaatatctctaaataaaattgaatgggatccgtcaattttggaccacctttcgtttgctctatctgtttcaggggatttgacagctttagcccatcaatgggaagaattactccctgggactatcaatcgaagagaaagataccatgccttatctctttgttattatggtgcaggtaatgacttggtagcactgaatcttcttaggaaattgctgagtagtagagaggacccaaaacatgttccttctttgttaatggcttctaagatttgtagcatgaaccctgatcttgcaaaagatggggcaagcttagcttgcaaggtgcttgagaacttggatggaagatgtgatcagttggaaagtctttccagttgcttacttggtgtttcactttcagcacactcaaaaattgctatttctaattctgagagggttgagaaacaatctgaggcacttcattctctggaaactgcaagcaaagtgaccagaatgaggaatccccctgtaatatactacttgagcttagaatgtgcagagcaaaggaagttggatgttgcacttcattatgcaaaatgctttctaaacttggaagctgggtctaatattaaagggtggttattgttagcccggatattatcagctcaaaaacagtttttggatgctgaatctattgtcgatgaagctttgaaccagactggaatatgggatcaaggagagttactgcgaacaaaagctaaactacaaattgcacagggccaattgaagagtgccattgaaacctatactcagcttcttgctattctcctagttcagagaaaaacttttggttcaaagaagaagctgtataaggactacatagatcatgctaggaacatggaagtggaaatatggcatgatcttgcttatgtgtacataagtctgtcacggtggcatgatgcagaggtgtgtctttcgaaatctaaagccatcaaactatactctgcttctagatgtcatgcaataggtacaatgtacgaagcaaagggcctttacaaagaggctataaaagcttttcgcgatgctttgagcattgatcccggacatgttcctagcttgatctctactgctgtggttcttagacggtgcagtaatcaatcaaatcctgctatcagaagctttctgatggatgcactacggcatgacagatttaatgcttctgcttggtataatcttggcatttttaacaaggatgagggtacaattctagaagctgcagactgttttgagacagcaaactttcttgaagaatcggcaccagttgaacctttcagatga

SEQ ID NO: 26435 - DNA, 236 bp, Glycine max
  Peptide Sequence Number=SeqID_143213
ttgatcagagcaaaggaatgttgggtgcttttgctcctcaaaaggagccatatgtatacgccttgaaggaggacaccactccttccggtgcacttgcaaggggtgtttactcagccaaacttaagaacatccgcaattctgttcattcctttaattttaggaattctgttcaatgtgcatctgaaaactcctaccttctgctcaaaactctggtttggttgagtggaagagaatga

SEQ ID NO: 26436 - DNA, 300 bp, Glycine max
  Peptide Sequence Number=SeqID_143214
atgtcatcaaagtccatctcatgctatatggcatccaccacttctttgaagtccccaaaatggtggtgcctgaacttatcagaaagttctaaaggactgccaaagtctataggaatgaagacattggatgatactttgccggaaaggtactggcaaaacatggcatttgggttgaaggtagctcgcctaggcgagctgagctcacccaagcgagctgataactttattctgaagcaaccctgctcacccaagcgagctggttacttcatcatgaagttgtctaggtggctcaggggctga

SEQ ID NO: 26437 - DNA, 174 bp, Glycine max
  Peptide Sequence Number=SeqID_143215
atggcttccacaagtggagatgctactccaccatctccaaaaactgcaaggctcatggcagagatgattaaacttggaattaatgaagcattgggcttgaatctagcattgggcttgaatccagaattgagcttggacttgaagagggcagactattttattctacagaattag

SEQ ID NO: 26438 - DNA, 117 bp, Glycine max
  Peptide Sequence Number=SeqID_143216
atggggagagttaacctagggttaaatgtgagaatggtagtgatgacttgggggaaagcttgggctgagcaaatgagaaaaatgagtgacaaaggtgaaagcaagagccatttctag

SEQ ID NO: 26439 - DNA, 315 bp, Glycine max
  Peptide Sequence Number=SeqID_143217
atggataacgaagagggagtgcaagaacagatgaaggccgacctatcggccttaaaagatcaaatggcttctatcacggaggccatgctaaagattcaaaaaactatagaagataatgctacagcggccgcttccaatacaactagggaagcggaaccggtgctacagcctgcaataaacttaggccgagacagaaacgcgacgggtttcaatcggagacttcactccccataccgttccagacgatttgagccaagcccctaccttcgaggggcagctccctcctcatgccgactatcctctgcaagaagatga

SEQ ID NO: 26440 - DNA, 345 bp, Glycine max
  Peptide Sequence Number=SeqID_143218
atggggatcgcacccacaaagacactcaatggacctaaagaagtccaacaggccctggggtttccagctctggttacgggtctctgtcggccctacagggcgcccgttccccccagcaaggattgtgcccgtaagacacctagtggacccgaagaaggccaacagggtcttgagttgccagctctaaatacggggtctctgtcagttatagggagtgcctgtcgcccccagcaaggtcatcaggcccccctactaatcaagctttcatcaagaagtactgcgcccccaggcaggcgcagggcgaaacaccacagcagcattgggatggccggtagcggacaatag

SEQ ID NO: 26441 - DNA, 183 bp, Glycine max
  Peptide Sequence Number=SeqID_143219
atgactgttgtcgttgttactatcgccaccaccaccatgattgtcaccatgactgtcgttgccaccaacatgaccgtcgtcaatggcgacagttatgttggtggcgacgatagggtcatggcggcaatcgcagagatggttgtgcggacacttctcaccgatatatttactggtggcatctga

SEQ ID NO: 26442 - DNA, 516 bp, Glycine max
  Peptide Sequence Number=SeqID_143220
atgcctttttccaagtactgtagaacagataataaatattggaagcatttttctgggggaaggcaagtgggtccaccaacatatcactgtgatgagcaggagtttaagacaaacttatctgggtggccaacaaaaataatcaacattgaaattccctcaactcgtgcatttgatgcatatccttcattctcagaaatacctgaggccaacttgtccagcatggagtgcggactacctactcaattatctttctcagctcgggaaatatcagatggcacctttttcaaggcaattgaagattatgacccagacagcaagaggctcttgtacctgttagagaaatcatatcttggcgatcctgttcttaatccccttacaccttgggaccggccaccaataaaaaatgtattctgcatttatgggactgattcaaagacaaagtccctctgtccaaatgcccttgtgcccaaacgttgtcagaatgaatacgttgaaaggaaaacatacatgtggtag

SEQ ID NO: 26443 - DNA, 849 bp, Glycine max
  Peptide Sequence Number=SeqID_143221
atggcgaaaaacccgttactctgctcgatcgtcctcctcgccgtgctcgccggagccacctcagacgacggcgccgagctcgactactcgaagctctccggcattataatccccggcttcgcgtccactcagctccgagcatggtccattctcgactgtccttactctccgctcgatttcaaccctctcgacttggtctggctcgacacaaccaaatgggggactcgaacccgcatcctatccctccctcctttctcccttcaccatcaagccaaccttatatctcctgctgtgtatgaaattagctctaatgagctgcgatttaaagagttaagagtgtggtatcttctttctgctgtcaattgctggcttaagtgcatggtgttggatccttacaaccagacagatcatcctgattgcaagtcccgtccggatagtggtctttctggcattacagaacttgatccaggttatataacaggacctctttcatcagtttggaaagaatggattaagtggtgtattgaatttggcatagaagctaatgcaataattgctgttccgtatgattggagattgtcgccctccaagcttgaagagcgggacctttactttcataagctaaaaataacatttgaaactgcttacaaacttcgtggtggcccctctttagtttttgcccattcattgggtaatcatgttttccgttatttcttggagtggttgaagctagagattgcaccaaaacattatatccagtggctggatcaacatattcatgcctattttgctgttggtatgattgacttacgtacatttgttacccctttggggatattactgatatga

SEQ ID NO: 26444 - DNA, 258 bp, Glycine max
  Peptide Sequence Number=SeqID_143222
atgagggcacagacgatagcgcttgagccttgttgtctccggactcgagtcgatggcacgttccaaagcagtaattgcggcgacggaggagcgagggcggttcacggagcgctttatcaccgccggaagctgcgaatgaaagccgttgtcggagaaaacctccgtttaacggcaaagatagaccatcgcaacggtggaggcagagccaccgccttgtggtgcgggtttaacgaaggtgcggtggtggcgcgggtttga

SEQ ID NO: 26445 - DNA, 2253 bp, Glycine max
  Peptide Sequence Number=SeqID_143223
atggatgattctggaagtaaaactaaactgttgaatccatggatgctccacttccagaaactcgctctcgaactcaagtgccctctctgtttgagtttgttcaagaggccggtgttacttccatgcaaccacttgttctgcaagttcgtttcttcttcttcttcttcttcttattcttttccttcatgtttggctgattgcataacggctgggcctggatgtgctgtttgtaaggcaacgtatgctcaaacagatgttaggcatgtgccttttgtggaaaacgtggtggcaatatatagaagcttggatgccactttttgtgctagtttgtttcagccatgttcttctggtgatgggagggttttggagccgtgccaagcaattcttaattcaacttctagtagtttaaaagctgccaagcttcctcggaatttaactaattcaaatgaggttggggttggcaagaatttcaaatccaagagtgtggtgcatgacaaagcagaggagtttgagttgtctcgtgagagagggaagcccaatccaatgcaatcttcccatatggaacttggtggccgcgaagagtgtggagttatggaaatggatgtgaatcaagtgacacaatcagcaccagatagcccacccttttgtgataccaaaggttcagataatgacttcagtgatcaaggcagtgagcatccattacttcctggtagattggaaaattcttcactaaagagagctggcacaggaaatggaaatttgaaagaaagaatgggacagctcaggtctgaaagttcagcctctgaaactgagggtcttgcaagggatctcaagagacagaagaatctggactttaaacctggaaaggaacctggtgcaccattgcccaaaattgacatgtgtccaaccggaaggatctgttcattttgccaatcctctaaaatctcagaggctactggaccaatgctgcattatgcaaatggaaacttagttacaggagatgcagcaatgaaaccaaatgtcatacctgtgcatagaatttgcattgactgggcaccacaagtgtactttgttggtgaagttgttaagaatttgaaggcagaggtggcaaggggagcaaaacttaaatgcagtaaatgtaatctaaagggagctgctcttggttgctatgtcaaatcctgtagaagaacgtatcatgttccttgtgcaatggacatctcagattgccgttgggatcatgaggattttctcttgctctgtcctgtccattcaaatgtcaaatttccatgtgagaaaatcaggtccaagaaaaaggcaacacagaagcatcccactttttctcatctgccatctcatcactcaaatcgtcttgaagcttcccaggatgctagtaaaaaattggtattttgtggatctgctctatcaaatgaagaaaaggtatttttgatcaattatgcaagcaaggttggtgctactgtgaccaagttctggacctcaaatgtcacccatgtaattgcagcaactgatgcacatggagcatgctccaggacgttgaaagttctgatggcaattctaaatggacgatgggttctaaaaatggattgtaagttgtttaaggatccacaatggggtcctggcaccaggggctggggatgtgttgtaggcgggataaaagcatgcatgcaagagataaatcctgtagaggaagaaccgtatgaaattaatcttgacaatcaagggtgtcaaggtggcccaaaagctggcagacttagggcattggccaatgagcccaagctattcagtggcttaaagttttatttttctggagattacgtgtcaacttataaggaagatcttgaagaattaattgaagtggggggaggtactgttttgagaatcaaggaagaattggaagcacacagacatgaatgcaaaggggattcttcaaagttgctagttgtttacaaccttgatcccccacaaggatgcaagttgggggaggaagtttcaattctttggcaaaggctaaacgacgcagaggatttagctgcgaacactttacaagtcattggtcacacatggattcttgaatcaatcgctgcatgtgcatggatgtaccttaccctcccttggcactcactcagcatagaaacactcaaatgccaaaagctatttgattctgtccagcttaatttcagcgtctcagaaaagactgagtttagacttcagcttaaaatgctgcatactggttaa

SEQ ID NO: 26446 - DNA, 1848 bp, Glycine max
  Peptide Sequence Number=SeqID_143224
atggcagtgatagaagaaaaaggcccttcaagtgggaacgaggattacactcaagatggcacagtggacctaaagggtagacccgttttgagatcaaagacgggaaaatggaaagcttgttccttcatagtagggtatgaagtgtttgagaggatggccttctacgggatacaatcaaacctagtgatatatctaactaataagctccatgagggcactgtgacagcttcaaacaacgttagcaactgggtgggtgcagtgtggatgatgccactggcaggagcttacatagccgatgcccatcttggccgatataagacctttgtaattgcgtcatgcatctatattctgttttcaccatttgaagacgagtattacgaagtgggaatgtgtctgttgactctagcagtttcactaccagctctgaggccatcaccatgtgaccaaggccagaattgcccacgggcatcgtcattgcagtatggtattttcttcttggccctttacatcgttgcaataggcacagggggaaccaagcccaacatttctaccatgggagctgaccaatttgatgagtttgagcccaaagagagatcccacaagctttccttcttcaattggtggttctttagtattttctttggtacccttttctccaacactttcttggtatacttacaagacaataagggttgggccattgggtatggccttcccacccttgggcttgttatttcagtagtggtgtttctggtaggaactccattttatagacacaaattgccatcaggtagcccagtaacaaggatgcttcaggtatatgttgctgctgggagcaactggaagctgcatgtcccagacgatccgaaagagctacatgagctgagcattgaagagtatgcaagtaatgggagaaacagaattgatcggagctcctcattgagtttccttgacaaagcagctataaagactggccaaacatcaccatggatgctttgcacagtgacccaagtagaggaaaccaagcaaatgacaaaactgattcctctcttgcttacaacgattattccaagcaccttggtagttcaagcgagcacactctttgtcaaacaaggcaccacactagacaggagtatgggaccccatttccaaatccccccggcatgtctcaacgcatttgttaccatctccatgctgataaccatcgttgtctacgaccgagctttcgttcccgctatccggcgctacacgaagaaccccagagggatcacaatgctgcagagactcggcattggacttgtgatgcatgtcttcataatgatcattgcatgctttgctgaaagaaggagactcaaggttgcaagagaaaaccacctctttggtctgcatgatacaattcctctcactattttcatcctcttacctcagtatgctttgggaggggttgctgataactttgttgaagttgccaagatagagatattctatgatcaagcaccagatggcatgaaaagtcttggaacagcatatttcacgaccaccttaggtattggaagttttctcagcagttttcttctgtcaactgttgctgatgtcaccaagagacatggccacaatggttggattttgaataatctaaacgtctcccgtttagattattattatgctttcatggctgtacttagctttctcaactttctctgctttttggttgttgccaagttctttgtctataatgttgatgttacacaaaccaaatccggctcggagattaacccctcttcatcacaggaacaggacaatactggaataagcccaagtatcccacaaccagatggcaaatcctag

SEQ ID NO: 26447 - DNA, 576 bp, Glycine max
  Peptide Sequence Number=SeqID_143225
atgggtgaaatagaggaagggcaagagcggaggaaggctgacatgcaggccatgaaagagaaaatggccacaatgatggaggccatgatgagcattaagaggataatggaagtcaatgcggctgcagttgctgctaccagcgccattgttgaggtggacccgactcccccatctagccttaaccaaataaatcatttaacctcggatgtggtaggtcaggaaggcaaagaattgggaagtataggcgacccccattttgtgcaagttcagaacacgcatgctttcccaccatatggcttgcctccgaactatacaacaccgaatgttgcgcacactcccaatgagaatgtcaataactccactaccatactcgttgagagccgacaacctcaatctaatcacgcacatgtctctcaacccatgggggagacacatgagataccccaccacaatctagccgacttcgagccttgcattggatgcgccacagaggggcaagcaattggtggtgtacctttgtcaaacactttggagggccctcgattttgcccacaaccacaacccttttattttgcg

SEQ ID NO: 26448 - DNA, 381 bp, Glycine max
  Peptide Sequence Number=SeqID_143226
atggggagagttaacctagggttaaatgtgagaatggtagtgatgacttgtgggaaagcttgggcagagcaaatgagaaaaatgagtgacaaaggacttgtaggatccaatttgagaaaaattggatgtgggcaagatggatttcgaaatctgccaaattgttcagcaaaaagctgtcaaatttgtgcagcagaatttttgttcttgtgcagaaaatgcttgtgcattgctgattatgggaaagacttttctgcctctgccctgttttcttggtttagggtagttcatgatagttggaattggattgctgggatattatggaagcttggaggggttgatggggacccggtgctgagaggaatgaggataagggctacgtag

SEQ ID NO: 26449 - DNA, 888 bp, Glycine max
  Peptide Sequence Number=SeqID_143227
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcggcttcggccgcaccggtgaatggttcggtaccgactactacgacctcaagcccgacctgatgaccattgccaagggactgacctctggttacatccccatgggcggggtaatcgtgcgtgacgaagtggccaaggtcatcagcgaaggcggtgacttcaaccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 26450 - DNA, 147 bp, Glycine max
  Peptide Sequence Number=SeqID_143228
gttgctgatattactactgcacaactgtcaaagattcaaccacaactcaaggacgaccaactttccaaaactaaactagattccttaaaaattagttctaaaggctcatctgatgatgacattgttgggtctgatgatgacattgtt

SEQ ID NO: 26451 - DNA, 171 bp, Glycine max
  Peptide Sequence Number=SeqID_143229
atgttcattctaaccccaattgcgataaactcacaccttacctctaagcgggctcacgtgtcgtttctggcaagctccaaatccaaggagagtcttgcaaagaatctcaaggaagttctccagatgcttcaacaagaagaagaggaagaatcttcaaaagaaggaagttga

SEQ ID NO: 26452 - DNA, 972 bp, Glycine max
  Peptide Sequence Number=SeqID_143230
atggagaacgactgttgcctccatgtgaggaagtgccataagtgtcaaacgtttgcagacaacgtgaacgctccacccataccattaaacatcatggccaccccgtggcccttctccatatggggaataaacgtcatcggagccattgagcccagggcttcgaatgggcatcgcttcatctcagtggcgatcgactactttaccaagtgggttgaagccgcctcatactctagtgtcacgaggaacctggtcatcagattcatcaaaaaagaaataatatgccggtacggattgtcggggaagattatcatggataatgccatcaatctgaataacaagatgatgatggaaatgtgcggagacttcaaaatccagcatcacaattccacgccttacaagcctaagatgaatggagccgtggaagcagccaataaaaacatcaagaaaatcatccaaaaaatgatcgtatcatataaagattggcacgagatgctccctttcgcgctacatggctaccggacctcggtgcgcacctcgaccggggcaacgccattctcattggtgtatgaaatggaggtcatcctaccatttgaagtggagatcctttccttaaggatcctggcggagtccaacttgaaagaatcagaatgggcccaagcgcgctttgaccaactcaacctcatagagggcaagcggctgacgactatgagccacgggcatttgtaccagagatgggtaaagaatgctttcaacaagaaggtgcacccgcacaagttcaacgagggagacctagtgctgaagaaggtatcccaagccttaaaggacaatagagggaagtgggcgcccaactatgaagggccattcatggtgaggaaagccttttccagaggagccctggtactcgccaatatggatgacatcgagttgctctcacctgtgaatgccaatgtcgtcaagcgatactacgcttga

SEQ ID NO: 26453 - DNA, 219 bp, Glycine max
  Peptide Sequence Number=SeqID_143231
atggaatggaggaaatattatttggatgtggtgctggtaccattgggatttcttataaccattggttatcatgtttggttgtggcataaggttcgaacacagccttcttccaccataatcggaatcaatactcatggaagacgctcctgggtccctgccatgttgaaggctagcttgaatatgatggagttaattattattcctaattctacaacttga

SEQ ID NO: 26454 - DNA, 99 bp, Glycine max
  Peptide Sequence Number=SeqID_143232
atggatcacggtgatccatttagacaacttgatcaccctagacatcgtccactctacaagtcaagtaagttatatgcaaatgtagaagttgaaaattga

SEQ ID NO: 26455 - DNA, 1230 bp, Glycine max
  Peptide Sequence Number=SeqID_143233
atgcgtcttgctggccgcttgcgcgtccgggccgcaggctcgcggtccgcaggccttgccggcgcaagccgctatgaaggtggacggacgcgaattcctgccgcgcgagcaggtgcgccgctggcaggaggaactggacgccatggggctacgcgacaccggctcgcccgcgcacgagcgctacgtcgaccagttgcacgagcggctgctggcggcgggtgtgcgtgccctgcgcttcgaatcgctaccgctggcgcgctggtcggcccggcactgggccttgcaggccgcggacggcgagcggatcgccgtcgcgggctacgtgccttattcgggcagaaccggcgcgcaaggtcgggaggcggggctggtgtacctgccgccgggcgcggcgccggaccagcgtgtcgctggcaagatcgtgctgttcgacctgccgcgcgccacgcttaccggcgatttcttccatcggttggcgctgcgcgcctacgacccggccggttcgttgccgccaggcgcgccgtatgcgcggccctaccaggtcctggaggtgttgaccgcgctgcaggaaaaactgcaggcggcgggcgccgtgggcgccatcgccatcatcgacgcgccggcgcagaccgccgagggactgtatgcgccctacgaccgggagttgcgcgccgtgccggccttgtggagcaagtgcgcacgcgcaacctgatcggcgtcattccgggggcgacggatgagtggatcgtgatcaacagccacacggacggcaccaacggcatcgaggacaatggccccaatgccatcgtcgatatggcaggctacctgtcgcgcctgccgcgcagctccctgccgcgcggcgtgatgatcatgctgtccagcggacatttcgcgggtggcgccggggtgcaggattttctggcgcgccatcagggcgacgcgctggcctcgcgcattgccgccgtcgtgaccatcgagcacctgggggcgatggagtggctgccggacgcaaccggcaagctggcgccaaccggaaaattcgaacctgtcggcgtattcatgccgccaatcccggcgctggtggacgccgccgaagcaatggtgcgccaggcggacgcggggccggccttcatcatgccaccgctcaaccctcaagggggatggcggcccgaacaacgctgtctggtcaggagaagggcagtactttctgggggcgcggccggatactaa

SEQ ID NO: 26456 - DNA, 249 bp, Glycine max
  Peptide Sequence Number=SeqID_143234
atggttggttttgcaccttttccgccaagaggtttcaatagcaccaacgcggaggcacttcagaaggtccgcaaggcatgggagatggtgcaaaagaagaacaaggaactcagaggcagtaacaacggggccatcggcggccaccgtaggtggttaaaagcccacatgcatggtctggactggctcccaagtttgagaaccactaagggggtggaagttgaagctccgaaggaggacgaagagatgtag

SEQ ID NO: 26457 - DNA, 111 bp, Glycine max
  Peptide Sequence Number=SeqID_143235
atgaccaagaataagagaaatcaaggagaaccccctcaaacttggcgcggaagcaagaaattgttaggaattagtgaagacgatagacaaaaagtaatcccgactatgtag

SEQ ID NO: 26458 - DNA, 948 bp, Glycine max
  Peptide Sequence Number=SeqID_143236
atgtcatgtattgacttgtatgaaaatctacgtttcgtgtgctatctgtcatgtagatcgttggcagctgcaactaagcacagtgacggtcctgaaagactaggggaagctggtcttgcactgcactatgctaacatcatcagtcagataaatatgattgcatctcgcccaactgctcttcctccaaacacccgagacacattgtatcatggtttgcccaacaatattaaggctgctcttccatcccagttgcaaaccgttgctgacatgaaagagctctccatcactcagatcaaagctgaaatggaaaagattcttcagtggcttgcaccacttgccacaaatacagtcaagctaaaactccctgcaattgcttatgcatttgttttctcttttaatattcctgacagagcacatcaaggtttcggatgggtaggtgaatgggcaaacacaagtaatgactctggcgataacacctccaaagaaaataacctgattcgcctgcagacactttattacgctgataagaggaagatagatgtttacatcattgaattgttggcatggcttcaccatttgattagctctgtaaaatctagacagaataccttgagaccaatgcctacacggtctcctccaaagggacacgaacttcagtctaagatgcgacagttattaattctatctgtggatagtagcaacaagccgttgggaactcaaatttctcatgaggataggagattattggaggatgttattgcaaggaaaaagaaccctggacttagcaaaagcgaggatcttggtttggctaagaaaagacaagtcaaacatttgcaagtgaccaaaagtgctgggagttcacctgccaaggaattcttcggtacaagactcgtctttaaccaccaaaactataacgttttggatattatggatgggttgggttactga

SEQ ID NO: 26459 - DNA, 519 bp, Glycine max
  Peptide Sequence Number=SeqID_143237
atggcccgcaccaagaaaactggtcaaatgacgtctgaggaagcaaagaaaattgctgacaagattttgcaatcacaggggctcacactatctcctaagcctgaggttggtccttcaagtgctcgtgttagcacaaaggagagttgtgttgatctctcagggaacgacctagacagggttgactttgagaaatgtgggttgtacatcgaagaaaatccttcccgcctggttgccctaagaagactttatgagaggtcgacaaccgttcacaacatccctttacgcaatgatcaagtcaaggttggtgttgaggaagttagagatgcagatgttcccattcctgtacccactcaaaaggttcaattagtggggcagacacttaacacttttgttggttggctgacacatcttgtcaagggtttattagaacagagagctgtgggattggcgaaacatgttgataggtcggatcatgatgtcgatgatcccctatatctgatgacattgaccatctcatag

SEQ ID NO: 26460 - DNA, 168 bp, Glycine max
  Peptide Sequence Number=SeqID_143238
atgtcacgaaaccttatggattacgcaaccgtcccctctttggcctctgaaattttacggatctttacggattgtgcattaacgcttcctttcgactcccgacatgtcgcggaatttcacggattgcctaacgatgggtatcaagtacctcgaagtggtcaagtgaag

SEQ ID NO: 26461 - DNA, 534 bp, Glycine max
  Peptide Sequence Number=SeqID_143239
cgtgactcaaaagtcagtatgacagatcttgtgagcgcggaagatgacggcgcagaagacgacggtagtctctgcgtgctattaggcttttcgtcttacagacagcaaaaagtttgtacggataaccactcgggtatttccgcccgtcagcgtgactcaaaagtcaatatgacagatcttgtgagcgcggaagatgaccaaaaagtttatacggataaccactcgggtatttccgcccgtcagcgtgactcaaaagtcagtatgacagatcttgtgagcgcggaagatgacggcgcagaagacgacgttagtctatgcgtgctatcaggcttttcgtcttacagacagcaaaaagtttatacggataaccactcgggtatttccgcccgtcagcgtgactcaaaagtaagagtgacagatcttgtgagcgcggaagatgaccaaaaagtttatacggataaccactcggatatttccgcccgtcagcgtgactcaaaagtcagtataacagatcttgtgagcgcggaagatgac

SEQ ID NO: 26462 - DNA, 216 bp, Glycine max
  Peptide Sequence Number=SeqID_143240
atggagttaagtaatattctttctggctttccaatacaattctacgaattgaagcagtcagagactaaaggacaggtaagagtgcaagggcacatgccacagttgagcaagaaaaacaattttttaagtgttcataacatcacaccaaaaaaaacatttttttttggacaaggctttgttaaacagaaggccaaatggaaattttctagcatataa

SEQ ID NO: 26463 - DNA, 348 bp, Glycine max
  Peptide Sequence Number=SeqID_143241
atggcatggcacatttttgccaaccgccataggaaatttgttaagggaggcccgccaaggcggcgccataagacgcaatggcgtgtttatatggcagaatttcagccttccgccatcaataacactacatacagttgtgtaaaagcagtgttatcgatggcggatggcaaactatggcagccagccgaaaatccgccatacgtcaagagaacagaggtcaaaggaaaaaacgttgagggttggctgagtcagagagaaacaagagcaagtttgagggagctggagacaggcagacaccggagatcatcgtccccagagatccccatcatcagttacgatcatcgctag

SEQ ID NO: 26464 - DNA, 963 bp, Glycine max
  Peptide Sequence Number=SeqID_143242
atggaaaagtctgtcaaatctctgtataggtcatatgatgataccaataactgtctccttgttttgtttaaacatttacaggaaaaacttcttctcactgagtcaaagctaaaggagtcacaatatcaattgacaccttggcgttcagatatgaaccatgctaatgttgccacacaatcacaacctcactcgattggtgcacctttgacaacttcaaataaaaatggccttgaactggtacctcagcatatgtactctcaagtaaagcctcaggtctctgttgatgctcaggcaggcactgaaccggatctattgggtcgccaccagaatggcttgagtggtggtgtggcaacaagtgttgatgctgatgatttggggagattttcacctcttgcaagcaggtattcatcagcccctgatgcatccacccacctggtagttactcagggtgataaccatcctgctcattatggagatgaaatgaccaacaaacaggtcacatttcgtgaccccatgatcaacaatgaagttgatgaccctgatggagatggaacccatagtacgagagaaacatctactaattggagttctggcaaccctccttatacaaccactgttgatgatcccagttcttcatattctccttatttaccaccagttcttgaagaaccttcttcttcattttctgaggctgcagatgaagatccattgccggctatagagggtcttcaaatttcaggagaagcctttcctggaagggaacttcaagcatgtggatactccatcaatggcactactagttgtaattttgaggggcaaagcaaccaacctaccttgtcaacgccgatgatgttggtacattacttgccattgaagtccaacctctggataacaggaagcgcaaggtactttttccctcttgctatgatggcagtcttacacatgtatgcaaaaaatgagtga

SEQ ID NO: 26465 - DNA, 414 bp, Glycine max
  Peptide Sequence Number=SeqID_143243
atggagaatggtcacgatgggaaattggccgataaattctcgggcttgaatatcaaccagcacgctcaacaacacgtgcatgatcaatctaacctctcttctaacaacaatgataacttgtatcaggtcatgaaggctgttgaagctgccgaggccactattaagcaacaggtagtactttggattcaacacgtgcttcgttataatggtcatggttcttcaccattcttgctaccgtgggaaattgcagacaaatgtggtcgatgctgccacagttgtggttgcgttaatgcattgagttgcagtggtagttttatgttggtagaagagaatagccggcttaggtctgaacttctgagcaaaattcaggaactggaaaaatatgtaggaattgctaattggaaccttttttag

SEQ ID NO: 26466 - DNA, 1251 bp, Glycine max
  Peptide Sequence Number=SeqID_143244
atgaataaaactgcaggaggtacaatgctggggatagtcaaaagctgcataggtaccaaattcactagtcaatttggggatttagttgctgatttagctattgatgctactaccacagtagatattgatcttggcctaggtttgagagatgtagatattaaaaattatattaaggttgagaaggtacctggtgggcagctggaggattcaagagttcttaaaggagttatgataaacaaagatgtagttgcccctggcaaaatgaaaagaaagattgttaatccgcgtatcattcttcttgattgtccccttgagtataaaaagggtgaaaatcaaacaaatgctgaaatgcttaaagaagaagactggagtctcttgttgaggatggaagaagaatacattgaggagctctgcatgcagatattgaagtttaaaccagatttggtgattacagagaaaggacttaatgatttggcatgccattttctcagtaagcatggagttagtgcaatcagaaggctgagaaaaactgataataatagaattgccaaagcatgtggtgctgttattgtgaacagaccggatgaattacaggagtctgatgttggtactggtgctgggttatttgaagttaagaagattggagatgagttttttgcatttattgttgaatgcaaggaccccaaggcttgcactgtactattgaggggtgctagcaaggatctcctaaatgaagttgaaagaaacctccaggatgccatgtctgtagcaaggaacataataaaaaattcaaaacttgttcctggaggaggtgctactgagttgactatatcagcaacactgaagcagaagagttcatctgttcaaggtatacagaagtggccttatgaagctgctgccattgcttttgaggcaatcccccgtactttggcacaaaattgtggagtaaatgtgatccgcactatgactgcactacaaggaaaacatgcaaatggagaaaatgcatggatgggcataaatggaaatactggtgacatcactgacatgaaagagtgcaagatctgggatgcttacaatgtgaaagcacaaacatttaagactgccattgaagctgcttgcatgcttctgcggattgatgatgtagtgagtgggatcaagaagaggcaggcccctggagcaggccaggctcgttcaaagcctaaggttgagaccgaggtagatgctgacagtgagcaaattcttcctgattga

SEQ ID NO: 26467 - DNA, 327 bp, Glycine max
  Peptide Sequence Number=SeqID_143245
atggctttctttctatgcattgactttttaaggtttaattgctgtttgtctatgattgaattgagtcgcacccaagatgaagaagttggagatggaacaacgtctgtcatcattcttgctggtgagatgcttcatgttgctgaagcactcatagataagaattatcatcctacagttatttgccgagcttatgacaaagctttggaggatgccattgctgtccttgacaaaattgctatgcccgttgatgccaatgatcaaatttacaatgagctgagccttttcaataatatactgtgctggtttgtagcaaaagtgtccaagtag

SEQ ID NO: 26468 - DNA, 165 bp, Glycine max
  Peptide Sequence Number=SeqID_143246
atggggcctttctgttatgacagggctttggattctgccattggaaattatgagaacttggagggtgaaaatggaataccagcaggaactaagcaaggtagtggggccttcctaggctgtgaactaggcactaaggcaaggccaactggccaagcacttggacca

SEQ ID NO: 26469 - DNA, 960 bp, Glycine max
  Peptide Sequence Number=SeqID_143247
atgagagcaccaaccatcctaaggagcctccccatgcggcagcttcagccaagagcaccggcggtggtgtcccctttgccggagaaaagccgattcgactgggaactcacggcggagctcgataccctccgatcacagggcgaattagggttggctcagttgcttgatgctgccatcaccacacagaaaattgcctcagattctcttgtgaacgtttcatacaaagactatgccgatcgtggtgctgttgataagtacctcgaagacaacgttgagatgcttgatgcgtgcaattatttaatggacaaaatggatcacatcaacaagtacgtggactcattgagagtggttgtgcatttggttgataagggtggtggtgctgcaaagcctataactcgtgctttggagcttttggagtcatgtcaaagcatggaaaagagatgcaaatcaatggagaacttctaccgtggctcttgtttgaagaaaatgttgcggcaaaagctgtgtcatgaaactgaactcagtgaggttatgtgtggctctaaggccatggccttgttgtgttgtaggtttcttgagcttggtctatcgtttgatccaaaacgtggattgcccttgatgaaattttctcagcatatgatgagttcttcttggttgagattgttgcaggagttggtaaatcaggctgagaagaaaaaggtgcagagaaggagatgttggtcatctttgttgatgcagacagtggctgcagctagagaattgaaggagcagatgaagggaaaaagggaaaaggagatgaagtattctgttgagagactaaagatatgttgcagggaactggagcatggggttgagattgttgaggaaagagtgaaaattttgtataaaagtttgattgattttaggatgactttgttggggattctttcccagcctactacagtgtttagatctgattag

SEQ ID NO: 26470 - DNA, 291 bp, Glycine max
  Peptide Sequence Number=SeqID_143248
atgatgctacccctaccattgtatttcaacgggtgcaaaatgaattgggtgaaaaaaaatgataaagagaaatcaaggtgtatgtacaatttgagcgtccagatattgggactcttaataacatgcgatgatgatgaagagagatcaagtctgaaagcaagcaggggctgttctcgttcttcaacgtgccaaggctgctcaacttgttactgtgaagggtgcatcaagtgccgctttgaggattgcaattgccaagaatgcagagactttatgctatatgctaaaccttaa

SEQ ID NO: 26471 - DNA, 778 bp, Glycine max
  Peptide Sequence Number=SeqID_143249
aggactaaacgcactcgccttcagaggaatacgcgtcctcgcctttagagggctacacaccctcgccttcagaggactacacgtcctcgccttcagaggactacacgtcctcgccttcagaggactacacgtcttcatcttcagaggactacacgtcctctcctttagagggctacacgtcctcgccattagagggctgcacgtcctcgccttgagaggactacacgtcctcgccttcagagggctacacgtcctcgccttcagaggactacacgtcctcgtcttcagagggctgcacaccctcgccttcagaggactacacgccctcgccttcagagtactccatgtcctcgccttcaaagggctgcacgccctcgccttcaaaggactacacatcctcgcttttagagggctacacgccctcgccttcagaggactacacatcctcgccttcagagggctgcacgccctcgccttcaaagggcttcatgccctcgccttcagaggactacacgtccttaccttcagagggctacacgccttcgccttcagaggaccacacgtcctcgccttcagagggctgcacgccctcaccttcagaggactacacgtccttgccttcagagagctacacgccctcaccttcagagggctacacgccctcaccttcaaaggactacacatccttgctttcagagggctgcatgtcctcaccttcagagggctgtgttcgcggccgacaagtgcaccggatcgcacaagtagtataaaacagtaa

SEQ ID NO: 26472 - DNA, 849 bp, Glycine max
  Peptide Sequence Number=SeqID_143250
atggaggacaagaaaaaaaaacgattggaggaagcagcccaatctaggagcattgacaccgtcattgatcctacatctcctattagacaacagatgaagaggaagatgaccctcacaaaaaaacatggtcaaatgacgtttgaggcaacaaaggaaattgcagacaggattgattccttggaggagcaggcctcacagggaagctttttctcccatggaggacccagacattgtgagtcagagaaatatgagttgtacgtcgatgaaaatcctcctcgcctggttgcccttggaagactttatgaggggtcaaccaccgtttacaacatccctttgggaaatgatcaagtcaaggtcggtgttaaggaagttcgagatgctgatactcacattcttgtacccactcaagaggttcagttagtgggacaaacacttaacaccttccttgcttggccgacacatcttgtaaagtgtttgtcagaacatggagctgaggtaccaacgcaacctgtagataggctggatcctgatgttgatcccctatacctaatgacattgataatcccgcagctttttctcaagccgttacaagtgtcgtgggatgttactgtgtttgggatgtataatgataacttccccttgtacataaagcatgaagatctttctaaaatagaacacggtggtcaatatttgagcatttctgttatacaattgtggattctgaatatgactgagacaagtatgcgagtggggaatgtcgatgtgtatggattcctcgaaccacagcccatacaaagatttggacaattacaatttgaatcaaaaacttatattaagaactggatgtag

SEQ ID NO: 26473 - DNA, 912 bp, Glycine max
  Peptide Sequence Number=SeqID_143251
atggctacttttatcactgtcatgcctactgcaccaaacaccctcttgaaacttatttacttacaattgaataattattttattggaattttatatattcatttatcttcttatatcaaatgtattctgttgaagcttcatttggataatctaatgatggtaattatgtatgtaatatcaggctatatttctacactgagaaacaatgtccgttcccgtgcttggggtgcagcaattggttgtagttatagagtggagcggtgttgcattgtgaagaaaggaggtggaactattgatcttgaaccttgccttacacatacatcaactattgagcccacccttgctccagtgactgttgagcgaactatgactaccagggctgcagcttcgaatgcattgcggcaacaaagatttgttcgagaagtcacaatacagtacaatctctgcaatgagccttggataaagtatagtataagcactgttgctgacaagggtttaaaaaagccactttacacatctgcacgtttgaagaagggggaagttttgtatttggagacacatttgtccagatatgaactttgttttactggagagaagatgctcaaggttacaccagcagccccgttgcatgaccctgccacagaaaagtctcaaaatcaccacccacattctgcaaatggtgaaaaaaatgattgtgagaatgtcatgattgacgcattccggtggtctcgttgtaagaagcctctgccacagaaactgatgcgtacaattggcatccctttgcctcttgaacatatagaggtactggaggaaaatttggactgggaagatgtgcaatggtcgcaagctggtgtttggattgctggaaaggaatataccctggcacgggtgcatttcttgtcaatgaattaa

SEQ ID NO: 26474 - DNA, 288 bp, Glycine max
  Peptide Sequence Number=SeqID_143252
atggttggttcaattgctactggtggccgatatgataacctgatagagatgtttggttcaaagaaatttacagcagttggtgtaagtctgggaatagagagagtttttgaaataatggagcaacgtcagaaggatcagaaccagatggctcgaccaacaaaagcatacaacttaaagcactttgagtatgaaaacaaatcaaggatcccttggatggtacttggtgagcgggaagtaaaagtgcaattgaaacacctcgagggcagtaatacatgtaaacattcctag

SEQ ID NO: 26475 - DNA, 1869 bp, Glycine max
  Peptide Sequence Number=SeqID_143253
atgagtggtgcacctaagagatctcatgaagagtctgttcattcatcttcaaagcactcaaatgaagattcgggtacttattccaagttggtttcattgccagtctcaaatgagtaccatatgccttatgatataagtcaggactcccgggtggcaaaagtgcctcgaactgaatttcgtgatgcagatagaagatcccctcttaatccagtgtatcggatgtcgtcacctttgaatgattctcgtgcagataatcctattggtcctgagaataggatagaatcaagggattcgaaggacagtagagatccccggtttgagaatcgtgatacaaagacagagaaggagttgtatggtgaagcaagaagggatcctccaaatgctaaaagtgaaaaggatatgcgcgtagaaggtagaggagatgacaacaaggatgtttggcatgatcgggatagtcataatgatccgaaaggtgacaccaagacagagaaagatggttataatgtggctagcagccacttgaattggaaagattcaaaagagtaccatagaggaaaaagatattctgatgctcctggtggaagtttggacacatggcatatgttacgtggaaatacacaaggctcggttgaggttgggaaggagagttccgcagcaggagagagagattatgttgaagctcatgaagctgttagtgagaacaaagttgatcctaaaggtgatgatagatccaaagagaaagatagaaagaggaaagatgtgaagcatagggaatggggagatagggaaaaagaaagaagtgatcgtagaaacagtccacaagttagcaatagtaccggtgactgcaaagaatctaccaaggaagatagagatgtagaaaggttggagagggagaaaaaagatcttccagaagagaaagaaaatataaaagagagggaaaaggatcagatgaagagggaatcatggaatggaatggagaaagaggtctcaattaacgagaaggaacctgttgatgcatcagctaaacttcctgaacaagaacctgtgttaccagagcagaagaaacaaaaagaagttgatagctggaaaaatgtagatagagaagctagagagaagagaaaagaaagggatgctgatttagaaggagataggtctgataagcatagcaaatgtcttgacaaggaatcaaacgatgggtgtgctgatggagaagggatgatggagaaggagagggaggtctataattatagcagtcagcaccgtaagaggatacaacgatctagagggagccctcaggtgcctaaccgggagcctcgtttcagatcccgtgcccaagataatgatgggtctcaaggtatgctgtcattttatttcactggcttgattgaatgtaaagtagaagtttcttctgttgtttataaagttggcgaaagcatgcaagaactgataaagttgtggaaggaatatgaatcatctcaatctcaaatggaaaaaaatggtgaaagctctaataatggtcccactctggaaattcgtataccatctgagcatatcacagctacaaaccgccaagatgctctgagacatcaatatccatattctgccaattatctggtacctcttgatttattcaaatcttctgcttcttccatagttccacctccttcttatacttctgtcctacagcatgttttttacattgagcagttgaaagaaaatcaagaaggcattgattatcttttcttcaacttgatccttggctctagatacgagggcaagccttggcacaatggtaagggtgtgggttcaaatcctgacaccaatcgctctgtttgtggggataaggctacatacatctaccctccctaa

SEQ ID NO: 26476 - DNA, 348 bp, Glycine max
  Peptide Sequence Number=SeqID_143254
atggcttccaggcgtttgagggcattcaagcggtggatgaagtcgaaggggctcgaatggagcgatgcactggagtttgtggacaccccagaagaaggagttgaagtgagagcattgtgccagttgaaggaaggtgatgttgtggccaagatgccaaaggaagcttgcctcaccacaaagaccagtggggcacgtaagatcattgaagaggctggtttggatggtcatttggggcttgcatttgctatcatgtatgagagaagcttggatggggactctccttttgctggctaccttcaactcttgcctcaccaagagtgtgtgccaattgtttggaccctcggatga

SEQ ID NO: 26477 - DNA, 636 bp, Glycine max
  Peptide Sequence Number=SeqID_143255
atggcattgaaggacacatttttcatatcacatggatcatcaacaatttccatagatgattcaattccagcatgggagttcttgacatcgtggaaggaggtgcttcctcagagattctcttccattcttgtcatttctggtcactgggataccgatgttcccactgtcaatgttgttgatcacaacaagaccatctatgactactatggtttccccaaagtcatgtacaagtgtgccagctctcaatttcatcacagagatggtacttaccactacaacttgggaaaggtattggctcctcttaaggatcaggatgttcttataattaggtcagggagtgctctccataacttgagagcaattgggcctcgcaatagccctactgctccatgggctctggcatttgattcctggttaaaaaactctcttattgaaggaagatacgaggaagtaaataaattcgatgagaaggccccatatgcaaaactggctcatccctggcctgatcacttcttcccattgcatgtggctatgggggctgctggtgaaaactcaaaggccaaaattgtccatcatagttgggatgctggttctatttcttgtgcctcttttggttttacagcagctactagttga

SEQ ID NO: 26478 - DNA, 603 bp, Glycine max
  Peptide Sequence Number=SeqID_143256
atggagtctagcaattttcatgctgacaaaatggaagataaaaagataattataagatacaaggaatgtctgaagaaccatgcagctgcaattggtggcaatgcaactgatggctgtggtgagttcatggctgctggagaagaaggcacccttgaagctctcaagtgctcagcttgcaattgccacagaaactttcacagaaaagagatagagtcttctgattctaatgccattcctttgatgattattcctgacactactcagataataagaccaattttggctcatttatctcccaacaaaagtggctcaattagtccttctgatttgtctgatgagaaggaaaacgaagatgggatgatgattaaggaggtggaaaatccaaatgagaaggtgaagaagaggttcagaaccaagttcacacaagaacagaaggagaagatgttggcttttgcagaaagagcagggtggaggatacagaagctagatgaatcattggtgcagaagttttgccaagagattggaatcaaaagaagagtcctcaaagtgtggatgcacaataacaagaacactttcgccaagagaaatccctcaactagctag

SEQ ID NO: 26479 - DNA, 1188 bp, Glycine max
  Peptide Sequence Number=SeqID_143257
atgtgctctacatttcatgaacattttctgatctcttacaattttaggcagacagtgcaagaagacaaggctctgatttatgatgactggaaagagaatattctacccctattggatttagcacctttaaaactaaatccaaagttctttggcgtagaacaatactttgcagcaaaaagtcttatatcttcacgatcttttgagattgatgattaccatggttttggcatggttcccttggcagatctattcaatcataaaacaggtgccgaggatgtgcatttcactgctatgtcctctaatgatgagtctgatactgatgttgatggctgtaacgatgatgagggcattgtcaaggaagaaacattggctcaaaattcctctatagatatgaccgtgttaaataatgggaactgcaatgttagtgactcggatagttcttcagttagtgatggtgatacttctatgctggagatgattatgataaaagatgtcagcagtggaactgaggtatttaatacttatgggctattgggtaatgctgctttgcttcatagatatggatttactgagcaagataattcctatgatattgtaaacatagatatggaactggtacttcaatggtgtacttctgtgttttctgaccgccacagtagagcaagagtttccctttggagaaagttaggctattctgcatgtggcagccaaaactctgaatattttgagatctcatttgatggagaaccacagattgaactcctcgttttattgcacatcatgttattaccagataatgcctaccataagttagacctatcggttgctggaaattgtgatgaatcaagtggaaccacctttctgaatggtaatatctttcctagtaaagcatttaatatgagcaagaaatccttgctgcctaaaaaagtttgtgatgtcctgtcgtcacttgctgatatgagggagagtctctatggcttgaaatcaattgaagatgatattgaggcattgggaaggtgtagtttagttagagagagaaagctgtatcattctttgatgctgcgcatcaatgaaaggaagatcctccagaggctcagaaattatgcttcacagccatttaaaaataaaatcactaaccatagttctccgaggaagaagttgaaaagaacaacaaagaaaacgagttga

SEQ ID NO: 26480 - DNA, 984 bp, Glycine max
  Peptide Sequence Number=SeqID_143258
atgttgtacaaatcatctgtgaggcctttaaaggtggtcatggctaatttgcttacagtgtttttgctaattgaggtgtttgcatatggctacagttacggacaatatggcttaaacacgaattactacttgatgagctcttgtccttttgttgaacctgttgttaagaacattgtcaacagagctttgcaggatgatcccaccctagcagctggtctgattagaatgcactttcacgactgcttcattgagggatgcgatggctctgttctgattgactccactaaggataatacagcagaaaaggattctccagggaatttgagcctgagaggctttgaagtcatagatgccatcaaagaagagcttgaaagacaatgccctggggtggtttcatgcgctgatattcttgccatggctgctagagatgcagttttctttgctggaggcccagtgtatgacatacctaaaggaagaaaggatggaagaagatccaaaattgaggatactatcaatttgccattccctactttcaatgcctctgagctcattaagtcgtttggtcaacgtggtttttctgcacaagagatggttgccctctctggggctcatacactaggagtggcaaggtgtgcttctttcaagaaccgattgaaacaagtggatccaactttggatgcacaatttgccaagacactagcgagaacatgcagttccggcgacaacgcaccgcagccattcgatgccacgagcaacgattttgacaacgtttacttcaacgctttgttgaggagaaatggggttcttacatcagaccaaacactctacaatagccccagaaccaggaactttgtgaatgcttatgcattcaaccaagccatgttcttctttgatttccaacaagctatggtcaagatgggcctgcttgatgtcaaagacaattccaacggtgaagtaagagaaaattgccgcaaaataaactga

SEQ ID NO: 26481 - DNA, 207 bp, Glycine max
  Peptide Sequence Number=SeqID_143259
atggaggcggaaacaggcgcgtggggcgagatctcgaaggagaaagtctttggaaagaggaaaaggggggaaaagaaatattcgttctgggcaatcgcgagaaaacagactctgttttggaaaattggaagagagagagaatttcagggatcggaaatcttagccgttaaaaccgactttaccgccatcataggtcatgcatattag

SEQ ID NO: 26482 - DNA, 2124 bp, Glycine max
  Peptide Sequence Number=SeqID_143260
atggtcgtgagcggagggaagggcctcaaacgcgccgcgaagaagagagtcaccgccgacttctacgacttcctaacgttccccacgccggcgctcgccgagtcggagaacttcgccggcggaccgttccgctccaacgtgcgcgcctttctgacgaagcacgcgctgcttccgccaccgtcggcgctctttccgcacctgctgacgtggcagatcgtcttccgcgtcggcgaactcaccgagggccccgacgcgccggcggtgtgcctcgacgtcgtcgaggaggatgtcgccagatccagatccgtttactgcgatcagtgccgagttttcggttggagcggccatccagtgtgcgggaaacgttaccattttataatcaaagccgatgggagctccattggtgggtaccacaagccgtgtatgtgctgtggagacatcttgcatttgtcagaatccaaatgcaagtcatgcaaccatgtgaccaccactgatgacgtcgaagactgggtgtaccaccaattagaaaacacaactcatcttttacatggagtagtccatgccaatggatatgggcaccttcttcgggttaatggaagagaagggggctctagatttctttctggtattcatattatggatttctgggatcgtctatgcaagactcttggagtcagaaaagttagtgtgatggatgtttcaaagaaatatgggatagagtatcgcatgctccatgccattatgaagggacatccgtggtatggtgactggggttataaatttggctctggtagctattgtcttactcatgaagcatacaagtctgctgttgaaagcctatccaatctacccttgtccaccttttcccacggacggatgcccaactctcgtgtggaggacatgattaaatattaccagtctttgtcagagcacgagcttgtaaatataagggacctcttttgtttcataatgggtttgattggtgatgctcacaagactgcatcaaatgttgatgagacaacctgcaagaagcgttgttttaatgcttctggactgtcaatgtcatgggataagagtggcattgaacgtgtggagcaagccatgatcagagtgctgtgtgcagtgtctgagtccaagtgggtgagctggcgtgctcttaggggtgcagcctccaagttgggctctccagagctgcttgattattgccttggagaactgggaggaaaaatggtctatggtggaatggttgttaatagccaatgcaatcctcaaactggagtttatgagttcagacttgaggctgcaactggtgcttgctatggaattttagcaaagaataattctctgggctcgaagtatccatctgaagaaaacctcctacaatgcttgagatatttatacgactctttgcttcatcctcagatgatggtaaactatgaagcagggacaaggactcttgcaatgaactcagctcagaagctttttgactgcaagcagtttgtaaaagattataatcctgagatgtggccattgtcagattcgcagatgtttcgcctctcatgtcatgttgaacttgtagatgaatttgaagattcagaagctataactccaccagaattagttgtgctgcccctgaatgccacggtggctgagcttaagaatcaagcagcaaatgcttttcaagatgtatatctaaggttcagaagacttcaagttgatgggctacatggttatagcggtgtcgacgattccacccaggtcaagctcttgttaggatcgagagatgtagtttgtgtccgaggaagatgcatcgggaagaatgggttgagcaagttccgaatggaaaggggacttgagaggtggactgtagattgcagctgcggggccaaggacgatgatggagagagaatgttggcgtgtgatatatgtggagtgtggcgacacaccaggtgttctgacatccatgatactgatcctgttccagctcgttttgtttgcctgaaatgccaaaactgtgaatcaaaactcaaatgtagtgggcactgcaaagatgagaccgtgactaacgttagtggtagtagttgcttcagaaacggcttgccagtgccatctgatgttatttga

SEQ ID NO: 26483 - DNA, 1008 bp, Glycine max
  Peptide Sequence Number=SeqID_143261
atgtctcgaatcttctccgcatggaacaagaagaagctgcaccttcatctcaacttaatccccactattttttcttcttcccacactcacttcgacgctctcgctgccgccaatagtgggcttctccggcccagtttgaggctctacagtagtagtagtagcagcagcaatggggagccaccagaggattggcctcacgatcactacgctgctacgcaaactcctattagtgttaatttcattcgggcctctgggcccagggacgggtgggtcggagggtccaatttgggtagggattttcctactccgaaggaaatctgcaagggactcgacaagtttgttattggccagcacagggccaagaaggtgctctctgtagctgtttataaccactatcaaagaatataccaggggtcagaggcagatgaaggactctctcaaggattggatgatggggatgatgtggagctggaaaagagtaatgttctcttgatgggtccaaccggttcagggaagacgttacttgcgaaaacactggctcgttttgtgaatgttccctttgtcattgctgatgctactaccctaacacaggcaaataatctgcatgtagatgtctggaagctagtgatagttttacttaagctcctcatcaactgtgacaaaggactgtccatggcagcagagttcaatgtccaagctgctcaacaagggattgtttacattgatgaagtggacaagataactaagaaggctgagagcttgaatattagccgggatgtttctggtgagggtgttcagcaggcattattaaaaatgctggaaggaactgtaacaaatctttcagttatgggagggcaattagagaagtatactgttgcaatgatcaatcccgtgcttcttgaccctgctgttgttagtattgcaaaggaggttttcagtgacttgggaattatatccttaagtttcaggaaatggtacctcagtgggagttgttgcttttttatgtag

SEQ ID NO: 26484 - DNA, 1224 bp, Glycine max
  Peptide Sequence Number=SeqID_143262
atggaagtgacaagtgctgttcaccttcactcagttgggtttctgcatttacagacacacgttgaaaggctcaacggtagagctttcttcctctccacaagaccaagaaaagtgaaggttcatcttccttgtcatcaccatcatcatctaaaccacttaagcaataccaacggtattggtgcttgcagtgatagaacaagtgttatactcaactccacttctgttacttccacaacttcttctgctgcggggtccctctctgaagtggaaaagataaagcagaagtgccttacatggcagtggaagggtcaatattccatcaactactttgtttcttctgattctcctcagcagttgcatggcagccaccctcctctcttacttgttcatggcttcggtgcctccattcctcactggcgcagatattatttatccttgcttatcactttcatatggaatatcagcacactggcccagaattatactgtttatgctattgatcttcttggttttggggcttcagataagcctccaggctttcaatataccatggaaacatgggctcagttgatcttggatttcttgaatgaagttgttcagaagccaactgtactaataggaaactctgttggaagccttgcttgtgtcattgctgcctcagattcaagtcaaactcttgttagaggcattgtgctgttaaattgtgctggtggcatgaataacaaagcaattgttgatgactggaggatcaagttactattacccttgctttggctgattgattttttattaaagcaaaagggaattgcctcagcaatttttgggcgcgttaaacaaagagagaatttaagaaatgttttgagttcagtgtatggaaacaaggagtctgtggatgaagaactggtggagatcattagggaaccagctaatgctccaggggccttagatgcatttgtttccattgtaacgggcccgccggggcccaatccggtgttgttgatgccaaaaatctccttgcctgttttacttttatggggagataatgatccctttactccaattgatggacctgttggcaagtacttttcttcattgccttctcaaaaagaaaatgttaaacttttcttgcttgaaggggttggacattgtccccatgatgacaggcctgacttagtacatgaaaaattgcttccctggttggccagtatttcaaattcagagtaa

SEQ ID NO: 26485 - DNA, 639 bp, Glycine max
  Peptide Sequence Number=SeqID_143263
atgaggctacaacaactcaacttgttctttctgttgctttgtgttgccaaagcaaacgggtctctgctcccattcatggatcctcccatcactctcttggctgatctctggtccgatcgcttcccagacccgtttcgcgtgctggaacatattccgtttggggttgacaaagatgaagcatccatggccatgtcacctgctagagtggactggaaggagaccccagaggggcatgttataatgctggacgtgccggggctgaagagagaagagataaaggtagaggtggaagagaatagggtgctgagagtgagtggtgaaaggaagaaggaggaggagaagaagggggatcactggcacagagtggagagatcctatggcaagttctggaggcagttcaggttgccacaaaatgtagacttggattctgtcaaggccaagctggagaatggggtgctcactttgacacttgacaagttgtcacctggtaagatcaaaggtcccagggtggtcagcattgctggggaggatcaccaacaagttttattttcttatggagctaaaggccaaaaccctgagctcacatcctcacaccatgtctctgcaatatcacaatacaagacctggcaaaagaaatag

SEQ ID NO: 26486 - DNA, 3102 bp, Glycine max
  Peptide Sequence Number=SeqID_143264
atgaacgaattaacaccaaacacagagagctatctctaccttcatccaagcgaaaacccagctgtagcccttgtctcgccaactttagattcgagcagctatcattcatggagcaggtccatggtaacagcactgagtgccaaaaataaagtggaatttataaatgggaatgcaccagaaccgctgaaaaccgataggacctatggagcatggagccgctgcaacaacatggtggaagcttcatcaatgaaacaaggtaccctctctgtcacagagtatttcacaaagctccgcatcatatgggatgaaattgaaaatttcaaacccgatcccacttgttcttgcaccattaaatctcaacaagaacgtcagctatcaagtactaatcccctcccaaacttcaaccttgaatcaaaagaaaacgcttcaatcaatgctgtcaagattgtttacgaattttgcggacgaattggccataccgagagtgtttgttacaagaaacacgatgtgccttcaagctatgaaggaagaagcaaaagttataatacaagaaacggaaaaacctgtactcattgcgggaaagtaggacataccatagatgtatgttataagaagcacggatttcctccgggatacaagtttggcaatggcaaagtgatagaaaataacattgtggcggtagaaggaaaagccacgagtgaccaaatgcagcgccatgagtctcaagatttggttcgcttttcactagagcagtatcaagcattgctcgctttaatacaacagccatcttcaggaagctcagcctctacccaatccctggttgcctccatctcttcatgttccaataacaccttaccaggtacacttctctctttcgaaacagcagattccatctcctggatattagattcaggagccactgaccatgtctcctcttccttgaccaattttcactcatatcaccaagtcagtcccatcatggttaaactaccaaacggccaccacgttcacgctacccactcaggaacagtacaccttaccccttctattatcttgaatgatgataccaacaccaaagcgaagattggtacagttgaaggaatcatccatcaaaccacttgtgttgagactcccgagcaaaatggcattgttgaaccatacttgatcaattgcattcctactcccttcttaaataacaaatctccttacgagaagttatatgcgcatccttgtgatatctcgaatcttcgagtctttagttgcctgtgttacatgagtaccctcaaatcccacagacaaaagcttgaccctcgtgcccacccatgcatcttcattggtttcaaaccacacaccaaaggatatctcgtatatgaccttcattcccatagcatcactacatctcgtaacattgtcttctatgaagaccattttcccctctttcctgataaccaaactttacccacccttcatacttctatatcaccaattcctttctcaagtaaccccgataaatttgactctcccatcccacccagtgtcaatccatcatctcctcacaccacttaccctcctttacgacgctccacgaaaccaaaacaagcacccacctacctccaagattaccaccgtgcactcacttctcaagctgatatcactgcgagtaatgttcagtatcctctacactcggtcctctcttattcccgcctttctcgctcacatcgacaatttgttatgtcaatatcggtaaacactgaacccaactcttatgctgaggcttctaaatttgattgttggattaaggcaatgcaggctgaaatacaagctcttcaacagaaccaaacctggactcttacaccgctaccaccacataagatagctattggttgtcgatgggtatacaagatcaaatacaaagctgacggcactgttgaacgatacaaggcacgcctcgtagcaaaagggtacacacaattagaagggttggacttcctcgatacattttctcccgtggctaagctcactactgtaagattacttcttgctcttgttgctcttcacaattggcacctcaagcaactcgacgtaaacaacgcctttcttcatggggatcttgatgaagaggtctacatgactcttcccccaggtcttgttgtgcctgattctaaccttgctgatcattccctttttctacacttccataataatgatatcactattgttcttgtttatgctgatgacatcatcttagcagttgctcgcactagccagggtatccatttatctcaacacaagtacgttctggacatattatctgactcaggcatgcttgcttctcgaccagcttccactcctatggactattccacacgattaacggcttcgatgggcactcctttatcagagacttcttcctcctcatatcaacgtttgattggacgactcatttacctcaccaatactcgtcccgacatcacacatgatgttcaacaacttagtcaatatatggctcacccaacctttgctcattcacaagcaacctttcgtatcttgcgatacctcaagggatcacctggttctggcatattcctcgttgctcacggtaccctacagctcaaggctttcagcgactccgattgggcgggttgtcgcgatacacgacgttccatcacaagattctcggtatatttcggtccctccttcattccctggcgttcaaagaaacaacccacagtttctcgaagctcttatgaggcaaaatatcgagccttagcatctaccacatgcgaacttcaatggctcacgtatcttctccacgattttcgggtatccttcatccagcctgcaaccctttactgcgacaaccaatccactattcagataggttctaaccccgtcttccatgaacgaactaaacacatcgaaatcgattgtcatatcgtgcgcgacaaggtcaatcaaggactactcgaactgcttcccatttcttcgcacatgcagttagctgatattctcatgaagccactctcgtcatctctatttcaaggtctctgttccaagctaggaatgatgaatatccattcccagcttgaggggggctcttag

SEQ ID NO: 26487 - DNA, 675 bp, Glycine max
  Peptide Sequence Number=SeqID_143265
atgggttacttaccgttctccagaataagttctccagaacgctcttccatcgcagtgtctcattctttatacaaatccttgcaagatttactttcttcgtattcgtattttgagattcctaagttcaacgactactgcggcgtcgacctcaaggacctttacctcaatgccacgaactactcccccgtcgccgcatgccgccgattaactctcccgctcgccgtcgctgaactgcatctccttcaccgttgcgttgaaccacaccgtccacgatgccttccgcggccactgcatcatgtggatgcaccacatggaaactgtgcaggactcgctcgaggagaggcacagcttcacactccgcctcataaagcaccaccgccatgcgctcgtcttgccatacctcacgtacgtgacctcatgcgtcgaggagttcgagcgtgtctcgcgagcgaaggctcttcaccaacaacactactgcttctggctgctccaaattgggttgggtttcgtccccttccgtcaccagtccctctacaaaaccctagccctcaagccaaaaatcaagatagggagagggagagaaagagacaagagaagaagtttatgtcatttgtgctacccgataaggaaaagacgcgtctttgtactcacattccattacgacgattttcctaa

SEQ ID NO: 26488 - DNA, 459 bp, Glycine max
  Peptide Sequence Number=SeqID_143266
atgcatattatggttagaaccagaggtttgggttgggctttagacaaggttataggaagaaccctagggagagaagttagtcgtgattcgaatgaagccccccattggcgaaggcccacagcatctgcacataggcaacaggaagctgcacctgttggtaaggatgttcaacatgtggatgatgcagctgacgaggtccatgaacaacctgaagaactagttgctgatgaacatctagagttgaagttattatcccatggaagaaaggttgaaaaatttggcaggcctactccaaagattgaaggcttagtggctgccatagtgtcgcaacctacccttcggcgggagggcgacgcgagggctcaaaggtgcgtcttccatgggtggaaaatgcgcggagtcgccaccaacgtttattcgaggaaaatgttggaaaaactaaaaaggtgtggtctatga

SEQ ID NO: 26489 - DNA, 528 bp, Glycine max
  Peptide Sequence Number=SeqID_143267
atggcatcatcatttgtgggtactttattacccaaccacttcacacaaaccaaacactcagctgttcctgcaagtagatcaggtgctccaagaaggaggagagtgcacttagcaacaacaagagcagagaccatgactactgtcatagaaaaactgggcattaagattgagaggaaccctcctgagtccaagctcactcaactggccgtcaccgtcgccaccgccaccaccgccaccgccaccgatactggtgtattgatttggaaagggggaagctggactcgctggaatgaattggggaaattagggttgagagtggctgtaagtgaaacggtgagtttagggttcccatggacatatgaagccaaagagacttgctatcttctggaaggaaaagtgaaggtctttcctagtgggtcgaatgagtcagttgaaattgctgctggtgacttggttgtgtttcccaaagggatgagttgcacttgggatgtgtctgttggtgttgacaagcactataattttgaataa

SEQ ID NO: 26490 - DNA, 1653 bp, Glycine max
  Peptide Sequence Number=SeqID_143268
atgttctacttcctcaaaagattgtgccttctatgcttcctcttgttatcctttgctgtttcactgttttcatgtgcttcactcagaggcttggcttcttgcttggataatcacaatatcaaaaactttaccacgttcccttacaaagaacatgatcattcctctgcctatagttacttcaaaattctcaatttttccatccaaaaccttcggtttgcagaacccgtgattcctaagccaatagccattgtactgccagagagtttggagcagctgcagaaaagtgtagcatgctgtagagaaggctccatggaaataagagtaagatgtggtggacacagctatgaagggacttcatatgttgctgatgatggcactccttttgtcatcattgatatgatgaatttgaaccatgtttgggtggacatggagacagaaacagcatgggttgaaggtggtgcaacattgggagagacttactatgcaatctctcaggaaagcaatgaacatggattctcaggtgggtcatgtccaactgttggagttggagggcacattggtggtggtggatttggtttgttgtctagaaagtatggtcttgcggcagataacgtggtggatgcccttcttgtcgatgctaacggaaaattgttcgaccgcgaaaccatgggagaagatgtgttttgggccattagaggaggaggaggtggtctttgggggatcatttatgcctggaaaatccaggtgttgaaagtgcctcaagttgtaactagtttcactgtatcaagaactggcacaaaaagtcatgttgccaatctagtgcacaaatggcaatatgtggcaccaaacttggaagatgacttctacttgtcatgcttggttggtgctggtctgccccaagctaaaaccacagggttatcaacaacatttaatggcttctatctcggtcctagggccagtgccacatccatcctaaaccaggcttttcctgagttgagtattgcagaagaagaatgcatagaaatgagttggattcagtcaattgttttcttctctggcctaagcgatggagcctcggtctctgacttgaagaacaggtatctgcaagaaaaagaatatttcaaggccaaatcagattatgtaaagaaaaatgttcctcttgtgggcatagaaactgcactagacatcctagaaaaggagcctaagggatatgttgttctggacccttatggtggcatgatgcataatataagcagtgagtccattgcttttccccacagaagaggaaacctgtttacaattcagtacctgatctattggaaagaagctgacaatgacaaaagcagcgattatgttgattggataagagggttctatgctgctatgactccctttgtttcatggggtccaagggctgcatatattaattacatggactttgaccttggagtgatggaggggattggtaatggtgctaatatgaaagatgctgtggaacatgcaagggtttggggtgaaaagtacttcttgagtaactatgacagattggtgagggccaaaactctgattgatcctaacaatgttttcaccaatgatcagggcattcctcccatatctttgaccagtccctatgccaaagcgcagagcaaataa

SEQ ID NO: 26491 - DNA, 1233 bp, Glycine max
  Peptide Sequence Number=SeqID_143269
atggtggttgcgagctgttggtgttcatcttcatcttcatggctgccactgtcattgccactgcattcgaacttgaaggcagcatcaacgtcactgtccccgaaatggaaatatcacgcattttctgaagcctcctcctcctcgtgttctctcgttcacaacaaccaagacgacgaccttcaagctctcttacagatccttccatctgatttgcatcacaatctcctcaatcaacctaaccgccctcaacttctagaggttattttggatttggggcgttttccagaagcgcgttatctaggaaaacacggaggccattctttaaggaacactgaggtaacagtgaaggagttggaatatgctgaacaagctgttggtgaatttgggaaggacaatagagctggcattgagggtacgttacaccgaatatctgcaattaggagtaggaatggtcacatagttggtttgacctgtcgagttgggagagctgtcactggccagattgatatggtttatgatctgcttcagtatgggaagagcattttatttgttggaaggcctggggttggcaaaactactgttatgcgagagattgctcgtgtactgtctgatgagcttcacaaaagagtggtgattgttgataccagcaatgaaattggaggtgatggcaatattccacatgcagcaataggtggtgcacgaagaatgcaggtgcctgagccatcaatgcaacatagagtgatgattgaggcagtagaaaatcacatgcctgaggtgattgtagtagatgagattggcacagaagctgaagctcatgcttgccgatcaattgccgagcgaggaatcatgcttattgggactgctcatggacagcagcttgaaaatatcatcaagaatcctacactgtctgatctgattggcggaatagaaagtgttactctgggagatgcagaagccagagccagaaattctcagaagacaattcttgagaggaaagcacctccaacatttgatttcttaattgagatgagagatagacactactggcttacacatcagactgacaaaagtgtagatatgttgcttcgaggaataagtccacaggttgagaaatataggttcgcgcctggcttgttcttttcttctttggtttcttccccagtaagaaaaagagatgaaaaatgtaaggtcgtgatagaaaagtctaaagcatatgataaatgccaaatttga

SEQ ID NO: 26492 - DNA, 822 bp, Glycine max
  Peptide Sequence Number=SeqID_143270
atgaccctgcacataggtgaatgcagcattgataaagtgatcgagcagaccagctcactccccttcgctgcgctgtttccggcgcaccgcgagacgatgggcgacacgctggcacagcagccggcagagatatccatccatagctgggtggtgcgcaccgctcgcgacaccatcgtgattgataccgcaaccggcaatggccgtaaccgcgataacaagccgctgtttcatcagctgcaaaccgcgtggccgcaacgtctggccgaagcgggcgtcgaccctgatgaagtgacgctggtgctgatgacgcatatccacaccgatcacgtcggctggaatacctgctggcgcgctggccgctggcaaccgatgtttcgtcatgcgcgttacatctgttcagcgcgtgaactggcacagtgccgcagcacgccgtcaatgcaagcgttgtatcacgacagccttgcgccgctgctggcgagcggccagctggaaaccattgatgtgcagcgctccccgctgtttgccggtgtgctgcgctatatgccgacgccgggtcacagcgtcgatcacgcttcaattgtgctgcaaagcgccgctgcccatgcggtatttagcggtgatgtgatgcatcatccagttcagtttgcacatccgcaatggaactcagttttttgtgaggatttaccacgcgccgtaacgtcacgtcagttactgatagactggtgcatccgccatcaggcactctggtgcagctcacattttgccggcagttcgtgcggccgggtttcgccagagcggcaatggattcctgtggagacctga

SEQ ID NO: 26493 - DNA, 399 bp, Glycine max
  Peptide Sequence Number=SeqID_143271
atggccaagaggatcaaggatggactattcatcaaaggcaaggaaggagaaaatcacaaggagctaaattggagcacattgaagattgttgaacagccacctgggcttagcgcgagctcaatagtttccaaaagtgatagtgatccaccttcccctagatccactaagctaatggctttattggctaagcaaatggataagttgcaaagaaatgttgaaagggggatgggagagagatttaatgacatacaaagaagcactcaagagttgagtgggagaatggaagacatagagaggaggaggcatcataggtcaccttattcttctcaaggaagtgatgatggctatgaagaaggtagaaggcatagacataggaggaatatggatgggatggaatag

SEQ ID NO: 26494 - DNA, 323 bp, Glycine max
  Peptide Sequence Number=SeqID_143272
atggatttgaaagaatttctcgcgtctaaccgactcgccagaaattggcagatcacacaagaacatgtgtggaccgttatatctgcttacttcgaagagaaaggcttcgtttgtcaacaacttgattccttccaccacttcatcatccagaccatcatgcaagaaatcgtcgacgattctgcgtacattgaaattcgacccaagaatcagcacaatcccgctcacaaatccgatcccgttgaggctgcttacaaattcagattcggcaagatttacttgagtgagccaatgatgacggagtctgacgggaaaactgccaggat

SEQ ID NO: 26495 - DNA, 198 bp, Glycine max
  Peptide Sequence Number=SeqID_143273
atggtagatatcctgtacgagatctctggaaagctgcaaaagattgttggaaggaaatgctgttgtcacctgtttcgatctattgatattaacaatggtgggatatgtgtattcaacttcaatgtcagaggagaagcaatgcttgacgctttaaatacgacggctcatatgtacagtgatcatgtctatcctggctag

SEQ ID NO: 26496 - DNA, 2872 bp, Glycine max
  Peptide Sequence Number=SeqID_143274
atgccttcaaaaacggtttggatagcaactaaccgtttaacactcaacgtcgtcgtttccgttaccatgaacttaacacagcgtcccgtcgcccagcgcggcggcgccagcaacttgccgcggccgcctcctccgccgctgaactccgtcttcaacatcatcccggtgcacgacctcctcacggaccacccgtcgctccggtacccggaggtgcgagccgccgccgcggccctccgcaccgtcggcgacctcccgaagcaccagttcatgcggtgggaaccggagatggaccttctggactggctccggttactgttcggtttccaactcgacaacgcgcggaaccagagggagcacctggttctccacctcgcgaactcgcagatgcgcctcgagccgccgccggcgatcgtcgacgcgctcgacgccggtgttctgcggcggttccggcggaagctcctccacaactacaccgcgtggtgttcgttcctcggcctgaagtcgaacgtacttctctcgcgccgccgcgacccgacggatctccgccgcgagttgctttatgtttcgctgtaccttctggtttggggagaggccggtaaccttcgtttcactcccgagtgtctttgttatatttatcatttcatggcgaaggagcttaatcatgttatagatgagcacattgatcctgatactggtcgtccttatatgcctacggtttctggtgaattagggtttttgaagtctgtgattatgcctatttataatactattaaggttgaggttgatagtagcagaaatggaaaggctccgcactctgcgtggaggaattatgatgacattaacgagtatttttggagtaggaggtgtttgaagagactcgggtggcctttgaattttgagtgtaattttttcgggactacgccgaaggagaagcgggtagggaagacggggtttgtggagcagaggtcgttttggaatgtttataagagttttgataggctttgggtgatgctgattttgttctttcaggctgcggttattgttgcttgggagggtaccacttatccgtggcaggcgttggagagaagggatgtgcaggtcaagatgttgactgtgtttatcacttggagtgctctgaggttgcttcaatcggtgcttgatgctgggactcagtatagcttggttacgagagagaccacgtggcttggagtgaggatgacgttgaagagcatggttgccataacgtggactgttttgttttcggtcttttatggaatgatttggattgagaagggttctaggccaatctggtctgatgcggccaatcagaggatttatacatttcttaaagttgtccttttctttcttatcccggagttgttggcattggtgctgttcgtggtgccatggttgcggaatgtcattgaggaatcggactggagaatagtatacatgttgatgtggtggtttcataaccggatttttgtgggccggggtgtgagacaagcacttgtagataatgtaaagtatactgttttctgggtagcagtattagcttcaaagttttcattcagttactttgttcagatcaagcctctagttgctccaacaaaggctcttttgaatcttaagagcattccttctaaatggcacgaatttttcagcaacaccaacagggtagcagttgtcttgctatggttacctgttgtgctggtatacttcatggatttgcagatatggtattcaattttctctgccttttatggcgcggcaattggtcttttctcgcatttgggtgaaattaggaatgtaacacaactcagacttagatttcagttctttgccagtgcaatgcagttcaatctgatgccagaggagaagctgcttagtcagcaagctacactgttaaagaagcttcgtgatgccatccacaggttgaaactgcgatacggacttggtcagcccttcaataagattgaatcaagccaagtggatgctaccaggtttgccttaatatggaatgagattatgataactttcagggaggaagatatcatcagcgatcgagaacttgagctcttgaagctgccaccaaattgctggaatattagggttattcgatggccgtgttcccttctctgtaatgagctacttcttgctgtcagtcaggcaaaagagctggaaaatgagtctgaccagtcactttggttgaaaatatgcaagaatgagtatcgccggtgtgcagtctttgaagcttatgatagtgttaaatatctgtttcccaaggttcttaaagctgaaaaagaagagcatttcattatgattaatatattcaaggtcatagacagctacattcagatggggaagttaacagaggcattcaagatgtctcggctaccacagatacatgccaaggtgagtgaatttgttcagcttttgatacaaccagagagagacatgaataaggctgtaaatttgttgcaagctttgtatgaactgtttgttcgagagttcccaaaggcgaagaagaccatcatccagctacgtgaggaaggtctggcacgacgaagttcaacagctgatgaaggacttatctttgagaatgctgtgaaatttcctgatgctggagatgcaatctttactgagcagctcagacgattgcatacaattcttacttcaagagactcgatgcataacgttccattgaatcttgaggcacgacgacgaattgctttctttaccaattctttgtttatgaacattccccgtgccccctatgttgaaaaaatgatggctttcagtgttttgaccccatattatgatgaggaagtattgtatagcaaagaggctctccgaaaggagaatgaggatg

SEQ ID NO: 26497 - DNA, 993 bp, Glycine max
  Peptide Sequence Number=SeqID_143275
atggttaatgtccagtttcctccattgaatgcaaaaggaggtgaatctcttacaggaactatagaaagcacacgacaaaagtcagacccttattattttgatccgcttcagttgtcttcatattccatttacagaaaccaagctgatgcttccatttggagaatggattttgagttaattatggtattggtgtcaaacacactggcctttattactctaggtcacatgattcccttgatattgaacttcgaagctttattcatggcaaaccacagtgtgcagaatacttttcttgggagtggaggttggcttgaagtgaatgaggtagttgtgaggatggtgacaatggtagcctttcttctagagttgcgccttgtacaattgacctggtcctcaagacagggtgagggaagccatcccggtctgtgggattctgaaaaaaaagctctttatatcactctaccattgtacattggtggtggattgactgcttggttggtgcacatatcgaagacttctcatcaaaaaagatttagaccatttcggctttcacgccacaagtttagtcttcctcgtgaacatttttaccgacctccttccctctgggaagactttaaatcttatgctggtttgctcctggatggttttctgctccctcagattctgcttaacataatatttaactcagaaacgaaagctctagcatcttccttttatgttgggacaaccattgttcgtatactgccccatgcatatgatctttatagagcgcacagttctgcatggtaccttgatttatcatatatatatgcaaatcatagaatggatttttattccacagcctgggacatcataatccctagtggtggtattttgtttgctctccttgtatactttcagcagagatttggcagtcggtgcattcttccaaagaggttcagagaaagtactgcttatgagaaagtaccggttattggcaatgacgatttatga

SEQ ID NO: 26498 - DNA, 305 bp, Glycine max
  Peptide Sequence Number=SeqID_143276
atgggaactccatcatcaaatcctctcttcatcttcttccttttcttcttccttttctactcctctgtatcacttaatccttcagatttggctttcgaatcgacctacgctcgcctctgcaaccaccatgtccctgcaccggcgtcccgttccgacgaaggaaccgtccccggcatcgccgacgaactccggttccaatccggctacttcgccggcggtgaccacttctttaaccgatccgtcaccacgaagaatcacgcgtcgtttcgcgtgacctccgttcgccgaagcgcgagtgacggcgt

SEQ ID NO: 26499 - DNA, 243 bp, Glycine max
  Peptide Sequence Number=SeqID_143277
atggttacacaatcccattttcaatcaaggagtggaaaagagaaacttacggtgaaggcgaaggcggtggtggtggcggggactggcgacaacgtgcgaatagagacactaatggtggtgacgcaacgagaagaagcgaagaaagaagaagatggaagcacaatgcaatgcgtaggaagagggagaggagagggagaactttttaaaattttaaatgaaggacaatttcaccactttatttaa

SEQ ID NO: 26500 - DNA, 159 bp, Glycine max
  Peptide Sequence Number=SeqID_143278
atggctagcggcatagcgtgccccgtaggtggagcgaggtggctagaatggctagcgggtaggtgtggtgtcaggtctccttatgtggtgactcgtgctccacatgtgtacccctcgaatctccccaacaagtggtatcagagcctccattactgttag

SEQ ID NO: 26501 - DNA, 153 bp, Glycine max
  Peptide Sequence Number=SeqID_143279
atggaggttaaggaaccttggttggggttatggctaccattgagttatcgagtggatatgggatcaagtttagcatatgacaacggaatttgggactttgtggttgatttagggatggcctttgtggataaatgggtggtgggtaaggaggag

SEQ ID NO: 26502 - DNA, 201 bp, Glycine max
  Peptide Sequence Number=SeqID_143280
atgcttttaaaattaggccattgtgttcttactcagccatctcttggagaaattgggtatgaggtagttgcgctgccggatcggccgttctggccatggatgaatcgagagagtgaaagggagaggacaagatggaaagggtggaaggggagcctacagcggcgttgctatcacaaccaccacattgccggtgcaagttag

SEQ ID NO: 26503 - DNA, 1164 bp, Glycine max
  Peptide Sequence Number=SeqID_143281
atggagccaaaactgagcaacccagttgcattgaactggttgaaacactttaatgtgggggatgagaggtccacatacaaagtagagtttgagatagattcagatttggggttctcgggagctattactgtgacaaacaaatacgacaaagagatctttttggaaggcttttccattgaaggtgcatgttgtggatattgcctgcaattcttggattcaaccctgaaggttcatccagaggagagaattttcttcagtaacaagcaaattgccaaagcacatgtttgcttcaatgacgctggtgttcaccaacttgtccatcattggttgagaatccacgcttgcatggagccattcatcatagctgctcatcgccatctaagtgttatgcacccggttttcaaactcctaaagcctcatttgaaacacacattgcaaataaatgcattggctctcatcaacgaaggaggcatcattgagtctgatttttctgccggcaaacacagcactgaaataatctcagctgcttacaaagattggtggcgttttgacatggaagccattcttgctgatctcatcagaaggttcgtctacttggacacatacatgaatcatgtcattcttgtagtggagatacagcaactcactatcacacgagaagaattatttaacttggttaggacttacgtgaactactattaccgtgatgggaacatggttcggtcagacagtgagcttcaagcatggtatagtgaggtcatcaatgtgggccatgctgatcatgcaaatgtgagttggtggcccacactctccactcccaatgatcacactcatatgggttgcttcggttcagcattcagcggtgaattttgggcaataacctcttggtggcattcgccggatgaagagtgcatagggcagaggaaggacttgtcagattggactggtgacacagaaatcatacaggcattttatgagttttccatggatataaagataatagaaaaggagattgacaagagaaataaagacccaacacgtagaaatagatgtggtgctggaattccaccatatgagtcgctaatagcctcctctggtcctggagttacagttgctcatagccagtttggtcctggtgttacttacagaggccggggtgcctga

SEQ ID NO: 26504 - DNA, 1713 bp, Glycine max
  Peptide Sequence Number=SeqID_143282
atgagtggtgggtcattgggtattcgttctgggagttatgggtctttggagaagcagcagctgcagctacagaacaatggtgtgtcgcttattcaatcagcacgcaaaccccccaagacgctgaaggagaaagacaggttcttccattggatcttcaagtttactggcagaaagaaggtcggaatgctctttctctttaccatctccgctgctgttttcatctgggttttgtacgttggaaaaggtgaagattcacaggagggaaacagtgtgcataacactagtgttaatggcaatatgtctataggtgattctccatctttgatcgctagagctaatatcatgggcttcactacaatttcagtactacctcctcctcccccgagctattttctgggttacactcttccttctggtcatccctgtaatagtttcacacttcctcctccaccagcagataaaaagcgaactgggccacggccatgcccggtatgttaccttcccatggatgaagccattgcacttgtgccaaagtttccgtcaccttctccagtacttaagaacttaacatttatctatgaagaaactcttatcagggatggtgaatttggtggttcggactttggtggatttcctactttgaggcagagaaatgaatcttttgatatacgggagtcaatgagtgtgcactgtggatttgttagaggaactaaacctggccgcaacacaggatttgacatggatgaagatgatctccttgaaatggagcagtgtcatggtgtagttgttgcatcagccatatttggaaattttgacgagataaatgagccaacaaatataagtgattattcaaaggagacagtatgcttccttatgtttgtagatgaagaaacagagaaatatttgaggagttctggcaggctgggaaccagcaagaagattggattgtggagaattattgttgctcataatcttccttatacagatgcaagacgcacagggaagattcctaagcttctgttgcatagaatggttccaaatgcccgctattctatatggcttgatggaaagcttgagcttgttgttgatccatatcaaatccttgaaaggtttttgtggaggaagaatgcaacttttgcaatatctaaacattatagacgctttgatgtatttgttgaggccgaagcaaataaagctgctggaaagtatggtaatgcctctattgactttcagatcgacttttacaagaatgagggactgactccatatacagaggccaaacttcctcttattagtgatgttcctgaagggtgtgtaatagtacgagagcatgttcccatcagcaatctttttacatgtctttggttcaatgaagttgaccgattcacttctagggaccagattagtttctcaactgtcagggataaacttttgtccagggtggattttcattttctcatgttcttggattgtgaaagacgcaactttgtagttcagaaataccatagggatatattggagcgcctggctgctccagtggatgttgctctcagtcctccacctcctgttgaaactttgccggaaaaggttgttaggagaggtcctggaaggcgcggaagagatcgaagaccaggttctaggcgccaccgcaaagttgtggccggaggcagggatataaacatggaagcaaattatacagttttgtttgtgtga

SEQ ID NO: 26505 - DNA, 722 bp, Glycine max
  Peptide Sequence Number=SeqID_143283
aagaagaagaagaaagagggaagctaatcatacttctccctccaagagtaaacaaggaagaaaacccacgaaagggccaagagaaaatcgccaacagtctggcggagccaatccaaggcgagatcctcgaccttgcgttcgaagtagaccctccacatggccatgaagaggtggagaagcgtgcaacccttggcgaagaagacctgaaagtcacgatctttaacaaacgacaccatgaagaggaggaagccaatggcgacgaggagcaagccggagaaggaatcggaggtcttgatgagaagctggtcgtgcggcgtggatcccaagagcttggtggcggcctgcacaccgtggccgaaggtgtagacctccttcatgtagaacatcatcagggccccacatgtcattgctatcaccgagtgcaggatgcagatcaccataaatgccgacgatgccattctccttctcatttcatctctaaaaccctaataaccccatcatcttgccttctgctttctggatacacaaaacaaaaaccaccccatcctaaaataatcttgtttctaattaaaactattaaattattaagattccataactatgacgtaagtgagggccatgctaagataaggatcccgtgggaccccccctctcttactcctttgtcaagccaggatacactcgtgccacgtttctttcaattggaaggccacatgaagtaa

SEQ ID NO: 26506 - DNA, 1153 bp, Glycine max
  Peptide Sequence Number=SeqID_143284
atgatcagacacaagcacacacaccctcttcttctgttaattctccttcttttcaactcagcatgtgccattgatttcgtcttcaacggcttcaactcctctgaagtgttgctctttggcaacgccaccatcgactctcgaattctaacactcacccaccagcaaagtttctctgtcggtcgtgccttgtacaaagaaaaaatccccgccaagaaaccaaactcttcttacgtgtaccctttctccatctctttcatctttgccatggcaccgtttgaagacactcttccggggcacggtttagttttcatcttcacacctatcactggcatccacggcacaagttcagcacaacacctcggtctgttcaacctcaccaacaacggaaactcaagtaaccacgtgtttggtgttgagttcgacgtgttccagaaccaagagttcgatgacatcaacgccaaccatgttgggattgacataaactctcttaagtcttatgtttcccatgatgctgggtattggccagatggtggtgacaagtcctttaaggaattggcgcttaacagtggtgagaattaccaagtttggattgactatgaagattcttgggttaatgttaccatggcaccggtgggtatgaaaaggcctagtaggcctttgttcaatgtttctctcaacttatctcaggtttttgaggatgaaatgtttgttgggtttactagtgccactggccaattagttgagagccataagattttggggtggagtttcagcaatgagaatttttcattaagtgatgaacttattactattgggttaccttcttttgttcttccaaaggattcaatttttaagtccaaggggcttgttgcagggtttactgttggagttttctttgttgtttgtctattggttttgttggcactgtttttgattcagaggaagcgtgtgaaagaaaggaagaggctggaaatggaagattgggagttggagtattggccacatagaatggcgtatgaagaaattgaggcagcaacaaaagggttctctgaggagaatgtgattggggttggtgggaatgggaaagtctacaagggtgttctgagaggaggggtggaggttgctgtgaagcgcatttctcatgaaaatgatg

SEQ ID NO: 26507 - DNA, 1530 bp, Glycine max
  Peptide Sequence Number=SeqID_143285
atgtcaaaagaaagtgaggagttttccacagagattgtgcagagaggtgttgagaactctggcccaaatgctggctctctttctttctctgtgaaagtgaggcctagactgccagatttccttagttcagttaatctaaaatatgtgaaattgggttatggctacctcataagccatcgcttgtacttattgctggcaccacctctccttgcagtcttcattgctcgtattggaaagttcacttggcaagacctctatgagaaatatggcctcattgaggtcctatttatatcagcacttttgtgcctaatgctatatttttatgctgacttaacacccggctctacctatttgcttgatttctcatgttttctcccttcaaatgaatacaagatctctaaggcagagttcattcagttggccaaaaaatctaggaatttcaatgaaaccgccattgagtttcaagaacgagttcttaagaaatctggcataggcgatgaaacctacctgccaaaaggagttttccgccctggttacagaaactcactgaatgatggcaggcaagaggtatcaatggtgatgtttggggcaattaaggaccttcttgctgccacaaaagtgaaaccaaaggatatcagaatcctgatcgtaaactgtggaatactaaacaccaccccatccctctcatcaatgatagtaaaccatttcaagcttaggcatgatatccatagtttcaaccttggtgggatgggttgcgctgctggaatcacagctattgatcttgctaaagaccttctggatgcttatccaagaacttatgcacttgtagttagcacagaagctgtgagctctacatggtacagtggcaatgacattgacatgttgcttcccaattgcttcttcagaatgggagctgcagccatcatgctctcaaatttctgtctagatagatggcgcgccaagtatgaactcaaacagctggtccgaacacacaaagggatggacaacagaagctacaaaagcatacatcaaaaggaagacagtgaagggaggaagggcatttctgtgagcaaagatgtcatagaggttggaggccatgcattaaaggccaacatcaccacactaggcccactagtgctacccgtttcagagcagcttcacttcttcaccaacttgatcttcaagaaaaagaaaacaaagccatacattcctgattacaagctggcattcgagcacatgtgcattctggcaacaagcaagaaagtgctggatgagattcagaagaatttggagctcacagaggagtacatggaagcatcaaggaagacattggagcgatttggcaacacatcaagcagcagcatttggtatgaactggcttatcttgagttatactcaaggatcaaaaggggtgatcgggtttgccagatagctcttggggccgggttcatgtgtaacagtgttgtgtggaaggcccttaggaatgttgggagacccaagcagagtccttggattgaggatgaatgctga

SEQ ID NO: 26508 - DNA, 894 bp, Glycine max
  Peptide Sequence Number=SeqID_143286
atggaaaataggagcttggacaagtgggtgtttgattgtgatgagagcaagatgttaagttatgaagacagaataaggattcttaaagatgtagcttttgcagtgttgtacttgcatgaggggtgggaagctaaggttgtgcatagggacatcaaggccagcaatgttttacttgataaggatatgaatggaaggcttggggattttgggttagctagaatgcatagccatgatcaagttgctagcaccacaaaattggttggaacagtggggtatatggctcctgaagtgattaagactggaagagcttccactcagacagatgtttacatgtttggaatcttgattttggaggtcttgtgtggaaggagacctttagaagagggtaagtcacctctggtggagtggatttggcaactaatggtacaagggcaagttgagtgtgcacttgatgaaaggctaagggctaagggagatttcaatgtgcaagaaatggagagggtaatgcacttgggtttgttgtgtgcctaccctgaaccaaaggccagacccacaatgagacaggtggtgaatgttttagaggggaagaatgaggtagacgactcagaaattgagaatatggatacctatttgctccaacagttgaaatcaagggatatattgtctgaatattctcagtattttagctatacgtcacacccaactttccaagatattcgtcactcttcctcaatgtctcttacttggtccgaagttgagggtaggtgggaattggcagcagccgcagaatcagcacctaataagcaaagctatatattgacatcaccaagaaacgagtggcattttcacttgcaagaatgtagtgatttgtcaacaagctggtggcgtccatga

SEQ ID NO: 26509 - DNA, 1005 bp, Glycine max
  Peptide Sequence Number=SeqID_143287
atgtgggccccacacaactccagttctggtataaaacccagtgacaagcatgatccaaatgtatgtgagtcagacaaaccaactactacgttaatcataatcatgggtggaacctctgtggccgccggcagaagagtcacgaggtttttggccagtcaccaccgtgacgtcacgtgcgttgttgccgatgttgagttcgactttcttgacgatattggagaaacgttgttagctcaaagtgctagcagtgatgaaatggatcggttcgatgaagacgaggatcacagagataccgtcgaggagaatagaaccttttgggacaaccaacaccagcttttgcagaccagtatatgcagaacgagttctttggagtcacggataaggcatgccaccaaagaagcgcttcaggaaattcaaagcgcggaaactgtgtgcggttgtggcagacagatggctgtcaccagttgtcgaaactgtttgatgagagaagtttcttggcggctccagaaagcgggttataatagtgctatttgcaaaactaaatggagaagctcacccgatattccatcaggggagcacaattttttggatgtgatagacagcacaaagaaggggaaggtaagggtgattgtggagctgaatttcagaggagagtttgagatggcgaggggaagtgaagactacaaccgacttgttaggaggcttccagaggtgtttgtggggaaggtggagaggttgagcaacctaataaagatattgtgtatgggagccaaaaggtgcatgaaggaaaagaaaatgcacatggggccatggaggaagcataggtacatgcaagctaaatggttaggtccatgtgaaaggaacacttccacagcctcactttcagtgggatattctgagaggatattgccaatggctaagccaaggccaaaggcatccatgttaactgttgatctgctagagaagcttcccaatatgcattgcaatgctgttgaggttgtgtaa

SEQ ID NO: 26510 - DNA, 271 bp, Glycine max
  Peptide Sequence Number=SeqID_143288
acgggcaccacgcaccaccatctgctccgtaaacagcacccaatccagatcaagaaatccactgctcgtggtagatccagtgttggaacaaccaaatatgcggtgtggctctccagcaatcatgctccgtcacggtgggacggttgacggcggcgtagagggcgtggggtatggtggttcaggggaagggtgttgggtgcggattcttaatggaagaacagagagagagagggaaaagagctgtaacacgtgtccaagtctgatcgactaa

SEQ ID NO: 26511 - DNA, 114 bp, Glycine max
  Peptide Sequence Number=SeqID_143289
atgttgacagtaacgacactcaagcgaaggtgcaaatcatggaattctcgacctaagaggctgatgccgggtttcgaggaggagatccggtggggaggggagggctgccagtag

SEQ ID NO: 26512 - DNA, 543 bp, Glycine max
  Peptide Sequence Number=SeqID_143290
atggagaacaaccctagttcatccagagtggaaagaaaaatcattgagaggaatagaagaaatcaaatgaaagctctcttccgcgaactcaactcacttgtgcctcatcaaagttcaaaggaggccatttcactgccggatcagctagaagaagccacaaactacataaagaaattacagattaatctggagaaaatgaaggacaagaagaacatgctactaggaattgaaaggccaaatgtgagaatgaataatggtggaaggaccgtgcggttaaattctccacggattgagatccaacaaatgggttcagccttagaggttgttctaataactgggttcgattgtcagtttatgttcagtgaaaccattcgtgttcttcatgaagaaggagtagatgttgttaacgccagttataaagttattgaaggtgcagtattccattcaatacactgtcaggacagggaatctgccaacggagctgcgaggatatctgagaggctaaagaacttcatctatgattctagctatagtgctttctaa

SEQ ID NO: 26513 - DNA, 831 bp, Glycine max
  Peptide Sequence Number=SeqID_143291
atgaatgtagaaatcaaggcattaaagctaaaccatacttggattcttactgatcttcccaagcataagactactattggatgtagatgggtttataagatgaagcacgaatctgatggatcaatagaaaggaacaaagcaagattggtagctaagggctacactcaaatagaagggcatgattatttggacactttttctccagtggccaagctaactacacttagacttttattggctttagctgctatcaatcggtggcctctaaagcaattgtatgtgaataatgccttcttacatggtgacttaaatcaggaagtgtacatgaatcttcttgaaggtttgcaggtggataagccaggacagaataaaataaggttatttctaggctttgaggtagccagaacacctgcaggtattaatctctgtcaaagaaaatatgctttggatatccttaatgacagtgggatgcttggttccaaatcagtgtccattccttttgactacaccactaaattgcataaacatctaggatcttttctctcaactgatgacacatctttatacagaaggttaattggaagattgatttacttgactaatactaggcccgatattacatatgttgtacaacatatgagtcaatttgttgctcaacctacttctgctcaccaacaggctgcctcaagaatccttagatacatcaaaggatctctaggtgcagggatctttttacctgttgatagtaatatccatttgaaaggtttcagtgattcagattggactgattgccttgacaccagaagatctatcactggttatgccatttaa

SEQ ID NO: 26514 - DNA, 609 bp, Glycine max
  Peptide Sequence Number=SeqID_143292
atgagtaccaatcgatcacatcaagatcaatccttaaatatacacaatcctttctatcttcatccaagagaaaatcctgtgattgcgctagtttctccggtgactgattcatcaaattacaattcatggagtctttcaatgctcattgcattgagtacgaagaacaaggttgagtttgtcgatagatcaattaagagatatgcatcaaatcatgcacttcacacagtgatgatggatccattacctagcatagcaaaggtcttctcatatgttgttcaacaagaaaggcagatcaataatagtgatctgatgggaaacactagtctcatcaatgcagcaggctcactttcatcgaaatcatgtacctactgtggaaaaatggttttcctccaaattatacttctagaggaggaggaagtagccaatgaagctttgataaagggagttttgatgggaaatgaagcaagatatcctcctggacacaagctttacaggcctcaaggatcaaatgttaacaatgttaatgttgtgaaagaaaaaggtgatggccttgttctggaaagaagtcaagaagtacaaaatgatgaagtaaagctgacctctcaatag

SEQ ID NO: 26515 - DNA, 240 bp, Glycine max
  Peptide Sequence Number=SeqID_143293
atgatgtcgttggagaggaggaactccaggatgcagaaggagcgcactttaaggagatccttggcggcaaagatgatgattttttgctattctgaagaggaggaggagtcagagattaaagtagaagagcgaaaactagggtgcatctttcattctttcagagagaaaacgagaaagaattcgaaggccatggaaatcagcagtggtggtgaaattgttcggaaagaagatagggtttaa

SEQ ID NO: 26516 - DNA, 518 bp, Glycine max
  Peptide Sequence Number=SeqID_143294
atgcctatcttcatctcatcccttgggatctttccctcattcagaaagacgtcagacaggagcattggaggaggctctgggagaagttgtggggaagagagggagcaagcggggttgagatttgtctctgggagaagggtgaaagaagaaacctttctctttgatggctttgtcttcagcttcggaatcgatggcggcgttggatcggtcgaaagggtcgggaatgagaggcgtgacggggctgagaacgagtgcggggaagtcgaggatgctgggggagaggatgtcgggttttcggggggaattagtgttgtggttcgagaaaaacgaggtgagggggttgatgttcttgagttcgaaggtttcgaggagccgccggcggctgcttgtttcgctgtctccgaggagccggttagcatttggactacttgcttgaaggaggatgtgtcagcttggacgaacgttgtcgggtatgggttcgctggttcggatctcgtcatcatggccttcgccgtagt

SEQ ID NO: 26517 - DNA, 264 bp, Glycine max
  Peptide Sequence Number=SeqID_143295
atggaggaggacgagaaggatctggaccaaagcatcgggcgcgaatgcttagcggaggcacgcggcaaagttggggattcaaagggtttgaaattggaggtggatgaaaccagttttgattttgaaacctctatgagattgaatgtgagagttgaaagcctccttgaggagttcctgaaggagaagagagagaagctgagagtaaggaaacatttcttgaaggagaagagagagaagatgagagtaaggaaacgtttcagctga

SEQ ID NO: 26518 - DNA, 219 bp, Glycine max
  Peptide Sequence Number=SeqID_143296
atgcacgaaacacaatgtggaccactacgggtacatagaatgaatcgaaaagcttggttcgagcaaaataggggaggtggttgccgcccagctcgcccaggcgagctcagctcgcccaggcgagcagggttgcttcctccagaagcaaccgccttctggaggaatattccggagggcccaagtgggcctgggtgctatttgcacccccatttttactaa

SEQ ID NO: 26519 - DNA, 732 bp, Glycine max
  Peptide Sequence Number=SeqID_143297
atggattcctgcatgaatggtggtctattttctatgaggtatttacctctaggcaagggaaggaccaagagaccgggcaagggtcctctagtcccaatgatgacacaaaacgcaaggaatgatgctcctcctaaaatccctcaaatatcaatgagtgagcacagaactccacaatttcaagtcaactccagctttaacaacatgatgactcaaccagccgtttgtgtaattccttcaataatgtacaataaagaagagcgtcttggatatctgcccgaaaatgttgaaccaagtttgcatgatgttataaatagtaacctgacgttcttgtcagggactagttcaaattatccactgcaagatgtagtaggcaagcaggcccagaagcaagtctttaaggatagtggaattggcatgagtgtggagagggatatacctagggacccactggatgtaatgcaaaaatcaatgcttcctttagatggacttcatgaaacaaaagccaatgaagctctcaatatagtaccactaaatggatggccaataaataaccaagtactaacttcatctttgcaaccaccaaattgtcgacagaagtgtcaaatgttgaaaacgcaaaatcaggatgcaatccttgctcaagcaattgcagatgataaaccaaatgattacaactgtagaacatcaacaccagcaggatcaacaaattcaggcgcaatcccagaatgttga

SEQ ID NO: 26520 - DNA, 324 bp, Glycine max
  Peptide Sequence Number=SeqID_143298
atgggacccacatacagtgatatggggtgcaaactagcccttgaagacaaaaaaagagtcgcatttaggaggaggcagaggcatgaacatgttgatgcaacaaggcatgccaaaccttgcaattgttcaagtttggcctctcagcaacaaaaagcctgtgtttgttgtttcatcaagctaccatgcagaatctgtcatcaagcactgaggtgtgcccggaaatgggcatgttatgtgtcataccctaatttcgtccggggacctttgctcgatgacgtgcgaccattctttggtcctcgtgaggtgcttggcacccatcattag

SEQ ID NO: 26521 - DNA, 306 bp, Glycine max
  Peptide Sequence Number=SeqID_143299
atggtttcttccaacaacattgttgagcagctaagagaggagattcccgtgaagcaacaatctctgactttgtctggagatatcaaaaccggcctcatactcgtcgacgttgtcaatggcttctgctccattggagctggcaatttggcgccgaaagaaccagatgagcgaatttctcagatggtgaaggaatctgtgaggctttccaaagcattctctctgagagaaagttgccaatttttgctttccttgattcccatcaccccaacaaacccgaacccccttatccacctcactgtcttatag

SEQ ID NO: 26522 - DNA, 942 bp, Glycine max
  Peptide Sequence Number=SeqID_143300
atggagcaaggagtcgaagaaggaggtggcatgaataagatacctcgggattcaagagtgaaggagataagacaaggtgatgcacaaattcaggttcaggctcctcagcaaccccaaaagtgtcctcgatgcgactctctcaacaccaaattttgctattacaacaactatagcctctcacagcctcgttacttttgcaaaacatgcaggaggtactggactcaaggtggaaccttgaggaacgttcctgttggtgccggttgccgcaaggggaagcgcgccaagagttctaactcatcttcttcggagaatatgaattcttcttccagatcactgcctcaacaacaacaacaaccgcaaggggtggtggttcaaactcaagcaccacccttaacaacggtggtgaaggccaaagacccttcttccgttgtggcttcaaccttttaccaaagtggtgggtacttgtcttctttggctgctatgcattcactcaactcatcatcacacccttttgatcactctctaaattttgcgggtagtgacaccttgcgttcttccaatttgggccttctatctggtttcaatgttcagcgcccaattgggccaattcgtccaccgcacttgtatcatcaaatggggagtggtgaaagggagatggtgtctctgtatgaacaaggtttggtcaatccatcttcatccagcatggctaatactgatactaatagcagtggtgtttctcagcatgattggcctatgagtttcatcaataacaataacaataatgctagtaatagagcctctgatgcctctttgtggagcaccatcagcaccactgttggtggtaacgctgagaggactagtcctagtggtgttggtgctggttcttcttctttcgtcaaaaatcaatggcctaatcttccagggtatggccctccaccgtga

SEQ ID NO: 26523 - DNA, 519 bp, Glycine max
  Peptide Sequence Number=SeqID_143301
atgtggagaagtgcagaagaagaagaaggaagaagagacggaagaaccgattggatatatgattctgcggaggcagatgaaatgacagagagggcaaaagaaacgatgattgaaggctatgacagggccaaggatcaagagcgagaagccaaagacagaaccaaggaatacacacacgacgcaaaggataagaccgaagagtatgcttatgacacaaaagagagtgacaaggacgatgcaggaaaggtggtggacaggagtagggaaggggcggagaggacgaaggagaagacggaggaggtggcggtctcggcgggggagacgctgaggaacgtgggggagaaggcgaagcagggcatgcaaggggcgtgggagacggcgaaggacaccacgcagaagatcaaggagacggtggttggtaaggatgatgatgatgatggtcgtggtgttctcaaggatgaggatgttgtggagatgaagagaagagttggtaagagttatggtgagaagggttattag

SEQ ID NO: 26524 - DNA, 306 bp, Glycine max
  Peptide Sequence Number=SeqID_143302
atgaattacaagcaacctcaggatttaagagtgaaggagagatgcaacatggggatgcaaaggattctcagcaaccccaaaaatgtccccgctgctattacaacaaccatagctgtcacagcctcgttagtcgttatttttgcaaatcatgcaggaggtactggactcaagtggaaccataaggaacaaatgcagttgaaggaaatgtctgagagggccaaaataacgatgagcgaaagcatggacagggccaaagggcaagcacaagaagtgaaagaaagcataaagatgatgttgtggagttga

SEQ ID NO: 26525 - DNA, 420 bp, Glycine max
  Peptide Sequence Number=SeqID_143303
atgagagtggatgcaaatacatggctacacaaatacgcacctttgcgggttcccgaaccctatccttacagcagaggctacgtaaagtccgtgggcgaggccacggtgaacctggagaaggataacactttcttctccaagttggaccaagagtcgaagccggtcataagagatgacactgaagaaatttctgccgagagaattgttgatcgggtggtttcaaagttcgagagagttgaaggcatagacctttcaaaagacaaagaagctcttgtgtgcatcactaaggaagcccggaatgcaatcaggaacctctcattcttgacttgtgcacccatcaggacagcagtagaaaatatattgaagaaagcaaaactccaagttggggatgattacgcggttgaactccgtagtgtataa

SEQ ID NO: 26526 - DNA, 153 bp, Glycine max
  Peptide Sequence Number=SeqID_143304
atgtcttcctacgcgggaaaatctatggaaccgatcgatcgagcatcagaattctttttcagtttcatgaatgaaattgatcctcaacatcaattgcgggttgccatgacgatttggagaggaaatgaaatgctatgggaaggtaagaactaa

SEQ ID NO: 26527 - DNA, 165 bp, Glycine max
  Peptide Sequence Number=SeqID_143305
gtagagggtgaaaaggtcattttcaacaagaacaaaattaagaaaagtttgtctatatatgacttgtgtaaatgtgccggtagagcaaaacagcagcaatctacattagtagcacatagcatgtcacaagtggatcacaacaaggatattcatgtgtatgaatag

SEQ ID NO: 26528 - DNA, 207 bp, Glycine max
  Peptide Sequence Number=SeqID_143306
atgatagaggtgttgttgccagatgcgaccatggccggaggtgttgacgtggtgacgcgaagtgaaggtgagaccagacgaaggtattgcaacacgaaggtgttgtggtggtggctagaggtgttgacgccgacaaaggtgacgcgagacgaatgggccatggcggagaggaagaagatagataggagcagagggggaagcttctag

SEQ ID NO: 26529 - DNA, 498 bp, Glycine max
  Peptide Sequence Number=SeqID_143307
atgatccatcctccatttcaaaagtttaacgggtgttacaaacaagcagataaacataggagaagtggaagttcagagaaggatgttttggctgatgctcatatgatttactcacaagatacagaatttatgtcaaagtgttcaaaaagaacaaaggtttctgcttctggaaattactcatcgtcttctaacccagagacacccgttgaagtcaaagaatgtgatacgtcatcgccaatgtctcgcccaattggacaaaaagcagcaaaaaggaaaagcaaaggaaaagaatctcgtaacactcttgatttatttggcatagaaagtgtaatgaaggacaaaaatatgaacacatcaaaacttattcagttaaagaaagcacatgaatggcgtatggagtatgaaatcctcatgaaggatacatccaacatgtctgaacaacaatgcaaagaccacgaaaagtattgtgaccatattaggaaaaaactaggatattaa

SEQ ID NO: 26530 - DNA, 537 bp, Glycine max
  Peptide Sequence Number=SeqID_143308
atggatccaaccatcaatttagatgaagttttagatcaaatgatagatgaggaattggaagacaacaccgatgaagaaatcattaggttgatacttgagagccaacaacaactacatggcaacaccactaggcatagccaaagaagaagagtggtacatcataatcgtgaagaaggtcatgatcgattgttcaatgactatttttcaaaaaatcctgtgtacacagagattcaattccagagaaggtttctggaattcttggagcgatttgtattaggcatctgcaccatatttgggaatgagtacttgaggagaccaaataacaaaggcaccgaacgcctactacaaatgggagcggcacgcggatttccaagtatgttaggttccattgattgtatgcactgggaatggaaaaattgtccagttgcttggaaagaccatctcaatgccacaaggagaaaagcgaaacttatttgcataacaacaagaatcggcaagaaaggatgtagaacgggcgtttggacgatatgcatatga

SEQ ID NO: 26531 - DNA, 257 bp, Glycine max
  Peptide Sequence Number=SeqID_143309
gagaaaagagggaggtggttgccacccagctcgcccaggcgagctcacctcacccaagcgaggtgggttgcttccaccagaaggcaccgccttctgttgaaaccccctggaagattgtgcaacaatgtttcttttcgacttccggaatgtcgtggaactttacggattacctaacggtgggtgttaagtacctcaaggcggtcaagcgaaggttggatgccaccaaacaatggtccctggacgaaattagggtatga

SEQ ID NO: 26532 - DNA, 615 bp, Glycine max
  Peptide Sequence Number=SeqID_143310
atggtgaaggatttaatgccatttttttctttatttaaggtacttgaaaatccaccaggtgttttcaaagcaaagcatcaacgcatatccaaaggagcatggacattctcaatgcagaatcggggttggcaagtctctagctatcttttatcccaagatatactagtttgtatagaacaagatcatttacgtgagctaaaaatgctaaacatttacgcttttcaagattggttgttagggaatttgctatacctatggcacctgcttcctaatggaggatggggtgagagttacttgtcaagccaaagcaagggagatctttatgaaagggatggaattgttttggataagagcaaaagggataaaagcagagtttcaaacccattaatgaaacgggcactgctaactacaactgctgaggataaaatgcaaaagtatggtcggtccaaagttggatctcgtgtggttccatatcatgaagatcagagtgaagactcagttcttgtcagttttgtctctaaagatctccaaaggaatggcaaagagagtgaagattcagaagcagcagtcaagtctactcaatctactgtagttgctggaaggaaggttggttaa

SEQ ID NO: 26533 - DNA, 501 bp, Glycine max
  Peptide Sequence Number=SeqID_143311
atgaaggccgatatggaagccatgaaggagcatatgacaatgatgatggaaacaatgatgaacatgaacaagatgataaagaagttgtgtgaggatttcaagatccaacaccataatttgataccttattggcccaacatgaatgctgcagttgaggatgccaataagaatatcaaaaagatcattcaaaagatgagtgacatacaaagattggcacgagatgttgttgtttgcattgcatggacaaccccattctcattggtatatgggatggaagttgtccttcctttcgaagtagaaattccttctttgagggtactgttggaagccaagttagaggaagtagaatgggtccaagcgcattttgaccaattaaatattattgaggaaaagagattggttgctatgagtcatgggcagttgtatcatagaagaatgaagaatgctttcgacaaaagggtgtgcccatgtaaattcaatgaaggagaccttgttttgtag

SEQ ID NO: 26534 - DNA, 141 bp, Glycine max
  Peptide Sequence Number=SeqID_143312
atggtactcattgtgaattctggtgacatagaggagaatgcaaggaatgaacaaattcatggactaccagtggcaatgcatcacaaaaaggggaaaactctagatgagacttcactgtcatcaagcgagttggagatctaa

SEQ ID NO: 26535 - DNA, 135 bp, Glycine max
  Peptide Sequence Number=SeqID_143313
atgtatcgtgggccccgtggctcgttcggtgtagaaggtcaatcgaaagtcggcccgtctgggtgcgatcataccagcactaatgcaccggatcccatcagaactccgcagttaagcgtgcttgggcgagagtag

SEQ ID NO: 26536 - DNA, 294 bp, Glycine max
  Peptide Sequence Number=SeqID_143314
atgacgctgcttgctctcggaatcaaccacaaaaccgcacctgttgcgctgcgcgaacgtgtttcgttcacgccagacacgctggaccaggcgctgaacagcttgctgtctcagccgatggtgcagagcggggtggtgctttctacctgtaaccggacggaactctacctcagcgtagagcagcagaccgatctgcaggagcagctggtgcgctggttgtgcgagtatcacgacttacgtgaagaggacgtgcgcaacagcctttactggcatggatgcttaggagggtcatga

SEQ ID NO: 26537 - DNA, 309 bp, Glycine max
  Peptide Sequence Number=SeqID_143315
atgcatttgcccccgcgccagctgttgcgccttttgccccttgccagcgtgttgctggctgcctgtagcatcaacaaaccccagcaaggtcccggtcccagcacgacatcgccgcagtggcagcaacatcagcaggcggtagcgaaaattacccagtaccagacgcgcggcgcgtttgcctatctgtcggataagcagaaggtttatgcccgcttcaactggcagcaaactgctgcagaccgttaccgtctgctgctgactaacccgctcggcagcacagaactgcagctcgacgcgcagggttcggtg

SEQ ID NO: 26538 - DNA, 1327 bp, Glycine max
  Peptide Sequence Number=SeqID_143316
atgcatcgccagcacgtagcgatcgcgcgaggagccgccgatgtcgttgcgctccagcgaactggtgaccggcaacacgatatccgccattttggccgccgccgtccaccagatatcttgtacgatcaccgtatccggcttctgccagccttccaccagccggttcagctgctgatggtgatggaacgggttgccgccggcccagtgcaccaggtggatatccgggtactgccgcgtctcgccgcaaaattgataggtttcgccggggtgcagcagcatgtcgcagatgcgcgccaccgggatcgccagcccggccgggttttcccctaccggcatggtcggcgcgggggtgtccacgcgcgggttgccgacgccgttcatcgagccgtggccgaacgagaagccgccgcccggcaggcccacctggcccaacatcgacgacagcgcgatcatcatccaatagggttgctcgccgcggtgcgcgcgctgtacggagtaggaacaggtgataaaactgcgcacgccgatcagctgccgcgccagcagggcgatgcgcgccgccggaatgccggtaatggcgctggcccaggccggcgttttcgccacgccgtcgctcacgccgttcagcgccagcatcagcgccacgtcggtattcggccggatcgggatccactccgcgttgacgaacccggggcagtcgtcgcgcatcgggctgatgttgacaaccggcgtgcccttgtgcgccagcttttgcagccagggtttgagcgcatgctccgccgcaccgccggaagagacctgggcatttttcagcgccagcccgccaaacgccacaaacagctcgcaatgctccaccacgcttggccaactggtgacgcgcccggtcaacggcgagaaagtgccgatcacatacggcaggaaaaactgcgccgcgccccagctgtagttgccctgctgatcgaccccgccgccgccgctgaaatagaaccgtcgcaccagcgagcgcgcatgatgcaagcgcccggccgacgaccagccataagagccggtaaacagcccggaggcgccgtagcgatcgcgcacccggcgattctcctgcgccaccaaatcgagcgccagttcccagtccacttcgacgaaatcttccctgccgcgcagcgtgcggtcgctgccctcgcgcttttgcagccacgagcggcgcaccgccggcttgcggatacgtttgtcagagtaaaccatcggtacgatggaatcgagcaacggcgaagggtcgggatcgtcggcgaagggttcacagcggataagccggccgtcttcaaccacggcg

SEQ ID NO: 26539 - DNA, 442 bp, Glycine max
  Peptide Sequence Number=SeqID_143317
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccgggtcaacttcgtggtttttgcccgttgttggcttggctagggtcggcggtgctgggttatggccccgtgctaagtttcggattggttggccccctcctcccccccgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagg

SEQ ID NO: 26540 - DNA, 126 bp, Glycine max
  Peptide Sequence Number=SeqID_143318
atggccgaaatcaaccaagggatggaggcaaatggaggatggggtgaccaccctgatcgatcgttgtcccttcccggtgctagacaagcagagaacgtcgctgcatggcagcccagtatcctttga

SEQ ID NO: 26541 - DNA, 249 bp, Glycine max
  Peptide Sequence Number=SeqID_143319
atggggctccgaaaaaggggtagagaatggagaattgcactaagcaatcactacgcatggctccaaactcgtgggtggaggacgcaggaactaaaatgcaattcatggggctccgaaaaaaggttgagaatggagaatttcactaagcaatcactacgcatgactccaaattcgtgggtggaggatgcatggaggaaaatgcaattcatgggtctccgaaaaagggttgagaatggagaattgcactaa

SEQ ID NO: 26542 - DNA, 304 bp, Glycine max
  Peptide Sequence Number=SeqID_143320
atgtgtttacaaggcaatgcccaattaattgatgatcaagaaactaataaatttgcaaagtggattctagatattggagatggagttattgggaatcaaaatgatggatatgctactgttgaaattcctgagtacctacttattactgaatataatgaccccattgatgctatagtcaaatcaacttttccaaatttatatcaacatcagagtaatcctgatttcttcaaatctagagcaatattagcttccaccaatgaaacagttgaagaggtcaatgattatatactctccttgattccag

SEQ ID NO: 26543 - DNA, 279 bp, Glycine max
  Peptide Sequence Number=SeqID_143321
atgacggaagggtgtggtgaagggttttgccttgcaaaccttcccgtttttccatgtgccggtggtcggttttggcccgtggctaggtcttggcaagcgttggttgaaattttgcccccggtcaacttcgtggttttgcccgttgttggcttggctagggtcggcggtgctgggttatggccccgtgctaagtttcggattggttggccccctcctcccccccgtgatcagttttgttgccaggattttgccaactttggcttgcgccccgttggctaa

SEQ ID NO: 26544 - DNA, 906 bp, Glycine max
  Peptide Sequence Number=SeqID_143322
atggcttctagaaagagaaagagcattggtacaaggcccacatctcagtatgacacaaggagattctcttcattagatgcttggaccagatacactgataatgttctgggaagaaacattttacctgagaggaaagtagagctatatcacactgagctagatgactttaaggccgagctggagaggcataatttccataaacacctcaccaatttagccgatgggagcatagatctggctttggtgaaagagttctatgcaaatttatacagttttgaggaccatccaccaaagcagtccagagtcagagaccatttggtgaaaattgatgctgacagtctcaacacatttttagagacacctgtgattactgaaagccatcctgggaagattctcaggaaggatctgactacactagctcaggtgtggagtgtcctctcatactccaacttggcccccatatcacatacttctaacttgaaagtggatggagctaggctcatttttggcctagtttctcacttggatatgaacataggagcgctgatctctgaccaaatgacctctatagcccagtctaacacctctagacttggcttccctgctctaatcaccgcattatgtagagccagagaggttgtctctgacagcctcacctttgagcgcctgagcccggtcattaacctggcctacatcaggaagaactgttggaaccctgaggatctaacagtctctatccgaggggctaggagggcgagggaaaggcaagctgagcttccttctacttctgcagctcctactctagcatccacttcagcagccccttctgtcccagctcaaacaaattatcagcgctttgaagccatgctacaaagcattcatcagggacaaatcattttactatag

SEQ ID NO: 26545 - DNA, 1145 bp, Glycine max
  Peptide Sequence Number=SeqID_143323
acctgcgcatcctggacgagaacctggcgggacacaacggtattgaagccgctggttggcaggtcccggcacggctctcaacgcggctcgaagccgttgcgcaacaggtgataaaggttgcgcagcatgccggccgtggcgccccagatgaagtgccggccatacggcatgccgtaatagtgacgcacccggccgtcctccagccgcgcctcgtacaaacggtgattggccggatccatcaggaacgacagcggcacttcgaacacctcggcgacttcgaacgcgtccggcgccagctggaagccgggcgtaaccaaagacacgaccgggatgatggagaatccagtggcggtcaggtacgggggcatgctgcccagcacctcgacgtggttggccggcagtccggtttcctcctgcgcctcgcgcagcgccgcggcgaccggcgtcgcatcgctggtctcgatacggccgcccggaaaactgatctggccggcatggtcgtgcaggtgcgcggcgcgctgggtcagcatgatgtgcacgccatcgtcgcgcgtcaccagcggaatcagcacggccgcgggcaccggggcgccttcgcggccgggatagcgcaggtcattgtcgcgcgacagctcgagcgtccaggtggacggctggctgagcgtgccgcgcagcaggtcgggcgtcagcaggccggccggcaccgccggcagggaatcgttggcgaccacccagggttgcgacgccgggtcgaacccgggacgcgccagcggccggcgcggccgcgcagaagacgaggaatcagacattcggcttttcaaaaagaaaaaggcaccctcgcaggtgcctttttaacccggaaacccgtgccgaacgaaaacgctggatggcgtgtgcgtccgacactggtagggccgtgtgccgataagcgatcaagccgccgaggcttgcttgctgaccagcttttccttgatacgcgccgacttgcccgagcggttgcgcaggtagtacagcttggcgcggcgcacgtcgccgcggcgcttgacttcgatgccggcgatttgcggcgagtacagctggaacgtacgttccacggcttcacccgacgaaatcttgcgcacggtgaacgcggagttcaggccgcg

SEQ ID NO: 26546 - DNA, 1311 bp, Glycine max
  Peptide Sequence Number=SeqID_143324
atgattaacggtatcggaccgggtagtttctcacagctccatctcagcagcgccagcgcacgcgtgaccagcagcacggcaagcaatgcgacccggcaaaatagtctgacggcagacgcctcggcgaaagtcacctttagcgaagccaccgacaccatctctgcggtgtaccagatgacgccggcgcgcgtcaccgccagcacgcctctttcgcctgatatgcagacgcaggcgatgggtgcgctgcgcagctcgggcgtcagcatgaacggtattggcagcgcgctgctgagcgcactgacgcagcagcgtgacgatgtcaccatcagcgtaccggccagcggcggcgcgcaaactgacacgcagagcgcgatggcgctggagattaccactcagtccggcgtaagcctgactctgcagatgacgcggcagcaggatgggcgtggcagttgcgctgaaaaccactcacgttttgacagtaaccagctggccagcgttgatctgaaaaccgacctgcgtcgcagcggcgaagtgatgcagtcgctgaatctgcatgccgacccgagctcacgctggctgggtttccataatgccgacgccagtttcaaactgacgacggacatgcgcagcctggcgcaggccagcaacgccggtcagcagcagagcgccctggcgcagtggagcgcgaaatttgatcaggccgcttcgcgcggtcacggcgatcgtgcggcgctggcactgtttaagcagggtttcgagaccttaaacagcaccagcgcggcggccggcgtggcgatgcgcaccccgcaggcgatcaccgtaggcgcgcatgcggcgcaggccggtgccatcagcggcctggcggatttctcggccagctatcaccagacggcgcgctccagcaatccgctgaagccggaagaagaagatactttcgctctggatgtggcgcagcgcagcagccagcagaagaacggcgatacgcagcgcatgacgcaggaaaccctgtttaagctgaacgccagttttcataccgcgctaagcgccagttcgccgctggcgctcaatgaaaccaaagagtcacaaaactatcactaccaccagattcacgatgaaacgcgcagtaccactgaggtgacgcaggatgcgcagggcaatctcaccgcccgtttcgcccagcagctgacgcagcaggaaacggtgaagacctatcagctggcgaagctgatcgacagtaccagcacaccgcacagtgagaagagtgaatcgacgcgccactattctccggcgatgtatctggcgcaggcgtag

SEQ ID NO: 26547 - DNA, 888 bp, Glycine max
  Peptide Sequence Number=SeqID_143325
atgatttttcgccttatcattccgctgttcaccctgctgagcctgctgctcagccccgctgtcggtttcgcccggcctgatatgacgccgctcggacccaacattgccgacaaaggctctgcctggtatcgcttcactgttaacacgtttgattccgctgacggccagcgccactacaaggtgtggacggcggtgccacgtaaaccggcaccggccataggttacgcggcgctgtatatgctggatggcaacgcggtgatgaaccatctcagcgaagcactgttgcagaagctggcagcaggcaacccgccggtgctggtggcggtaggctatcagaccccgctgccgttcgatctcgctgcgcgcacgctggattacaccccgccgcagcaggtgcaggatcgtcgcggtcggccagccggcggcagtgccgcattccgccagctgctggaacagactatcgcgccgcgtgccgaacagcatctgccgatcaatgcgcagcagcgtgcgctgtggggccactcttacggcgggctgtttgtgctggacagctacttgacctccggatttttccagcgctattttgccgcaagtccttccctgcgcggcgacgcaacgctgttgcagcaaatggcggcggtgacgcccgcatcgttcaagcagaagcagctggtgctgatggaaggcaacggcgaatcacgtcccggcgtcagcgatgtgctgagccggattcgcaccactctcgacggcatgcatgaaaaaggcctggcggctcgcttccagctgtttcccgggctcagtcacggccagatgtttccggcttcgctggaaagtgcgctgtcggctatggcggaagacggtgcgccgtcacgcgcaccggatgagtga

SEQ ID NO: 26548 - DNA, 543 bp, Glycine max
  Peptide Sequence Number=SeqID_143326
atgacgcaaatcagggctcaacaacttcagcgcgcggcggtgatcacgtctgacgcggcggcaatcgacgctgcccgccacctggcggaacaggcgagagccggggcagccgaacgcgaccaacagcgtatctatccgcgtgaactgctcgatcagttcacccagctggggctgggcagtatcagcgtgccgcgccagtttggcggcggcggtttgtcgtttggtaccgtggcggaggtgttccgtctgatctccgccagcgatccgtcgcttggccagattccgcaaaaccacttcgggctgatccagttcatcctgggggaaggcagcgtgcaacagcagcagcgcctgctcagcgcggtggtacagggccagcggctcggcaacggcggtccggaaaagaacagcaaacacacgcgtgatgtgcaggcgcagctggtgtcaggcccggaggggttacggctcagcggtgaaaagttttattcaaccggtgcactgtttgccgacattctggtgaccaccgcgcagcaggagggccagccg

SEQ ID NO: 26549 - DNA, 243 bp, Glycine max
  Peptide Sequence Number=SeqID_143327
atgtgggaatacaaaacaatgcacccagatgttaatagcaacttgtctcaaatgaaacaaatgaggttgttaccaatatattacaagcttgttgatatgtgtcgcaacctacccttcggcagaagggcgacgcgagggctcacgggtgcatcttccaagaaaggaaaatgcgcggagtcaccaccaacgtttattcgaggaaaacgtccgaaaaaccggaaagacgtggtctacgaactttaa

SEQ ID NO: 26550 - DNA, 408 bp, Glycine max
  Peptide Sequence Number=SeqID_143328
atgaggcttgatgaggttgtttttccagagccaattgtgccagttatacatgaaactgttgaagcaggtgagtcacaattgagacaagaggctgctactcctgaaaggacaacacagaccccagaagatccaccctcaccagggatggagctatcttttgctcagcaggtagcagatcctcctacaccagtacatgagagaccagctgacccttttactcccattttagagataccaaagtaccctccttcagccacacctgagcttcaattttcaaatgaggaggggggacgtattaccactcctccggggacgccaagtttggtggaagtgttgattttgagccacccgctaagccaattctcttgcttagcgagccatccactgagcgcagcagttcatggctaa

SEQ ID NO: 26551 - DNA, 258 bp, Glycine max
  Peptide Sequence Number=SeqID_143329
atgtcttggaagagggcacattacttctcaatgccacaccaagaaaaccatgattatgagggtgtcgcaacctacccttcggcgggagggcgacgcggggctcacgggtgcgtcttccaaggaaggaaaatgcacgaagtcaccaccaatgtttatttaaggaaaacgtcggaaaaaccggaaaggtgtggtctacgaactttaatcgtgaaaggttcgggggttgtttttatgcacggggaaggagagaaacgttaa

SEQ ID NO: 26552 - DNA, 159 bp, Glycine max
  Peptide Sequence Number=SeqID_143330
atgactaatgaatgtgcttattttgggtgtctggaaatgatcgtggctaaagagaaaaacaaagaagaaaaagctgaaaaaatgtttgtctctcaaagaaaatcaaaagcagaggatatacgagccattgttgaagagtttcttttgaaagtatattaa

SEQ ID NO: 26553 - DNA, 309 bp, Glycine max
  Peptide Sequence Number=SeqID_143331
atggcctcggtgtcgtctctgtcaccgccaacccctttcgtcaccgcctcctcctcccttggtaacttcgtccgcgtcttcaatgtcaattccaacaccaccattgcaacactcaaggctcctccctctgaagttgaagtttcgcaaatgcacttcgatcccaagagagaaataacagtgcaagaaacagaaattgtgtgctctaagggccctcaaacactttggtctgctaggatatcaggaaaagtcactattttagctggtaatggaaatttttgggcagttggatgtgaagatggatgtctgcag

SEQ ID NO: 26554 - DNA, 680 bp, Glycine max
  Peptide Sequence Number=SeqID_143332
atgtctctcttagtaagctatgtttatcctgtcttattagggtacgcgaaagctaatatcatattctattttaaaaatagagaagtaggtgatatcgctaaaccactaaataaacagtctattcccttaacgtttgatgatggtagtcctatttctaagtcagagatatatgctagtgtgtttagtagtatatttaaattaattgatatttatgacggttttggggttgttagaatagctattcgagcacattttgaagaaaatatccccggccctcttcaacctttaaaagaggagttgctagaggaggctctctctgaatgcattaagccatcttctggagaaatcgatatcagtaatttacctgttaaaagtcttagttctacttctcgaaagtaccctaagaatataaccgttccaaggaaatcgggcaatatatccctgaggccgttcttggtggccgatactgagaccataattaacaaaaatagtcaacatgtaccctatgcggtcggtgtcatggttgttaatccggggattcccgttagtaggcgtgaaaggatcgatacttacttcagcgaagattactcttcaagaatcttcccaacctttgaagaaaggagctgccaaatgctcaaatcatttatctttagggtcgcggctattactcgacaaaatag

SEQ ID NO: 26555 - DNA, 228 bp, Glycine max
  Peptide Sequence Number=SeqID_143333
atggatgcacaaagaaattcccaacaaaggatgtatctagtcatggatttttcttcctgcaccagcccaatcttaaatacacctagcaaaaagagcagagttttaggaagagctttaagtagacaggtttatgttgatgaggatgttgagaatgtggataatgttgttgacgagcctcatgaggagcctcaggatccaattacggaggatgtaggaggtgattcatag

SEQ ID NO: 26556 - DNA, 951 bp, Glycine max
  Peptide Sequence Number=SeqID_143334
atgtctcacctgtcagacatcaagcctgtcatgattaccaacgatgctaaagccactgcaacggtaaccaacggagaaatttatctacgcgttcgcggaaatatttacgctttcactgcagttggatgcaggcaaacgcttttctcatgggcctgtcaggataaggctatcacaacacaatataccctaaataattcgagtggcaggaaggcggcaagggaacgaatccccgggagcgtacataagtacgtgactggggtgagtgagtgcagccaacgcacctgcaacttgaagtatgacgggtataaacacaacaagatgaggtctacgatgggaagtaattcttctttttctgcccgtagaacggcactggccatggccgttgcgctgtgttgcgcctggcaatcccctgttttcgcccacggcagtgaggcgcatatggtcccgatggacaaaacgctacaggacttcggcgcggacgttcagtgggatgattacgcacagatgtttaccattgcgaaagacggtgcctttgtgaaggtcaaaccgggtgccaaaaccgccatcgtcaacggcaaaaccctcaagcttgaggtgccggtggtgatgaaaggaaagaaagcctttatttcagacagcttcatcaacgatgttttccagtccggtcttgaccagaccttccaggttgaaaaaagccctcacccgttaaacgcgctaacggcggacgaaattaagcaggccgtcgagattgtgaaaagctcagcggattttaagccgaatacccgctttaaccagattgccatcgctgagccagagaaagccaaagtgtgggactttgtgcttcacggcacgccagtggatgcccccagacaggcgacgatcgtgatgctggatggaaagcacgttatcgaaagcgtggtggatctgaaggataagagaatcctgcgctga

SEQ ID NO: 26557 - DNA, 1080 bp, Glycine max
  Peptide Sequence Number=SeqID_143335
gttgggatcaatgtgccagtacctgttccattaccgttttcctccaatgggtcaaaatcatcatttgctggtgatagtttttctggaaaagctggagtacagttttatacccaaatcaaaacagtggttcaccaatggaaggatttccctagacaagcactattccctgctacatgtccatctgagagagattcacctaggcaattgtcacaagccatgcctgtagaatctgaaagtgattcaccaacctatgaagtacaagtggccatcactgatgtggatataccgaacacaaccatgtcatctgcatctacatcaactgataaggatcacagaagccaggatgtttccctattgctgccttcagcatctgagagggatatgtcagatcgggatatttcactggtattatcacctgcattgcaaagcaatttacctagccaaggagtatctgttgccacatcacagtcatcagagaggatgtatgtctctgaaacatctcagtggaatgaaaattcgccagcaacatcaaaaagaagtgaaattattctaccaacttcagagaggagtcttgtgtctgcatctcagatgaatggaaacttatttatcccccatacgactgatactgctacagctttgaaaccagaggggatatacatgtgtacgtcacataaaactgatagcattgctcaagcatcacaagagagtagtgataacatcactccagggtctcatagaatggatactactgtgcattcaaactctgacaaggcatacatactggcagcatctcatttgaataaaagtgttggtcaaacatttgaaagaacagaccctatgtttccaacttctgagagaatatacatgccttcaacgtcatcgcacatgaatgaccaaattggctcaacatctcaaaggactgatattccaactacagagagaatttatatccctgcagcatctcatataaataaaagcattagtccagcttgtcagcttgatgatgatactttggctcctacttctgagagggtctttatgcctcctatagtaccagaatataccaccaacttcagagag

SEQ ID NO: 26558 - DNA, 297 bp, Glycine max
  Peptide Sequence Number=SeqID_143336
atggaggatattgttaattacatatgcaatgatgaagatataaaagctgtatcgtttgttggtccaattacagctggaatatatgccacagcttctgctagagggaaacgagttcagtcaaatgcaggtggcacaaatcatgtacttgtaatgcccgatgctggcttggatgcgactttagatgcccttgttcctgctggctttggtgctgcaggagagaggtgcatgacttcaagcatagctatttttgttggaggtactaaaggagttgaacctatacctaccgttcagtactaa

SEQ ID NO: 26559 - DNA, 297 bp, Glycine max
  Peptide Sequence Number=SeqID_143337
atggatgataataatgaagatgttgggaatgtgttggggtacggtcgcgtgggggtggcaacctccatgctgaaagcacaccctgaaacggatgatgcgagtgtgcagagattgatgggtgtgtgctggttggatctggacagattgggcgaaggtgagtcgaagatagtcttctccatcttcgcccaatttgaacagtcgccggtggctgttggaaaagtcgtcggtaagtgtaaaactagtcaccaaaaggacaatgatcagaagggtccaccaaggataataggtccccagtga

SEQ ID NO: 26560 - DNA, 309 bp, Glycine max
  Peptide Sequence Number=SeqID_143338
atgctcggagggtcctcgctatgcgaaggtatggaagagggtcattgtatgcagttttatcctagcaaaggcaaagaggttgtttctagatttgaatctattgggaaaaatccaagtcccacattggctagagataaggccaacataaagtatctaagtaggaggcaaccctcaccctatgaactagctcttggggttgagttaggcccaaacccacattctaagagaacccatgaccaaccggtcaccaagacacaattttaccgttgtgccaggactcgccctcacaaacatgatttaaatccatga

SEQ ID NO: 26561 - DNA, 1473 bp, Glycine max
  Peptide Sequence Number=SeqID_143339
atggagactcaaaatcaatcagatcctgcaggattaaaaaggatgcttcctccaccgcctggaagtttccaagaccgtgaagaccttattaaacatgttcgtgatttcggagctaatcaaggatatgttgtcaccatcaagaagtccagaaaggatagaagagtcatccttggctgtgacagaggaggtaaaaaggaagatgatgcatgggtacttactgtaaaaaatggagatcacaatcatgaaccgttgaaagacatgtcagaacatccttatagtcgacgtttcactgaggaagaagttagacaaatcaaacaaatgactgaagctggtataaaacctcgtcaagtgcttaaagctctcaagcatagtaatcctgaattgcagtcaacaccaaggcatttgtacaacctcaaagcaaagattcgtcagggaaatctatcagattctcagggttctgtaatcattgatgttataaatcccgcaacgcaagaagttgtatctcaagttcatttaactatatatgaagagtttaaagctgcagttagtgcagccaagcaagcttttccttcatggaaaaatactcctatcaccactcgtcaacgcattatgtttaaacttcaggagcttatccgcagagatattgataagcttgccatgaacatcaccatagaacagggcaagacattaaaaggtgcaaaaagagatgtgctttatggtttagaagtggtggagcatgtttgtgggatggcaaacctgcaaatgggggaatttgtccccaatgcctacaatgggattgatacgtactgcattagagagccccttggagtttgtgctggaatatgtgcctttaactttccagcaacgataccattgtggaaacaagaaaccaaactagcgctagatgggtcatggaaggaggcatttgtgaagcatcattcttgcaagactgacattttctggaggctgatccctatcccgaggacaagaacaacacggagggaatgtggtgaagtagaggctatctcttggacaagaaagggtagtagtgatggtgaccgattgcaattcttgaagtcagaaattagaagtaaagaggaaggaaagttgatggtggagatgcaaccaaggcttattgttttcaaaacccagatttcagaaaaagcttattacaatgaaacaataatcactgttggatccagatttgacatgaatgtgggtggaacatcaatggtgttggactctaggaattcaaacttgctgggtgagcctttatggttgaactttgatgtttcagtggttgatagcatgacaatggagccaagggagaaggaaggtggagctacccacctttggagggaccaattctttgagataggtcacttagctggaaaaactcttggatgtgcacttgacgaagcctttggaggaagcataggaagaagcaaatacagtgacaaaatcaaaacatga

SEQ ID NO: 26562 - DNA, 498 bp, Glycine max
  Peptide Sequence Number=SeqID_143340
atgtcattggcaaagatatcttgggcctttttccagaaagaacgacatgttttgaatgatctaaggatctccaaaacatctggctcaattgattgccataaaacagcagagttgataatccagcttttcccacacagagaaggagagcacaggtctagacgaagtcatttccactcaaaaaacacaaaccctagcggagaaaatgggagaagaaccaggtcgacacgttccaagtgtcaaaactggaaaatgaaggctggaatgggctcagaagggtccgacgagtcgaatggcgtcggtgtggcaggagtccgacgccgggagggtggcgcgtggcggccacgcgcgagaactagcggtggacgacgacggcgcgtgaatggccggttgaccacgcgaattgtggggttaggttacgcttctcgaggcacaccaaaccctgttgtcgtcggagaaaaacggcggcggacaggcggcgcggacagcgacgctgggtga

SEQ ID NO: 26563 - DNA, 159 bp, Glycine max
  Peptide Sequence Number=SeqID_143341
atggagagtagagaccacaagacgggaaacatgggactggaatcatggcatcctaccgtctgcatagccactgtggattgcatttcatctccatattccacaaaggcaatccctggctttgtttcaaccattctaacttccttaaatccaggatattga

SEQ ID NO: 26564 - DNA, 294 bp, Glycine max
  Peptide Sequence Number=SeqID_143342
atggatattggtaagatccttccatctagtagcaccttaggatggcataaccttaaagttaagggcaaggttcaagtgaagaaaggcttatggtggatacctaggcacccaaagatgaggaagggcatagttggcaagagacaacttggtgaactaaaatatcttagtaactgtcgcaacctgcccttcggcggaagggcgacgcggggctcacgggtgcgtcttccatgggaggaaaatgcgcggagtcggcaccaacgtttatttgaggaaaacgtcggaaaaaccgaaaag

SEQ ID NO: 26565 - DNA, 691 bp, Glycine max
  Peptide Sequence Number=SeqID_143343
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatggattggtgtcgaagccgatcaccgaccagctccccttcttcgcgaggttccgacacatcgcctcgcccatcacgccgagaccgatgaatgcgactgtcttgatgctcatgacttgccctgcctgtgtttccatcctgggcggatcaaacaagccgcggccctccgttgcaagcgcatgttcgctaagccaacagcgcgccggaccggagacgatcgaaggcgtcagcggcgagagttgcaatccgcgataaatagccgccagatccctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 26566 - DNA, 510 bp, Glycine max
  Peptide Sequence Number=SeqID_143344
atggagcagtacacctggtccagtgaaggttcgtggtctgatccgccaccagaatgggtcaggcctgaagcccaaaccaggctcgaaggttgttggagcttagaggattgtaggggagtatccgaaacgagtaggccaacttatgtgccaagaggatttgcttcttatctgttgggattaaataggacgacttatgagttgtcaggagttggaaatgaagagacaacaatagtttgtcctgtatgtgaagcaaaaaatgcaccaaattggcaaaagaaattagcagaggcacttgcaaagcatttaactagttgtgactataattctagccttcaagggtatgcacaattttattgtaagcctcactttaaggctactactagacatgaatcatattcatggactggccaagacttccttaggactcaacattgcacatgtaaagagccatttgcagagagagagagggagaaagagaaagcgaaagagtgttctaatattttggaatga

SEQ ID NO: 26567 - DNA, 1566 bp, Glycine max
  Peptide Sequence Number=SeqID_143345
atggtcgccttgctccgaaatcccgacatcaactatgtgcttgccttgcaggaagccagtgcggttgtgatgcccgatggttacgcgcaggccgccggtaagcccggttttctcaatctgcacacggccggtggtctgggacacggcatgggcaatctgcatactgcggtttgctcgcaaacgccattagtggtgacggctggccagcaggatttacgccacagcatcaccgatcccctgctgttgggggatttagtgagtatgggtaagattttttccaaatggtcgaaggaagtcaccagcgttgaccagttaccaatcctggttcgccgtgcttttcatgatgcggatgctgcgcccaaaggcccggttttcctctctttaccgatggatgtgatggaagccatgagcgccgtcaacatcggcgcgccgtctaacgttgatcgtaaagcggtcgcaggttcactgccgctgttagccaaaaaattagccgcctttactcccggcaaggtcgcgattattcccggcgatgagattcatcaaagcggcgcggcggcggaagttgtcgcactggctgagttgctggccgctgacgtttatggctcaacctggccgaatcggattccgtatcccaccgcgcatcctctgtggcgaggcaatctctctactcaggcgacggacattgccaaagcgcttgatcaatatgatggaatctttgcgctcggcggtaaatcgctcatcaccatcctctacaccgaggggcgtgccgtgccggagcattgtaaagtgttccagctctcagccgatgcaggcgatttgggacgaacttatcgtagcgagctctcaactctcggcgatattaaattatcgctggcggtgctgctacctgagctgaaagaggctaccgcgcataatcgcccggattatcagcgtcgtttcgcggctgcggcagcacagttcgaacaaactaaagagaacttattacagtcggtacaagagcagcagtcggccacgaagattacgccattgatcgccgcatttgaggccgcgcgcgctattggtccggatataaccattgttgacgaggccattgcgacctcacaatcgctgcgtagatcgctgtcgagtaacagagcagatcaatatgcttttatgcgcggtggcggtctgggctggggcatgcccgctgcagtggggtattccctcggactgggcaaagcccctgttgtctgttttgtgggggatggtgcggcaatgtattcgcctcagtcgctgtggaccgccgcccatgagcaattgccggtaacctttattgtgatgaacaatactgaatataatgttcttaagaactttatgcggtctaaagaagattatacctcggcgcaaaccaatcgctttatcgccatggatttggtagatccggtgattgattatcaggcacttggcaccgcgctggggctgaaaacgcgtaagattgaggtggcttcacagatcgctgcggctgtcgaggaggctatcgccagcggtaaacccagcctgatcgaaatcgtgattgctaagaactga

SEQ ID NO: 26568 - DNA, 495 bp, Glycine max
  Peptide Sequence Number=SeqID_143346
atgggattaagtaagctgggcgcaaccatgtacgcatcgtacagtgtggtgccgcaactggtcatgaaacacagaatgaattaccccagtattgatctgcaatttcaggaaatgatcccgaccgggttgaacgctgcgctggaggatgggcggctggacgttgcgattagcttttcggaagttaccagctccgcgattaactcgctggtgttattgcgtgaaccgttaattgttgcgcttcctgcggaccatccccaggcaaatgtcgaaaatttcaccctggaaacgctggccaatgacccgtttatcattgtgcctcgccctatgtcgccgctgctttatgacaggatttttaatcagtgcctgaaagccggttttagtccacatattggcgttgaggtttcggtccagcaaaccatcgttaatttcgtcgctcatggattagggcgctggaacactttgttaaccaatgccgtgccttcgcagaggagttaa

SEQ ID NO: 26569 - DNA, 639 bp, Glycine max
  Peptide Sequence Number=SeqID_143347
atgatgcttaccaatggtactaacaataggaggttaggaaacctaagctctcatgggaaagttttcaaagggctttactcaagcatttccagcctgaatatgacccaggcctgcatagtttgggttcaaaaaaaggaactggtatcaagggagcatgaaaacagaagaggaaacaaaggaaaaacgaccattgtgggtggctccataaaagagcatttatggaaggaacaagtggcagccgaagaggatggagttttccttctccccggctgctgtgatccattcaatgagaaagctcttcgggctagccggggtgcctcgtttcagctccctgttgtttctggcagttggaatcacctggagtcgctcaaaaaagaattccaaatgaggtttctggctggtcatccagagcatgaagggttggtcaagccagtgagttcactctctccaagcttctgtgattccttatcagatacaccattgtgcttggttttaggcagtgaaggaagtggcctttcagaaaaatccctgcagacatgtgagcttgtgagcattgcaatgactggagaatatgagtcactcaatgtttcagttgctggtggaattttcttgtacatgctccaaccaaagaatacatga

SEQ ID NO: 26570 - DNA, 282 bp, Glycine max
  Peptide Sequence Number=SeqID_143348
atgcctggtttgagctcggatatcgtgcaacataaactacccctgaatcccgagtgttccctggtaatgcaaaagctgaggagaatgaagcttgagatgtccctgaaaataaaggaagaagtgaagaagcaattcgacgctggtttcttggccattgctcagtacccagaatgggtcgccaacattgtgttgatccctaaaaaagatgggaagataaagatggcatcagaggatatggaaaaggcaaccttcatcactctatggggaactttttgctacaag

SEQ ID NO: 26571 - DNA, 162 bp, Glycine max
  Peptide Sequence Number=SeqID_143349
atgagaccttataggggtagcacccacaacaatagcagaagcatgagagcgacgataagaagaggaattgcgaagtttgaggcagtgcttcacaaatgggttcgaaacactggttatcggcttcggtttttcttcgtgagaggagtaatgagaccagattga

SEQ ID NO: 26572 - DNA, 168 bp, Glycine max
  Peptide Sequence Number=SeqID_143350
atgggtcgctggaaagcagaaaggtccaccggggaccgtaggtccccagttgagcatgggtttttgttattcctctctcaagaagaacctagctgtccccgatggagcacggggatcctggtaatcttggtacattgctcagatcagccgtggccttcagatgggtaa

SEQ ID NO: 26573 - DNA, 195 bp, Glycine max
  Peptide Sequence Number=SeqID_143351
atggagttgatggtttcattcgagttgctaaaaggagacctggaagttgcagatgaattaatgcacattccttgtccatgtgcaaaatatttgtggatgaaagatgaggggatagtgtatcagcatctgttatcccagaccgcgttgaggaaacagaaatccttatgtagacatggttatgaatgttgtttgtga

SEQ ID NO: 26574 - DNA, 111 bp, Glycine max
  Peptide Sequence Number=SeqID_143352
atggaggtgctcaagggaaccatcattgccccaaacaagattggattgaaaattgccaaaaagtacaaggaaggcatggattcgtttcaggcacataagagactaacatga

SEQ ID NO: 26575 - DNA, 135 bp, Glycine max
  Peptide Sequence Number=SeqID_143353
atggatgtaaacacggcagcagaggtcatatatgacctcgtggaccctactgctaatttaatatttggtgcagtaatagatccatcactcagtggtcaagatattgatgttttgaatggggataacatgggatga

SEQ ID NO: 26576 - DNA, 786 bp, Glycine max
  Peptide Sequence Number=SeqID_143354
atggcgagcttatggcacataatgttgaggttgattaccagcatgtcagatggttgccaagagaacgggtctgtgttcctatgtaggacatcaactatgcgtacactgcctgggtttgtgtccaagctgcaacttgatgagttcttcaataagctttgggcctctatcgaaagtgtcatcgcacagatctacatcgaatatgttgtccaggcttgcttggctttcaacgtagcaatgtcgtgcttgggtttgatctgccttgatagtcatgatctctcctgtcaaggtggggaacttcatcttcaggcacggtgtggagacgatggctctgagctcgttgagcgttttcttgccaatcataaggtcaacatagcctctggtctctactctttctcttgtgaagccaaggagtggactgacttgaggctagatgatgtcgatggagccgccctggtcgatgatgaccttggacaccatgaagttggtgattacaatggagacaaccatggcatagttgatgtcaatgtcccagatggcgtggaggtgatgcttgcaagagtagcaagaatgcccttcgtaagagaatccacccacaatggtgttgattacacatatgtttttctgggtgggcttagtttcccattcttggtggtgtctctgtcttcctcgatcttctgctttgtctcttcttctatcgacatcgtggtttctgttgtgatcctcttggtgtcctctgcatctcgctcctgctgcatgattgtctggcctcttcacgaattgggctag

SEQ ID NO: 26577 - DNA, 504 bp, Glycine max
  Peptide Sequence Number=SeqID_143355
atgaagggcaacgaggaaggaatcatcctcgaaggccttgatagtgtcgccctagagcaagccctcaagcttaacttcaaagcctcaaacaaccaagttgagtataaggcactcattgtaggcctaaagctaacaaaagaatttagagccaaaaagctaagatgctatactgactcacaaattgtccaattgcaagttgcctacagatatcatactaagaaaacaatactactcaagtactaccacattgccaaaactctaattgacgacttcaaatgctttgaaatgtattacatatccagggagagaaacaccagagtagtcctactctccaagctgaccaacaccaaaaagactgggcacctcaagactattatgcaggagacgctccaaagtcctaccatagacattgaggaagttatggccggagaagaagaggaatcagattggatgaccctacaagaatttcctaattcatggggcattgccaccaaactagaataa

SEQ ID NO: 26578 - DNA, 687 bp, Glycine max
  Peptide Sequence Number=SeqID_143356
atgtgcaccaactacaccaatctgaccaagacgtgtcccaaggatgcataccctctgcccaacatcaacaggctagtcgatggagcatccaggttccaagtactaagcttcctggatgcctactctggatataaccagatcctgatgcacgctccagacgaggagataacgacattcatcactgaagatgccaacttttgctacagggtcatgccttttggccttaaaaaagtctatgttgataacatgttcgtcaaatcccatagcatagcccaacatgtgataggcctggaagaagtatttagagaaatctgtaaatatgacatgctcctcaacccgaaaaaatgcactttcagggtcggcggaggcaagttcttcggctttatgattacacatcggggaatagaagtcaaccctgacaaatgcacaaccatacttgagatgtacaaccctaccaacatccaggaagtcctgaatttgaatggtagactagcatccctatccaggtttctcccaaagctcgccaaaaaggcgaagtcattctacaaattgctcaagaaaactgagtcattcccatgggacgagaactgtgaacaagccttcttggccttcaagaagaccattgccacaccaccagtcctgagtgacctaggccaggagtacccctactcttatctctctcggtaa

SEQ ID NO: 26579 - DNA, 345 bp, Glycine max
  Peptide Sequence Number=SeqID_143357
atgcagttttggagttgttggagaatgtcaatatccatcatggttgttggaggaggattggagtctttgaaagggatatcgcgtctgaggctagactgcatgctaaccatgggtgaaaaagggaaattgcggggtatgttttaccgtggccctacggtggacaccaaatgtacctaccaaagttcagagttggcacacgtaagggtagatgtggctaaggagagtatgagtgagcatgaaaagaatatgagggaacctggtacttatagtgtagagtggaagttacgggtccttgtttgtaagggctgttacagtgacataacaacccttgcagatagtttttga

SEQ ID NO: 26580 - DNA, 126 bp, Glycine max
  Peptide Sequence Number=SeqID_143358
atgactcgttcaagaatgaatgatgatgaagcaattcatgcaattccaatatcattttgcattcctgataactattatattgattgggatgatgacattgatagtccaacaaaagaggctaattag

SEQ ID NO: 26581 - DNA, 441 bp, Glycine max
  Peptide Sequence Number=SeqID_143359
atggtggatattgatgtttctgagcatcagattgccaaggaaatcactgccaaacaagtccagcattggccgaagaaagggaagctttcagcagggaagctaagtgtgaagtatgcatctctgcgggaggattggagctgcaaactgggttcccaccaatcatacttccactgttgccacagagagaatctcctctatccctgcattacaaactgtttgagggggacacatgtcccagacattgtctcgacatcagggaaagctgctgcttcaggtgctgtgtccaaggatgctctgattgctgaactcaaggacacatgcaaggtgctggaggcaaccatcaaagcccccacagagaagaaaatggagctggaacgcctgatcaaaagactctcagacaatggcgttgatttctccccaaccccccgaggccgaagctga

SEQ ID NO: 26582 - DNA, 285 bp, Glycine max
  Peptide Sequence Number=SeqID_143360
atgacaagcagagaccaagtttggtcattctgcacccttgtatcatccagaggcggcgggcccgatgatacgcggaaatacccgagtgagactgacatagtcttctgcaccttttgttcctccgggaacaacaagtcatttacatgcggaaatttcatggtcgcccgcgactctcgtcaaccgagaggagccaaattagtgtcatacactgattttcggggacctttgcttgatgacatgcgaccattctttggtccttgtgaggtgcttggcacccatcattag

SEQ ID NO: 26583 - DNA, 156 bp, Glycine max
  Peptide Sequence Number=SeqID_143361
atgtccaaatcttttgaatttgggatgaccggctctctcgatgagtcgatctcttgctttctcataaggatggaccctcgggtactagtaccctggtcttcagagaactacactcctcgccaacagagggttgcacgccctcaccttaagaggact

SEQ ID NO: 26584 - DNA, 334 bp, Glycine max
  Peptide Sequence Number=SeqID_143362
ggccttttctctccagaagcttccccaacaacacatcgcaacaacaacaaaaaccctctcctcctctcaaacacaaatccctcctcatcaacatgacgcaacaccaacaatgtcctcctcatcaacaatgcctctctcgtcggaccctctcttcctatgcgccgatgaggctgccattgtcggactcctcgacgttgagccacaccacatgccagaaaaggactacctccgtcgttgtcgtgatcgctcaatcaatgccaccgctgtcggaaaagggagtgcttttgcacctggacttttcgctgtcaaggtagtttcgccgaaaaactcataa

SEQ ID NO: 26585 - DNA, 426 bp, Glycine max
  Peptide Sequence Number=SeqID_143363
atggatcagttcttccaggacacagagatcatagagcagattgaccgagatgtcaagcgtactcatccagatatagacttcttctctggtgattctcattttgcaaaatctaatcaggaggctttaaagaccatattaattatttttgcaaagttgaactcaggtataagatatgttcaagggatgaatgaagtattggctcctctcttctatgtgttcaaaaatgaccctgacgaggaaaatgcagcctttgctgaagcagacacattcttttgttttgttgagctattgagtgggttccaagataatttttgtcaacaacttgataatagtatttgtggaatccgttccactattacaagattgtcccagcttttaaaagaacatgatgaagaactgtggcgtcatcttgaggtcactactgag

SEQ ID NO: 26586 - DNA, 501 bp, Glycine max
  Peptide Sequence Number=SeqID_143364
atgaatgtaggagctctcatctctggccagatcacatctatggctcagtctaactcctctacacttgggttccctgctcttatcacaactctatgtaggtccagaggggttgcttctaacagcctagtcttcgaacgcttgagcccggttattaacttggcctatatcaggaagaactgttggatccctactgatctggcagttactattagaggggctaggagagcaagggcaaggccagctaaggctctttccacatctgcaactcctcctctagcacgtacctcagcagctccttctaccccatcttctacagactttcaacgtcttgaagccatgtgtcatacccaaatttcgtccggggattattatttgatgacatgcaacctttggttagccgctttgagatacttggcgtcctttgttgcacaaaaaatgaagtcccgagacgtgtcagaaataaaaaggaagcaggcttacgcgatccgtgaaattccataa

SEQ ID NO: 26587 - DNA, 277 bp, Glycine max
  Peptide Sequence Number=SeqID_143365
atggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgagcttatcaacaaaaaagaataaacttcgatagtcctttgtggctccggtggcgactagatcaacgcattatttcgtcaagagaagttcctatcgaagttcactatgaatctttag

SEQ ID NO: 26588 - DNA, 540 bp, Glycine max
  Peptide Sequence Number=SeqID_143366
atgaccgcgatgtccaagttaaacccgattctggcttcctcggcgcacagcgccgaggcttaccgccaggcgatcgcgcagagcagtgaagccgtcgtgcaatggctgcaacagcccgagatgtatcagggcaaaagcgttgccgaactgcgcgagcgcatcaagctcgacttcaccccgcaaggcctgggcaaccaggcggcgatcgatcgcgccatcgagtactttttgaaagacagcctgtcggtgcaccacccgcagtgcgtggcgcacctgcactgcccgagcctggtgataagccaggccgccgaagtgctgatcaacgccaccaaccagagcatggattcctgggatcagagcccgtcggccacgctgatcgaaatgaagctgatcgaatggctgcgcgcccaggttggttaccagcccggcgacgccggggtgttcaccagcggcggcacccagagcaacctgatggggctgatgctggcgcgcgatgcattcttcgcgcgtcagggccactccgtgcagcaagacggcctg

SEQ ID NO: 26589 - DNA, 261 bp, Glycine max
  Peptide Sequence Number=SeqID_143367
atgaaagaagtagccgagtcattgaaagaatttgttgaagtgactaagaagaagatggagaacaggaaaaagatggagataaaagaagctcaagaagtggtacatgaagtggtgagtgagctagataatatacctaattttaatggtgcacttagacatagagcaattgattggttgacagaaaatcccattaagtttgcgattataaaagctcttccattggatgagaaagaggattacatcttatcttttatgccttga

SEQ ID NO: 26590 - DNA, 1321 bp, Glycine max
  Peptide Sequence Number=SeqID_143368
aatggtgtggttgaaaggtggaattgtactctgaaggatatggttagggttcctagtaaggcagttcctaagaccccttatgaattatggacaggaaggaaacctaatttaaggcatctccatgtttggggttgtctgacaaaagtaaaggtgcataatccacatgaaaggaagcttgatgcaagaaccgttagtggtttcttcattgggtatcttgaaaagtctaaaggttacatattctattgtcctaatcatattacaagaatagttgagtctggtaatgttagtttcattgataatgacaatgagcaagtcacaaatgaacaagagatagaagaggcacaagaaatagcaccaaggaggtttgaaaggaaaaagaggccagctatttcaagtgattatgttgtgtattcacttgagcatgaatgtgaattgagcattgatgaagatccagtctcatttagacaagccatggaaggtgactattttgaaaagtggctcaatgcgatgaaagaaaagttaaaatcgatggatgacaataaagtatgggatctagttgaatttcctgaagattgcattgactacaaagagaccttttctctggtttctaagaaggactttttgagaattatattggctttggtggctcattatgatttaaagcttcaccagatggatgtaaagaccacctttctaaatggtgacttacaggaaaaggtttatattaaccaacctaaagggagtggtgccatggaaagtgcaaaacaatctgtgattgttacttctaccatggaggttgagtttgtagcatgctttgaggccaatattcaagcattgtggttgcagaactttacttcagggtttggtattatcgacagtatagccagaccgttgaggatttattgtgataactctacaattgtcttcttctctaaggatgacaaatactctaaaggagcaaaatatgtggatttaaagtatttgtcaattaaaaaagaagtgcagaaacataaagtgttaattgagcatattggtacaaacttaatgatagcaaatccgttgactaaaggtttaccacccaagatatttgttggccatgttgaaaggatgggtgttgtggataagtctttgttaacgatctccttcattttcttgcaacagcttctttcgaaatccttcgttctctctcttgctacagcttttgccggaaacctccgcacttgtttagctgccggcggtggtttctgctgccggtggtggtttctggtgactgcatcggtggtttctggtgactgcatcggaaaggaagaagaaaaagaag

SEQ ID NO: 26591 - DNA, 728 bp, Glycine max
  Peptide Sequence Number=SeqID_143369
atgggtgaagtagaggaggtgcaagagcagatgaaggccaacacggaggccttgaaagagcaaatggccactatgatggaggccatgatgagcataaaggaggtcaatgtggctgcaatagcctctaccagcaccattgctgaggtgggcctgagcgccctatctggcctcaaccaaatgaatcatccaacctcagatatggtaggaaaagatttaggaagtacgggcggcccccatgatgtgaaaattcaaaacgagcacgccttctcgccatatggcttgcctcccaactatacaccatccaatgtggcatacactcccagtgaggatgtcaataactctactcccatactcattgaaagccaacaacctcaatctgatcatgcacatgtctctcaacctatgggggagacacatgaaatgccccaccacaatctagctgacttcgagccttgcctcggatatgccactgaagggcaagcagttgatggtgtaccccggcaaaacactttggagggccctcagtatcacccacaaccacaccccttgcattacacactgggaaaaaaccctcatgctatggcagaaatgggagagttggatcatctagaggaaaggctcagggacattgaaggaggtgaagattatgcctttgctaacctagaagagttgttcctagtacccaatatcatcacccctcccaagttcacggtgttggactttgacaa

SEQ ID NO: 26592 - DNA, 369 bp, Glycine max
  Peptide Sequence Number=SeqID_143370
ggtccagcggctggaagagcaccgcacgtcgcgtggtgtccggtgcgcccccggcggcccttgaaaatccggaggaccgagtgcctcccacgcccggtcgtactcataaccgcatcaggtctccaaggtgaacagcctctggtcgatggaacaattcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaag

SEQ ID NO: 26593 - DNA, 786 bp, Glycine max
  Peptide Sequence Number=SeqID_143371
atgcaaggaagttggcgaactgaaaagcgcccattacaaaggggccgccctatgaaaaccatcctgaagtggccgggcagcaaagccggcgtaatgactgagctggcggctcacctgccagccggcgatcgtctggtcgagccgtttgccggttcctgcgcagtaatgatgaatactgattacccggaatatctggtcgctgacattaaccccgatttaatcaacctgtaccagcaggtaaaagagcacgcgcgcccgtttatcgtgctcgcagcgtcgctttttaatcagaacacgagcgaggaaagctattaccggctgcgtgatgaattcaacaatagcgcctcaatgccactgcttgagcgcgcggcgcactttctctatctgaaccgccacggataccgcggaatttgtcgctataaccgccgcggcggattcaacgttccttacggaaattacgctaagccttatttcccccttgctgaaatcgaggcgtttgccgtgaaggctcagcgcgcgactttcatctgtgccggttatcaggaaacgctgaccatgattaaaggcggcgacgtggtgtattgcgatccaccttattacggcacgtttgccgattatcacaccgccggctttgacgacgatgatcaatgttcgctggtctgctacctgctgggcattgctgaccgcaatcctgttgtcctgtccaacagcgacactctgtttacccgaagcatcctgcgtgatttcaccatcaccagaatcaacacagcccgctcaatggcgtag

SEQ ID NO: 26594 - DNA, 637 bp, Glycine max
  Peptide Sequence Number=SeqID_143372
atgctgaaaaatctgcacgtgattaccggtattatctttgccctcaccatattctgtctgctgcaagttgtcacgggagggttgttctactccgccgtcagcaacgatcgccataacttccagaactccggcgtgctcaatgcccagcaggaaaatctgagcgacagcgtaaacacgctggtaaaaacgcgcgtcaccgtgacccgcgtggcgatccgctacctgaaaaaccagcgcgatccggcttcccttgccgcgatcaacaaactgcttgataccgcaagtaactcgctggctaaagcagaaacctataacaaacagtggcaggccctgccgcaggttaacggccagaatgcggcgctaaccgacgagatgctgaaatcctggaatcagatgcatgaagtgatgcgtctgtcgattgagtatctgcgtgccgacaactaccaggcctatggcgatctggatgcgcagcaggcgcaggacgctatgaaagcggtctataaccgctggcgtgccgagaacaataccctgctgaaagccgctaccgaagagaaccagagcagctttacccagatgcagtggacgctggcggcaattttcctggccgttatcgccgcgctggtggtgatctggcagg

SEQ ID NO: 26595 - DNA, 258 bp, Glycine max
  Peptide Sequence Number=SeqID_143373
atgaggatcaagaggtcttttaaggttgtaatggggccaaggacaaggcttgtagtgagcttcaaaacaaggaaagggaaacaaggctcaaaagggctatcaaaggaattaattcaaggtaagtccatttggctagaagcttataagaacaaaattgcctcaatcatttccaaatatgcatgtgaattaggacgcatcaacaagaatcaagccaaggctattgtgcaagcaatcaatggggcaaaacacaccaaatga

SEQ ID NO: 26596 - DNA, 708 bp, Glycine max
  Peptide Sequence Number=SeqID_143374
atgtcctcaccttcagaagaatacacgtcctcaccttcagaggactatacgtactcgcctcagaggacttcacgtcctcatcttcagaggactacacgtcctcgacttcagagggctacacgtcctcgccttcagaggactacatgtcctcaccttcagaggagtacatgtactcgccttcagagggccacacgtcgtcgccttcagaggactacacgtcctgaccttcagaggactacacaccttgccatcagaggactacacgtcctcaccttcagagggctacatgtcctctccttcagagagctacacggcctcgccttcagaggactacacgtcctcaccttaagaggactacacgttccaactatcagaggactacacatcctcaactttagaggactacacatccacgacttcagagggctacacatcctcaccttcagaggactgcatgccctcaccttcgaaggactgcacatcctcacctttagaggactacacgtcctcaccttcagagggctacacgccctcgccttcaaaggactacacatcctcggtataaaaggtcgcataccctcaccttcagagggatgcacgcactcgccttcagacgactacacgtcctcgtctttagagggctcctcgtcctcgccttcagaggactacacatcctcgccatcagagggctacacgccctcaccttaa

SEQ ID NO: 26597 - DNA, 216 bp, Glycine max
  Peptide Sequence Number=SeqID_143375
atgtcggagctaagagaaatacccttcgcaccgtacctttctcttttcccgcagaaacgcaaaacggtctcagtaaaactacaatcccgggagaaaaatgaatcacatgaagacagtacaaatggagacttcaatctcttctccgtctctctaacgtttgggaactctatcagagcagttggaggaaaaactgaaagaatcttaggaaaccgctag

SEQ ID NO: 26598 - DNA, 279 bp, Glycine max
  Peptide Sequence Number=SeqID_143376
atggtccatgacatctttgtcaaggtgaaactggaagtaacaaggacatcaacaatcctaaatatgtttggcagtagacgaagcagtgatgtgactcaattcatctttgccccaatttgcaggacgaaatgggtttatgatcccaacattgttggctcatggtgcctaacacatgcaactaagaaggaaaacgcaaggatgagcaaacatgaaaacaaatggtatgcaattttgcagatcaaaaagtttgttgaacgcatatgcatgatgatgccatga

SEQ ID NO: 26599 - DNA, 267 bp, Glycine max
  Peptide Sequence Number=SeqID_143377
atgatgcatgcacctgacctcaactctcagatgcaatgcggtacgtaccgtatccaataccaaggaaatagccctaagcgtgtctacacgacacctcacttaggaaaccatgaagtatttgtcgaggccacccagtcgtccactgtaactccccccctaggtgatcaacctgggcccacaaggagttccctaccaggtgacacaccccctagtacaaagtacatactgccacagtgtatactatttcccatgtcatatgaggtatga

SEQ ID NO: 26600 - DNA, 578 bp, Glycine max
  Peptide Sequence Number=SeqID_143378
atgacccgcacatctttaacagcatcaagtgaaatgaaaaatcccatgatcggaccgccattgatcattcagtttatcgctgccttcaacaacgacaaaaataccatacagcttccagcgttctaccatacacaatgggcaccacagtatcccgagtttgttcatatgagatacaatggagccatctacgaaatacgggtcagacaacacaaagaaaaagtgtatttagcagatggactcgaaaacttcaggaaagatttgaaaatctacgagtcaaccaccatcaacttttttgcctgtgaccatcactttgtatttgacatacatttcataccaccactggagcggcaaacttgtggcaggcagaggcattcatccagaaagcatatctggactcttcgacttactcagcaaatgctggattctcctgaacccctgaaacgcccccgttgtacagaagttcctcttaaagcttgcggtaatcacatgacactcttaaggcgacatggccccccattgcaatggaaagttgaaaccctgaatcctgctattggtggaaaaggcgttctccaaccatg

SEQ ID NO: 26601 - DNA, 1452 bp, Glycine max
  Peptide Sequence Number=SeqID_143379
atgatttcccagcgtatccgcgaagaggtgaacaaactttccggcatcgataccgggctgatttgcacgcttgccgaaaaactgctgaccaccaccgccaaagatatccggattgccacctgttactgctgggcgcgtctgcaccaggacggagaaaccggctttgccgaagggcttgagctgctggcaggattgctgcagcgctatagcgctcagcttcatccacagcgcgagcggagccgtaaaccggcgctggagtggctcgcaggctcccgtgtgctcgacagcctgtcactctggccggaggtggtgcgtgaggatgccctgcgcacggccggtgcgctgctgctgatttgcgacagcctggagacagagccggaagcgtcacgtccggagatgactgccctgtacagcgcgctggtatcccgcctgatgaaagccggtggcgtggatgccgtggtaccgcagaacgccggtcacagggtgcagtcacagacatcacacacaaccgggcctgacgcgccggtactgagccgcattacgtccggtcaggatttactggctcaggcccgaaccctgacggagtatctgcgtgaacaacccgatggctggcttgccgcacaccggctgatgaaaagtctgcgccatgacacgctgagagcgatcccggcgccggatgccgaagggaaaacgcgcatcgcaccgccgcgggctgacgagcgggccatgctcaaacgtctgtacctgcagcagagctggctggagatactggagcaggcggacagcactttctcgcgtggtgccaaccacctctggctggatctgcagtggtatatccatcaggcgctggtgaagttggggcaggatgtgctggccgacatcatcaccgccgacctgaaagggctgctgcgccgccttaccggactggaaaccctggcttttaatgacgggacgccatttgccgatgaggtcacgctgaactggattaatcagagcgtactggacgatatgtccggctggcgggatgagccggtctgtgccggcaatggggaggataacgatatcctgaccctcgagcctgaagcgctggagaaagcggacacggacggtctggacgcggcactccactggctgcagacccgcccgggcaccgacgccacaaaagacaaatggctgctgcgcctgctgatggcgcgtatagccgagcagaagggcaaaaatgaacttgccctccatcttctgggcgagctggacagtacagcacagtcaatcaccctcacgcagtggacaccggcgctgttgtttgaagtcaaatcccgccgactcagactgctgcgcatgaaagcctcgcgcagcgaaaccgacagatcacggcttcagcctgagatggatttgcttctgtccggtctgattgcgctcgatccggcaagcagtgcggtgctttgcgggtaa

SEQ ID NO: 26602 - DNA, 233 bp, Glycine max
  Peptide Sequence Number=SeqID_143380
ggcatctccgcatgctaccaaacacttgagtctgacggcaaaaatgagactttttcgcggtctcggccggaagacgctgacatctttgggaagggtgcagatgacgatgtgcggataaccataaggtatctctgcatgtcatcggactcgtcgtctctggatgacaaaggtgcagatgatgacgttagtatctgcgtgtctgatgcaatcctccctagaaataggatgtcaag

SEQ ID NO: 26603 - DNA, 1005 bp, Glycine max
  Peptide Sequence Number=SeqID_143381
taccagtaccgcaccggcggcaccacggcgcatgcggtctacatcgacgacaccatcaatgtcggcaactggaccatcacgccgggcgtgcgctatgaattcatcgactcgttcctgaacgacaagtccaatcccgcggccaggacccataccagcatcaagtccgaagaacccctgccctcgctgtcggtggtctaccacgtcagcgaacaatggagcgtgttcgccaacgccggccagtcattcggcccgctgcagtactttcagatcgcctcgaccaccaacggcctgcatccggaaaaggccaccacctatgaagtcggcacgcacttcaatggcggcggctggaagggcgagctgacgctgttcaacatcgacttcgacgacgaactgcagctgcgcggcggcaccaacggcggttcggacgcctggaccaacctgggcgccacccgccaccgtggcctggaaaccgggctgtcgtacgacctgggcgaactgtcgacggcgctgtcgggcctgtcgctgtacggcacctatacctacacccaggccacctacaaggccggcgtgttcgagggccgcgacctgcccttctattcgcgcaacgtggcctcgctgggcgcgcgctacacgcgcaaccagtggaccttcaacgtcgacacctttcctgcagtccaagcagcggtcgcccggcgcgcccgatcccggcgcccgctaccagaccgaggaaagcgccaacggcgcctacggcgacatcccgggctacggcacggtgcacgtgcgcgccgcctacgacttcggcaaacagatgcacaacctgaacatcgcgctgggggtgaagaacctgttcgacaagcgctacttcacgcgctccaccgacaacaacgcgggcaagtacgtgggcatgccgcgcacggtgtacctgcaggcgtcgctggcgtattgatcgggcgccggcgcgtgcggcgccccttcggcgcatgtgccggcggcacggcgggctga

SEQ ID NO: 26604 - DNA, 525 bp, Glycine max
  Peptide Sequence Number=SeqID_143382
atgtacgcactgaagcttggcctcagcaccaccacctacaatgtcgtgaacaaaatgatccgccctccgctggtgcgcttgaggcgattcgcggcctccctagcgctcgcaaagatgttgcgcgcgttcactacaaagagaggcctagagaacaaagttcgcattttcaaaattgaagcttttgggtctccgaggtttgatctctgcacaagaaccttgttttctcatctgggtatgttgcttttgcctttgttggctcaatatggttgtggaaaaccaaagggaagatgggattgtgatcattttcctatgggtatgcatgttcttgctgtggatgacaactcaatttgccttaaggttttggagaatctcctttgcaaatgccaatatcattcttttaaaattaaaaaaacaaaaattgatgacgtggagatgcctgtgcttatgtggttagtgactaggcgtgatgacgtgacactctgtttgtcacatcatcatttaacggatgctgatggtaggtactaa

SEQ ID NO: 26605 - DNA, 108 bp, Glycine max
  Peptide Sequence Number=SeqID_143383
atgagcaatggactactagccatttctgttgttgctgcacataccttggataaaaacatggttgaggccaactctccaagcaatagagcaatggtatttgtgtattga

SEQ ID NO: 26606 - DNA, 414 bp, Glycine max
  Peptide Sequence Number=SeqID_143384
atgccccagcatgcctatctcatccgcgctggtaattttgacacgttggtcataatggtgattgcgcgtgatgttactgacaaagctttgcagggcgtgaatcgggtcaacgatattacggttcaggcgccacatgatcaggcagccggtcaaggctgcggccaggacagcaatagcgataaagccattgcgatacagccggtgctcgcggatgttctggatgcaggctttgtaggggatgtcgcggataagatgcgaacgcaggctgtggtagtggctaccaaaggcaaagacgataaagaccagcagcatgctcaaggtcatcaccagttcggcgagtatcaaacacaatgcctgcctgttttgctgaggtcaggtgtagtgcgaactggtagcgcttgtcctgctcactga

SEQ ID NO: 26607 - DNA, 888 bp, Glycine max
  misc_feature (888)..(888): n is a, c, g, or t
  Peptide Sequence Number=SeqID_143385
atgaatgtcgttgctaattccattgggcctgcggtgatgtttggtgaagtgagttcagcagcgaaaaccctggagcctctgactgacaaccaaaatatccgcagcattatcatcctgaaccagcagcaaaaacccctacaaagcctgcatccagaacatccgcgagcaccggctgtatcgcaatggctttatccttattttcacgacatggaagtggaaacaccgattattgtgaatgaaaaaactgtaggtaccctgcatgccaccgtaaagcaagaacagattgtggatgtactgattggctttgcctggtcaaacgctattgctgtcctggccgcagccttgaccggctgcctgatcatgtggcgcctgaaccgtaatatcgttgacccgattcacgccctgcaaagctttgtcagtaacatcacgcgcaatcaccattatgaccaacgtgtcaaaattaccagcgcggatgagataggcatgctggggcatgatattaacaatatgctggaaagcattcgccaacgtgatacgcaattacagacagaactggaacatcgcaaaatcatcgaggaaaaactccagttcctggcgcattacgataagaatacccaattgcttaatcgccacgcatttgaagaagccattacccgcaaaatcactgctacaccggatgaccgtaagcatgtttacctcctgctactggatctggaccgctttaaaatcgtcaatgattcgtttggccacgggactggcgacaaactcttgcaacaagtcgcccaccgcttgcgcggcaatctatcccagaaagatgcaattttccgtcttggcggagatgagtttgccatcttgctggatgcctcgggacgccctgccatcgagcan

SEQ ID NO: 26608 - DNA, 199 bp, Glycine max
  Peptide Sequence Number=SeqID_143386
tcaaggtgttccttttgagagcactctagttaatgactggaaatatgtttattcaagtcatgatactcgtaaaatggtctgcattgaccatgctgatatgatcggtagattgcttgctaggtgcactaatcttgctcaggcctctgaggaggatttactcttgttatgggctcttcaaaccgatcgtccgattaactag

SEQ ID NO: 26609 - DNA, 273 bp, Glycine max
  Peptide Sequence Number=SeqID_143387
atggatcattttaaggttcaacgccttaaaagaccaccttccaagttaagagaatcgcttgattcgccctttagaaagaactacataggtctgatttcctcttcgatgaaggtttttctgacgttttccacaaataaacgttggtggcgactccgcgcattttcctcctttggaagatgcacccgtgagccccggctcgctcgcccgcaaaaggataggttgcgacagttggcgactccactggggactgtttgtgagttaggcctattttag

SEQ ID NO: 26610 - DNA, 1231 bp, Glycine max
  Peptide Sequence Number=SeqID_143388
atgaatcactccaaatccaatgacacaagcattgacattgaaccctccaacagaagagtgtcttttgctgaaaaccacccaaatgaacaagaaccacctcatcatcaccaaccctataacaacagtattcccttgctcctacagccatcatatgcgagatcaaagtccataatcttcgatgagctgcgaaactttcgcatcagcctcaagtggtgtgcccttgatcactcttcattcattggcagactcatatcctacgtgaccttcatcttcttcaccatcgttgttcctcttttcacatcgatcttcgtcgaagtcccagcctctgcaccagaagatgatcccatctcctttaacaagcttgttcaactgccagaatctggccttgccattgttgccttcttcactctctccagtttcttcaaaaggtatggccttaggcagcttctgttcctagatgctttacaagaagacactacctatgttcgacgcgggtacacgagggagcttgagaaggctttcagatacttgacatacataatcttaccctctttctttatggaacttgcccacaagatcatattcttttcagccgttaagatttcagccccacacatcagccctgggttcccattgaactcaattgtctttgtgttggtgttggtgtcttgggtctacagaactggggtgttcctgttggtatgtgttctcttcaggctcacctgtgagcttcagaagctgaggtttgaaggggtgcacaagctttttgaaggctgtgggtctgaggcaggcgtgatattcaaagaacatgtgaggatcagaaggcagttgtgggttacaagccataggtataggttcttcataattgggtgtgtggttacaatcactgttagtcagttgggtgctttgctgttggttttggcttccaagtctgataagaccttcttcaattctggtgaccttgtgatttgttcagctgtgcagttaagtggcttcttcttgtgcattttgggagcagcaagaatcacacacagagcacaaggaatagtggcaattgcaacaagatggcacatgctggtgactactgcatctgctgaatcagagcattgcgaagctcaggtgtctgaggggctagctagtgatgatgacagtgactctgatgattcctccaacatacacgtatcagtgatcccaccacaactttcttctttccaaaccagacaaactttag

SEQ ID NO: 26611 - DNA, 264 bp, Glycine max
  Peptide Sequence Number=SeqID_143389
atggtcgtctacaccatttgtcgaagactcaatgtctgtcaaccgagactattgaagtctcccctcttcatccagagggaagcgagcccgttgacaagcaaagaccaacatggtcgtctgcaccctttgtcaaagactcaatgtttgtcgactgagactactgaagtctcccctcatcatccaaaggcaagcgagctcattgacacgcagagaccaacatggttgtctgcaccctttgtcgaagactcaatgtctgtcgaataa

SEQ ID NO: 26612 - DNA, 279 bp, Glycine max
  Peptide Sequence Number=SeqID_143390
atggctaaattcgatccagagatagtcatggagttctacgctaatgcctggcctaccaaggaggggggccagcagtgcaagtacaaccagagaaagcgagaggtctctagctttgatgaggagaatattgcccagctgctatacataccggggcaagacttcgcccagaccaccgcagggaggcgggtgcctcgcatcctccttggaaaaccactcaaagtgttcaaatctctccctaaaagtcaggaaactcatcctccttggaagatgcaaccatga

SEQ ID NO: 26613 - DNA, 645 bp, Glycine max
  Peptide Sequence Number=SeqID_143391
atgagtggcggaggagaagagggagcaactctggagttcactacaacgtgggttgtggccgccttttgcatagtcatcgtcgccatttccctcaccgctgagcgcctccttcattatggcggaatgtttctcaaagccagggaccagaagccactctacatagctctatgtcagtggaaacactgggaagattctattgcaaaacagaattacgagactgaccgagacaaacctgacctgtcacgatgctccttgaagtataaggcatttggttatttggattgctttggtgatcctcaaacaattggaaagataggtacagatattgaagatttcaagtgctcttggttaattgcgaaagccttggaacttagtaatgaacaacaaaagaaagttgtacaagagaactatggtaagccagatcctgaaaatgttgctaaagtaaaggccctgtacaatgagcttaatcttcagatatgtttgacatattgttcggttggtccaaagcttccaaacgtaagaaggcgaccaaatgagtctggtgtctgctcaagctactcaagaacaagaggtgataccagcccgcctaagaaattctcctacatgcatatcaaagtagttggagtaggtgacaacatcttgtga

SEQ ID NO: 26614 - DNA, 483 bp, Glycine max
  Peptide Sequence Number=SeqID_143392
atgggtgaagttgaggaggtgcaagagcagatgaaggccgacacagaggccttgaaagagaaaatggccacaatgatggaggccatgatgagcataaaggagataatggaggtcgacatggaggccatgaaagagcaaatggccacaatgatggaggccatcatgagcatgaagaagataatggaagccaatgcggttgcagttgccgctaccagcgctgttgctaaggtgaacccgatgcccccatctggcctcaaccaaatgaatcatccaacctcagctagggtaggcaaagatttggaaagtacgggcggcccccattatgcgcaaattcaaaacaagcaggccttcccaccatatggttggcctcccaactatacaccacccaatgtggcatacactctcagtgaggatgtcaataactccactcctataaccattgagagccaacaaccccaaactgatcatgcacatgtctcttaa

SEQ ID NO: 26615 - DNA, 123 bp, Glycine max
  Peptide Sequence Number=SeqID_143393
atggcctccatcattgtggccattttctctttcaaggcctctgtgtcggccttcatctgctcttgcacctcctcaacttcacccattactctagctctagcacaggttcggacatggggttga

SEQ ID NO: 26616 - DNA, 468 bp, Glycine max
  Peptide Sequence Number=SeqID_143394
atggataaccattcatggtgttatccagcctgtgctcaatgtcataggaaaactgacatccaaacaggaccattcacatgtggatgtggcaaggataagatcagcctgtatagagttgaagtcatggttacccaaaataacgagaatagcaaatttttgctctgggaccgtgaatgtgctgaattgattggtgaaacagttgatgatgtgaatagggtcaagattgaagatggtgatcttgatttgaatgcttcccctcaagcacttgacaaattgttgggtcatgtgcttgcttttaaggtcaggattcaatcaaaattcaaaaatgcagttgtccttagatactcaaaagacctggatttgatcaatgttgttctcaagatgctgccttatagtgagacatgttccaaaatagatccttccaatgttgattgcaatgatgctacacaagttgaacgtgtgagttaa

SEQ ID NO: 26617 - DNA, 210 bp, Glycine max
  Peptide Sequence Number=SeqID_143395
atggtggatgataacgaaagcgctatgcaatcaattcgtggggctccggacttgatggtgttggtggaggatgcacgaacagctagacaatcaatttgtggggctccggactcgatggtggaggatataagattcattggcggaggatgcacgaacagcgctaggcaatcaattcgtggggctccggactcaatggtggaggatgcatga

SEQ ID NO: 26618 - DNA, 126 bp, Glycine max
  Peptide Sequence Number=SeqID_143396
atgggttttccattgccggcagtcatttaccctgccgaaaatttatctggaattcaggttttagcattcgttattcgctctcccttgcggagattctactgtctttttcttcgggggaaaggatga

SEQ ID NO: 26619 - DNA, 429 bp, Glycine max
  Peptide Sequence Number=SeqID_143397
aaaaaacgcgaaaatggcgccagactcgatgcccagaaacaggcacatatccttctgctcgagaaagcccgagcggctcaacatgaagtcgaacgtctcaccaaagaggcgaaagaaggatcttttgaggtcaaagcctgcgatgataacatctcctcctgggaagcaactattacggatttgctgtctcaggtcgatgatataaggcaaaaaattgtgacagagcaggccaaacgcaaagaactccaggagaaggccgctaactcgattcagaaactggttgctgaaaaagggagggaaggcctgaaggcctttagcgcatctcaagctgtagcagatgaagcgagagttatggagagtgctgaccaggtcttaactaaagagatggccaccttgaagaaactatatgaggacttggtcatgcattag

SEQ ID NO: 26620 - DNA, 372 bp, Glycine max
  Peptide Sequence Number=SeqID_143398
atgatgttgcctgtgcacaataaggtgacctcgacacttgctgctgaggttttgatggttgtttgttggatcccaaacaaagccaaaaagaagagaaaaatggtcatttcacaaagatttttgacacccagctcgcccaagctagcacccagctcacatcggctaaagatcttgcaaataactcgcttgagcgagttggtaccgtcagccctaagcaagcagctcgcctgggcgggtttcccatccactaaatggctttttctattaaatagacatgcaggggaagagaaaaaagaatccagcagcctgaaaccacagagaaaaacacagaaagagaagaagaattggaaaagtggagccgaggcgctatag

SEQ ID NO: 26621 - DNA, 102 bp, Glycine max
  Peptide Sequence Number=SeqID_143399
atgtggttgaaaggggtgaagacccctgtggttctgtctagaaatcgcgatgaacgcgctaagcgtgcctatgaacgcgctaagcagaccatgtcgcactaa

SEQ ID NO: 26622 - DNA, 1224 bp, Glycine max
  Peptide Sequence Number=SeqID_143400
atggatgtattagcactactagtgttcgagatagtactatttcctaatgtagacagacttgtagatctagcagcaattgatgcatttcttgcttatcaccacagcaaggaaagctcggtcattgctgttttagcaaatgcatatgatacattcgacttaagatgcgagaaaagcagtgcgataattgtttgttgtacgcctgatctttatgtatggcttatatcccacgtctttaatcatggaagtagatctgtctatcccttacaaggtcatcacatgtgctcgagaaaggataaagcaaattgggaagaactcttggcaggcatgacaggagcatccattagttggttcccacggtggaaagaagggggggcaggagtattgtgctcatgtgaaggatttctaaatgtccctttgatggggacaaggggtttcattaataataaccctgtgttggccataagacagttaggatatcctatgagaggtgtgccatcggaggaaaccattacgcctttcatcgcacgagggttcaacaaagctaatacaaaaatacttcagaagatctgtaaggcatggaataaagtgggaagaaaagataaagaacttagaggaagaagcaatggtgtcataggcggctatcacaaatggttgaaatctagaacgcaagggataacttggctaaaaaagctaaagggtctaaatggggaagtggcagaagtgcctgaggagagtgaagaggtgcaagccttgaatgatgagctcaaaaagacaaaagtagcaaatgagaatctgaaggtggcagtcactagagttaggaaagaatatgataagctgaaggatatcaacataactgcggctgaagcgctagagcgagaaatgaagaaagccagaaaggaggagtggtgcagaaacaagtttcgaggggctttgttaggcaacagtaatgagctcaaacttagaaaggccgagagagacaaatcaaggatggagaacgtgatgttagaggataagttgaggaattgtcagaggtcaaagggaagtttgaaagagcagttgagcaagacggaagagaatatgttgataatcattgataagtacaaagagaaggtgaaccaagctgctagtcatgggcagatgctgagagacgaacaagcgaagatgtcggccttgcgggtagaaagagaggcaagggaagaggtgatagagttattgcataaataa

SEQ ID NO: 26623 - DNA, 192 bp, Glycine max
  Peptide Sequence Number=SeqID_143401
atggatgatcagaccataaagtgcgcttgtgcccttagtgcggtgctcacgcagaacacgcatgtccagttggatggcaagtggatcaagtggattcgcgctaagccgcaagtttgtacatttagtgagcttgcatgtgacaattgtattccattgaagcttcattgcactaagcaacttccttcaagctaa

SEQ ID NO: 26624 - DNA, 240 bp, Glycine max
  Peptide Sequence Number=SeqID_143402
atgacgtctaaggcagcaaaggaaattgctgacaagattgattcgttggagaaccaggcctcacaaggttcgtttatcgcccatggacgtcaggatgtactgactgctgccattggtcgaccaaaacaccctggtcatgtgtgtgctattggagcggtgtcacaatcaaggacctcctgcacatcttcctccatggctcccgaagacctggagcaactgacgcaacaaatcaaggagtag

SEQ ID NO: 26625 - DNA, 501 bp, Glycine max
  Peptide Sequence Number=SeqID_143403
atgtttcaaggaagttccaaatcgagtgacatgcccccaagtaccagtatttttcctcatgaaaaactacaggaatatccaacatggtcattgaaccccccatgtacatacacaacatacatccatcataatgacatcatctcatctcaatgtcatcatcaacatcaacatcatctcatcccaatatcattgtcaacaccaacattatatcatatcaatatcatcatcaacatcatatcatctcaatgtcatcaacatcataagaaatcgacttccacatacatatatacaaattcatgcttgagattcatattccccaatgacgtagttccatgtggagcttataggccttggatcttcttcatcaatggagtcttttgcttcttgaagatcaatgacagtgaatggagaaggaagaaagatgattggagacgtcacttcaaggagaagatgagacaagaacaagctcaccaccataagaagctatggataagagcttga

SEQ ID NO: 26626 - DNA, 306 bp, Glycine max
  Peptide Sequence Number=SeqID_143404
atgccgcttagccgtgatgttcataaagaagatgaacattcaacaacatggatgaacttgcttagcgcaggcatgctggctaagcgagtttgtattaacaagagaagaagcataaatgaagttgggaacttacttagatcgaagatgctcagtgaagattggatgcaaaatgcaagattgaagctcgaagatgcaatgcatgaatttcagaaggaagaggttgcaggaaaacttttgaaatatttggggctgcgaggaattgggcttagcgcgaatgggtcgcgcttaactcaattaaaccagtaa

SEQ ID NO: 26627 - DNA, 438 bp, Glycine max
  Peptide Sequence Number=SeqID_143405
atggatggttatggttttaccgaagtgatgaaaaaggtaggtgttgagcgccgtctgatgaccgctggatccaataaaggcatgctggatccattctcgcccgttaatcctaaacagcaggcatttgcacaaagtatgttggaccagattcaccagcaatttatcacggtcgtgcgggagggtaggggtgcacgtctgaaggaaaacgaagaaacctttagcggtttgttctggaatggtgaagaaagtatcaaattgggactggcagatgctcaagggagtgccgagtatgtcgcccgcgaagtcattaagcaggcggatattgttgattttacttatcaggataccgttgttgaccgcttcgcaaaaaaactgggcgccagcatggcacaagagctgggcttgaatgcgaaaagttggttgccgacattacgataa

SEQ ID NO: 26628 - DNA, 600 bp, Glycine max
  Peptide Sequence Number=SeqID_143406
atggtcattatgcgtcttttgtcatccagaggtggcaagcccgatgacatgcgagagacaaattatgaggcggcgggcccgatgacatgcggggaaccatttggtcccacactttttcacctgttgtcatccagaggcggtgggcccgatgatatgcgggaaccatttggtctcgcactttttcacctgttgtcatccagaggcggcgggcccgatgacatgcgggaaccatttggtcccgcactttttacccttttgttatccagaggcggcgggcccgatgacatgcagaaaccatttggcggcgggcccgatgacatgcgggaaccatttggtcctgcactttttcaccttttgtcatccagaggcggcggacccgatgacatgcgggaaccatttggtcccgcactttttcaccttttgtcatccagaggcggcgggcccgatgacatgcgggaaccactttgtcccgcactttttcaccttttgtcatccagaggcggggtgcccgatgacatgcgggaaccatttggtcccgcacttctttaccttttgtcatccagaggtggcgggcccgatggcatgcggggaaccatttga

SEQ ID NO: 26629 - DNA, 612 bp, Glycine max
  Peptide Sequence Number=SeqID_143407
atgtcgcgggggtcaggagagcttggggacatcaggcgagctcctggcagtcaacagataaaaggaacaaagaccacaaagcaaggaggcttgtgggggctggccagctgtgaattttgtgtgatatgtggattatggcctctgagggatgggtcactggtaatcgattaccagatcgtgatggcggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcacggtggagttaatactacccacgcctacaccatatcgtctagtggagcccgtccaagtgatcgaggtaacgtcatccgaggaagaccctgaggaggatcttgcggagctacctcctgagcctgctgtggatgctcttgactttctagagggtgatgaggatccacttcttgaggtggattctcccgaggaagtcatgtcggcatctgaggcagactctacggaggatggtggcccaggggagatggcgatcagcggaggctcttcatcctag

SEQ ID NO: 26630 - DNA, 745 bp, Glycine max
  Peptide Sequence Number=SeqID_143408
atggctagtcctttcgcgacggtgccggcttgcgtggcgagcgggtcggcggcgcgtggcgactgccgccatcaagcccagcgggccgggcggacgttggttttcacgccacaggcgcagctgttcggcgaggtaggcggcgggctggcccgccaggcttgggaaatgatcgcccaccccgatgccgccggggccgtggcactggttgcaggcgggtatgtttctgtcccaggcgccacgaatggcgagccaggcgcccacgtcggcgggcttgggagactgctgcgcggtggcggccaggcggtcggtgtccaggggggagggcagcgcggcgtagaaccgcgccacggcctcgcgttgcgccggctccagtgtcttggcgatggctgtcatgacgggactgacgcgcgagccgttggcgatggcctcaagctgttcctgcagataggccgcgccagcgcctgccaatcgcggaaagccggagaccggattgccttctccttgggcgccgtggcagagcatacaggcgggcgcgccgttggcgccccgggtgctgatgagcagtgcgtcaggcgcgccatgaaccgtgccgggcactacggaaaacacactggcgaagaagatcgccacgctcgcccatcgggcgccgggcagaaggcgggaggacatgaggaggaacgctgccgaagattttggctcgactatatttccaaagacgacgacatagaaccgctatgcacgaaag

SEQ ID NO: 26631 - DNA, 447 bp, Glycine max
  Peptide Sequence Number=SeqID_143409
atggatgccttagaaatttacttgaatgaagtagaaagacaattagacagaaagtggagtacagttccacgagatgtggaaattaaagaagttagagtgcaagtccctctagcttgtgcctctagcagtaaggtgattgctcctttggttgttgttccaaacaataatgaagaagagcaacataataatgagtccatgatacatcataaacctattgtggaagaaccacaagaagtagcattaaggaggtctcaaagagaaaggagaccagctattttgaatgactatgtgaattgccaaagggctgtaagtgagttggttgtaagtaggtcttcaagactaaacgtgaatttcatggtaaccttgaacgttacaaggctagacttattgctaaggaatttactcagaaagattgattataaagaggcattttcaccggtattatga

SEQ ID NO: 26632 - DNA, 456 bp, Glycine max
  Peptide Sequence Number=SeqID_143410
atgggagagatacatgaaataccccaccataatctagctgacttcgagcctcgcctcagatatgtcactgaggggcaagcagttggtggtgtacccctaccaagcactttggaaggccctcaatttcacccacaacctcaacccttgcattttgcggtggggagagtccctcctgctatggtggaaaggaagaaattggatcacatagaggaaaggctatgggccattgaaggaggcaaagattatgtttttgttaacatggaaaagttgctcctggtacccaacatggccattcctcggaagttcaaaacgctggattttgataagtacaaggggactacttgccccaagaatcacctgaaaatgtactgttggaagatgggggtgtgcgcaaaagatgaaaaattgctgatgcatttcttccaggaaagtcttactggggcaatcatcacctag

SEQ ID NO: 26633 - DNA, 309 bp, Glycine max
  Peptide Sequence Number=SeqID_143411
atggcagcatgtcaagctcaatggcttgataatatttttggtgaactaaagatgaaggaaaagggtgctattacactgatggtggacaacaaatctgccatcaatctagctaaacacccagttgctcatgggaggagcaaacacattgaaacacgatttcatttccttagagagcaagtgacaaaaggcaagctaagtgttaagtattgtccaattactgtgcaagtagcagacatattcactaaaccattgaagattgatcaattcaaagagttaaggagcagattgggagtgattaaaatgcagtga

SEQ ID NO: 26634 - DNA, 833 bp, Glycine max
  Peptide Sequence Number=SeqID_143412
ttcaaatgtggtggatttgttttgggcgtaaacgtgaaccattgcatggttgatggtataagtgctatgcaattcgtgaacgcatggggtgagacagccagaggcatggacttgagcatttcaccagttctggaccgaactatactaagaacacgaaatcctccaaagatagagtatccacaccacgaattcgacgaaattgaagatgtatcaaatgtcacaaaagtctatgaggaagagatcctctacgagtccttttgtttcgacccagataagcttgagttgcttaagaaaatggccacatcagaagatggtgttgtaaagaagtgctctacttttgaagcacttacagcttttgtgtggagagctagaagtgaagccttagggatgcacatggaccctaatcaacaaaccaagctactttttgctgttgatggaaggtctaaattcgtgcctccaataccaaaggggtactttggcaatgctattgtgttttcaaatgctctatgcaaggtagaggagttagtgaataatccactgtcatttagtgtgggattggttggcaaagcaattgacatggtgacagacagttacatgagatctgctattgactattttgaagtgaaaagatcaaggccttccttaactgcaacacttttgatcacaacatggactaggatacctttccgaagtgcagatttcggatgggggaagcccttcttttttgggcctgtaactttgccagggaaggaagtcattttgttcttgtctcataacgaagaaagtaaaagcataaacgtgctcctaggtttgcctgcttctgccatgaaaag

SEQ ID NO: 26635 - DNA, 552 bp, Glycine max
  Peptide Sequence Number=SeqID_143413
atgatgataacaaaagatgatgacaaaggtgatgaaaaaaagctcaacgaccaatcaaagaacaactcaagtaaatcaataagaattcaagactcaagaagaaagtttagagtcaagaatcaagattcaaggttcaagatctcaagaatcaagatcaagattcaagaatcaagagaaggcttaatcaagataaggtacatcctttgtggtacaagtagagggtacatctacttgggtttgactgagaacaagagagagtacatctcttgcggatcagttctagtggagggtacatccactagggtttcaaagagaacaagggaggagggcaagcggctaacggctatgagccatgggcgcctccaccagagacgggtaaagaatgctttcgacaagaaggtgtgtctgtgtaagttcaacaagggagacttggcgctgaagaaggggcaccaggccctaaaggacaataggaggaagtgggctcccaactatgaagggtcgttcgtcgtaaagaaattttttcggaggagccctggtgctcgccaacattga

SEQ ID NO: 26636 - DNA, 243 bp, Glycine max
  Peptide Sequence Number=SeqID_143414
atgacgtctggcactaggcacaagtccgtcatgtccgtgaacggaaagtcaccaaatccttcaacgacatttaatctctcctcgaggaggtcgagcttttctcttctttttgctgctggaggcggccccgctacagacaggagtatgggttgtactgggcgggcaaccctagtaggttgtggaggctgcccttcaaaagcagcaggaggggttggtggtgtgaagttgggaggcaagccatag

SEQ ID NO: 26637 - DNA, 456 bp, Glycine max
  Peptide Sequence Number=SeqID_143415
atgacgcgacacggcaaaaggcatgagggtttgcatcgcggtcgagacgcaaaaaacaaggtaacgttctcagagttacataacggaaacaagaccgatggaagggaaattacaacattttgcacagaaataaataggcctaactctcaaaaaaagtcctcagtggagtcaccaactgtcacaacctatccttcggcgggaaggcaacgcggggctcacgggttcgtcttccaagggaggaggacgtgcggagtcgccaccaacgtttatttacggaaaacgttagaaaaaaccaaagtgtggtctacaaacctcaagtgtaaaaggttcaggagttgtatttatgcatggggaaggtgtcgcaacctacccttcggcgggagggcgacgcgagactcgcgggatgcgtgttccacgaaaggaatacgcgcggagtcgccaccaacgtttatttga

SEQ ID NO: 26638 - DNA, 1245 bp, Glycine max
  Peptide Sequence Number=SeqID_143416
atgggatcgagtcaaacacctccactcaagaaaaggttctaccaagtcaggatcaaaagcctagaggtcaccagtttacaagaattagggggattgatggggcggctccagcagcaagccttccgcaaagcttacgatttccagctagtgccgactgtaaaagagttcaaagaaattcttggatgccctctggaagggaggaagccttatatcttctctgggttctacccctccatgcctagaatcgacaaaacagtcagaattttggcacaggaattagaccgagtgaaacaaaatagaaatggagtgatcagtataccaagaaagtatctagaagagagagcaaaggccttggcagcaatcaacactttcctcgccttccaccacaacaaggaaagcccagttgtcaccattttggccgacatatatgacacattcgactggaggggggcgctgttggtggagagcctcacacctttcatcacacggggtttcagtgaccccaacgcaagggtgcttcaaggagtctgcaaggcgtgggaagtggtgcaaagaaaagatagagaacttaggggaagtagcaacgggaccgtcagcagctatcataggtggttgagagcctacacacaaggtctggattggctcccgaagctaagagccgctaaagaggaggaggttgaagccctggaagaaagcgaggaggtgcaagccctcaaagcagagctcgagaaagcccaagtgaatgaagaactaagggacatcaactcggccactaccaaagccttggagcaagaaaccaagagggcccggaaagaagaacatgaccgaaacaagttccgaagagctttgtggggcaacaacaacgagcttaaactccagagagaagaaagaaaccagtcacgagtggaaggcatgattctaaaagatgaattgaagacttgtctgaggtccaagaggagtttgtctcagcaattgagcgagaccgaggaaaacatgttagccatcatcagcaagtacaaagaggaattggagttggcaacggcccacgagcataaggtggcagatgagtatgcccaagtgtacgcggaaaaggaggcaaggggaagggccgacatgtcggccttaaaagatcagatggcttccatgttaggaatgaaaaggctgatggaaagcaatgctgctacagccgccgctgccagtatcgctgctgaagtggacccagtctttcacccgccacaagcctag

SEQ ID NO: 26639 - DNA, 222 bp, Glycine max
  Peptide Sequence Number=SeqID_143417
atgtatgatgcatttagagatgcatggacaatatcagagcgattaactcttggcacaacaggcacaggtatggcaaacttagaatgtgttgttctacctccaggcaataataatgaagcaatcccattggaagcaacagttaaaacaatgcctccattagagcacacagcagatgataaagttttccacataaatgtcttgccaatcccaccatatccatag

SEQ ID NO: 26640 - DNA, 555 bp, Glycine max
  Peptide Sequence Number=SeqID_143418
atgcgcttgcaatccaatccttctaaccatagcagcactcatgaactcatacagttttctgattggttactagacataggtgatggcaaacttggccaacctaacaatgtacattgcgaaatcaccatcccagatgagtttcttataatggtttttgaggatcctatccaagcaattgttgatgcaacgtatccagatttattacaaaactacaacaatgcagatttcttgcaaaagagagctatcctagcctctacaaaagatgttgttgacaaaataaatgactatgtcctgtctttgattcctggtgacgagaaagagtattgtagtgctgatagtgttgacaaatctgatgaactactcaatcctacttttggagtactaacacctgagtttcttaacaccttgaaaacatcagggatacctaatcacaagctaagaatcaagattggtactcccatcatactactccaaaatttggaccaggcagatggtttatgcaatggaactcgactaattgtcaccaaacttggaaccaatgtagttgaagcagag

SEQ ID NO: 26641 - DNA, 222 bp, Glycine max
  Peptide Sequence Number=SeqID_143419
atgggttccatgggtgttgatgccctaattatcctctccctcaatctcctttgctatgccatgtgctcactaatcgggggtcttccgatcggtaatggcgctttctgcctttgccgcgcaatcgagatcctgggaaataattcgagatatcgtgcgacaaacattaaggagctgtggataggcgacgacagtgaagacttcaattgccaaaccggagattaa

SEQ ID NO: 26642 - DNA, 981 bp, Glycine max
  Peptide Sequence Number=SeqID_143420
atgaccaccgggcagcagcagcgcgtcgaactcggccgggctgacatggtcaatatccttgtcgattttgacttcggctttgccctgttttcccttcacggttttgcccgcctgcatctcaatagtgaccacttcatggcccgctttggtgaaggcctcggccgacaagtctggaccctgagcgcggaaacgcaagccagccggcgcaggcgggattggttaaattccggagacagatcaagtttaagcgtgacgacgctggcacacgggcataacctgaataacactgtgggatctgcgtcgcgccctccgcgcggcatacgttattcagttgaatacggaaccggtcatgacccaattcgcctcacctgcaccagcggcccgcttcgcctggtggaaaccgctgctgttcctcgccgtggtgcttatcggcctgtggtacgtaaaatggcagccttactatggcaaagccttcacggccgcagaaacccattccatcggccgctctattcttgccaatgccgcagattcgccgtggcgcgccgcgctggattacgccatggtctattttctcgcggtgtggaaagccgcggtgctcggtgtggtgctgggctcgctggtacaggtgctgattccgcgccgctggctgctgcgcctgatgggcagcaaccggctgggggccacgctggtcggcaccggttttggcctgccgggcatgatgtgcagctgctgtgccgcgccggtgaccgtcggcctgcgccaggcgcaggtttcaagcggcgcggcgatggcgttctggctggcgaatccgctgctcaatccggcaacgctggtgtttatgggctttgtgctcggctggcagtttgccgccattcggctggtggcgggtggggtgatggtgctggggattgccatgctggtgcagcgcagcgtgccggaaaccgccgttgccgcgccgctgttgccgcaagaaagccatga

SEQ ID NO: 26643 - DNA, 138 bp, Glycine max
  Peptide Sequence Number=SeqID_143421
atgtcagagaatttccaaggaaggcttctaagccatactagcaggctcaggtttcttgacaatgctgcaatagttgaagaaaataatattgagcagaaagatagtcaatggcgatcagcaacagtgacagaaagatag

SEQ ID NO: 26644 - DNA, 747 bp, Glycine max
  Peptide Sequence Number=SeqID_143422
atgtatttcaatggaagggtatataaagagaatgatggtgtaatatttgaaggcagtaaaaaagcgattcagattaaacgtgaaattagtttcaatgctttgaagaaaaaaattggagataaggtaaagttagaaaataatgaaattatttgtgctatcggttgtagattcttagtgtctggaaaatatgttgcgttacaaatttgtgatgacaaagttgttgaaatcatgctcgaaagttttcaacaacaggatcaaatgtcagttctggaattgtacatagaaaaggatgtggctggtggttctatgtttcattctgcaaattctcttacatcatttggaaataacttatctaataatgaggcgcaaccgccaagaaatgtgagcgatttacatggtgatgaagatgatgatgatgatgattatcttgtgtctaactcatacgtggaagagtctttagacgaagatgatagtattgacggtatatctgatacagatgatgaagtcaccgacatgattcaaccagtaagaattgttcacccagcaaaaggtgtacaaggaattcaaaatccattttggaatgatgctttgcattataataatatcaaccgaagtcatcctgatgaggaggacatttgtggtttggagatgccatcgagttttaatgttggccaagaattatatgttggcatggattttaatagtaaagatgcggtcaataatgcagtcaaacaatatgttatgaag

SEQ ID NO: 26645 - DNA, 369 bp, Glycine max
  Peptide Sequence Number=SeqID_143423
atggcaatcattcacactggactgacaattctacgtgaagagcgaagggcggcgcggttcacctattcgtccaaccttggtctaccattgaatcaattacttcaattctttgaaattgcgttatttgactcacgccacgttgaagaaaaatattcaccaccaccgccactagatggtactttaaatccaatattagcaccagcatcatctaagcgagagaagaggccctatagaggagtagaagaaggccatggggaaaattcgttgcagaaaaaagagaccccacaagaaatggtgttcgagtatggactggagcatttgacactgctgaagcagctgctttggcttatgaccaagcagctttcttga

SEQ ID NO: 26646 - DNA, 819 bp, Glycine max
  Peptide Sequence Number=SeqID_143424
atgtaccttcaccttcagaggactacacgtcctcgccttcaaagggtcatgtaccttcaacttcagagaactacacttcctcgccttcaaagggtcatagggctacacgccctcgccatcaaaggaccacacgtcttcaccttcgtagggctacacgccctcacctttagaggaccacacgtcctcaccttcagagggctacacgccctcgccatcagaggaccacacgtcctcaccatcagagggctacacgccctcgccatcagaggactgcatgtcctcaccttcagagggctacacgccctcgccatcagagaactgcatgtcctcaccttcgtaaggctacacgccctcacctttagaggaccacacgtcctcaccttcagagggctacacgccctcgccatcagaggatcacacgtcctcaccttcgtagggctacacgccctcacctttagaggaccacacatcctcaccttcagagggctacacgccctcgccatcagaggaccacacgtcctcaccttcagagggctacacgccctcacctttagaggaccacacatcctcaccttcagagggctacacgccctcgccatcaaaggactgcatgtcctcaccttcgtagggctacacgccctcacctttagaggactacacgtccttgccaacagagggttgcacgccctcacctttagaggactacacgtcctggccaacagagggctgcacgccctcaccttgagaggactacacgtcctcattttcagtgtgctccacatctgcaccttaagagaatttaaggtcctctgtccttaa

SEQ ID NO: 26647 - DNA, 639 bp, Glycine max
  Peptide Sequence Number=SeqID_143425
atgagttcccctttctttcagcatgcagattggggcatgttgaaggagcctaattcggatattttgtttgaatcattttcaagcaaaggagttgatcatgaccctttccatgattgtctttcctttgatatgattgataactcaagggatccacaggaagaaagtcatcatcaagtgattgaagaagctatgaaaacaaagaagaagtcttatattggggtaagaagaaggccatggggaagatttgcagcggagatcagagacacaacaaggaagggtataagggtttggcttggaacgtttgatagtgctgaggaagctgcattggcttatgaccaggctgcattttccatgagaggctctagtgcagtgctgaattttccggtcaaaagggtcaaagagtctttacaagagatgaactattctggttgcagccgagggtgctctcctgcattagaactcaaagagaggcacaacataagaagaaaattgtcgtcatcatcaaaggctaagacaagtaaaaggaaacaggacttggaggaatccagtgttgtggtgctggaggacttaggagctgattatctggaggcacttcttagcacatcggcggatcaaagtgcaacaagctctacctgctaa

SEQ ID NO: 26648 - DNA, 717 bp, Glycine max
  Peptide Sequence Number=SeqID_143426
atgctccccaacaatgaagaactcaaacaattttcacattggctacttgacataggagatggaaaaattggacaatataatgacggattttcagaaatcactattccagacgagtttcttataaaaaattatgatgatcctatccatgctattgttgaagccacctatcccagcttgatagataactacagtgacacaaattacttgcaaaaaagagttgttcttgcctctaaaaaagaaattgttgacaaaataacaaccttctccaagttcctttctcctatcacagacaatggctgcgcaactaccccaaatatgttttattccactatgatggcgagatacatttcattaggaagggcacacaacctcaacgaaagcgtgattctacgtttggtcgctggtgacaaaaacaccactttcaccgttcatattgacggacctgcacaccaccactctagcctaaagcccatcatttatagaaggagatacatcttcatagttgatatcacagatgatatgctacagcagaacctgcctttgacacttcctgcagcggcttccaaatttgtgtatggctccaaaaaaagtattaccatccaccacggactttcaaaatccaccaaatggccactcaccatccagcatgacatcccagccattacacaaccatggttcaacctgattcatgaaaaaaatttaagacccggagatgag

SEQ ID NO: 26649 - DNA, 306 bp, Glycine max
  Peptide Sequence Number=SeqID_143427
atgacacagatgcaatttatgaatacgggagcccgggaaactgcctccttcttagatacaacgtcttggggtagcaaagtgcccaactggaaaaatggcatgcagcgtgtttgctccgtgcccctatttaagggacctatatgggagagagctaaaaaggttttagtgataatccccaaggtggtcatatctctcttgatggtctctagaggtatcatcctcttcaaagaacatactgcagtagtagggactactagcaacaatatgttttcaaagagaaaaaccctagatgagggttcactataa

SEQ ID NO: 26650 - DNA, 168 bp, Glycine max
  Peptide Sequence Number=SeqID_143428
atgccacaggttgctgagtggaatttggtaaacgaagatggtgtcatgaagctgaggcaatcatggacagtaaagactttcgccaaaggattggaattttttaggatagtagctgttcttgctaaaaatgaaggaattcctggttcaaaggttacaatccctccatga

SEQ ID NO: 26651 - DNA, 702 bp, Glycine max
  Peptide Sequence Number=SeqID_143429
atgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcgggttagcaggaggtatgctagaaagacattatcgaataacaccttttgatgagagatatgaacaagaagcttcgagaaaactagtgttttctgaattatatgaagccagtaaacaaacatctaatccatggatatttgaacccgagtatccaggaaaaagcaaaatctttgatggaagaacaggggattctttttaa

SEQ ID NO: 26652 - DNA, 291 bp, Glycine max
  Peptide Sequence Number=SeqID_143430
atggtccccagtggagtcgccaactatcgcaacctacccttcggcgggggcgcaaaaaggccaccatcatgggccaaagcatttgtctccaagggagaaaatgagtggagtcgccaccaacgtttattcaaggaaaatgttagaaaaaccaaaaatatgaagcaaagagaatcgttaaggccttggaccttgaaacaatcttttgatttttttgaaaagaggagagaatcgttaaggcattggaccttgaaacgatctcaagtgatatttgataaaaagaagaggttatga

SEQ ID NO: 26653 - DNA, 180 bp, Glycine max
  Peptide Sequence Number=SeqID_143431
atgtttgatataccttttagaggcttgaatagtgcaagaaaacgaactgtgttttctggaaaatgcgatgaactcgctaagcgagcatgctgcgctaagcgagttcatcaatactcattgtattcgcgcgctaagccatgctttcctaggccaagcgcgattggttgcagcatccactga

SEQ ID NO: 26654 - DNA, 101 bp, Glycine max
  Peptide Sequence Number=SeqID_143432
atgccaaagtataatcaaacaagattgcttcaagaaaccttcaaggttaagcaaatagagattgcttcaagattaattcaaggtcaagcgaacaagatcaa

SEQ ID NO: 26655 - DNA, 231 bp, Glycine max
  Peptide Sequence Number=SeqID_143433
atgacatatgataggtcaaatgatggtcctgtattcacaactaccaccctctgcacaagtttaccttttggtctatacttcactgccgcttctcacgaaaagggtgcttctctgatccaatttgctagggaccccacagaacatatcattgcctttctagccaagccttgccatcatggctcagttgttggacctgcaccggatattcagactaagcatttcaccccttaa

SEQ ID NO: 26656 - DNA, 1782 bp, Glycine max
  Peptide Sequence Number=SeqID_143434
atgcaagcattgacgaacccaaaatccgacgaaggctttggcgctagaagcaacatgttgaacctcattgtcgtatgtgctcatgaagtcgagatgcgaagagagctcgctctagaacttatgctttccctagaactcaagctcgccttacagggaggcggagtccatgagcttcaccaccatgggctcgcgcgacgagggagaagaggtttgaggtttatgagaggtggggttggtcctatagttgaaaaacctggttcacactcgaccgatcgggtcagtccaatcgggacttggtggcataatcaggccaatttggctattggaccggccatgcatttggcccgagatgacctgatcaaacctgaccattttttagtaaacccaacgacccaactggtttttaaaacccatactaggcttttcatgttaaaaaaagctcaaaaacaacattgttttgaatcaaccctaaaaaaaaaccttagtctcaatcacttctcttcttcacactcgacccttctcttcatcttcatgctcgttgtcatgccaccgcacctcaagttgtcacgccatccaccacaagctcatcgcacgaagctcgttgcgccactgcaccaggtctacgacttgccagctgccgtcacacctgagtcccatttctggccgattcttttgccgcttctctctttccttgtgcggaaccgttctcgcttctcggagaacatggcctccatctcctccgctgaactcaattacctcgtttatcgctaccttcaagaatcagaggagtcatatagactagggcattcatcagaatttggaaaacttcatgagaaatcactctacagtctgcatctgaattgctttactggttacttgtgctacgtcactactgcaggtttcacgcatgctgcttttacttttggttatgaagctggtattaacaaatgctccattgatggaaatttggtgccgtcaggtgctcttgttacatttgttcagaagggtctacagtactttgagatggaagccaacttgagtaattgtgatgcagacctggaagaagatttttcattcttacaacctttggatcttatcacgaaagatgtgcatgaacttaggcaaatgataagtgaaagaagaaaaaaactacagaaggaaagaaagaaggaatttgaaaaggagcatgaaggtgaacgtgtacgggtaagagaaaaggatagacgtgaaagggaaaaagaagttgaaaaggaaagacgtgaaagggagaaagaagttgaaaaagatagacgtgaaagagagaaagaagttgaaaaggatagacgtgaaagggagaaagaagttgaaaaggatagacgcgaaaaggagaaagaagttgaaaaggatagacgcgaaaaggagaaagaagttgaaaaggatagacgtgaaagagagaaagaagttgtaaaggataggaagaagatagaaaatgataaagagcgagaacaacagcatggtgatcagactgtcagagaaatgttcgtggatcatgaagatagggttcctgtaaagcttgaagagaatggagcagttggagttgcaagtgttcacactatagtcccttgccccaaaatgctgttaataggggtatttcaggggccagaaccaatggacatctctacaacatcaacatctcagctatgtggaattcctagttcagatgtgacaattttggaaggtcatacttcagaggtgtgtgcttgtgcatggagccctacaggatctcttcttgcatccgggtag

SEQ ID NO: 26657 - DNA, 519 bp, Glycine max
  Peptide Sequence Number=SeqID_143435
atggtcaggtttgatcaggtcatctcgggccaaatgcatggccggtccaatagccaaattggcctgattatgccaccaagtcccgattggactgacccgatcggtcgagtcaccctcgtcgcgcgagcccatggtggtgaagctcatggactccgcctccctagcactggaccaagtcgtaggcgggatcttgaggctgagggcattgtcggtgtagaattacaacatgttgcttctagcgccaaagccttcgtcggattttgggttcgtcaatgcttgcatgaaagaagagagagagaaaaagagaaagagagagagagaggtggtggtggtggacctggtggcaatgcaagagagggagaaaataatggcgttgaaaggggacaaacatcaaagagagtggaggtggcaaggaagaaaaaaaataatgaaatgttgtcatcagaaatgtctccaacaacaatggacagtggtgtccatgatggtgttctatttgaagaagatggtggggtgagttga

SEQ ID NO: 26658 - DNA, 150 bp, Glycine max
  misc_feature (121)..(121): n is a, c, g, or t
  Peptide Sequence Number=SeqID_143436
atggacacctggcaacatgtgattggggatcccatgaatggagttcaacggcttttaatgaatccgatgacaattattgtaggggtgggggtcacaaaccactctttgaggattcacctantgagtgtggtggtggggcggccacggtga

SEQ ID NO: 26659 - DNA, 144 bp, Glycine max
  Peptide Sequence Number=SeqID_143437
atgcatggtcagatactgaggtccatccacatcggacaacagctcatcatggagaatatgcacaaactgtccttacatatgcagatggacccaccgctcatcactctagaggcttatctctgtttgggtattaaaaagaagtag

SEQ ID NO: 26660 - DNA, 318 bp, Glycine max
  Peptide Sequence Number=SeqID_143438
atgagtggattgtggaaaataatgatggagacaatgaaggtttggatggggatgctccaaagtgcagaggatgttggtgaccctcctaatatggagaatttggatgatgaagttgttaatttaagttggtacaagtatatgagttattgtctgaagtataagacagaccaagcacaagaagccaagaagatggaaaaactcaataatatattctttactttgatggctcggggaccagaagtggatccatcagaagtcactgggaaagaaccaatggatacacaaacgaccaagagaggaaggggaaggaagcaataa

SEQ ID NO: 26661 - DNA, 360 bp, Glycine max
  Peptide Sequence Number=SeqID_143439
atgcaatggtacttgcaagaagttgtccttgggaaggccaggaagtccctggtgactgatgagtatagttggcaatcggatcaatccaactcaaactcaataaatagctcataccatggaaagggtgaaaggttcgtgctagagagtggtagggatcctgctctggtgaacaagggatgtgatttcctgaaagaccattacttgattccaccaaactggaggcaagatgcaaacacgggcatgatcagaagcaatattgatggacgctggatgcaacctgagcgaccaaagcttgaagatcaccctgaagacatgcatcaccatctcaccctactgggtctggcttcatctgatatatga

SEQ ID NO: 26662 - DNA, 927 bp, Glycine max
  Peptide Sequence Number=SeqID_143440
atgacaaactggccagataacattttgcaagatttaaggaacaagattttccctttcaaaaaaagaaaggagaaggcacctgtatctgtctcttcagtactattaccagctagaagaaaggagagatcactgtcgtctttggttgtcagcactccaagggtatgtacacagtcaaccatgacaggaagaagaacaaaacctgcaagaaaggctagtggcctgcagggatctagtttatccattgagaagttcattaaaaaagaagaggaattactggaagatcaccaagataatttgtgctcacctgacacttcaaacaagtctgctaagaatggtgggcagagtttgtcaccttgtaaaaatagccaatccatatgcaatagagaaccacagaatggcgctgaaccacaggaagcaaaatgggatctttggaaaactttgaattatttagcagaggctgcaagtaggagtaagccttttaagtctaatgtgcaagcgtctgatgctaaactagaatctatgaaaatgactgatagtgatgctaaagtgctgaaagccaaaattaaggaaaagaagcgcaaggcaaaagttgaagaagaaaagattagcactgatcatgcctcttcagatacatcaaaacccaacaaattgcgaagagttcgccaaaaaaaggaacctgtttttggagaatctagaatatcacctcaggctgttctggatgctaccgacagaaatctcttatggaatgattcaatttggttctccttagcagcttctgaaaaccaggaaggagatgcacctttaccacaaattccttcaaattatacactcttggagcttgtagacactcttggagcttgtttggatacaaggctacaagtgctcttgagagcttctctacttgaaaaagctctatatttcaagtag

SEQ ID NO: 26663 - DNA, 1086 bp, Glycine max
  Peptide Sequence Number=SeqID_143441
atgaataatgtgataagcggtgtggtgagaaaagaagagagattgaaaatgaagtggaaagcaggtgaaagaatccaattttccaaacagaacaattccatctgtagggctaccaccaacaaccgaaaccaaacctccatcagaaacttccaattcatccacgtacaaatcctcggtgttccgaagcgccgcatgcagcgccaccgccgccgccgcgaagagcagcgccaccacaacgttgagccagacgccggtaaggacaagcccggcgacggtgacggcggagagcgccgcgaggacgaggcggtcgtcaagctcgcggcggagcacgacgatggggccatcgcggaaaaagtagaggaagaaccacgcggcgaagacggcgaggaagacgacgagggagatagggaaccagaggaggctaaggaacacgaagaggagcacgaccatggcgtagttcacgcggaagtggccgaggttgcgcttcacacggagcgtggtctcgccgagggggttaatggacgacattgcgtcgaagttcgaagccctaattccctaaccctaaccctaacccgaagcgcgaagatgggagttggtgttccgagtatgagtatcgggaacgaatgtcgttttgatgtaataaccgcgtttgtgactgtgactaaaagttctcttaagtgttcaaactcaacgaagtcgttcttgatatctgccattatgaatctgactgcaccaatgcaacccaagatagcaacgattgaaaaccaggtagctattaaaatatttaatggtcgcatcaaaaggccaagtttggagttattggccgttcttcctgccttaaggtatgctaaaacggggaacacaaagtccaaaggagtgaacccaattgccccacagatagacacaaaatctccaaaaaagggcatagctgcagcaataagagtaacaagaaccatgaagatggaagtaaaaataagttgtgccgggcgatttctgaggggaaaaggaaaatggctagttgatttgttggacttggaaccccttgtttcctcaaaacaggcatatgttggcctgcagtatatctga

SEQ ID NO: 26664 - DNA, 219 bp, Glycine max
  Peptide Sequence Number=SeqID_143442
atgagagagagagagattaccgagaagagtgagaaggttgagccggtgagagacgaagacgagaggagcgacgacggagagaaagaagagagagaggatgagaatcctctggcagcgacggatgttgctcattggcgaagaagtagtagtgcattaaatttctcagattcagatcccggagaggataagatagtttcaccggaaggaacacgcgcgtag

SEQ ID NO: 26665 - DNA, 585 bp, Glycine max
  Peptide Sequence Number=SeqID_143443
atgtcgctttggatttgttatcacttacaaatgcttcgattgattctgtgcgtttctgtgaccggcgtttcagggagaggagagtttctcgaagatttgtatcgcgctacatacaggggagatactttgaagttaaatgctgtagaacaggaaggtgctgaaggattagaagagccaaatcaagttgtttatacggaaaaagatttttcttcgacaattagttacttttcagaaaagaataatgattttaaggaatctagaattgccggttacagaactaccactttggaaagaaatggattcaatcccgataaaagacaacaccagggagctcagcagaatgaattatccttcatggctcaaggtaggaacatacatgattcacagagaatgtcagagaagaatattgaagttacaaataagaaagttcaggagattaaggatcaaattattttagcaaaagcatacttgaaaattgcaccaccaagcagcaatttacgcttgagggatttggagcagctaacgagagagatggaattagcagttggagaagctgcccgggattcagatctgtcaatgaggtaa

SEQ ID NO: 26666 - DNA, 1182 bp, Glycine max
  Peptide Sequence Number=SeqID_143444
atggaggcttcactgtctaaagtctatcgtgctttcccagactgctctgccatgggtgctaagctccatatgatgcagcgtcaggctgaagagcaagtccgttctcagagacatcaagcaacatatcttgttcatattgctgcgaggaccgccccaaaaggccttcactgtctttctatgcggttgactgcagaatacttttccttgaggcctgaggagagaaaacttccaaatgaaaataaaattcatcatcctgacctttatcattatgctgtcttctctgacaatgttctggcatgtgcagcggttgttaattctactatctctactgccaaggaacaggagaaacttgttttccatgtattgaccaaatcactcaacttaccatcaatctcaatgtggttcttaataaaccctcctggcaaagctacagtccatatactgagcatagacaactttgaatggtcgtccaagtacaatacctaccaggaaaataattccagtgatccaagatacacttctgaactgaactacctgcgtttctaccttccagacatttttcctgctttaaataagatagtgctattagatcatgatgtggtggtgcagagagatctcagtgaactatggaatatcaatatgaagggaaaagtaattggagccattggaacttgtcaggaaggaaaaatcccatttcataggattgatatgttcataaacttgtcagatccattaattggaaagaggtttgatgtcaatgcttgcacatgggcatttgggatgaatttgtttgatttgcaacagtggaggagacataatttaactgttgtctatcagaattatttgcaaatgggtttgtggaacattggaagtctacctttaggctggctgactttctataacaagacagagttgttggatagacagtggcatgttcttggccttggttatagttcgaatgtcgatcgaaatgagattgagcaggctgccgttatacactatgatgggcttaggaagccgtggctggatattgcaatgggcagatataaaatgcaatctccaggcatagttcaaaattcaaagttccctctacctgacatgaccgggattctgcaattgtttaaagttctccatatctctgacctccccaaaatttccatgcacttctttctagaaacttag

SEQ ID NO: 26667 - DNA, 1854 bp, Glycine max
  Peptide Sequence Number=SeqID_143445
atgaaatcaccaaaaaaagcgcgccaactctcccgcgcggttcttatatttgccttggcacatcctccattctcaaccctttctccattctcccatactatggatcgtcctcccatccccgccgctctcccacccgctcacggaggagatgccgctgatgccgccaagcacggcaagaagcgcggcagttacaactgcggccgctgcggcctcccgaagaagggccacaactgcaccgtcaaaaccctcgcctccaccgccgatgcaactcccgattcgtctctctccgttgtctccgtcccttccgcggccgcgcccagtctccgaaagccttcgtcgaatctccgtcgcgcgctgtcgttcgacgatcttgatgaacgtcttcccgttgtcgatcggtccgaaccagatgaagaagtggattcggatgtgttcgatgagaccgatccggatctggatctggacgccgatgcgtgcgggctgccggctaggctcctgtgggaagtgatgaggaggctgccgccgccggggctgttgtccgccgcgaaggtttgtaagggatggagggatacggcgaagaggatgtggagagcggccgaggaattgaaaattagggttccggctaatgttcctgtcggatttgttgcctcgatgttgcaaaagtgtcctgggattgtgagactctcgcttagaatggagagtgattttgattcaactatgttggcttgcattgccttctcgtgccctaatctcgagtgtatggagatcttgacgtttgatactgcaaccattcggatcaatggagatgaattaggccgatttgttgctgataaaaaaagcctcaaaagcctcaagatggaaggttgttctaacctgggtggttttgtcctgtgttcgtctagtctttctacactctggctatcagatctgcactctctctctaagatgttgagagaggtttccttggagttttcttgccaagagaatgatagtacggatctcaaaactatgattgaaggtttgggaagaagttgtctgagattgcaaaacatacatatagcttcaatatggctttcacactctgccgtgcttgctcttacagctgctcagttgagggggctgcgaatgctttctctcgttcttggatccgaaatcactgatgcatctgttgctgccattgcctcaagctatccaaatcttgaattgcttgatctcagtggatctggcattagtgacagtggcattagtatgatttgcaatgtgttccctgatacattgacaagactccttcttgctctttgccctaatgtgacttcaagtggtattcaatttgctacgtttcagttgccacaccttgaaattatggactgtggcatgaccatatgtgatcctaatatgcaaaatccaactgcggatgaaaacaactgcaaattgcagaaaacatctgcctctaatgtacactttacaaaccaaaagctaatcatcaagcatagccgtttaaagaaactcagtttatggggttgcactggcttagatgccctatacttgaactgcccacgactcattgatctgaatctaaattcttgttcaaatttgcatcctgggagactgttgctccagtgccccaatttggaaaatgttcatgcatcaggttgtcaggatatgttaataggggccatccaaagtcaggtccatgatgcttctgctgatatggaaaaccattcaccttctaaacgtctacctgatggttccaaaaggatccgggttccacatttactcagtgaagagtcccctgaacctgaaaaaaaacgaaggaggatcgagagacagctttgtaatgtacttctggactga

SEQ ID NO: 26668 - DNA, 669 bp, Glycine max
  Peptide Sequence Number=SeqID_143446
atggatcatcctcccatccccgccgctctcccacccgctcacggaagagacgccgctgatgccgccaagtgtggcaagaagcgcggcagttacaactgcggccgctgcggcctcccgaagaagggccacaactgcacgaacataggcctggagtctgttggagtgaaactagctaaagatggagctatagaggttgatgaatactctcaaacatcagtttcttcaatttgggcagttggagatgttacaaacaggataaatctcaccccagttgctttgatggagggagaagcattagtaaaaacgctgtttcaggataacccaaaaaacctgattataggattgcacccagtattcaataatacagaaactgttgaaaaagtgtcaaactgtgttgctactgttccttctgctgtattttctcaaccaccaattggacaagttggtcttactgaggaacaggccgtacaacaatatggagatattgacatcttcactgcaaattttaggccgctgaaagctactctctctgggcttccagaccgggtttttatgaaattagtagtctgtgcaaaaacaaatgaagttctaggtttgcatatgtgtggagaagatgctcctgaaattgtgcaaatttttgtactattattctttgatgacaagttatag

SEQ ID NO: 26669 - DNA, 1500 bp, Glycine max
  Peptide Sequence Number=SeqID_143447
atggctgcttcttcttcttcttcaatctcaaacatgctcattattcccttttccaaaacacacgaacccatcagcttcagcttccaattaccacactccaaattcccaacatcatcacctctcacacgaacgcaacaaaagtcaatgaaactcgtcacacgtgacaactcctcacccaccatcggtgagctcgtgcgagaacaagaacaaacaacaacgcaccacaactacaagcccaagttagaggaacacctagagcgactcccggaagagtggcgccaaatccacggcgagagcgactgggccgggcttctggagcccatggacccacttttgcggtcggaggtgatccgctacggcgagatggcccaggcctgctacgacgccttcgacttcgacccgttctcaaagtactgcggcagctgcaggttcacgcgccgcagcttcttctcctccctcgaaatgccccaccacctcggctacgccgtcacgcgctacctctacgccaccgccaacatcaacctccccaacttcttcaagcactcccgctggtccaagatgtggagcaagcacgccaactgggccggatacgtcgccgtttccgacgacgccaccaccaaactcctcggccgcagagacatcaccatcgcgttccgcggcaccgtcacgcgcctcgagtgggttgcggatctcatggatttcctcaaaccaatctcatccaacggcatcccctgccccgatcacaccgtcaaggtcgaatcagggttcttagatctctacacggacaaagaagagagttgcggttatgccaaatactccgcaagagaacaggttttatcggaggtgaagagattgttggagatttacaataaggaggaagtgagcgttacgataacggggcatagtttgggaagcgcgttggcgattttgagcgcttacgatattgtggagacgggggtgaacgttatgagggatagtaggggtgtggcggttacggtgatgtcgttttcggggccgagggtggggaacgtgaggtttaaggagaggttggaggggctcggggtgaaggtgttgagagtggtgaatgtgcatgacgtggtgcctaaggcgccgggggttgtgtttaacgagcacttgccggcggcggtgatgaaggtggcggaggggctgccgtggagctactggcacgttggggtggagctggcattggaccacaagaagtctccgtttctgaaccccaatgctgatgctgtctctgcgcataacttggaggctcttcttcatctgcttgacggggatcctgctctggtgaacaagggatgtgatttcctgaaagaccattacttgattccaccaaactggaggcaagatgcgaacaagggcatgatcagaagcaataatggacgctggatgcaacctgagcgaccaaagcttgaagatcaccctgaagatatgcatcaccatctcaccctactgggtctggcttcatctgatatatga

SEQ ID NO: 26670 - DNA, 177 bp, Glycine max
  Peptide Sequence Number=SeqID_143448
atggtgaagcaacaattgtggttcaaactagcacagaggtatttctttgcacaaccatacattgcaagtcggaagatccctttaccctacctaaaagtgcgaaaaattgttaaactgaatggcgcatctcaaattgggtttggatcaagcttgaattttaaaattgattttgattaa

SEQ ID NO: 26671 - DNA, 183 bp, Glycine max
  Peptide Sequence Number=SeqID_143449
atgctctttgagcgtgcacatgatcctgtcccccaatccatcatgttcagggaacatttcaacttaaccttgcttcagttactaagtcaactaggcaccgctaatgatgatggagcagattttggactggtaactactagtctagctcctgttcttgcatttctccacggctcttggtgctga

SEQ ID NO: 26672 - DNA, 318 bp, Glycine max
  Peptide Sequence Number=SeqID_143450
atggggggtgcaaatagcaattatcaaatctgggcccttctagaggattctgtgcatttccttgaagcaacccaggcggcaaccaccgcccccattttgttaaaaaaatggcttctgggacacccagtattttcgatgcaggattgcttctgtaggaagcaacccagctcgcctgggcgagctgggcggcaacctcctcctttttttcctataaatagacaaaagggggctgttctacgggtccctgatccccttggctatgcatttcagttgtttttggtgaaaaaaaattgtttccgtgaagaaaatccaagctga

SEQ ID NO: 26673 - DNA, 192 bp, Glycine max
  Peptide Sequence Number=SeqID_143451
atggtgaagcaagtaatttccctcataccattttcccgcatagaccctaatgtggtattgagagggaagggtggaggtaagtgggaccctagggtaacagagccatgtgggtcaaaccctatcccatgtgcgccgctgcagggcaccccacccacttccccttcaatccccactcaacatcctctcttctaa

SEQ ID NO: 26674 - DNA, 282 bp, Glycine max
  Peptide Sequence Number=SeqID_143452
atggtcagaatcagaaggaagattcatgagaatcctgaattgggttatgaagaatttgagaccagtaaactcattagagaggaattggataaactgcgtatcccatataaacaccctgttgcaatcactggtgttattggcttcattgggacaaaaagatcgccttttgttgcaattagggctgatatggatgctcttcccatgcaggaaattgtagacagatgcgattaccattgcagttgtggtgaccctaaatctttgaatttgcagttgaaactgtag

SEQ ID NO: 26675 - DNA, 165 bp, Glycine max
  Peptide Sequence Number=SeqID_143453
atggcacatcaccgaccaataggcgaccaagtccaaagccaaagtcatagcaggacacacctagttgctcatgatcctaggtatttgaataaaacaagcacaagctcggaaggtagtgaaaataccttagatatgcatgtagcaagatacattggatatgcatag

SEQ ID NO: 26676 - DNA, 276 bp, Glycine max
  Peptide Sequence Number=SeqID_143454
atggatgaagatcagtggatgtatgatagtatcatgtccgaagaagttgaaatgaatgtcgaaaatgaggaagatgccgacgttaaagttgattgctctgatgcctttaatacttatgaggagtgggagtataggcctaagaaacataatttggtaagaacatgcactggcagtagaaaatgtggatgtccgtttaagttgcgtgcgaagccagtttcgggaggagacgacgagatggatgaaaagattgttgttgctgatatgacgaagtccatg

SEQ ID NO: 26677 - DNA, 440 bp, Glycine max
  Peptide Sequence Number=SeqID_143455
gacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggaccgagtgcctcccacgcccgggtcgtactcataaccgcatcaggtctccaaggtgaaccagcctctggtcgatggaacaat

SEQ ID NO: 26678 - DNA, 258 bp, Glycine max
  Peptide Sequence Number=SeqID_143456
atggaagaagaaaaagcagcggcgtactacgacgagctgacccgtaagggcgagagagctgcgaggttcaagcaaggtctcggcttttcctcttcagcaccaaacgacgatgttggaaaaccctcctcctccttcctctccaaatttgtcaaagcctcgttcgagtcgaagaaggaagcgcagctccaatccatccatgacaggctcaaggaaaagccttctttcaagagctactttcttttggtgccgcaaatctag

SEQ ID NO: 26679 - DNA, 453 bp, Glycine max
  Peptide Sequence Number=SeqID_143457
atgatcctagattttaagagaggtgaggactatattgaggttgtttgtggtgctacaaacaaaaaatatggagattatgttgggaggctaaaaattaataacgaaggtcaatatttcatcacttgtgagtgttgccctgactgtcccttggtgaatgccactctagaagcatttgacaaacatgctttaagggaagggagtggaaggtggaagagaaacatctgggttcattgcgaagaggaagacaaagttccactctggaagacacctctgataaagtattacacacaccaggcaaatgtggctaactggaaagactctgcaatgaggaaacaaaactttcatagggatgagttcctacgttgcacgagatgcgggaaggagtgcaggttccatctcaagagcagaccagacattaagaactaccatgatgctttaaccaacaaacgctag

SEQ ID NO: 26680 - DNA, 396 bp, Glycine max
  Peptide Sequence Number=SeqID_143458
atgaggaggtgtccattgctacctccagtagtacctgaagaagaaaatgaggaacctagtagagctgctaaaggtgtaattgagggtgcagctcaaggtgcagctgctggagttcaatatggaccaatcaatgtagttgagggagcggctcgggttggaaataagggtgcacctgccgaaggtcagactcaggaaaaggggtactgtgggcacgacactactgtcaatgaaaaagtacaaaaacttgctcctaaacgcaaggcaccaaaaacaagggaaaaaattaaaggttgtcaactacctactattgagaagaagattaagctaggaattggacttgttgccactcagaccaaaccagacgcatcaattaaagatacagatagacaaaaataa

SEQ ID NO: 26681 - DNA, 237 bp, Glycine max
  Peptide Sequence Number=SeqID_143459
atggcgtgtagccctctgaggctgaggatgtgtagtcctctgaaggcgaggatgtctagtcctttaaagcttagggcgtacagccctctaattgcgaggacgtgtattcctcttaagccctctgatggtgaagacatgcagccctctgaaggtgaggacgtgcagccctctgatggacaggacgtgcagccctctgatggtgaagacgtgcagctctctgaaggtgaggacgtgtag

SEQ ID NO: 26682 - DNA, 639 bp, Glycine max
  Peptide Sequence Number=SeqID_143460
atgaaagggctgcacgtcctgaccttcagaggaatacacgtcctagccatcagagggctgcacgcctacacctttagaggactacacgtcctcgccatcagagggttgcacgccgtcaccttcagaggtctacacgtccttgccatcagagggctacacgccctaacctttaaaggactacacttcctacccatcaaagggctgcaggccctcaccttcagaggactacatgtccttgccatcagaaggttgcacgccctcacctttagaagacaacacttcctcgcaatcagagggctgtacgccctcacctttagaggactacacgtccttgccatcagaggactgcacgacctaaccatcagaggactacacgtcctcgccattagagggtcgcatgccctcaccttcagaggactacacgtcctcaccatcagagagctacacgtcttcaccatcagatggctgcacgtcctcgccaccagagggctgcacaccctcaacttcagaggattagaaatcctcgcctttagagaaccacacgtcatcgccatcagagggctgcacgccctcacctttagaggacaacacgtcatcaccatcagagggctgcacgccctcacctctagaggactataa

SEQ ID NO: 26683 - DNA, 780 bp, Glycine max
  Peptide Sequence Number=SeqID_143461
atggcggaaccatcgaaaaagcggaaaggaacttcgactcggagtcagcgacattctgggtcacaggaagcaccaattcctccctccattccctctggatcattattctcatcagaggaacagcatatacggtacacaaacctcttttcctctcgttccattgtagacccaaaattcatagatatggagttcttctcaaatgagaattttgaatgcttccaagcatttgaaaactccaatcttattccattcatgtctctgaaattacatgtctattatgaattagtcaaagccttctattctaatttagaaattcatgaatgtgttctaatgtctgaaatctatgggattaagatggtcattgaccaatccctattttttgacttaaccaaattgcctagtgaaggtgtgccttttgagggcgcattgattgatgaatggaaattcgatttctctgtacatgatgcccgccggttggtttgcaccaaccaagcggatatgaccggaagacttattgccggttcattggcttttgaaagccgcatcctccattgccttatagttcgcattttgcttcctagatcttcaaaccttgcccaggtttctgaagaagatctcattgtcatgtgggcctttcataaagctttacaaattgattgggcatatcttgttagatatcgcatgcataaggcattgcgattgaatgccccattgccttatcctcaccttgttaccctcttccttcaacatttcaacatccctcttgattctgaactttat

SEQ ID NO: 26684 - DNA, 294 bp, Glycine max
  Peptide Sequence Number=SeqID_143462
atgagaacgagagtgaatagagctgtgagtaagagtgagaacgagagcatgaaagtgatagcgagaatgagagtgcaagagcgagaacgagagttaaagatgatagcgagagcgagagtgagagcaagaacagtgtggtcgtgtcgccgtggagagtgtgtgagagtgagagtgagaacgagagcgcgaaatgattggaaggacataatggtgaagctaggcaagattacaattcaatttttcttgatattggagggacatattggtgatatatttccggatttacacttttga

SEQ ID NO: 26685 - DNA, 564 bp, Glycine max
  Peptide Sequence Number=SeqID_143463
atgactttgctcttcaattggctgtgtgagcatgaaagaagtaaagttgtaaagagtgagaagaagatcattgaagatagaatcgccaagctgaaacaaagtgttgataacctatgtgttgatttgcacaagagcattttgactaaggataactcgaatgttgagctacctaaggccaagaaacatattattatcgataattgggaaggtttatggaagtttatacatcaagcacatgtgttagctcttggagttggcatagatttatttaatgtagacaaggacataaaaaatgacgagcttgttagggagtcacaaatgtttgaggaagaagaagaggaggaaagtgaagtggattccaatggcttagactcgacctttgagaaacatgaagattcgaacttggcctttgagaaatgtgatggcttggattcagcctttaagaagtatgaaggctcggactcggcctttgagaaatgtgatagctcgaactcagactttgagaaatgtgagactcggcttttgagaaatgtgatgtcttggactcggcctttaagatgttag

SEQ ID NO: 26686 - DNA, 468 bp, Glycine max
  Peptide Sequence Number=SeqID_143464
atgtctttcatttttgtgattgtagttgtgcgtgatggaaaacccattggtttaaatgttgcttcaaattggttgtacgtttatccaagaggatttcgagaccttttgttatacactaaagagaaatacaacaaccctttaatttatattacagaaaatggtataaatgagtatgatgattcatcattatcacttgaggaatctcttcttgatatttatagagttgactatcattatcgtcatctattttatcttcgagaatcaattaagaatggtgtgaatgtaaaaggatattttgcatggtctttgctcgacaattttgaatggcacttaggttacactgtacgatttggaatgaattttgtagattacaaaaatggcttggaaagatacccaaaactttcagcattatggttcaaggattttctcaaaattgaaatcaaacttcatgaagattccatgcaataa

SEQ ID NO: 26687 - DNA, 354 bp, Glycine max
  Peptide Sequence Number=SeqID_143465
atgctaccagttgtgtcaggcttagtgtgcgccacgtgctcagccaatcaccctttcactcctgggatggcatccaagaagaagcgtgcttcttcctctcggcctcaagaatcctatgactcctcacgttttgtgtcgaaggaggcatgggaccgagtactctcgctactgccatacctaccccgaccaccaggccatagcggccaagctatgcattccagggcggggatttatgctaaatgcggaaggagccccctgcaagttgctgagaaaggacctaactaccttggctcagacctagagtgtcatatcttactccaacctagcccccacctcctatacctcagaccttaa

SEQ ID NO: 26688 - DNA, 330 bp, Glycine max
  Peptide Sequence Number=SeqID_143466
atgaggctcaatgcctatgattcttccaagttatataaacaggagatgaaggcctaccatgacaagaaactattaaagaagagttttcaactaggacaacaagttctgctcttcaattctaaacttaggctgtttctgggcaaactcaagtccaaatggtctggccccttcaccatcaaagaggtaaagccttatggagttggggaattgatggatccttcttcagatgattcgaagagaagttgggtggtgaatggccagagattgaagttgtaccatggtggcaacattgagagaataaccaccattctcaatctgcaagacccttag

SEQ ID NO: 26689 - DNA, 546 bp, Glycine max
  Peptide Sequence Number=SeqID_143467
atgttgagacgcttaacacctttctggagacccccgtggttttggagtcaggggagagatattcagcttactccaggttctgtcgcactcacccagatccttaggagctcaccaccagactttggagcaccctggaagctcctgaggaaggatctcacgacattagctcagacctggaacgtcttgtcttattctaacttcgcccccaccaattatacgtccgatcttaacatggatagggcgagaagaactactggaacccggatgatcccacgatcacttttccggggacctgcaagtctagggctcggggaccctctaatgcctccacttttgctccagcccctccagtacccacaacgcccttcaccatggcttatgcctggaggaggtgaggcttctacaactcaggagccgcagccagagtcggaggcgacactggaggagaagtcggaggacatgtcagccgccatacccatggaggtcactaaggagggagatggcactgcggacacaaattatgtcgcagatatgacaacagcgtag

SEQ ID NO: 26690 - DNA, 2907 bp, Glycine max
  Peptide Sequence Number=SeqID_143468
atggaaagaggtgcttacagaggccgtggccgtaacggtaatggtggccgtaacagttacggtggtggtcgcggtagttacggtggtggccgtgacggtaacggtgaccataacagttacggtggtggccgcggtggtcgtagcagttacggtgatagaagttctccttctcaatcacagtggcaaccaaggtcaaacccttctttttcttctccaaaacctaacaattctcattctcaagttcaaacacaaactcaagctcatccagacattggatcttcgaagataccagagaagaaaatggacaccatcacacctgtgcgtaggcctgacaatgggggaacagttgcagtgcgaaagtgctatctccgtgtgaaccatttccctgtttccttcaatccacagagtataattatgcattataatgtggaagtgaaggccaaggctcctccactgaagaacaatcgtcctcccaagaagatttcgaagtacgacttgtcattgattcgggataagctgttttccgacaattcactgccagcttcagcgtatgatggtgaaaagaacatcttcagcgcggtgcctttgccggaggaaacatttaccgtggacgtgtccaaaggagaggacgaaaggcctgtttcttatttggtctctctgacattggtgagtaggctcgagcttcggaagttgagggattacctcagtggaagcgtgctttcgatccctagggatgttttgcacggcttggatttggtggtgaaggaaaatccttcgaagcagtgtgtttccttggggcggtgcttcttccccatgaaccctcctttgaggaagaaagatcttaaccatggcataattgcgattggagggtttcagcagagtcttaagtctacttctcagggattgtccttgtgcctggactattcggttttgtcctttcggaagaagctgttggtgttggattttctgcacgagcatattagggacttcaatttaagggagtttgggcggttcaggagacaagttgagcatgtacttattgggttgaaggttaatgttaaacaccggaagacaaagcagaagtacactattactaggttgacacccaaggttacgagacatatcacattccctattttggatcccgagggccggaatcccccaaaggaagctactctggttggttactttctagagaagtatggtgtgaacattgaatacaaggacattcctgccttggattttggaggcaacaagacgaattttgtgcctatggagttgtgtgagttggttgaggggcagagatatcccaaagagaatttggacaaatatgctgccaaggacttaaaagacatgtcagtggctcctccaagggtgaggcaaagtacaatacaagcaatgagacaaaggcctcacaaaatctcttttgacagaggtggtgttattaaaaattttggaatgagtgtcaacacttccatgacaaatgtgacaggacgtgtaattcagcctccacaattgaagctaggtaatccaaatggccagactgttagtatgacacttgaagtagagaaatgtcagtggaatctagtgggacgatcaatggtggaaggcaagccagttgagtgttggggcattcttgattttaccagccaggagtctggttggcgcaaattaaacagcaaacaattcattgagaaccttatgggtaagtatagaaaattgggtattggcatgaaggagccagtttggcgtgaacaatctagtatgtggagtcttggggattacaattcgctgtgtaaattacttgaaaatattgaggataaggttcaaaaaagatatcgacgaaaactacaatttcttctgtgtgtgatgtccgacaagcatcaaggttacaagtgcctcaaatggattgctgagaccaaggttggcatagtgacacaatgctgcttgtctggtattgctaatgaagggaaggaccaatatcttacaaatcttgccctcaagatcaatgccaaaattggaggaagtaatgtggagctcatcaataggctaccacactttgagggtgaaggtcatgttatgttcataggggctgatgtcaatcatccagcttcccgggacatcaacagtccatcaattgctgctgtagttgccactgttaattggcctgctgcaaatcgctatgcagcacgtgtttgtgctcaaggtcatcgggttgagaaaattttgaattttgggagaatttgctatgaacttgtttcgtattacgataggctgaacaaagtcaggcctgaaaaaattgttgtctttcgtgatggcgtgagcgaaagtcaattccatatggttctcacagaggagttacaagatttgaaatcggtgtttagtgatgcaaattacttcccaaccatcactattattgtcgcacaaaagcgacatcaaactcgattttttcctgtgggtccaaaggatgggattcaaaatggcaatgtgtttccaggtacagttgtggacacaaaagtagtacatccttttgaatttgacttttacctttgtagtcactatggaagcttgggtactagtaagcccactcactatcatgtcttatgggatgagcataaatttaactctgatgatttgcagaaactgatatatgacatgtgctttacctttgcaaggtgcactaaacctgtatctttagtccctccagtgtactatgctgatctcactgcatatagaggacggttatactatgaagcaatgaatcaaatgcaatctcctggttcagctgtgtcgtcttcatcatcacagattacttctttgtcaatttcttcaacaggctcaagtttaaatgatccggggtattacaagttgcatgctgatgtggaaaatataatgttcttcgtttga

SEQ ID NO: 26691 - DNA, 399 bp, Glycine max
  Peptide Sequence Number=SeqID_143469
atggcgattggagggtttcagcagagtttaagtctacttctcagggattgtccttgtgcctggactattcggttttgtcctttcggaagaagctgcaggagacaagttgagcatgtacttattgggttgaaggttaatgttaaacaccggaagacaaagcagaagtacactattactaggttgacacccaaggacattcctgccttggattttggaggcaacaagactaattttgtgcctatggagttgtgtgagttggttgagggacagagatatcccaaagagaatttggacaaatatgctgccaaggacttaaaaggcatgtcagtggctcctccaagggtgaggcaaagtacaatacaagcaatggtaaactcagaggacggaccgtgcgggtaa

SEQ ID NO: 26692 - DNA, 312 bp, Glycine max
  Peptide Sequence Number=SeqID_143470
atggaaatgatccattggtgggaaaaattcctcgaaggggtgcaatggaaatggtcaagatcttttcgtggaggtctaacaaatattgtaacggattctgagggctttgttttcttggcgagtccgataggcgttggcggttccagcaaagagccaccagatggtaatggtggtgctggagttaaaaatcgactgtcgtttaacgggaaaaacttaaagcatgtgggaggtgagaatagcaaaatactcgggatgaaaataacaactcccatgaaattatggagggtttttgttggtgtaccaattaattaa

SEQ ID NO: 26693 - DNA, 2961 bp, Glycine max
  Peptide Sequence Number=SeqID_143471
atgacttccctcagagaactcctcacagacgaaggcttctaccaaacaacccctaacaacaacaaccctttgaagccaaagctcaaactctcaccaccaacaccagagataatactaaactcactccctctacacctatgcaatgacagaaaaagctttgttgattgctccaacaaaagcatagacaagtccatgacaagaaaagggtcttggccatttcactccaatactcaaagggttgttgttggttcagtttctgaaacttcattggtgtcaccaccaccaagaactgttgtgggaccccccatggatgaagttgccacaagagcagtggttgctatcctaagtggatacattggaagatatgtgaaagatgatagtttcaggaaaatggtaagggacaagtgcaattcttacttggtcagaaggagaagaaacggttcaggatcatcatcggaagaagaaaatgaggttctggtgaacatgaaactaggcatggagaatattgacaagttggtgcaggatcaagggacaaagaaagatatgaagatcaaaagcttgaggaattccattgagcttttgaccatagttgcttcactgaatagtaaaattagaacaacatcaagggaaagtggttcaacttgtggaatacccaattcccatatctctgcttgtgctcagctctacttggcaatagtttacaagcttcagaagaacaacaggatttgtgctaggcatttgctgcaagtattttgtgactctccttttttggccaggacttatttgcttcctgacctttgggagcatgtgttccttcctcaccttctccatcttaaaatttggtatgccgaggagctcgacgcagtttcggcctcaagtgaatgtcaaggtgagaaggacaagaaaatgaagaccttgagcaaggtgtatggtaacaaggtggacacaggaactgctatgtttgctttgtattacaagcagtggcttaaagttggggctaatgagcctcctcttcctattgtctctttgccttcaagaccaagttgcagatcatcaagaaaaatgtcttcagattcttttgttttgcattcctctatcaacacaaacttatacaaggaagtatttggccccaaactagagatgaaacctacccctctagctgaacaaaatggattgttgacaattagatggagctcaaggaatcatgaatacagctgcagttcacttcagaaagaagagacaatatacctaggaagatcatcaaggtcaattgacaagagttatgctgaaataaggctagggtcacagagattggacaattttcaatgcttttcttgcaggagtatgcaagcagaaagcttggtgaacagcagctacacatcctgcaatgcttcatttagaaatgaaacaactgtcctttcaagtgaatttgttggagctcttacaactatatgttcatcagatatattaagtgaatgtgaattctcaattcgtgtgattgccaaagcatggttgaactctcatgctgaccctctaattgaagaagcactgtcacagtctagtgtggttgaggctatccttgaggtattgtttgcctcaagtgaagatgaaattctagaattggctatatcagttttagcagaattagtaggaaggaatgatgcaattagacaaattatgctgaactcggatccacgactagaaatctttgtgagacttctaagaaggactggcctatttcaaaaagctgcagttctgctttatctgttaaagccacaagcaaaacagatgttatcaccagaatgggtgccactagtacttcgagtgttagaatttggagacaaagtgctgaccctcttcacagtacaatgcaatcctcaagtggctgcaatttactttctggaccaacttcttactggtttcgatgaagataggaatttagagaatgctaggcaggttgtttcacttggtggattgacccttcttatgaaaagaattgaagaaggagaaatccatgagagaaacaatgctgcttttatcatttatagttgcattcatgctgaagaaagctgccggagttttctagctgacaatataaagaagagttctttactagaactcatcgttcttggcaatagtaaaaattgcagtggatgtgccttttctgtgctagctgagttactataccttgatagaactaccaagattttaaatttcttgaggggacttaaagatggatggggtggcctaaacacaatgcacattctgttcatctaccttcagagggctccacctgaagaatgccctttggttgcagtggtattattgctgtttgatattatggaagatcctttcaaagagagcttatatagagcagaagcaattgaggcaattgtggctgctttaaattgtcaagtgtgtaatgacaaaatacaagaacaatcagcaagagctttactcttgttagcaggacacttttcttatacaggagaatcattaatggaaagaactcttctacaacaagctggcttccaagaaaattgcttagaagattcctcttatggcaaggaaattgttgtttatgattcagctcacaagaatgaagaggatgatgaagctgaaagttggcgaagaacagcagccaatgtcttgttgaaaagtggaaataagaatttactaagtgtactttcagattctgcagcaaatggagttccaagtttagcaagagctagccttgtaacaatttcatggatgagcagctaccttcacttagttgatgatagaaagcttccaccaatggcattatcaatcctcatgccattgttgctaaaatacttgaattatgacaaggatgttgaggcaagagtcttggcttcatattcattgctatgccttgtaaaaatttcaggtatgaactctgaaacttttgccattttcagaattatgccaaaattgtcctag

SEQ ID NO: 26694 - DNA, 219 bp, Glycine max
  Peptide Sequence Number=SeqID_143472
atgagagagagtggtaggaacttaatgttttcatatggtggtgagattgaaagtgctgggaatttgaactctgagggtgatgtaatcaagtatggacgtgtaccaaagaagaatcatagcattatattggccaggaaaagaaaatttgaggaagagacaaacaactcatatgttggagcagagtcaagtacccatgacccaagcaacgatgttcattag

SEQ ID NO: 26695 - DNA, 2502 bp, Glycine max
  Peptide Sequence Number=SeqID_143473
atggagttacgcaccgcaattcttcaatcctcttcttcgcttcctccgaggtttcacactctcaaacccactccagatttcgccttccccttctcattattcgtttcaaacccacttcgactttcgtgtttcacttttgtttccaaaggagatgatcctaattcctgttatgctaacttgtttcttggtcaagcagaccagcagcattcctttccagtcactgcacgcgacacaagagcagtgctgaattgtatcagtgaagggttgtcatgtaccggtgcctccagtggtgattgttcttgtgatgataaaagggatgatgatgaagatgccatggggttcttgaataactatgaaatgatcattagagattgtgacaagctaattgaggctttcatggttgacgagagaaattggaggaggctgttagttttcaacaaaaagtggaataatattaggccccatttttttagacactgtcaggataaagcagacacagaagacaatccggtgacgaagaacaagctgctctggcttggaaagaagcttaaagagatagatcaagagttgcaggggcacaatgaacttatcgaaatgatcaaagggaatccatctaaaatttgtgaaattgtctccagcagtcgtaaagatttcacaaaagaattttttatgcatcttcatacaatagctgaatcttatggatacaatctcgaaaggcaaaatgatttgttaaagctttggaacacgtgcttggctgctgtaaaagtctacgatgctgcaactgaaagcattgaggcactaaatgctgcagagttgaatttccaagatattatcaagtctcccccggatgctttctgctggaagatagacaatttagctgagaaaagtcaatgcttcaatccagaattagtagctcattggctgcgattgtgttataatatggaagaagtaggaagggtacacacaattgtcttgaaattttttatacatccagttacttatgtagataataatttgatttgtagttatttaagattgggcaagttagctcaggctcgtagagtgtttgatggaatgtcaagaaagaatacagttacgtggactgctataattgatggatatttaaaatttaacttggatgatgaagcttttaagttatttcaagattgtgttaaacatggtgttccagcaaacagtaagatgtttgtctgtatcatgaatttgtgtggtagaagagtggatttagagcttgggaaacaaatccatgctcggattttgaaaagcagatggaggaatttaattgttgacaatgcagttgttcacttttatgcaaaatgtggcaatatatcaagtgcatttcgagcatttgattgtatggctgagcgagatgtaatatgttggacaactatgattactgcttgttcccaacaagggtttggacatgaagccttgtcaatgttgtcacaaatgctaagtgatgggttctatcctaatgaatatactatatgtagtgcactaaaggcttgtggagagaacaaagcattgaaatttgggacacagctgcatggtgccataataaagaaaatctgcaagagtgatgtttttataggaacttccctagttgatatgtatgcaaaatgtggagtgatggtggattctaaagtagtgttcgatagaatgagaattagaaatacagctacttggacttctattatatcaggatatgctcggaatgggtttggtgaagaggccacaagcttctttcgattaatgaagatgaaaagaatacatgttaataagttgacagttttaagtgtcttgatggcttgtggcacaattaagtctttgctatttggaagagaagttcatgcacagataattaaaagtaatatccataccaacatatatgtaggaagcactttggtatggttctattgcaaatgtaaagaatactcctatgctttcaaggtgctccaatatatgcctttcagggatgttgtttcatggactgccattatctctggttgtgccaggctcgggcttgaacatgaggctctggagtttttgcaggaaatgatggaagaaggcgtgttgcctaattcctatacttactcgtcagccttgaaagcttgtgcagaactggaagctccaattcaaggaaagttaattcattcctacgcgagcaagacccctgcctcgtctaatgtatttgtaaacagtgctttaatatatatgtattcaaaatgtggatatgttgctgatgcttttcaagtttttgacaacatgccggagaggaatgtggtttcttgggaatccatgatattggcttatgcaaggaatgggcatgctagagaggctctgaagctcatgcatagaatgcaagctgaaggttttgtggtggatgattatatccatacaacagttattagtgcatgtggaggcgttgagcatggagacattcatcaggatagtgagtattcttcacattacttgcattcctag

SEQ ID NO: 26696 - DNA, 429 bp, Glycine max
  Peptide Sequence Number=SeqID_143474
atgaacccaactcaacgtcaagccttccacaaggcatatgggaaaaactgggatttttccatgatagaagtgtctgttgaagacatcgcatccctcgctcagtattatgaccagtcgctaagaatttgcttaacaaagggggagaatgtgaatcatgcatgttttgatgatatcgaaaagaaatcacttgattgtcatcataaaaaaggggaagaatgtgaatgtatgatgatgccaaagaagaatcaaacaaggccacttcaaaggataagcatttgcttcaagattaattcaagattgcttcaacaaacaaagccttgtttcaagattcacaaaagattaagccttgcctcaaaacaaagggtttcaaagtcatgtaaggctctggtaatcgattaccaaaagggaagaatgaaaaagaactgttga

SEQ ID NO: 26697 - DNA, 348 bp, Glycine max
  Peptide Sequence Number=SeqID_143475
atggagctcgcactccctttctcagtcggattcatcttaacaattgtattcctcccttccttagctccactacctcttctgtcttcctccttgttccttcctcttacaatggcaagaatgcctttagagcctttaatagtggggagagtcataggagaagttcttgattcttgtaccacaagcacaaaaatgattgtgagttacaacaagaatcaagtctacaatggccatgaactcttcccttccactgtcaacaccaagcccaaggttgagattaagggtggtgatatgagatccttcttccactgtcaacaaagttttttggggaaaaagagaggaaaaacttga

SEQ ID NO: 26698 - DNA, 549 bp, Glycine max
  Peptide Sequence Number=SeqID_143476
atgggcacttgccagtcgacaaggaaagtctcgacaacactgtatgcgaaaagtacgacattagcaaggagaagtggacccaattttcatgtgcgaaaaaaggcacaggccatccagaagcaaaatattgccccttacgtgttgtctcgtggaggttatgaatatttagaaaacaagttgatggatgagaagagaaagaaaaaactgaaggaagctgctcaatccggaagcactgacgccgtgattgatcctccatctcccatcaaacgacacgtgaaatggaagatggcccgcaccaagaaaactaggcaaatgacatctgagacagtaaaggaaattgctaacaagattgattcattgaaagaccaggcctcacagggttcctttgtcgcccatggacgtcatgatgtactgattgctgccattgggcgaccagaacaccctagtcatgtgtgtactgctggagtcggtgtcacgatcaaacaatactttggaccagctctaaggacctcccgcacgtcttccttcatggctcttgaagacctgtag

SEQ ID NO: 26699 - DNA, 177 bp, Glycine max
  Peptide Sequence Number=SeqID_143477
atggtcaaccggctgagtcggtcagaagcatcgaagacgttaaggccgcgaaatcaaacttacaaggcgcttcgcaaacgggtgacgtccacaagagcaaattacacaaggacaaaggcgattaccatcaaaggtaggggtaacgtgagtgcgggaaccaccgaggacagagagtga

SEQ ID NO: 26700 - DNA, 552 bp, Glycine max
  Peptide Sequence Number=SeqID_143478
atgaaagatggtggtaggaagcagggtgcaccctcaccctgtgctgcatgcaagcttcttaggagaaggtgtgctcaagattgtgtttttgctccttattttcctgctgatgagcctcagaagtttgcaaatgtgcacaaagtctttggtgccagcaatgtcaacaagatgcttcagggtaaggctgcgtacaacatccctcccccataccttcgcatagcgaagagccttcgggcaatggggtacgaagacttaccagagcatcagcgaggagatgcagtgagcagcatggtgtatgaagcaaatgcaagagtgagagaccctgtctatggctgtgtaggggccatctcatctcttcagcaacaaattgatgtgttgcagacccaattggcagtggcacaggctgaggctgtgcacctcagagtgcgccaagctgcatcactctacagccccactagcccaaccaacagtggctctccatcacaagccaagcctatttttgacatggacatggtggtggaccagaccccctatggtgattcaatctggtga

SEQ ID NO: 26701 - DNA, 1635 bp, Glycine max
  Peptide Sequence Number=SeqID_143479
atgacaggacttatgcctggagagttgccacatcatggaacacctgatggcaactctggtaaaagttctcaagacaagcaagaggaatcattaggtcgctggtatatgtctagaaaagaaatagaggaacattccccatcaagaaaagatggaattgacttgaagaaagagacatatctgcgcaagtcatactgcacattcttgcaggatttaggcatgagacttaaaaccattgcaacggtctgtatgttccttgctgggaaggttgaagagactcctcgtccactaaaggatgttattcttgtttcttatgagatcattcacaagaaggatcctgctgctgcgcagaggataaaacagaaggaagtgtacgagcagcaaaaagaattaattttacttggtgagagggttgtgcttgccactttaggttttgatctgaatgttcaacatccatataaacctcttgtggaagccataaagaagtttaatgttgcgaagaatgcccttgcacaagttgcgtggaactttgttaatgatgggctgaggacatcgctctgcctgcaatttaagccacatcatattgcggcaggtgccattttccttgctgccaagttcttgaaagtgaagcttccatcagatggtgagaaggtttggtggcaagagtttgatgtcaccccacgccaattagaggaggttagcaatcaaatgttggaactctatgagcagaatagacttccaccagcacagggaagtgaagtagaaggaagtgctggaggaacaagagctgcttcaaaggctccttctgcaaatgaggagcaggcctcaaagcaaatatcatctcaagccccccagcactcatctgtagagagaactgcggtaccacaaagaggaactgagaaccaaagcaacgatgggagtgcagaaatgggcagtgacatcactgatcacaacttggatattagggagtcacataattcagaacagttgactcatcaagataacaagagagaagtgtcaaatagatctaaatctggtactgaacgtgaccaagacagaattgttgggactaaggagggtgcagaagtaggaaggagagatgaatctgcattaaacaattctggcagcaatgttggccgaaatctggagcgtcgggaagttccactaggtcattcacccaatgaagcaatcaagattgacaaggataagttaaaggcactggcagctatgggaaagaagagaaaggaacaacgaggcgaaatggcattaaagaaagatgtaatggatgaggatgatctcattgagagggagctggaagatggaattgaattagcagtcgaggatgagaaaaataagcgtgagagaaggcagaactggtctaagcctgatggtgaagatcaccatgggggggagaaccatgaggaaactagagacgggcggtacatgaacatgaaggtgcagtttcagaaagacatggacgaagacaatgctgaagaaggggagatgatagacgatgcttcatcctcgttgaacaatcgcaagagaaggatggggagccctccaggtaggcaaccagagatgaaaaagcatcttgattccaggaaaacacaaggaatggggagcaaaatcattgttgag

SEQ ID NO: 26702 - DNA, 645 bp, Glycine max
  Peptide Sequence Number=SeqID_143480
atgaatctggtattgcttgaagttgaacagctgttacaggccaatcaaagatcacttaaagactatccttccaggtcatatcctgagaacgcaaatttactaacacatgcagacaacgacctcattttgtctgagctcaatttcaacaacgaagaacttagatcagaattcttgaaccttttttctcaaatgacagaccaacaagcaaaaatttataaccaaattattcaggctgtcaataaaaatgaaggtggaatgtttttcttatatggatatggaggaacaggaaaaacatttatttggaagacacttgcagcctcattaagagctgacaataaaatagttattatggttgcttctagcaacatagcttctttgttattgcctggaggaaaaacaacacattcaaaattaaaaattcttgttccgatatttgaagactcgacatgcaatattcatcaaggaacacaattggctgaattattgaatgaaacaagtcttatcatctgggatgaagcccccacggctcacaaattctgttttgaagcacttgatcgaagtctaagagatgttattaaggcgaaatcaagttctgataaaatttttggtggtaaagttatggtatttggtggagatttccggtag

SEQ ID NO: 26703 - DNA, 849 bp, Glycine max
  Peptide Sequence Number=SeqID_143481
atggcagttgaggctcctccgcacaacatgaatctcttcccctcgcagttactaaccgccagagaaatgatgaaaccgaatcttggcttctacaccgcacagcaaacggaagctgctgctacgcctcttcttcagtcaacggcgttaccttttctccaccaatccgatagtggcctcacctgccacgtcaccaccaccgctccgacgagaaaacgctccagagactccatcaccactgtaccaaacgcgcttctaccacttccgcagaagaacaaactatcatcatcatcatcatcatcaccaccaccgtccattctcgatcaagagcttctcttccatttccagaaccagcaatccgagatcgaccgcttcatcgtacaacacacggagaaagtgagaatggagatggcggagcagcgagtgaggcaatcgagaatgttgataacggcgattcaagaagccgtggcgaagaaactgaaggagaaagacgaagagattcagcgcgtggggaagttgaattgggttctgcaagaacgagtgaagagcatctgcgtggagaatcagatttggaaagaactagcgcaaacaaacgaagccaccgcgaataatcttcggaacaatctagaacaagttctggcgcacgttagcgaagatcaccataaccacaaccaccacgccgtcgaagcggcggaatcgagttgcgcgagcaacaacaacaacaaccaccaccaccaccgcgaggaggaggaggtttgcggcggatacgagcgaaacgacggcgttttggggaagaggatgtgcaatcagtgtgggagttgctggaatttgttattgcttgaatcagtgtaa

SEQ ID NO: 26704 - DNA, 204 bp, Glycine max
  Peptide Sequence Number=SeqID_143482
atgggatttctaaaaacattgaccggacacgtagactggaagagtgcacatcgagaagcattggacatcctcaatacagtggggatatcaaactctgttttgaggctaattgagagacgaaaccgagtggaccaatggatcaaatatgcagggatgctattgactgtcattttcctgttcgggtttgatacctggagacattga

SEQ ID NO: 26705 - DNA, 1266 bp, Glycine max
  Peptide Sequence Number=SeqID_143483
atggtgtcagcttggagatgcaaccaacatgtaatagtgctggaggactactatgcatttggaatgaggaagaacatgggcggcaaatggtgcaaaagtgataattgtaaacatttactcgccttggaatacaattctgaaaagaaatctgtgggaacaaatctgacagctaagaagtgcaattatgggggggctatgggagaaagttcacctagtacaaaccaaatggaactgccaaaagtagattggatagagtgcttgtatctgcagaatgaaaataagaagttaaagtgggagattaacaagctggaagtagaagcaaggactacatggattaaggaaggtgactacaattcatggttcttccacatgactgtaaattggaagcgtagaagcaatacgattaaagatgaaaatgaggtgagggatgcggtgtgggaatgtggcagcgagaagagtcttgaaccggatggtttcctggaatcaacttctatttctattttggccaatgggcgcccaaaagctgagttcattccccagagagatctcaggcaatgggacccactagcccctttcctattcaacattgtagctgggggattaaccgacgacatagtcttctttgggtcagcgatgatggagaatgtcaaagcaatcaagggtgctgaagaaggtgatggacaagatggtaaagctacagaggaggcaaggggcatgggtattagggatttgagcaagttcaactacgctttacttgggaaatggcattggaacttgtttcaccgtcaaggtggactgtgggcacaagttctgaattcaaaatacggaggatggcggaatctagatgagacaagaagattcaatagagaatttataaggtggagggacctaagcttcattttcaatttgacgaaggaagggagctggtttaatagaaacataaaatggaaaataggaagtggttcaaaggtgctgttttgggaagatgcttggaaggaggatgaagtgtcgctgaaggagaagtatccaagattgtatcagatttctcaacaacaagttcagcaaatggggataacaacaaacacaggttgggaatggcaactccagtggaggaggtttttactggaagcagaaatagctgcagctgcaaattttatggaggatatacagagtttggaagtacaaatgcagcaacaagacttagacttggggaggggattcaagtgggaagtattcagcgggaaatgcttatatgcttcccaatag

SEQ ID NO: 26706 - DNA, 213 bp, Glycine max
  Peptide Sequence Number=SeqID_143484
atgtccaatgatttgattatagtgtcaccactttattcttctaaagtttttaacatgcaaccaaggggacattccatgtgctggggaatcccattacatgtatgggacctggagaatatcaagaagatagtggtggcagtgggagaagtggtggactttgacgacaacgttgaagatcccaacaatcaaccacaatgtgctggtgtccattaa

SEQ ID NO: 26707 - DNA, 1623 bp, Glycine max
  Peptide Sequence Number=SeqID_143485
atggacactttcatgaatgaatttgatctagatggaaaccacattggaatagtcacaacaagcataacaaatccacttgcatctgagagtctcaatagctctggcattgacctcaaaagtggaagagacattgaggtcagagttgactatgatggatggagtaaaatgatttttgtctctgtgggatacactgagagccaattgaagagtgtccttaaccattcaattaacctacctgacatagttccaagctccatttatgtaggattcacagcctccacaggcaacaacacttttcctgaaagccaccaagtcctcaattgggtattcacatcagtgccactgcctattctttctgttgaactcactaaagttggcaccatcaagaccatattggtagttgtcatggtatgcttatttccttgcatttggatagctgcttctttgaggagaacatatgtaagggctaaaaagaaaggggatatagaaagcctaacaaagaaggctgctgatatccccaaggtgttcacttacaagcaactatcaagggcaacatgcaaattcagccaggaaaatcttttgggaaaaggtgcatttggtagtgtttatagaggcatcatattggactccggaaaaactgtagcagtaaagaagatttcagcaacttctaagcaaggtgaaagagagttcttagctgaaatatgtaccatagggcgtcttaggcacaaaaacttagtgaagctccaaggctggtgcagcgaaggtgagaatcttctcttggtttatgattacatgcaaaatggaagccttgatcacttcataggcaagggcagtctgaactggcaaaccaggcacaagatattgacaggattggcatcagcattactttaccttcatgaagagtgtggaaacccttttgttcacagagatgttaagcctaacaatgtcatgctggactctaatcacaatgctcatttaggagattttggactagcaaggttactcaaaaatgaaggttcagtgactacaaatctaaatggaactctaggatatttggctcctgaactaagctttaccgggagagctacaccggaatcagatgtgtatagctttggcatggtagttcttgaagtcatatgtgggaaaaggttaaactggcttaagcaagggaatagttttgtagattccgtatggaatttgcatgctcaaaatgcgttgcttgagtgtgttgaccaacgactagagaacaaattcgatgaggaagaagcaaaaagggcattgatggttggtttggcttgtttgcatcctgattccatgttcaggccaaggatgagaaaagcggtgaacatttttcagagcccaaatgaacctttaatggaattacctggagtgaggcctactggagtttatgtatcagtttcttctagttcatcattagcctccaactctagctctagagtgatcattgtctatgattacttaccagcaaggtttttggagcctctgcgaacgaaatttcagctgcatttgtccacaattttccagattatcaaagatcgcgacgaaaccacaacctcgagtgtgactgccattcaccaccaagtagtaaattggggaagataa

SEQ ID NO: 26708 - DNA, 430 bp, Glycine max
  Peptide Sequence Number=SeqID_143486
atgttcataatcatgcttttgttgctctctaacttgatgatccaaccacaaagtggtgcaagcactgtagttgatcctaacactttctcctttgttactttcactcccgagagttgcaccaatggtgagttgctttgcatgggttcagccaccgctggaaatgggtatttgagtctcaccccagagccacaacaaagtggcaatttaagtttatcattgtctaacacaacaaacagtgttggaagggttttgtaccctcatcctgtgaaggtttggcctgccattatctccaccacattcactgttaggatcactcccttttcggaaaattcaaccaacgctggtgatggaatggcattagtgtttgcacaagataataggccctcaccaaatggctcttatcttggcatgtttgatcagtctacacaag

SEQ ID NO: 26709 - DNA, 975 bp, Glycine max
  Peptide Sequence Number=SeqID_143487
atggctaagcaggaagtggtggaagggttcaagttcgagcagaggcacgggaaagaacgcgtgagagtggcgcgcgtgtggaagacgaggcaggggcagcacttcattgtggagtggcgcgtggggatcactctcttttcggattgcgtcaactcgtacctccgcgatgacaactctgacatcgttgctactgataccatgaaaaacaccgtgtatgcaaaagcaaaggaatgctctgacatactttctgccgaggagtttgctattctgcttgctaagcactttgtatcattttaccagaaggttactggtgctattgtgaatattgtggaaaaaccatgggagcgtgtcactgtggatggtcaacctcatgaacatggtttcaaacttgggtctgagaagcatacaacagaggcgatagtacaaaagtctggttcacttcagttgacttctggtattgaaggattgtcagtgttgaagacaacccagtctggttttgtgaatttcataagagacaagtacacagcacttcctgatacccgtgaaaggatggtagcaacagaagtaaccgcactgtggaggtattcgtatgaatcgctgtatagcctccctcagaagccgctttactttacagaaaagtatcaggaagtgaaaaaagttctggctgacactttttttggcccaccaaaagggggagtctatagcccatctgttcaaaacacactctacctgatggcaaaggccacactgaacaggtttcctgacatagcttatgtcagtctaaagttgccaaatcttcatttcatacctgtcaatatctcaaaccaggatggccctattgtgaagtcatgggcttatggccataattgcagctgcaggatggacaagtttaatctcaccttttaccaatggtttgtgatgacattaggaaagacctacagtaacatgtcctgtatttactgtgtattattttaa

SEQ ID NO: 26710 - DNA, 288 bp, Glycine max
  Peptide Sequence Number=SeqID_143488
atgcccaaacccctccacctccccataaccatcttccttcttctcatcaggtcctgggttctcaaggtaccggggttgcttcagatcgcaaatgtgatccaccaggtggaatctcccttctccctcatggaggttatcctcaataaaaacatgttcaagcccagaatattggtgttgtgccttcaagctcagaggagatgcagtctgaacctagcatggttgtgggagttgttccttcaagctcataagagattcaatctgaacctagcatggtcgtggaatatgtag

SEQ ID NO: 26711 - DNA, 288 bp, Glycine max
  Peptide Sequence Number=SeqID_143489
atgaaccgcttcttccggaaagttcccggaagacgttttccggaagtcttccggaagaagtgttcttccggaagacgtttggttacttccggaagaacacttcttccggaaactttccggaaaaggggagttagggagactaacctcgttcgcgaagaagaagaagacgacgttcgcgcttgccttgccggagaagaagaagcagttcgcggagaagaagaagcagttcgcggaaggaatgagcagcagcagaaaagtttcttccggagaggggggggctttttataa

SEQ ID NO: 26712 - DNA, 789 bp, Glycine max
  Peptide Sequence Number=SeqID_143490
atgacgtcatcggcgatctccatcaacggcgtaagacactccggcgcgaacttcctcgcgaagagaatgagctccggcgagacctccggggcggtgtacagatgcgggtgcccgtcccagcacccggtccagttgacccgggtcagggtaaacccggcgaaacttgttccagagaagaatgtcacgcaccaccacgcgcgcgtggcggcgagtgagaatgaagaactgcgaccccacgcggaaggaggagaaggggatttctgggagcatcgcgtgttcgccacgcgcggtgtagcggtcgaagaggttgggttcgttagaaagaatctcaatgaagcttttgtgtgggtttttgaagaggaagttgtgagtgaattgaagggagtggagagggatacagtattgggagaggagggcgaagtagtggttgagggggtcgtcgaggagggcggcggcgaggaggcggcgggcggcggagatgagggagggggaggcgcgggcggttggtttcgcggggacgaggtggtggaagacgccgccggagatggtgatgtttttggtggggtcggcgtggatgtagatgttgaagaggcggtggcggtggtgatcggaggaagaagaagagaagaacttctcccagagaggggagaaggtgagattggagttggtgaggaagaggaaggcgattttcggggtggcggagaggtgggaggttgtgtggggggcggcggcgcggcggaagagggcgaggtcgtcggcgtcgggaggggacaaaatatgaggagatag

SEQ ID NO: 26713 - DNA, 1047 bp, Glycine max
  Peptide Sequence Number=SeqID_143491
atgtctgagaactatggggatgtgctgcagcagctacagtccgctggtctgctgatcaccgaactggacaccaccggacgcatggtccgctgccgagtcgagggctcacgcgagcgccgcggctggtacgcgctccacgaactgaacacctcggctggcgaagtgctggtcgtcggcacatacggcgtctggcacggcaacgagaacggcgcaacgaaggtcgatctgcgcaagcgcgacaagaccttctccgatgaacagcgcgaagcgctgcgcaaccggctggccgaggatcgtcgcagggccgagtctgctcgccagacccaggcgaagcgggcggccgaacgggcatcgtcggcctgggccaaggcgaatgcagtcggcgaggccgactacctggtcagcaagggcgtgcagggcttcggcctgcgctatggcaacacgggcgcagcacttgtgccgctgctggacgtgaacggccaggtgcatggcctgcaggtgctgcgcagcgccaagcttgccgcagcagggcgcaagccagccaaggagtattggccggcaggcatggtcaagaagggtcacttccatctgatcggcggaagtcctcagtggatactgctggtggccgagggctatgccacggcggccacattgcacatggcgacgggctacccggtggcagtggcgttcgacgccggcaacatgctggccgtcgcctcggccctggcgaagcgctatcgcggcatcaagatgctgctgtgtgccgatgacgacgtgctgcagaagtgccggcactgcaagagccgcctggtgctggccgaccatccgcaattctgcccatcgtgcgcgcagccgcatggcgcgtcgaatgccggcctactcggtgccgaggctgcagcgctggacgtgggcggagcgatgctgcacccggtcttcgccgatgagtcgggcaggcgtgagcgcttcatcgacagcggccgcaagatcagcgacttcaacgatctgcacgcccaagagggcctgcacgttggtcgacggtatcgataa

SEQ ID NO: 26714 - DNA, 414 bp, Glycine max
  Peptide Sequence Number=SeqID_143492
atggcctcctatggtgaagcaaaggaatccattgatgaacaagatcctaggtctacaagctccaatggagcttacataattgatgatccaatagtaactttcagaggacccaggaaggccaagggtaagagatctgaggccccttccacttcagcaccatcagaggcaccaacaccgtcttcttctacaacacctcccttttcatccactcagattccagttattcctccagcaccttcccagatgccatttctaggtccagtgaaaaagaggctaagttttgaatttcaaaaagtagtagttgggctaagctcagcagttgggctaagcgcttatccactgctaagtgcagcttcagcatgcttagtgaaaaggagaatctggcagagcatcaacatcaaagccgtgcgctaa

SEQ ID NO: 26715 - DNA, 685 bp, Glycine max
  Peptide Sequence Number=SeqID_143493
gcatgcttgcccattagaaagccaccgttcatgcacagagaaaggaagggtgaattgggatcaactcttagcaagcaaagaaggagcatctgtcaaccgcttccctcgatggaaggaaggaagaatcgaagttcttatttcatgcggaggatttccaaatgttcccttgatggggacaaggggttgcatcagctacaatcccgttcttgctaccaatgtggagacacttcagaaggtccgcaaggcatgggagggtttggattggctcccaagtctgagagccactaaaagggaggaagatgaggcaccggaggaagacgaagggtgcaggacagaactcaagcaagctcaaacagtcaaagaaagattcaaatttgcagctcttaagatccgaaaggagaatgccgaactgagagacgggaagaacatagctgggaacaagttccgaggggctctgtgggcacgtttatgcgagacagagaccagcatgttagccatcatcagcaagtaccaagaggaactaagtctagccatggcccacgagcatagggtggcggacgagtatgcccaagtgtatgcggaaaaggaaactagaggaagggtgatcgactcgttacaccaagaggcaaccatgtggatggacctatttgctcttaccttgagcgggagtcaagaacttccctga

SEQ ID NO: 26716 - DNA, 291 bp, Glycine max
  Peptide Sequence Number=SeqID_143494
atggagaggagtatgattgatactgccagtggtggagctcttggtgatatgacccctgctgaggctaggaatttgattgagaagatggcttccaactcccaacaattcagtgcaagaaatgatgtcattgttcttagaggagtccatgaggtggccatggctgttgcaagagtctgtggtctatgttcttctgcggatcaccattcagatctttgtccttctttgcagcaatctggtgtcaatgagcaacatgaagcttatgctgcaaacatttataatagacctccatag

SEQ ID NO: 26717 - DNA, 441 bp, Glycine max
  Peptide Sequence Number=SeqID_143495
atgggtgaagcagaggaggtgcaagagaagatgaaggccgacatggaggccatgaaagagcaaatggccacaatgatggaggccatgatgagcatgaagaggataatggaagccaatgtggttgcagttgccgctaccagcactgttgctaaggtgaacccgatgcccccttctgatctcaaccaaatgaatcatccaatctcagatatggtgggcaaagatttgggaagtacggacggccctatgatgtgcaaattcaaaacgagcacaccttcccgccatacggcttgcctcccaactatacaccacccaatgtggcatacactcccaatgaggatgtcaataactccgctcccatactcattgagagccgacaacctcatcttgtacatgtctctcaacccatgggggagatacatgaaattccccactataatttag

SEQ ID NO: 26718 - DNA, 1140 bp, Glycine max
  Peptide Sequence Number=SeqID_143496
atgcctgggaaagaaccaaaatttgcacaattgtatatctttgacacagaaaatgaagtgcaaaataggattaatgcaataagcagtccacataatcaaattcaagaacacattgtttcacaacttagtgagatgctggatgaattcaacgtgcatgcaaaaactttcaggatggtgagagatagattgcgggatgttcaagtggataatatcaagttgaaattgattgctaattgtgagaaagatggtcgtacatataatgtacctactgttcctgaagttgcagcactaatagtaggcgattttgatgcaaattcaaaaagagatattattattgaaactcagcatggacaactacaaaggatccatgaattacattctagctatctagctctacaataccttctcttatttccttacggggaagatggatatagacctgatattatacaaagcagtcgatcagatggtaagaaaaggaaaagaaatcatcttacaatgagggagtggttttcttataggctacaatgcagatcaaatgagtctaaaactttgttgaattctaggagactattccaacaattttttgttgacgggtatactatggttgagtcagaaaggctttcttacatcagaaacaacaaaaaaaaacttcgagttgacaagttttgtagcttacaacagtcattggatgatggaagcaggaaaggcctaaataaaggtaaaagagtcattttgccttcaacttttgttggcagtccgcgctatatggatcaactttattttgatggtatggtcatatgtagccatgtgggcttcccaaatctgtttattactttaacctgcaatccaaactggcctaaaatccatagattgctgaatccgttgaatctgaaagcagcagataggctagacataatatccagagtcttcaaactaaagtatgaacaaatgcttatggacctgacaaagaatcacatgctaggcaaagttattgtatatatgtatataatagaatttcaaaaacgagggctgcctcatgtccatttgttgctttttttacatcctgataacaaatacccatccttagatgaaattgatcaaattatatcagcagagatacctttcacagcaagatga

SEQ ID NO: 26719 - DNA, 294 bp, Glycine max
  Peptide Sequence Number=SeqID_143497
atgacgggagattcatcaaagttcacacatatctctcccaagaaaagtgggcatgttacttatggtgataacaacaaaggtagaattcttggagttggaaaaatagaacaaatgcacattcatggacaagattctaaaggaaaaggagaaggaagcaatgaagatcctccatacgtcatttcagtgtgcttttgccttgatcacgtagatgcatgctttgttaggatcattcaacagtggaaactgttttggtcaagttcagtccaacaagaggaatttgaggatgatgcttga

SEQ ID NO: 26720 - DNA, 588 bp, Glycine max
  Peptide Sequence Number=SeqID_143498
atggaaacaactaaatcaactcaacgagcactccaaagtgtaaaaatccaggttggtgagctggcagaagcagtgactcaatttatgtccagacaagaaaaatactttgtagaaattgaagctcaagataaaatccctataaaagagcacgagtcaagagaaaaagatgaggagaaagatgaggaacaagcacaacaacaaagggagaagtactcaacaatagaaaaccaacaagaaaatattctccaaatcaataaccttcctcatcaaatgattgtcaagaaaggaaggcaaggagagcatgaggaaattgcaactgccattctttctttaatcactaacacctttcttgaaattattgggaatgtccttctagactatatgaagttcatggaatttctagctaaaaggcgaaacttcaaggaagatgtgttctatgtgactttcattcctttcgctaagcgcaagtcttgcgttaagcgcatctctgttcatgcgctaagttgcgagtctcaagcgcttagcgcccaacccttgcatctgaggctgatttggtccgctaagctggccaaggtagagctaagctaa

SEQ ID NO: 26721 - DNA, 696 bp, Glycine max
  Peptide Sequence Number=SeqID_143499
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatagaagttagtagagatgaaggacacattctacctagagttggtctccaagatgctagtgtgaaattcaacaaggtcaccaaatacaatgccttgatgaaggattcctctacattcattgttattgtttccaaaggcaagggaaaggaaatatttggcataagccccttggggagtaatgatgcacaactgatagatgagatcaagcttatcgataccgtcgacctcgagggggggcccgaggcggtttgcgtattggcgctagcggagtgtatactggcttactatgttggcactgatgagggtgtcagtgaagtgcttcatgtggcaggagaaaaaggctgcaccg

SEQ ID NO: 26722 - DNA, 357 bp, Glycine max
  Peptide Sequence Number=SeqID_143500
atgaccggatacgattggccattggattttttgtttcctactgacaggtacatagggacggatgcaagtggggatagggtcacgaccgaccgatcgttgccccttcccggcgctaaacaagcagagaacgtcgctgcaaggcagcccagttcaagtgggcaaacgctaacccataaggaaggaggagacatggttaatgttcccctaaaaaaaaaattggcagttgaggatttgaatgagaaggccttaggcctatgttgtattctgaagcagtggggcatgccacattgcccccattctcttgcaatttatgtccaaacatgcgcccatcaagtgctcggtgaaatgccccaatga

SEQ ID NO: 26723 - DNA, 899 bp, Glycine max
  Peptide Sequence Number=SeqID_143501
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatctctgcttcgtcttgtcgtccgaattggaggacttgcataataagctatatccatagctcttcccagatccagatcatcttcctcatcacttgcatcatcagatctccatctaggtccaccattgatggagatctgatgatatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 26724 - DNA, 981 bp, Glycine max
  Peptide Sequence Number=SeqID_143502
caccaggcaggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcacggttcctctcgtactagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctc

SEQ ID NO: 26725 - DNA, 366 bp, Glycine max
  Peptide Sequence Number=SeqID_143503
atgtgggcctttcatatcggtcgaaaaattaattgggcacatctattccgatctttcttgatcggtgttgttgtggttgcctcctttggttactgcaaagagcgtgatggctcttgggtaaaaaagggtgctcaaccaaatgatgatgaaggacacttaccagttgaaagggactcttctcttcttcagagtattttggacaggtttgatggacttcaaacctatgttggtgagaggtttaactccttggaacgtcaagtggacacacaattcgaggagatgaactcaaggattacaaaggttgaagaagatgtcaccatcattcacaactaccttgatttacctccaccaccaccaccagtttag

SEQ ID NO: 26726 - DNA, 462 bp, Glycine max
  Peptide Sequence Number=SeqID_143504
atgaagaagaagaaaggaaaaggtggcaagaagagaaaagatgatcctaaggacatatgcaattactacaaagaaccaggtcattggaagcgagactatccaaagaaagcaaataaagattatgtgagtgctcttgttcaaaatgactccttatcgcaaatcaatttggttatggctgttggtgaacaactacaacaacattttgaacaatgggtattggactcaagttgttcttatcatatatatgcatataaacattggtttgtgacatatgagaagaattcttatggtaacatcctcatgagtaatgatgatccttataggtttgtaggtatagcttatgtacagcttagaatgcatgatggtgctattaaaaccttaactaaagtttgtcatgttccaggccttaagaaaattcttgtatctttgggtgccatggattcaaatggtttttcttactag

SEQ ID NO: 26727 - DNA, 195 bp, Glycine max
  Peptide Sequence Number=SeqID_143505
tggtgtcttcaatcatctttcttccttctccattccactgccattgatcttcaagaagcaaaggaatccattgatgaagaagatccaaggcttataagctctacttggagctacatcactttgtccgatgttgctacccatagatgcgatgctcacaaaattgaagaggttcctccttgtgatttccaagtatga

SEQ ID NO: 26728 - DNA, 249 bp, Glycine max
  Peptide Sequence Number=SeqID_143506
atgactgagacaagtatgcgagcggggaatgccgatgtgtatggattcctcgagccacagtccatacaaagatctgggcaatcacaatttgaatcagaaagttatactaagaactggatgcagaattcaaagagggatgtgtacctaggagtctacttgaatgggccaaacaactacctcaaagaaattattaacaaatcagtcctatttttcaatacattttgcattagcattagtcgggaacattaa

SEQ ID NO: 26729 - DNA, 252 bp, Glycine max
  Peptide Sequence Number=SeqID_143507
atgggtggctccgtgatttcttatgggcacaggcatcccagtttaatgtttctattcagcgggcgtggttattggcaagaacttattgaatccattgtttgggctcataataaattaaaagttgctcctgctactcagcctagagccttgagcattgtacaaggacgtgctgtaggagtaacacattaccttctaggtggaattgccacaacatgggcattcttcttagcaagaattattgcagtaggataa

SEQ ID NO: 26730 - DNA, 639 bp, Glycine max
  Peptide Sequence Number=SeqID_143508
atggggacaaatcaaaatggcaaaaggttttatcaagtcaaggttaaaagtctagatgtcactagcctcaaggaattgggacgattgatgggacccctccaaaggcaagccttctgcaaagtgtacgggaagattctagatttggccgcagcgaaggtatttacggaagttgtcgtatccctcgcccaatactatgaccagccgttgaggtgtttcacgtttggggacttccaaatggtaccaactattgaagagtttgaggagatattaggatgccctcttggggggagaaaaccgtatcttttctccggctttcttccttccttgagcaagattgcagctgcaaggcaagggatatgggcgagccaagagaagtggggcccgtttgcggatattttagcttttctgatttttggggttgtcctctttccgaacgttgacggtttgatttgtttgacacctttgtccggaggtgtgagaaaaacagtgcacggattgtctgttgtttacccgctctctgtgtgcggtggatttcacacctattccgacaagccacgagacacccgtgtccgcttcaaagctatcgctcatgcgccgaaaaaggaagagttgattgggaccaacatttggctgggatag

SEQ ID NO: 26731 - DNA, 283 bp, Glycine max
  Peptide Sequence Number=SeqID_143509
taatcgagctttcattcaagaagtactgcgccccagacaggcgcaagggcgaaacaccacagcagcattgggatggtcggccagtgggaaacagaccgcaccgccaccacctctagagttcacctcagctcatccgcaaaaaaggttagagcgttgccctacgacacatggccgaccagcaggctaccaagtccaaagccaaagtaggacgcacctagttgctcatgatcctgggaatttaaataaaacaagcgcaagctcggaaggtagaaagataccttag

SEQ ID NO: 26732 - DNA, 496 bp, Glycine max
  Peptide Sequence Number=SeqID_143510
atggtgagagcctttaaaattttgtgccctttcttcaatatccggccttgtacgtcggtcttcctatttttcttccagatgaagttgattggcaaaattggctgggtctccttgaaaaacatgtccaagaagttgtttgagtttgactcaaatgtcttttgccacttcaaggaccgtttcatcaagatcctagctactgatgtcgtgactgatggaattatgtgtgacttcgcttggaggccagacatattggtgaagcaggccaaacttactggtgggactatgccttcgtccgctgttgttgctcttgctgctggagaagggggtcaacctactgctaaggttggccttggtgctgctgagattgctcctagtgccccttcctctgttttggctaagaggaagtgggatgacagtgttaggacgtcgggtcacaagaagtcaagggcctctatgagcctttgtgccctgaggcaagctgcaaggttgacgctcg

SEQ ID NO: 26733 - DNA, 288 bp, Glycine max
  Peptide Sequence Number=SeqID_143511
atgatcaaagaaaatcaatgtagtttatgtaaggagtctgaggaatctattggccatctgttttttgaatgcaaaattacaaaatccatatgggagcagattcttaaatggattgaagttactcatgaacctaaaacttgggatgtagaactcaagtgggctattcgagaaactggaaagaaagggtggaaagctaaactcctaaaactagcactcactgaaactctttacgagatgctggctagatctcatgagatcgccatgtacttatctgattttttgaattaa

SEQ ID NO: 26734 - DNA, 1059 bp, Glycine max
  Peptide Sequence Number=SeqID_143512
atgactccaaggtgtaccaaggatgcactgcaaaatcctcaatggttagctgtaatgaaggcagaatatatggcacttatgcagaataacacatgggatttagtccctttgccccctcatagaaaggctattggctccaaatggatctatcgcttgaaatacaatgctgatggctttgtagccagacacaaagctcgactggtggctcaagggttctctcaaagaccaggccttgattgcaatgagacattcagtcctgttattaaaccagccactattcgcatagtcctgagcatttggacatcaacaatgctttttctaaatgggaccattcaagaggaagtctatatgcagcaaccagaaggtttcacttctgccaattcccatcttgtttgtaaactgaagaagtctatctatgggctcaagcaggcaccaagagcctggttttccaagcttgcatctagtctgatttcttttgggtttaagccaactaggtgtgatacatctctgtttgtgcatgctacaccaaaatttatcacctacattctggtttatgttgatgatatcattataacaggcagctccacctttgcagtccaatctgtgatttctaaacttcactctttgtatcctctcaaagacctaggcaccttacatttctttctaggcattgaagccaactacaccactactggggctcttctcctatctcaatccaaatatatgattgatcttttagccaaagtcaatatgcataatgccaaacccataaagactcctctggcccctggttcaaaactgcatatggatggtacaaattccttttttgacccaactctcttcagatctgtagttggagccctgcaatatgccaccatcactcgtctagatatagcttatgcagtaaataagctttgtcaatttatgcacagccctcttgaaagtcattggaaggccacaaaacgtgtactcagatatctcaatggcacagttgatcatggtttagctttttatccttcccagcatctcttcatcactggctatagtgattcagattga

SEQ ID NO: 26735 - DNA, 138 bp, Glycine max
  Peptide Sequence Number=SeqID_143513
atgggatctggtatgggagtgatgggtgcagctagtgttggagcaggaggattgataggattgatggttgctatagaaggagggagaccaaggaatatgcacggggtggatcgaaactcaagtttggttttggtgtag

SEQ ID NO: 26736 - DNA, 441 bp, Glycine max
  Peptide Sequence Number=SeqID_143514
atgtcaaacactattaaaaccccaaatgacgaatcaacacacctatacccatcgcaaggtggaggtaaggaagccatagcccgcatcatggaggcctataaattttctacccggcaggcactttgtaatcacctcggggtatctcagagcaccatggcaaaccgctggatgcgcgataccttcccacatgactggctcattgcatgtcacctggataccggtgtctctttgctttggctagccacaggtcaaggtgagctgatggatagtgcttcgccctcttcagaatccagaatgagatacaaaaaaatctcaaatgggcaatttactgaggaaattctcgtcgcttatgattcacgactgctgccgccagcaatctcaaatccgctgttagttgagtttgatggcaccacttatctaattgaagaatccaaaatcgag

SEQ ID NO: 26737 - DNA, 138 bp, Glycine max
  Peptide Sequence Number=SeqID_143515
atgtatcgtgggccccgtggctcgttcggtgtagaaggtcgatcgaaagtcggcccgtccgggcaggcagaaggaatatacactaaagccccggatcccatcagaactccgcagttaagcgtgcttgggcgagagtag

SEQ ID NO: 26738 - DNA, 207 bp, Glycine max
  Peptide Sequence Number=SeqID_143516
atggccgaagaagcaccacctaagctgccacttaggcacactcttggcaactatattgcaacaatagagataaatggcattatggaggattccatcaagatgaggttgtttcccttctctttaagggaagacaagggagcatcacttggaaagactttgtctaacaaattcatatcctactacttccttcattcttcattcatctag

SEQ ID NO: 26739 - DNA, 330 bp, Glycine max
  Peptide Sequence Number=SeqID_143517
atgagatgcaaggctagtgggtggctcgttaagttttatagcaacaatagtgtgggacaatatctaggtgacttattctcatgggtgcaagaattttacacacaaatcatgaagcgcgaaccgaccaccttcgcctgtgacacgcgccttttcacggaccaatcagactccgacacagaaacgcgacatataactgccggtgacataagggacaacgaaagaacacgttgtaaggctgagaggggggcaagaggggaacaaggcggcggcagtggtactcaacagtggggaccacggtggggctgcgttgattgggacaatgggatgtga

SEQ ID NO: 26740 - DNA, 216 bp, Glycine max
  Peptide Sequence Number=SeqID_143518
atggccaacaatattatcgcaaagcagaagcacggtgggaaaataactgggaaaggaatcacaactgcggttacaagaggtagaaccgtagaaggaaaaactaagatgaacagaaagatacaagagaagcacagcttgtgcaaagttgaggaaaaggcctacacgcttctagcatgtttagttaggtgtctgaaaacagaattgacaatgaactaa

SEQ ID NO: 26741 - DNA, 207 bp, Glycine max
  Peptide Sequence Number=SeqID_143519
atgaagaataaagttgtaaatgcttgtgatccaggtcaatattcggaaagggaagggtataatggatctgaatatgctccaacttatgaagacaaggatggggattggatgctggttggagatgttccatggaacatgtttgtgtcatcctgcaagaggctgagaattatgaaaggatcagaagcaaaggggttgggttgtttttga

SEQ ID NO: 26742 - DNA, 307 bp, Glycine max
  Peptide Sequence Number=SeqID_143520
atgcctcaatactcatttcaagctcttcctacctcaaatgtttttgaaggaatctcacaaagctttggtgccagtttcaacactctatcatatgcatacaacccaccaccatcgagctcttgttatcgtccatcattacctactcaaatacatgacatgggtcatgaggatgaggaggaagatgatgataacaataataccaacattaatgatgatggcaataatgatgatgtccatggtggtgatgatgttcctcaacaacaacaaagaattacacgtgatcatccaagaacaaaagaagaaagag

SEQ ID NO: 26743 - DNA, 270 bp, Glycine max
  Peptide Sequence Number=SeqID_143521
atggtttttgatgggcaacccatgcctacaactgttcctactgctccacatctaccagcagtgcgacctagagtgcgggctagaagaggacaggctacagatccacatagtatagctgaaaggttgcgcagagagagaatagcagaaagaatcagggctttgcaagaactggtccctagtgtcaacaagacagatagagctgccatgctggacgaaattgtggattatgtcaagttcttgaggcttcaagtgaaggttaatgctttgtga

SEQ ID NO: 26744 - DNA, 324 bp, Glycine max
  Peptide Sequence Number=SeqID_143522
atggctcctcaccagaatcttattccctgcaccctgttgctgtcattttgctcccacgaacaagtaagtgtcaaggccaccctgtcacacaaggcaactcccctccccccccacccccacggtgatcagcctgagtctcaagggagttccaaaccgagtgacacaccccctagtacaagtattcctccgcataaggaactacaaggacatccgacaaggtcaatgcaccacccccatgatcatacacaacatacgacgtatggacgtaggagtctcaagtacatgaccatggatgaattaaagtgcctaagcatcccctcataa

SEQ ID NO: 26745 - DNA, 207 bp, Glycine max
  Peptide Sequence Number=SeqID_143523
atggaactcttgcaaaatggccacaaaaatttggtcagcatcaaaccctccgagttacccctcttgaatggggccgcgttaactctcctcaactcgctctccgaaactcatgagtactatggcaacatagatccttccagagtttttgtcaccaaagtgaagcgtatcattgtaaaggtcaaagaaaatatagatgcatcacaataa

SEQ ID NO: 26746 - DNA, 324 bp, Glycine max
  Peptide Sequence Number=SeqID_143524
atggacaaaagaattgatattaaggatgattttaaagcaaggataccgagtatggattggataaaggatttgatacgtgaagctgacatctctcgactctcttttgcggttgagcttgctgaagaattttatgggagagtgaagggtcaagatgttgcatttgaacctgctaagctcttatggctcatccaacgtgattttttgcatgagattacctccaacaagaacatagtagctagaggtaaagggcctgacaattggacattgtgcacaatcctcatcttacatgacaatatcagcattacccttatttgtataaactag

SEQ ID NO: 26747 - DNA, 222 bp, Glycine max
  Peptide Sequence Number=SeqID_143525
atgagaaacaaaaaccttgagaaacagtacccccacaaagaggggttcggtcaattgattcctgaaattgacagaggaaaggctgatgaggcgaatggcactggcagcgcatcaatccaagacttgggatggtggtgcatgaatttcatgctctggtgtgcttgcaaagttgtgatgggttgtggcagcgattttggcggtggtgtcacagggagaggctga

SEQ ID NO: 26748 - DNA, 903 bp, Glycine max
  Peptide Sequence Number=SeqID_143526
atgaaggatgtggagcttgatcaattgtatgtcaagagaagggagcaattgaaaaagcttgttgctagcataatcactccaaaaattgtacagggaaagactctaaacgggaaggagtttgtctcctttctggagcagatacttgaagccttgaacaaaggagagattccatcaacaggctctcttgtggaggttttcaacaagaatattcttgagaaatgtcttaagttatacagtgaaaagatggcgaaattagttctacctcttcctgagaaatctctgcaaggggcccatgataggtctagagatgaagtcacaaaagtctttgatcagcagcattttggtcgtcaccatgctaagaaatcatttatgcagctggatgaagaaatacaacaggtgtataagaatgttgttttgcaaaatgagtatcaatcttcaaggctctgtgaagcgctgtacaccagatgtgaggacaaaatggatcagcttcaagttctcaaacttccttccttggcaaaatttaatgcagatgatggggaagtctcggtctctgtttataaaggagtacaatcacaggctcttcaattggttggtggccttctccctggttatgagtcactttactataacccagtttggcattttatagttgcaacttgggaaactgttgtttacagcccaatcctggatcttgacaggacttcaagaagacagtgggcaatgctgggcttctcatatggagaaatatttctgtcgcttggtgctactgctgctctgatagggccaaaggatttaccaatcatatgcagaacagcaggaaggctagctggtcgagctattggatgtgtacaattggctcgtggtcagtttgacactgttatgcagcaatctcaagctcgccgg

SEQ ID NO: 26749 - DNA, 1140 bp, Glycine max
  Peptide Sequence Number=SeqID_143527
atggcgagaatcgagaaatgtgataccgcagaacttcagagttcaagaatccgtaatggaaaagacgaacaaccaatcgactctcaggttctggccgaggggactcagcttgagctcgccaagccggttgtgaagtcgcggctgaagcggctcctcgagcgccagttctccggtgttcttagaaattcggcgccggaaaagatcgccggagacgatgaaacgcttaacggctccaatgattttgagccgagctcggcgtgtttagcgaaaatggtgcagagtttcatcgaggagagccacgagaagcactccgcttcacaccaccgcaaccgatgtaactgcttcaacaggaactacgacgacagctctgacgaagattcgaactcgttcggcggttccggcgactccaatttctcctccggcgaggcgtgcgaaactctcaaaggtttggtagcgtgtgccagtgtgcgcgaaaggaatttgcttgcggataccgcgaagatcgttgagaagaataagatctgcaagcgcaaagacaatttctgcagaaagatcctcacggacgaattgttaacccttggatacgatgcctcaatttgcaaatctcgctgggaaaaatctccctcatatcccgctggggaatatgaatacatagatgtgatgatggggaaagaacgaattctaattgacattgacttcaggtcagaattcgagattgctcgatccacgaaggcgtacaagacgattcttcagaaccttccctacatattcgttggcacgtgcgagcggttgcagagcatcgtggcgctcgtgtcggaggcagcgaagcagagtctgaagaagaagggaatgcacgtgccgccgtggaggagagccgagtacgtgaaagcgaagtggctctctccttacacgcgcactactaattctgcgaacgatatcaaagaggagaagaagaaggaagaacaacaacaacagcttttgaaggagaatttattcgctgcggagtcagagagttccggcgaagataacacggcggtggtcgaatggaagccaccggagctgaaacctaagggttcgctttccggcgtgaaggttgtgactggtttggcggtggcttttcataatgacaataacccataa

SEQ ID NO: 26750 - DNA, 315 bp, Glycine max
  Peptide Sequence Number=SeqID_143528
atgagtacattacatgacccttccatcttagtgattgggccgtatcgttctggaaaatcttttttgcttaatcaacttctctctctttcttgttacgaagggtttggtgttgggcacatgcgtgacaccaagacaaaaggaatatgggtttggggaacacctatagatttggatattaatggagtaagaacttctgtcttttaccttgatacagaaggatttgaaagtgttgggaagtccaatgtatatgatgatcggatatttgctttggcaactgtcttgagtactgtgctcatatataatttgcccgagacg

SEQ ID NO: 26751 - DNA, 228 bp, Glycine max
  Peptide Sequence Number=SeqID_143529
atgggaagacgtaggaatgaaagtgccacgtgtgatcctacgtggcggaatacgagaagcgtcatggtgaagttcgtgatctcggccgagggtgggaattgccgaaaatgtcctcgtgatgcggatgcttttcggaagcaggctcacgagtcacgacagtggcgggggcaattccaaaaccattttcagtttcgtgcgtgggctggttttaatgcagtcttagtttga

SEQ ID NO: 26752 - DNA, 2154 bp, Glycine max
  Peptide Sequence Number=SeqID_143530
atggccaacctcaacatgctcctccaacaattcttgcatgtgttgttgttccttctgatccctgtttcatctcagcctaaccagctcttctatgatggattcttgggaagcaacatcatgtcccttagaggagtagcagaaatagagtcaaatgggatactgaaactcacagatgattcaagtagagtagtgggtcaagctttttatccaactggtttaaggttcaagaactctagtgatggtaaagctttctccttttcttcttcttttgctttgattatattccctgagtatgaaaagttaggagggcatggtcttgcttttacaattgcatcttctaagaatctcaaggctcttccaagtcagtatcttggtcttctaaactcaactagcacagggaactcctccaaccacctctttgctgttgagtttgacactgcccaagattttgagtttggggacattgatgacaaccatgttggaattgacatcaatagcttggtctccattgcttctgcacctgtaggttactacaccgggggtgatgataattcaaccaaacagaatctcacgctcacaagtggggaacccattatagcttgggttgattatgatgcttctcaaagtgttgtcaatgttacaatttctgaatcttctaccaaaccaaagagacctctcttgtcccatcatgtggacctttcaccaatctttgaggatttaatgtttgttgggttctctgcatcaacagggttgcttgctagctcccattacatcttgggttggagcttcaagatcaatggaccagctccaccccttgagctctcttctctcccacagcttccaggcccaaagaagaaacacacatctctgataactggggtttcaatttctggttttcttgcattgtgtggtttcttatttggcatctacatgtacaggaggtacaagaatgctgatgtcatagaagcttgggagcttgagattgggccacataggtactcctatcaagagctcaagaaagcaacaaaagggttcaaggacaaagagctgcttggacaaggtgggtttggtagtgtttacaaaggaacattgccaaattccaatacccaagttgctgttaagagaatttcacatgactccaaacaaggccttagggaatttgtgtcagaaatagccagcataggccggcttcgccaccggaatttggttccgttgctggggtggtgtcgccgccgtggtgacctcctccttgtgtatgatttcatggaaaatgggagcttagataagtacttgtttgatgggccaaaaacaatcttaagttgggagcaaaggtttaaggtcatcaaggatgttgcttcagcccttttgtatcttcatgagggctatgagcaggtggtgatacatagagatgtgaaggctagcaatgtgcttctagatggtggactcaatggaagattaggagattttggattagcaaggttgtatgaacatggggctaacccaagtaccacaagggtggtggggacctttggctatatggcacctgaggtgcctaggacagggaagtccactcctaactcagatgtttttgcatttggtgcacttttactagaagtggcatgtgggctcagaccacttgagccaaaggcgttgccagaagatgtggttttggttgattgtgtgtggaacaagtacaaacaagggagaatacttgatttggtggatcctaaactaaatggtgcttttaatgaaagagaggttctcatggtgttgaaattgggaattctatgttcaaatgccgcacccgcggctaggccgagcatgagacaggtggtgaggtttttggatggagaagttggattgccagatgagttgagaaagccagaagaggtaggatatcaggagggttttgatgaattcatgaactcacttgaaccttcttccttttatcagatgagcacaagttcctatgctataaagactgacatggatgctaggtttccttttattgatacatcactttatactctccatgctagaggagaaacaagcttgaaagggattttgcccggaaagttgaaaaatgttgcaattgtgattgctgttgtggccattgcgactgttgtgatgcagatggcagtcgttgtggcgtga

SEQ ID NO: 26753 - DNA, 2049 bp, Glycine max
  Peptide Sequence Number=SeqID_143531
gttggaacagctgttgttactcgaagtgatggaagattagcattgggcagaattggagctctctgtgagcagcttaaagaacttagcagtcaagggtatgaagtcatattggtaacttcaggtgctgttggtcttggcaggcaaaggcttagataccgcaaattggccaatagcagcttttctgatcttcaaaagccacaaggagagcttgatggaaaagcatgcgcggctgttgggcagagtagtctcatggctctctatgataccatgttcagccagcttgatgtgacttcttcccaacttcttgtgaatgatgggtttttcagagattctggctttagaaaacaactttcagacacggtgaactcattgttagatttaagggttatccccattttcaatgaaaatgatgctgttagtactaggaaggcaccatatgaggattcttcgggtattttctgggacaatgacagtttggctggtctattagcccttgaacttaaagctgacctccttgttttattgagtgatgttgagggtctttatagtggtcctccaagtgacccaaactcaaagttgatccatacatatgtaaaagagaagcatcaaggggaaattacttttggagacaagtcaagattggggagagggggtatgactgctaaagttaatgctgctgtttgcgctgctcatgctggcatcccggtcattataactagtggctatgctacaaacaacatcatacgagtgcttcaaggggaaagaataggtactgtatttcataaagatgctcatttatggaccaatataaaggaaatgagcgcacgtgaaatggcagttgcagcacgtgagggttctagacagcttcagatcctcaaatctgaagataggaggaaaatattgctggcaattgctgatgcattggagaaaaatgaaagtatgataaggcatgagaatgaggctgatgttgctgatgctgtgatctctagtcttgcaaagtctgtgcgcctgctggcagatatggaagaaccaattggtcaaattttaaaaaggaccgagctagtagataaactcatcctggagaagacatcatgtcctttgggtgtccttctggttatatttgagtctcgacctgatgcccttgttcagatagctgcattggcaattcgaagtgggaatggtttactgcttaaaggtggaaaggaagcccgacgatcaaatgcaatcttacacaaggtcattacttcagtgatgccagatactgttggtgacaaacttattgggcttgtgacttcaagagatgagattcctgacctacttaagcttgatgatgtaatagatctagtggtccctagaggcagtaataagcttgtttctcaaatcaaggaatcaacaaaaattcctgttcttggtcatgctgatggaatttgtcatgtatatgttgacaagtctgctaattttgatatggcaaagcagattgttagggatgcaaagactgattatcctgcagcttgcaatgcaatggaaactcttctcatacacaaggatctgtcaaataatggtggacttaatgagcttgtccttgaactccaacgagaaggtgttaaaatgtttggtggaccaagagccagcggcttactaaacattgctgaaacgaacacttttcatcatgagtatagttcacttgcttgcacagttgaaattgtagaagatgtatttgctgccattgaccacataaatcaacatggaaggcatgttggtgctcatactgaatgcattgttacagaagatagtgaagttgctgagactttcttaagtcaagttgacagtgctgctgtattccacaatgcaagtacgcggttttgtgatggagcacgctttgggcttggtgcagaggttggaattagtacaagtcgaattcatgctcgaggtcctgtaggagttgaggggctgttgacaaacagatggattttgagagggagtgggcatgtggttgatggtgatcaagggatcgattacacttacaaagagcttccactaaaagcatag

SEQ ID NO: 26754 - DNA, 465 bp, Glycine max
  Peptide Sequence Number=SeqID_143532
atgaccggccctctcaatgagtcaatctcttgctttctcaaaagggtggacccttgggtactagtaccctcaccttccgaggactacacgtcctcgcctttagagggttgcacgtcctcaccttcagagggctgcacaccctcgccttcagaggactacacatcctcgccttcagaggactacatgccttcagagggctgcacgccctcagaggactgcatgtccttgccatcagagggccgcacgccctcaccttccgaggactacacgtcctcgcctttagaggactacacgtcatcgccattagagggctgcacgccttcaccttcagagggctacgtgtcctcaccttcagagggctacatgcacgccctcagaggactacgcgtcctcactttcagagggctacatgccctcgcctttagagggctacacgccctcaccttcagagtgctacacgccctt

SEQ ID NO: 26755 - DNA, 276 bp, Glycine max
  Peptide Sequence Number=SeqID_143533
atgacacatgataatcatgtgaagattttcgcatgtcacatcatcattaggaggacatttgaagctctaggagaaggtaataaatggtggtccgtaatgaagaaattgaaatttgaaagtggggtccaatggaaaaaaggaaagacgatggtccatggtagagttaacgtttgtggtgtggacctcactgatggagatcctgtcgggaaggaacccagtttactacctgctaacatagttcaagtaaggcccatgaatatactccctatgccctag

SEQ ID NO: 26756 - DNA, 315 bp, Glycine max
  Peptide Sequence Number=SeqID_143534
atggttatccgcacctttcgtcaactaggggcaaacgagctcgttgacgcgcagagactaacgtcgtcttctgcaccttttgtcatccagggacagcgagtcaggtggcaggtggagataccttatggtcgtccgcacctttcgtcaaccaaggcgaacgagttcgacgggttttactctcgttgtccagagacattcaagcccgatgacgcacgacattcttctctgctgggcggggacgatcaagttcgatggtgtgtggaaatgacgtggttatcccattttaacgctttcaagacactgaagttttgttga

SEQ ID NO: 26757 - DNA, 213 bp, Glycine max
  Peptide Sequence Number=SeqID_143535
atgatacatgcacctgactcaaccctcagatgcaatgtggttcgtaccaacaaccaaatcccaggaaatagcctaagcgcgtccacacgacactctcacttaggaaaccatgcagagttcgtcgagaccacacggttgtgcacgatggccaaaagtagtgccaaagaccatggaccaattaaagtgcctaagcatcccctcagaaatacttag

SEQ ID NO: 26758 - DNA, 537 bp, Glycine max
  Peptide Sequence Number=SeqID_143536
atggaatcaagaaaaagagatagaatggaggacatcccttcatcatccattccagctcctctgttagtaactgtaggacaagatgtccaaagttcactaactttagttcctatgctacaaagcttatttcgaggacagtttattatcatgcacagcctgcaagagttggctcacaataggccaatcatatctatggagcattttcttgagcaagtagcctggcctgaagctcaacttccattggtgagacccaacgaggttgctccgcctgagcccacacctgtgcaggtcaattcagagccagctaacccacaatctccagtggtgaatccaccttcttcgcctgagcttgaagcagttcccccatctcctcctctgattgtcatttatgatgcatcatcagatgaagcaactgctcttcttgattcaccaactgtagaaacagctgacccccctgtttccccaattggaggaatcgctaatctttctgattcgtcatctggagaagttgttgctctcaccgattccccagtttaa

SEQ ID NO: 26759 - DNA, 552 bp, Glycine max
  Peptide Sequence Number=SeqID_143537
atggctgagctgggaaggctactaatgtatgaagcttcaagggattggttgcccaccgtttctggagagattcaatcaccaatgggtgtagcctcagtggaattcattgatccaagggagcctgtggctgtaattccaatcctaagagcaggccttgctcttgctgaacatgcatcatcgatcttgcctgcaacaaaaacatatcatttaggaataagcagagatggggaaactcttcagcccactatatatttaaacaagttacccgggaaatttccagaaggatctaaagtttttgtggttgatcctatgctggcaacagccttaaagcaacatgttatatgtagtgctgtaataattgcatatatctgggatctcaatgttggggttttatttttttatattaaattgagctttgtgtcatccttttcatggttgcacgagtatgagcgtgccatcatttacaaactagagctgtatatggattgggttgcatgttggctttggaatttgttaggatccaactgcaaaggtgtgggatttgggacttga

SEQ ID NO: 26760 - DNA, 183 bp, Glycine max
  Peptide Sequence Number=SeqID_143538
atgtgggatgagaactactctcagtctgtttcacaagttgaacaacattcaactaatttggaaattactccaattcctaatggtgaaaatgttccaactccaagtcatgaaacaatcttcgtacctccaccaatgtcaactgtgtttagaccacctccacttaggcctcgagcaccaatttga

SEQ ID NO: 26761 - DNA, 263 bp, Glycine max
  Peptide Sequence Number=SeqID_143539
gaagcctcctttacaacaaagagaagaacaagatgaaagattgcaaaaatacaagtggtgaagatgtctccttcacctctaggatcccacaaccactcacaaactcatctcaagctctcagaacagcttcctcttcaagctctggtggtcttgttcgtgctcatgcgcttagcacaattctggaccgattagcgcacattagtgaatttcggcttagcgcgtgtttttctcgcttagcggatggactgaagcggtgcgcttag

SEQ ID NO: 26762 - DNA, 165 bp, Glycine max
  Peptide Sequence Number=SeqID_143540
atgagggtgaaaatgccagtatttgaaggggaggattcgttaggatggatcgtgtatgcggagaagttttttgccgcagcgctgattaagtgctacggcgataccggaaggggagatgtttacgaatgtttgatagcgttgcgccaaatgggggactttgactga

SEQ ID NO: 26763 - DNA, 396 bp, Glycine max
  Peptide Sequence Number=SeqID_143541
atgaggactgacggctccaccgcgtccagtcgcatacaatacaatggagcgccgcacttcataaagcttaggaaaaatggtcagcaatactacctggccgatggactcaaagacttcagaagaaacttcaatatacatgaaggtgtattgttgttgcctactgaggctatcgattttgttgatgcttcaagaccatgtatgactgtgcaacatacgagtggcgttcgtcacatatggaccatctccatgcataatggtgaacaatatgtggatgacccttggcacagattcttaacggacaatgacttgatgggtggaaatgaggttgtcttctattaccggcctaacgaacatgtgtgggagcccatatgggatgaacatgacgagtccacttga

SEQ ID NO: 26764 - DNA, 826 bp, Glycine max
  Peptide Sequence Number=SeqID_143542
atggaggtggttaaaaagctaacagaggatgttattagatggaactccatggaagataattatatgatgcagaaagcgaaacttgactggctgaaaatgggtgatgataacagtgctttttttcatgcgtatgtgaagactaaaagtaaaaccaaaagtatgagaatggtacaaacaagtgatggtacacttttatcaactcgggcaaaaattgaacaggaggttcttgagttctatggcaatctcatgggaaaagccaaccacagcttgaaccatattgatattggtgtaatgaggaagggtagacaagtaaacatggagcagagaaaacatttagtgagcaaagtgactgttaaagaaattgaatatgctcttcatggtataggggacttgaaagcccccggtgaagatggatacagcgcaaaatttttcgaagtttgttggtcatttattaagaaagatgtcattgcagctaatgatgatgctaaatgtgtgaaggattatagacctatcgcgggttgcaccgctttctacaaaattatttccaaaatcctaacagctagggccctggaggatgttatgcaagagataggcttgcctaggactttcacaaactggattatgactacagtgaaaacagtttcctatagcttcaatattaatgggcagatgacagaagatatgcaggcgtgtcgaggtatcaggcaaggggatcctatatctcctttgctatttgtgatcatgatggaatactttaataggatgggagattctaaatctgtggacatgatgcttgacactgttcaaaacttctcagatgctacag

SEQ ID NO: 26765 - DNA, 171 bp, Glycine max
  Peptide Sequence Number=SeqID_143543
atgacatctttgcataacccaacagtggttgatcacagtggacgtggcactatagtggcagctgtgagcctcttaaaggaacgtggagttggcaacaagcagattaaagtgatatctgctgtttctgcccctcctgctcttcaaaagctgagcgagcagttccctgggtaa

SEQ ID NO: 26766 - DNA, 138 bp, Glycine max
  Peptide Sequence Number=SeqID_143544
atgtcagtgaaaaatctcgtcagacggccagaagtacatgacaagacaaatcacacactaggagatcctggggagaccagtcagggtcctctgttttacgagaacgctccaaccatatgggatcagcatatgctttaa

SEQ ID NO: 26767 - DNA, 1872 bp, Glycine max
  Peptide Sequence Number=SeqID_143545
atgaaattccttaaaatcttcaattccaaacccttcaaactccgaactttcaattccctctcccattcccaaacacctcccttctccattcccaccacactcaccgaatccacactcctccattccatcgaatcttctcagtggcatttcatcgaacaggttgccccacacctcactccctcccttctctcttccactctaaccacccttcgccacaacccccaacttgtccttcacctcctctcccatcttcaaaaccaccctcactccctcgacctcgccacctcttccctcgccatctgcgtcctctatcgcctcccttctcccaaaccctccatcaacctcatacaacgtctcattctctctcccacttgcaccaacagaaccattttcgatgagttggcccttgcccgcgaccgcgtcgatgccaagactactctcatctttgaccttctggtcagggcctactgtgaactcaagaagcccaatgaggccttggagtgtttctacttgattaaggaaaagggttttgtgcctaacattgagacttgcaatcagatgttgagtctgttcttgaaattgaacaggactcagatggcttgggttctgtatgctgagatgttcaggatgaacatcagatcgagtctgtacacttttaacataatgattaatgtgttgtgtaaagaagggaagttgaagaaggcaaaggagtttatagggcacatggagacacttggagtgaagcctaatgttgtcacctataacaccattatacatggacactgcttgagagggaagttccaaagggctcgtgtgatctttcaaacaatgaaagataaaggtcttgagcctgattgctacacatataattcttttatttctgggttgtgtaaagaaggaaggcttgaggaggcgtctggtttaatttgtaaaatgttagaaggtggcttggttccgaatgcagtgacgtataatgcactgattgatgggtactgcaacaaaggggatctggataaggcttatgcctacagggatgagatgataagtaaaggcataatggcatctctggtcacctacaatttgtttattcatgcactgtttatggaaggaaggatgggggatgctgataatatgataaaagaaatgcgagaaaaagggatgatgcctgatgctgttactcataacatattgattaatgggtattgcagatgtggggatgcaaagagagcctttgggcttcttgatgaaatggtgggaaaagggattcagccaacactggtcacatatacatcacttatatatgttctgggtaaaaggaatagaatgaaagaggcagatgcattgtttagtaagattcaacaagaaggtctgttgccagatattatagtgtttaatgctttgattgatggtcattgtgctaatggtaatatcgatcgtgcatttcaactcttaaaagagatggacaacatgaaggttcttcctgatgaaatcacttataacaccttgatgcaaggatactgcagggaggggaaagtggaagaagctcgccaacttcttgatgagatgaagagaagggggatcaaacctgatcatattagttacaatacactcattagtggttacagtaaaagaggcgatatgaaggatgcttttagagttcgtgatgaaatgatgactacaggatttgatcctacgattctcacttacaatgctcttatacaaggcttgtgcaaaaaccaggaaggtgagcatgctgaagagctcctcaaagaaatggtaagtaaaggcatcactcccgatgacagcacctacttatctataattgaggcgatggagacagttgatgacttggagggaaatgatgataaatga

SEQ ID NO: 26768 - DNA, 276 bp, Glycine max
  Peptide Sequence Number=SeqID_143546
atgtctgctatgcttagagaaaaagttcttccccgcaagcctctcttatccgaagccaaagaaggatcagaaaggaaccaagaagaagaaaaggaaactcaaaagaagaaggagaacactaatattaagagagacactagtaatggaaccatgtcagaggcaacggtgttcttgaggacatcaaggaatgagcaacagcagaaccaagatgtcttgtattttcttcaagctttttggttacaatatgtcttgtatattagtccgcgagatatgtaa

SEQ ID NO: 26769 - DNA, 2282 bp, Glycine max
  Peptide Sequence Number=SeqID_143547
aaaacggcctcattggatccctcgtccgcaaggagggccacatatattccctcgccgtttccggcaacttgctatacaccggctctgacagcaagaacataagagtgtggaaggatctcaaagacttcacgggattcaaatcaagcagcggattggtgaaaacgattgttatttccggcgggaaaatcttcaccggccaccaagacgggaagatcagagtctggaaggtttcgtcgaagaatccgagcaaccataaacgcatcgggagcttgccgacgttcaaagagtacgtgaagagttcgatgaatccgaagaactacgtcgaggttcggcggcaccggaacgcggtgaaggtgaagcacttcgacgccgtttcgagcctgagtctggacgaggaggaaggcttgttgtactcggggtcgtgggacaagacgctcaaggtgtggcgcgtggcggattcaaagtgcttggagtcgattagcgcgcacgacgacgccgtgaacgcggtggcggcggcgttcgggggttgcgtgttgacgggctccgcggacgggacggtgaagatgtggaggagggagaaccaggggaagaagttcaagcacgttttagaccgtgttttgctgaagagggagaacgcggttacggcgctggcggtgaaccgtttagctacggtggtttattgcggttcttctgacgggttggtcaatttctgggagcgtgaccagaaaggtggattcttgcacggcggcgttttgagggggcataagcttgcggttctctgtctggccgcggcggggaaccttgtcttcagtggctctgcggataagaatgtttgcgtgtggaagcgtgacgaaaatggcttccacacgtgccattcggttctgacggggcacagtggtcctgttaagtgtatcgccgtagaggaagcagaaccgccgccggagggtcgttgcgagaaggggaacctgcggtggattgtgtacactgggagcttggacaagtcggtgaaggtgtggtgcgtgtctgaacacgcgccggacgcgagcgtgttccagagctgggccacaccgtatcattcctcctcctccgcagctggattcagttattcctcgccggggaaaattagtgttaattcatcaccggcgtggagttattcgtcgccgagaagaattggtgttagttccgtctcagcaggattcaactattcctcacccacttcattcgggctcaattcatcttcctccccagcaggaggaatgatttattcttcgcccagaaaaatcaatgttagcaacaacagtggaaatagcaaccgcaatggtgatagtactcaaagttttgataacgatgatgatgatgatgatagatgtatattcaatggcaatggcaccaacaacaggagcagtagcactaaaagcggcgacaatggcattggcagcaacaaccgcgatagtgttaaaagcagtggcaatggagaaaacaaccgcaacaatggtagttctaaaagcggtgacaatggcagcaacaacgtcaatcgtgataatgctaaaagtggtggcaatgacagcaacaaccgcatcagtgatagttctaaaagtggtggcgatggcagcaacagccgcgacagtgatagtgcttatggcagtggcaataacatccgaaacaaagatggtgctaaaagcaatggaatagcatacacaatagtgatagtgctaaaaacaatccccgtaatggtgatgatgcttatggcaacaagaacaacaatcataatgctaaaagcaatgggaatagcaatgactatcgcaacagcaatagtgttaaaagcagtggcactagcaacggcatccgaaacagtgattgtgctaaaagcaatagcaatgtcaatggccataacaacagcagctgcaagagtgatggtgctaaaagcaataacaattacactcgcaacagttagggtgccagtagcaattacagccaaaccagtgaggacgctaaaagcaatgccaatggcaataacaatagcagctgcaagagtgatggtgctagtggcaatggaaagagcaattacaaccgcaacagtgatggtcctaaaagcaatgccattggaaatgacaaccaaaatagtggtgctaaaagcagtgacaatggcaatgaaaagatcaatagcaaccgtagcagcgatgttgaagcaatgtgatgaaagagtaaaggcaagagaaatgaagatagaaaacgaggtggagcttacgcgggtggtaatagtgacaggagggtgtgcttag

SEQ ID NO: 26770 - DNA, 843 bp, Glycine max
  Peptide Sequence Number=SeqID_143548
atgagtactggtgcccagagataccctgatttcttcaaagtcttcctcccagagaggcactctgagagaatgcttataccaaatgcttttgtgaggttgccacagttacaaggaaggatccctgaggatgtgatcctgagaaatgctagtgggagagtgtggcatgtcaaaacacgatatgttggagagaaattatattttgatgatgggtggagggctttccatcaagaaaactgcttaggccaagcagactttcttgtcttcaagcttgaacggagaaatgagttcgtggtactaatccttcaattatcaacacagtgtcaaaagcctttggtaaagatggaggaggagcaagcagcaacacaactagttgaggagccagacagctcttccgatgatgatgatgaagagagtggagaagaattcagtgctggattcaatcttcaaagtcatcatagaagagcttgcaaaagggagactgcatcaagttccaaccccaatgctgaagatcctcttccagaatatgtatttgatccacaaatgtgtattcatccggagaatcatttttttaaagcaaagctctacagaactagacccaacgaattgcatattccaggaaatgccattcaagaattttcccttactcttcctgaaaagatcacccttatatgttgtcaaccctgccagcgcaaggatattccaatgaatgaattgggagactatcatcataatttgacacccatccgcataaagtatcaggaagtgacaggaagagatttgttcttctttgagctgaagcttctctgggagaggctgagtgagaatctcataaacttcatttga

SEQ ID NO: 26771 - DNA, 300 bp, Glycine max
  Peptide Sequence Number=SeqID_143549
atgtcgtacgacgatgtggagatcgaggatatggagtggaacgaggagttgcaggcctacacgtacccgtgcccgtgcggggacctgttccagatcacgaaggaagaccttatgctcggcgaagaaatcgctcgatgccctagctgctctctctacatcaccgtcatctacaacctcgaagatttcctcgccgattccgatcaaaatcgacgaaacaagggcctccaaccttccaagcagcaacccctcaccggtgcaagtgctaattctgctggtgtctgtgtgtggcttaggagttga

SEQ ID NO: 26772 - DNA, 2529 bp, Glycine max
  Peptide Sequence Number=SeqID_143550
atgatttacatggcttctcttctgaaaaatctacgtcctggtgtgccttcagttcatgatgatggaagtcatcattacagctatgagtactcttttgctgaggaatacaaaggtcctcctctcaactattccatcccagaaattcttcccttcaacgttaaccaaatccctcttgcacacgttgctgatcattctccccctcatcacttatcactcccagtcatccaaccgtttacaaaaatcaatgcagaattggattcaagaactgattctatttcttctgagccactttcatgcagagaagaagaggatcatcatgatgatcatgatggccctcttagtcctaaacatgttaaacggccttctgtggttacttttcgtgatcccacgacaaatgagatagtggaggatgaagagttagttgaatctgttagaggaaaaagtaatagtagtagtagcagcagcagcagccgtgtgaggccacatgctgtgagaggtgggaagaaaggatcgtgctatcgatgccttaaagggaatcgttttactgagagggaggtttgcattgtttgcagtgcgaaatattgtggcaactgtgtgattagagcaatggggtcaatgcctgaaggcagaaaatgtgtcacttgcattggttatagaattgatgagagcaagcgagggaagcttgggaaaccttctaggatgctcaagaaattgttgtctgagtggggaatgaaacaaatcatgaaggatgagatgttttgtaaagcaaatcagataccagcagaaaatgttatggtgaatggagaacctcttgattgggataagctcactttgcttttgacctgttcaaacccaccaaaaggattgaaacccggtttctattggtatgataaagcatctggattttgggggaaggaaggtcaacggccaagtcaaattattagcccacagttggaggttgggggtcacttggagagaaatgcaagcaatggaaagacaaatgtaactgtaaatggtcgagagattacgaaagaagagctctggttactgaagtgggcaggagtgccgtgtgagggaacaactgaattttgggtgagtcatgatggatcatacatggaagtgggacagaagaatgtcaaggggaatatatggaagaagtctacagtgaagctagcttctctagtgctctcactgccagttccttctagcactttgaatcttaccgcagaagaagaaaatggaattagcgaacacaaccttcaacagaaaacgcttcacaaatttttacttgttggttctgtcaagtctggaacatgtactatatttaaacaggccaagcttttgtataatgttcctttctctgaaaatgagcgccaaaacatcaagttggtaattcaaagcaacttgtataggtaccttgggataatactggaggcacgcgaaatttttgaagagagtttgcgccagaaaactaacggacggcattttgatgaatcaacttcttctgggatcactggggaaattgttgacacaacctattccattggcccaagactgaaagccttctctgattggctactcaaatacatggtgtcaggtaacttggatgcaatatttccagcagctgcgcgtgaatatgccccactggtggaggaactgtggagggatgcagccattcaggccacatacaacagaataaatgaaataaaaaatttaccaagaagcgcgagttattttctagaaagggctattgaaatttccaggatagattatgaacccttggacacggacatcttgtatgctgaagggataaccttatccaatggcctttcttctatggaattttcatatactgtgacaggtcatgaggactcattggaccctgagtatcaacatgatccttcactcaggtaccagctcaccagagtaaatccaaaaagcctaggagaaaactgcaagtggttggacatgtttgaagacactgatgtagccttattttcggtggccttaactgactatgatgagtacatagtagacagtaatggagttgctatcaacaaaattttagcagccaaacatctctttgaaagcatcatcactcatagagtcttcagcaacaagaaattccttttattgctgactaagtttgatctgcttgaggaaaagattgaacaggttcctctaacacaatgtgaatggttttgtgacttcgacccagttattagccacaatcataaaacagatagtattagaaaacatagcaatcatcctccattggctcaacgtgcttttcagtacattggtacgaagttcaagcgattgttcaattctcatactggtcgaaagctgtttgtttcactggttactgggttggaaccaggtactgttgatgaagctcttagatatgccagagaggttcttgtgtgggaaaaatgggaccccactttgagaaatgagaagtctgagataacatccacaacttttgaggcaagctctgatgaaaaatataataactatcacccttcatag

SEQ ID NO: 26773 - DNA, 396 bp, Glycine max
  Peptide Sequence Number=SeqID_143551
atggggatggatgaattttttgccatgtccaagatgaggaaagcagatttggtgaaacgggtggtggtcattgccgtgatggctatgtttgttgcagatgcagctgatacaaatgatgtttatagtccatgtcttgatgctaaagttcagagaggagatggttttacatttggtattgcattttcggacaagcaatttttctcccaaggtaatggtccacagctttcaccttgtgacaaacgcctcgacctcgcgaacaaaggagcccagctttctgttttcaggccaacggttgatgaggtctccctactcaccatcaataggagcacctcaaacccggagatgctctcagcaagattcatgagaatgatatgtttgtatttgactttggtttaa

SEQ ID NO: 26774 - DNA, 831 bp, Glycine max
  Peptide Sequence Number=SeqID_143552
atgccgcacccttctttccacaagcttcttctaccctccactgtccaacccaaccaacaactgtggaatgctccttcttcagtctgtattactaacaattaccaatatttggaatctaacttgacttgtgaattgcagaggcttccagataattttatgaggaaatatgggggtgaactattgccaattgttaccctctctgttcctgatggtagtgtctggcgtgtaggattgaaaaaggcagacaacaagtattggttccttgatggttggaaagagtttgttaaacactattcaattagcattggatacttgttggtattcaaatacgaaggaaagtcatctttcagtgtccatatttttaatttggctacctctgagataaactatcaatcagccacgcgaagcagtaatgaagggcttcacttcacaaatcgtcttaaattatttgaagaaatagaagatgaagattccattgaaatctcggattcatcaccttcccaccttgctcccagttcattgcaaaatcaagctcttactggatcagtagataaaatgatgcctgggaagagttatacacctccagcattgcagaatctgttcaatggatctaaacttaatagcataaactggggagagggtggtaatgcccattcttcaagaattgccaattcactagataatcgattgaccagagacataggacttcagtttaatgcagtcgagtttaaaagatctactgaagaattgaaattgcgtgcttccatggaggaaaggatgaaaaaaactacaagaaagaagcgaaaatcaggtcttagtagtatcttttga

SEQ ID NO: 26775 - DNA, 285 bp, Glycine max
  Peptide Sequence Number=SeqID_143553
atgtcgtggaacttcacggatttcctaacgatgggtgtcaagtacctcaaagtggccaagcgaaggtcgcatcccaccaaacagatggcgaaaaagttgtgggaccataaggttcccccgcatgtcatcgggcctgccgcctggatgacaaaaggtgaaaaaaagcgcgggaccaaatggttcctcgcatgtcatcgggcccgctgcctctggatgacaaaaggtgaaaaaagtgcggcaccatatggttccccgcatgtcatcaggcccgccgcctctggatga

SEQ ID NO: 26776 - DNA, 177 bp, Glycine max
  Peptide Sequence Number=SeqID_143554
atgggatcttcgttagcaatgggatgttcatctcggtttgatgtttgcgtttgtggtagttgtgaaggtggcgtaaagggggatgaaggatggttttgttggtcaaaggaggtgggagagttagattggaaggttaggttgggagagttagttacgagggttagatgggagggttag

SEQ ID NO: 26777 - DNA, 570 bp, Glycine max
  Peptide Sequence Number=SeqID_143555
atggagagtaacgcggcccccgccgccgttgttagttcggctgccgaggcagacctgactctttcgactgctgcgcaccaccctattccaaataaggtgggacgagagaaaagcacgccagggcacgtcggcaacccgcatctggggtacaaccgaggagcttacccctacggtttaccacctaattacacaccaccagtcatacgtgacgatgcgggtcatgttcctccccccatacttgaaggggagcctcctcgacatccggacgtggtccacgaggatcatcgagagcatgctcagggagacatcgactcctactccccgttttccactgaggggctagcgcccaacgcactacctcaacccaacatcacgggagaacctcgaagccacccaacgcagccaatatttctgtctgtgggaggaccacccctggcagcagaaggaacggggaaactcgatctcatcgaagaaagattgagggttgtcgaaggatttggcgattatctgttcgtggacatgaccgacctttgcttggtgccggacgtcgtcatccctccgaagttcaag

SEQ ID NO: 26778 - DNA, 477 bp, Glycine max
  Peptide Sequence Number=SeqID_143556
gatgtgccacatggtcgatcccatcttcgtgcttggcgatcaggatttcttctgccccgatgcctccccgcttcttcttcgtcagcctccgcagaaaatgcgtgccgcaaatcaacaccgaataagtcacccgtgttggaattgggccatgatattgctgtgaaggggtcattgtgggccatgaaaaatgagcttgtgtttccgcaacaccaccgaacgattgctggcttgcagaagtatcagtgtgatgaccctgaaaaggatattgatacatctgggtcggatactcagcaaatgtttgtggcgtgtaatacattccatggccacgctccgccatttgttgggaatattcttccgcttcaacaatgtcccttcttctgtctatcccctgagtttcaatacttgactgaagtatgtgaaactgttgtgcaggaaattgacgctctgatgcgggaccatgtgacactggctcagtga

SEQ ID NO: 26779 - DNA, 993 bp, Glycine max
  Peptide Sequence Number=SeqID_143557
atggaagggaaaaaagcagcagcagtcttcatcacctcacctacttatcatggtatttgcagcaacttgagtgagatttctgagctgtgtcattctcataaaattcctttgcttgttgatgaagctcatggtgcacattttggatttcatactgaactgcctaactcagccctccagcaaggagctgatctgactgtacagtctactcacaaagttctatgctctctgactcagtcatctatgctgcacatgtcgggaaatattgtagataaggaaaaaatttctagatgtctccaaactcttcaatccacaagccctagttatctgcttttggcatctctggatgctgctagagctcaacttagtgaaagccctgatgttgtattcaaccaagcaatggcattagcttatgaggcaaagtgcatgctaaaacgaatccctggtatatcagtgcttgagaattcaagctttccaacctttcctgcaattgatccattgcgtctcactgtgggtttttggaaggttggtttatcaggttatgaagcagacgaaatcctatatggagattacggggtcgtctgtgaacttgttgggaataaatctattacttatgcattcaatcttggaacttgtagggaccatgtccaaaggcttttatcaggaataaagcatttggctgcaacatatgttaccattcagcaacctgaagagagagtgcttacagttcatgcaccctttgatgataaaatcacgagtttgatccctagagatgccttttttgcaagtaaaagaaaagtaacgataaaggagagcatcggtgagatttcaggggagcttatatgtccataccctccgggcataccagtattaatccccggcgaggttattaccaaaaaagctgttgattatcttcttcatgttaggagtaaaggtggtgatattactggagcatctgatcccttactttcttcaatagttgtttgcaatgtatag

SEQ ID NO: 26780 - DNA, 741 bp, Glycine max
  Peptide Sequence Number=SeqID_143558
atggtgatggcctccaagtctaattccctaacatttggagctgcttgtttcacaacttgcccattctctagaactaaaacctgctgcattcactttcttgccattccaaatgcaaaatccagagccactttttctctcggtcccactctgtccaagaggatgagcttaggtattctttctagtcccatcgagacaactcccacacatctcattacaccaatttcagctcttaattcaggtttggaagcatcaattacagattcgaacgatatttcagccatcttagcaaatgccaaaatagtagtagattctgaagatgaaaataagatacaactaagagtggacttgactggcgatcaaacacagaaggtattcgacaggatcctaacaaacttaggccgtactgccccaccagttcctggatttcgcatgcaaaaaggagtcttccttgaagataacttgataaggaaatgcatgcagatcccaaaggacttccttgtacagatgcttggggaagaacgtgtcaccaagttttcaatacaagaaatactcaattctaccatggctgattatgtgaaaaaggcaagtgatttttaccccttcatatgtggctgtcatggatataaacttatttccacatttgatgacacaataccaggaaaacttggatgtaaaggaccggaagataagcactacccaaacgcaagaacaactcaaaaaatcattcaagccaggaaatga

SEQ ID NO: 26781 - DNA, 732 bp, Glycine max
  Peptide Sequence Number=SeqID_143559
atgtctcctacattctcactctcttgcatgtcaaactggttatgccctctccattttccagattttgccaacacttccactttcaggcttcattgctctcaggaaagaagccttgcaccgccttctgtaacttctgttgggcaagatgaaagcattggaagaatagcaatcagaaacgaccacgttttgaggaacaactctccggtgcttcaacaaaatggcctacctcctctagttagtgcattgaaagcttcggctgagcaaaatgttgccagttttcactttcctggacataacagagggcgtgctgcgcccgcttcgttgactcggctcattggaacaagaccatttgttcatgacttgcccgagcttccggagcttgacaacctcttttgcccacagggtcccatattagaagcacaaactgaagcagccaaactgtttggatcgtcgcagacatggtttcttgttggaggtactacttgtgggatacaggcagcaataatggcaacctgttctccgggggaatttctcattcttccaaggaattctcatatatcagctatatctgctttggtattatctggtgcagtgcctaagtacatcgttcctgactatgagaatgattgggacattgctggtggtgtcactccattacaggtggtttggttgtgtccaatatcatattatgcttaccttcatggaaaatttactgatgaaaataaaaaataa

SEQ ID NO: 26782 - DNA, 255 bp, Glycine max
  Peptide Sequence Number=SeqID_143560
atggcgaagcatgctgagctggagggtgtcgccagtgacacaagcgagatacaccatactggaatgccgtcaatgcaaatggccatggtgtatctcgcttgtgccgctggtggcaccctccagctcagcatgcttctcgccatctgcaatggcgggacacttatgtcgtcagttcctctgacaacatccatggaggaacagactcccctcgccaaggccttaggctcatgcgtcaccgaaatttctatttcttag

SEQ ID NO: 26783 - DNA, 843 bp, Glycine max
  Peptide Sequence Number=SeqID_143561
atgatgatgatggggaacaatgtgcatagcattggtgtcataggagtgatggtgagtggcttagtgttgatgatggtgtcaaaaggtgtgagtgtgagagctcaaaactgtgggtgtgaggcagagttatgttgcagcaaatacgggtattgtgggagtggtgatgactactgtggcaaaggatgcaaagagggtccttgctatggcactgccacacccaacgacgatgtttccgtggccgacatcgtcacttccgagttcttcaacgccataatcgatcaagcagaagaccattgtgctggcaagaatttctactcacgagatgccttccttgatgctctcattgcctacgaccagtttgctaagactggttctgttgatgactccaagcgtgaaattgcagctgcttttgctcatttcacctaccaatctcgacatttttgctacatagaagagattgaaggtgcatcaaaggactactgtgacaaaaccaaccgccattacccgtgtgcccataacaaaggttactatggacgtggacccatccaactatcatggaacttcaactacgggccagcaggggagaacaatggttttgatggattgaacgctccagagacagtggccagtgaccctgttatatccttcaagacggcattgtggtactggacacagaatgtgagccctgtgatgaagcatggttttggtgcaaccattagagctatcaatggtcatcttgaatgtgatggagcaaaccctgaaactgttcaggctagggtcaattactatactgaatattgttcacagcttgatgttgctccgggagataacctcacttgctaa

SEQ ID NO: 26784 - DNA, 294 bp, Glycine max
  Peptide Sequence Number=SeqID_143562
atggagtcccaagctgaagctcttggccagttgacaagtgatgatcttgaaggaaaggatcaaaggatccaaacccaagtttattgcatcttaggaaaatttgctttgcttgagggctcatcagttgatgacgaccttgcaaatttgaaaaaagagttatctggtgcctcaaagcagaaaggagaccttcctcctggaagaagtaccactagcgccaacactggaattccatttcgagatgctgagattgagttggaacttgatcaattgaggcaaagagctaaggaattttga

SEQ ID NO: 26785 - DNA, 270 bp, Glycine max
  Peptide Sequence Number=SeqID_143563
atggtacaagcacaaggtttcagttccctagcaagcttcaacaacatggtagatcatgatgtggtggaaagcattgggaacaaggcaaatgctccaagctggtttgccgtcacatttgccaccgtgggtgttgcttgctcatgcctcagttttatcattctccatcatgccatgatacagaagctggagaaattgctcgtcaacgttcattctcagccacctcagtcatctcttgaaattgtcactgttgaagctgttttgatgttatag

SEQ ID NO: 26786 - DNA, 570 bp, Glycine max
  Peptide Sequence Number=SeqID_143564
atggcggcgaaacttcaaatatttacgggattgccccccgcgccatttcaatcttcttcttcctccactctctgcgtactcaagaagcctctcactacctccttcttcggcaccgcgcgagtggaagttctgaaacttagagtgatgaggattgtgaagcctacgcgtggcggaggtgctctcggtgctcgcatgaacctctttgacaggttcgccagagttgtgaagtcgtacgcaaacgctgtcttaagttcgtttgaagatccggagaaaatattggagcaagctgtgcttgaaatgaacgacgacttgaccaaaatgcgtcaagctactgcacaagtattggcatctcaaaagcgattggaaaataaatacaaagctgcacaacaagcttctgaagagtggtaccggaaagcacaacttgctcttcagaaaggtgaagaagatcttgctcgtgaagcacttaagaggcgtaaatcttatgcggttttaaaaagggctgctaatttgtggagtgtaaatgagtcaaatgaagttgttgattttttttccctttcacatggttgttaa

SEQ ID NO: 26787 - DNA, 1620 bp, Glycine max
  Peptide Sequence Number=SeqID_143565
atggaaaatctccatagccataggggcattactaatgctaccactagtcctccacatggctttacagatattttcagaagagagttaggtttgtctcatcccaacagtttcgcgcgtcgtttttcagcttccgaggtccttgtgaagagcttggatttatatgggaagttggatggtcatgaagggtgtgtgaatgcagtggaatttaactccaccggtgacattcttgtttctggttctgatgaccgacaaattatgttttggaattgggaatccaaaactaaattgtttgcatacccttctggccacacagacaacatattccagacaaagattatgccattcaccgatgactgccgaattgtgacttctgctggtgatggccagcttaatatatttattatgctagaagaacatcagatggaggggtcgagtctagcagaatggactagtctcatagaacatggtgaatcaagatttgaatccctactggctactaggagagaatctagcaaaaagctgtactttgtattttatgtgcaatgtatagcttcttttcctgttcaagtagccaatatgccacaaataaggcttggccttctctgggaggatggtagagttgacactacaatgttggggaagcaccatggttgtgtatacaagcttgctgtggagcctggaagtgcccacatattttacagttccggtgaagatggatttattcaacattttgatttgcgaagtaattctgctacgaaacttttctgttgttcctcatcaataggaaacaataaacagactctaagcaaagtagggttgaattccattgtgattgactgtagaaatccatattactttgctatcggtggatctgatgaatatgcacgtgtttatgacatgagaaaatgccagtgggattcagcaagaaattcagatcgacctgttaacacattttgccctcgtcacttaattggttcaaataatgtccatatcactggattggcttactcaagctttggtgaactccttgtttcttataatgatgagctcatctatctgtttgaaaagaatatgcactcggattcttcaccttcatctgctacatctgaggattcgaagaatattcatgaggcacaagtttactcaggccacagaaatgcacagacaattaaaggagtgaatttttttggcccaaatgatgaatatgtcttgagtggttcagattgtggccatatattcatctggaagaagaaggaagctaagctggtgagattaatggtaggtgatcaacatgttgtaaatcaacatgaggcccatccgcatatacctattcttgctacttgtggtatagaaaaaaatgtgaaaatctgggctcctctagggaatgatatacctccacttccaggaaatgtgaaagagataatggagacaaacagacagggcagagaagaccgatcacagaggcggcagacattggcatatattgaaagaagacataatagggcagatattgtgagtgatgaagaagatgcagagggctaccttttaggattcttagatggtgatgcctcttctgaagaggattatcctggaaattccagagattgcaacattagctaa

SEQ ID NO: 26788 - DNA, 3081 bp, Glycine max
  Peptide Sequence Number=SeqID_143566
atgcagattggacaggatcacccatttgataggcgttccacttcaggatattgtgtgtctattggaggaaatcttgtctcatggaagagtaagaagcaaaatgttgttgcaaggtctagtgcagaggctgaatatagagctatggatggagccacatgtgagctcatttggattaaacaacttcttcaagaattgaagtttggaattattcaacaaatgaagctatgttgtgataatcaggcagccctacatatagcttctaatccagtattccatgagagaactaaacatattgagattgattgtcattttgtctgggagaaagtcctttctaaggaagttattactgaattcgtaaagcgatgtggagaaatgtcaagaaagctacgattcttcaaggatcaaatcagtaaagctggtctaatgtcttcttctcgtactgaattgcaacccgatatagacttggaggatttagagatacaacttgctgaacatgaacatgagctgattgaaatgaactctaatagtgacaaacttcggcaatcctataatgaactcctagaattcaaaattgtattacaaaaggcatgtggttttcttgtttccaatcatagccgtgtggttttagatgaaagagaactacgagagaatgtatattcaaatgatgcctatgttgagacagtatctttgcttgaacaggaaatgaggcctcagtcatcaaactcgtctggtttaagatttatcagtgggattatttgtaaatccaaggttcttaggtttgaaaggatgttgtttcgtgctacgagaggcaatatgcttttcaatctggcaccggctgatgaacaaatcatggatcctgtttcagctgatatgattgaaaaaacagtgttcgttgtgtttttctctggggaacaagcaagaaccaagattctgaaaatttgtgaggcatttggtgcaaattgttatcctgttcctgaagatattagtaagcagaggcaaataactagagaggtttcatcacgtcttacggacttagaggcaactttggaagctgggattaggcaccgaaacaaggctctagcttctgttgcagaccatctagcaaaatggatgaacatggtaagaagagagaaggctgtgtatgatacgctgaacatgttaaactttgatgtcacaaaaaaatgtcttgttggagagggctggtgtcctctgtttgcaaaaacacagatgcaggaggcactgcaacgtgcaactttcgatagcaattctcaagttggcataatcctccatccaatggatgcagtggaatcaccacctacatattttaggaccaacactttcacaaatccttatcaagaaattgttgatgcatacggtgttgcaagataccaagaagcaaatcctgcagtttacacaactgttatattccctttcctgtttgctttgatgtttggggactggggtcatggaatttgcctgttgctaggagcattggttcttatagcacgtgaaaacaagctcagcacacagtatggcgatcaaatccccatttttgggcccagtaagcctccagttttggtgtaccaaagaaaaaagaggagcagcaatcataagggcaggatggtaattatggtggagtttgttagagaggagcagcctagcagaatggacaggcggtggcaaatcagtggtgaaaggagtgtggaaattattgcgagtggagggaatatgaggcagggagggagggagtacaatcagaataggcataaaatgtgtaaggggattctgggagggtttggcatggggcagagtagcattacttatctgattttatctctgtttttccattactctgttattcatcttgtgtctgttactaaacttggaagctttatggagatgctatttggtggccgctatgtgcttcttctaatggcactattttcaatctattgtggcttaatctacaatgaatttttttctgttccttttcacatatttggtgcatcagcttacaaatgccgcgatagttcatgcagggatgcacatactattggcttaatcaaataccaagatccatacccgtttggtgtagatcccagctggcgtggaagtcgatcagaattgcctttcctaaactctttgaagatgaagatgtccattctgtttggtgtggcacatatgaacttggggattgtattgagttattttaatgctcatttctttcgaaactcactggatataaggtaccagtttgtgccacagatgattttccttaacagtctatttgggtatctttcccttctcattgttatcaagtggtgtactggctctcaagcagacctttatcatattgtgttattgcttttggctgtaattgcagttccatggatgctctttccaaaaccttttatactaaagaagcttcatactgaggtgccactttcacctgtcttgtgtatgttaataattaaggaggtgatgataaggagtttatcaagattattaatctattatcctgatgacattgtacagaggtttcaaggtcgtagttatggtatactgaatacctctgaggtggatcttgaggctgagcctgattctgccagacaacatcatcatgaagaattcaatttcagtgaggtctttgttcatcaaatgatccatgccattgaatttgttctaggttcagtttctaatacagcatcatatcttcgtctttgggcattaagtttggctcactcagaactttctactgttttctatgaaaaagtcctgcttcttgcttgggggtatgacaatcttgtcattcggttggtggggctaaccgtttttgcctttgcaactgcctttatactactaatgatggagagtcttagtgcttttcttcatgcccttcggcttcactgggtagaatttcaaaataaattctaccatggcttgcttgatgatattcttcttgatattgacctagcaacaaaaatttcctgctcatttccccatggcttcggggttgtaacaagatcgcactgccgatggtcatggaaggaaacggaagagctaagggaagggactgcttag

SEQ ID NO: 26789 - DNA, 618 bp, Glycine max
  Peptide Sequence Number=SeqID_143567
atgttatgtgatgcaaaggtaccgatcaagctaaagggaaagttttatcggactgtggtaagaccggcgattttgtacggaacagaatgttgggcggtcaagagccaacatgagaataaagtaggggtagcggagatgaggatgttgcggtggatgtgtggtaagactcgacaggataaaattagaaacgaagctattagagagagggttggagtagcgcctattgtagagaagatggtggaaaatagacttaggtggtttggacatgtagagagaagaccggtagactctgtagtgaggagagtagaccagatggagagaagacaaacaattcgaggcagaggaagacccaaaaagactataagagaagttatcaaaaaggatctcgaacttaatgatttggatagaagtatgctttttaaaggcagccatcgacgcgatcctctccctcgttgtctcttggattcaggtgagcatgatgaaagaggaagggtgaacatcaagcattacgtgccagataaatatatgatcccctatgttgctaacctcattgatgctgcagagtactttttctcctttctcataaaacaaaaactcctacctcgttatgtcatttga

SEQ ID NO: 26790 - DNA, 2916 bp, Glycine max
  Peptide Sequence Number=SeqID_143568
atggaagaccatgtttcccctgagggaaaggaagttagctgttgcgcacctcctggggctcagttggaggaatcaacatcggtagatggtggaaagaaaaattcatcttcagaggacatgtttagcaacttctcagagctcatgaactttgatacctatgctggctggagtaatagcccatccatgactgatctgagtgtggctaatgtgttttcattattttcctcagcgccatatccaccacctgatggattgaatttagtggaacaaagcaatggttcattctttatgacagaagatagtgaatttcacaatggtatggaaagttctcctagttgtgttgagagagttatatttcagcaaatggacatccatcttgggttcttagatgaagcaaatgattcaaataacttggactcaaaagaaaaacttaatggcaaatctcagcaagttaatacctcagacatgtgcaattacataatctcaaggtcaccaggtaggtcgcttgatgatagaatgctgagggctttgtccttctttatggaatcagctgatgagggaatgttggcacaggtgtgggtgccaacaaagcatggtgatgaattcatcttaagcacaagtcaacaaccgtatttgttagatccaaagcttgcagggtatcgtgaagtgtcaagggcatttacattttctgcagaaggaaagacaagaacatgtcctgggcttcctgctcgcgtgtttatatcacatgttcctgaatggacctccaatgttggttactacaataaaactgagtatttaaggttggagcatgctaagaatcacgagattcgtggatcaattgctcttcctatatctgatgtgcactctcaagtgccatgtgctgtattggaactagtcactacaaaggaaaaggctaattttgacagagaattagaaattttttctcatgcactccagcttgtaaatttaaggacttcaatgcctccacgacttcttcctcagtgtttatcaagtaacaaaagagttgctttaacagagataattgatgtgttacgtgccatgtgtcatgcacatagattgccacttgcactaacatggattccttgttgctacagtgagggaataagagatgaaactgagagaatacgaatcaaagagggtcatacaagttctaatgaaaaatgtgtcctatgtattgaagaatcagcttgctatgtaaatgatggaggggtaggaggatttgttcatgcatgcattgaacatcatcttgaggaagggcaaggtatagctgggaaagctcttcaatcaaatcatccattcttctatactgatgtgaagacatatgatattggtgaatatccccttgttcatcacgcacgcaaatataacttgaatgctgcagttgcaattaggctaaggagtacctataccaatggtgatgattacatattagaattctttctgcctgtcaatatgacagggagttcagaacagcaacttttattggacaatctctcaggtaccatgcggagaatttgtaagagtttgaggacagtttcagatgctgagttaacaggaatagatggttcccaaggtgggtttccaaaggaaaaagtctcaggtttttttccaatgtccaggagaaactctgagatagcattcataaatggtgaccatgattcggtccagaagatgtccatgaagacatctaacatgagaaataatggaactgaagctgttcatagccaggcaatgaatggatcaagaaagcaggttgagaaaaagagaagcacagtggagaagaatgttagtttgagtgttctccaacaatacttttccggtagtctgaaggatgctgcaaaaagcattggtgtttgcccaacaactctaaaaaggatatgcaggcaacatggaatttcaagatggccatcccgcaagataaataaagtgaaccgttctttgaagaagatacaaactgtgcttgattctgtccagggagtggaaggaggactgaagtttgatccttatactggggggtttattgccggaggatcaatcatgcaggaaattgatgcacataaatatcttgtgtttcctaagaaaagttctgtgaaagatccaaagccggcaacacaaaaaacagtctcagtagctccagcacctggaagcactagggagaattctacaattaagttgaatgatgatgaaagtgtttgtctggtgagaaacaagtttgtgcactcaagaaatgttcttaactccaatagcagtaagggagaattgaagaaagacaatgtttcttctgatgattgttgtgatgattcaaaatcaatggccatgaatgatggatcatgccagaaatcctgcctttggaccaagactcaggattgtcctgaacaaacttgttcaatatccttggttactgatgaggttgaagttggtgtagatagggtagaaggagctgatgaacataaccatccgacttcttcaagcactacacactcatccaatggctctggctcaatgatgcatggcagctcatcatgctctcaaagcttcgagaaacaaaagcattcaaaagtcaagtcaaattgtgttgatagtgggtcaaaaatgattgtgaaagctagctataggggtgatactatacgtttcaagtttgatccatcctcaggttgtttccagctatatgaagaagttgcaacaaggttcaaattgcaaaatgggtcattccagctcaaatatcttgatgatgaagaggaatgggtgatgttggtgaatgactcggatttgcaagaatgtacagaaattttgggtgacattggcacacgttttgtgaagtttcttgtccgtgacgtgccttgtgtttttagaagccgtggaagcaatagttgcttcttgtcagatagctcatag

SEQ ID NO: 26791 - DNA, 2031 bp, Glycine max
  Peptide Sequence Number=SeqID_143569
atgatgaagtttgatagagcagatgcccagtcaattttgtcccatttcaagcgcaaagacaaacagattaaacttaagagcaagtggttactcgggattcctctcactaaatataagatgaagaagttgaaaaattatatcaaaaataggtatttgtccgagtctttaatcagggaagatgatatgttttatgagtctgtaagaactcatgttgaagaagcctttggaatgcaccacattgaacaagagaatcatgtcaccgtggatgatattgatttgattcaaataccaaacatgaaaaggttgatatcatcgtgccttgataatttgactaccaagggtctctaccttcttgctatgatagttactggtggctcattcaagtctgaaataactcgttgcaaattgaaaaaggttatcaagggttctctttcaagtgttccgggtagcaaaagcgacaaccgtctggagactcgtaagcatattttttctcttctcaccaatccacagaatttccgagacaggtgtgagcctttggctgcattaagattccaatctcatcatgctgctgtagaaaatatattgcgtggacttcaaaaattgccatgtcaggccttgattgcaatgcgtagaaaacttaaaggagtgaaagcatcagtacctcagttacaacctcgcagacatggatggacacgggaccatctaatcaaggtagtgaagaaaatcagtatggaaatgctttcacaacttgatagagaaagtgagctgcaagagccattagccaaagccatggcagtagcagacttgtcacaaaagctgaatactggttgtcataacatattttcaaaagaatttttccaattctccccggaggtgaagtccttgcaaagtgatattatgaatgctatatggtctgttaagaaagtagtgacagtgccagaactaagaaatttacagcttctcatagaaccgaaggcggtaatatcaaataggtccatacggacagcttttgtgaattttttgattgaatttctttttgagtgcagtgatatggatagtgttccaaagtctctatcacagaccctagatgttattaacagaggttctaatagctgcatgaatgatttattgttcaagaagaagtatattgaggaagaagttgactgcatactaaacatgagtgctttgacaaaacaaattgttttggatttgttgcctgatgatgaattggataaagactttactgatgcttactcggagcaattggaagaaagtgattacagcagcagcgatgatgatgataatgatagtcaacttgtggaggatatacaattcagaaatggaacatctggttcaatgtattcattctgtgaaggagaaagtattggagaatttgtgccatttgaggaaaatgtttcttcctccccacttacaactagtgataagttgaatagtggttctgaacagcatcaagctaataactgtgatacggtggatttggactccaaagttcataacactcaatgcaacatttttactgaccaatgccaaagagaaagcacagagattttccatacatttatggcctgtaaaaataataattcttcagttatttcacctgacagagaattggacgaaaatgttgtaaagagaaatgaattttctgaatctgatgctaaagtagatgctacagacacaacagatttgttttgtaaggagaaagaacccatgcccactaagtgcagtgaatgcaagaaccaatacctcgctatccaagatgcttgtgataagacaagtatgcttgcatataatctcataggtcatttgttggaagagtttgtcatgattgaaggcctagatttaaacttgagcaagagtttatacctcactggtaataatcgcattgaagatgttgaagaagagcagtcatcatctgggaaacatgcaagagattttgttcaagtaattgaagagctgattccttcctttccagataggtatttgttgcattcctcaaatatggtggcataa

SEQ ID NO: 26792 - DNA, 903 bp, Glycine max
  Peptide Sequence Number=SeqID_143570
atggcagtggttgattaccaaagtgttgatcttgtgctgagtcttataccaaatgcttttgtgaggttgccacagttacaaggaaggatccctgaggatgtgatcctgagaaatgctagtgagagagcgtggcatgtcaaaacacgatatgttgaagagaaattatattttgatgatgggtggagggctttccatcaagaaaactgcttaggacaagcagactttcttgtcttcaagcatgaacggagaaatgagttcgtggtactaatccttcaattatcaacacagtgtcaaaagcctttggtaaagatggaggaggagcaagcagcaacacaactagttgaggagccagacagctcttccgatgatgatgatgaagagagtggagaagaattcggtgctggattcaatcttcaaagtcatcatagaagagcttgcaaaagggagactgcatcaagttccaaccccaatgctgaagatcctcttccacaatatgtatttgatccagaaatctgtattcatccggagaatcatttttttaaagcaaagctctacagaactagacccaatgaattgcatattccaggaaatgccattcaagaattttcccttactcttcctgaaaagatcacccttatatgttgtcaaccctgccagcgcaaggatattccaatgaatgaattgggagactatcatcataacttgacacccatccgcataaagtatcaggaagtgacaggaatagtgtgtaggtggcaagatcatagaatatatatcaagggttgggcaagcttttgtagaaggaataagattgaaagaaatgatacatgcttctgtgaagttatatcaggggaagaccaagtagtaaaaacactacgggtgcatgttgctaggaggagatga

SEQ ID NO: 26793 - DNA, 303 bp, Glycine max
  Peptide Sequence Number=SeqID_143571
atggaagacacactcacatgctgcggagaagcacagaataagcgaggcggttccacggcggggatatcagttgcttctgcaggaataattgggaacttgattgtatatctgatacgtgaattcaatataaagagcatcgatgctgctcaagttgcgaacgtggctaatggaagctcctctctatttcccattgttgcagcaataatggctgactctttctttggctctttccctgttgccttggtttcttcttgtgtttctttcttggtaattattaatactcctgtttctatatatcaatga

SEQ ID NO: 26794 - DNA, 168 bp, Glycine max
  Peptide Sequence Number=SeqID_143572
atgattgacctcaattttggggttgaacgtagccaattttatcgcttgagaatcgatgttggcgatggaatggagatcaacgtggctttcgatggtggcatgtcccttgaagggaagaagacccaacttggggtgtgtagaaacatgcttaaaaggctagttggataa

SEQ ID NO: 26795 - DNA, 573 bp, Glycine max
  Peptide Sequence Number=SeqID_143573
atgtgtttcctggttactgaatttttatccagggcaatcatgagtgacgaaggagaaaggacttgtcctctctgtgctgaagagatggatttgacagatcagcagttgaaaccatgcaaatgtggttatcagatatgtgtctggtgttggcatcacatactggaaatggctgagaaggatgacacagagggacgatgccctgcatgtcgttctccatatgataaggaaaagattgttgggatggctgcaaactgtgagagattggtggctgaagttcatatggaaaaaaaggtgaagaaccagaaagcaaagtcaaaatcttctgaagcacggaagcagctcagtagtgtgcgagtaattcagcggaatctggtttacatagtgggattgcctctcaatctggcagacgaagatttcctccagcagcgagaatattttggtcagtatggaaaggtcttaaaagtgtcaatgtctcggactacagctggtgttgttcagcagtttccaaacaatacatgtagtgtgattattagtagcagcagtggtagcccccatagtggcatagcagagtga

SEQ ID NO: 26796 - DNA, 717 bp, Glycine max
  Peptide Sequence Number=SeqID_143574
atggggaagggtaatgctgattcattgttaccgaagttgcttttggatatattagcagttacatcagtttgcactgcaagtcttagtaatatgaaagaaattgcgaagtctaaagccaaagaagagaagaagaaagtagaggctgagattgagctgctcttggtagtagagaagcttcaagagttacgctccataagaatacaaaagttgaaaaaacaaggccattttctcccagaggaggatgacaagtttcttgagaaagttcaagctgctgtggaagaagaggagcgtgaagctttggctgcagttgaaacagatgctgctaaagatgcaattgcaactgctgaggaatccaggaaagctattcagaatcaagggaaattgtcaaaaggaagcaattatgatagtgaagtaaaggagagaaaagagctaacagttcaaagtgtgactgaagagggatctggtgcagttgacgagaagaaatctagtaaaataggacagatcagtggaggagcgtatgatcctttggcaaacttacccattgagttctatcattattatcacggaagcaacaatgatatgggcacacttattgaggttagaagaggatgggatgcctatatcagaccaggaggaagccgcataccagggcattgggttcagcctcctcctccagctaatgagatatgggcatcttacttggtgagacctaaatga

SEQ ID NO: 26797 - DNA, 807 bp, Glycine max
  Peptide Sequence Number=SeqID_143575
atggctaactcttctgggaatcacgaagaagagcagacaacccatgttgcgtcgtcgtttaacgggaatttggcacccgacgcttcgcccaccgcgctcgccatgaagcacaaccccggcatagccctcgattggactctccaagagcaaactattctcgaagaaggactctctctgtttgcatctgaacctaacctcacacgctacgcaaagatagcacaaaatctaaataacaagacagtccgggatgtagcactgagagtcaggtggatgaataaaaaagaaaattgcaagagaaggaaggatgattttccaaggaaaagtaaagataaaaaggtttcggatcctgcagtgagatcatctcactatactgctcaacccaatgtttccccatatgctcctgctatgactatgatggacaatgatgatggcatctctcacatagctattggaggccccacaggtgagctcttagagcaaaatgcacaggccttgaataaaatctctaccaatcttgctgctcttcaggtattcttcaagtatgtaaatgaatacaattcagtcactgtagcaaccttttcatgtctatctgaagccttagaaattcaacttcaaaataccagtgccggcactaagttacagggtaacatcaatcttttcagccaaacgagagacaacatcatcaaaattttgaatgacatgaatgacatgcaagaggcaatgaagcaaatgccacctcttccttttaagatcaatgaaacgatattcaactccatactttccaaaacaaatcaacatatgcaataa

SEQ ID NO: 26798 - DNA, 450 bp, Glycine max
  Peptide Sequence Number=SeqID_143576
atgatcaccatcagagcgctgcgcgcagaagactttatgccgtggctggcgctgtggcagggctatcagcgcttttatcagaccaccattgacgataacaccaccggcgagagctttcgccgcttgctgtcccgcgcggaacccatgcactgtctggtggccgagcaggacggcgcgatggtcgggctggtgcattttcttacccatcgctcaacctggactcagggcgactactgctatttgcaggacctctacgtcagcgaagccgcgcgcggtctgggtgccggcaaggcgctgattctggcggtctatgaacaggcggagaagctcggctgttcgcgcgtttactggctgacgcaggcgtctaatagccacgcgcgggcgctgtacgatcggctggcgcaacaaaccgactttgtgcagtaccgacatttattcgaccagccgtaa

SEQ ID NO: 26799 - DNA, 408 bp, Glycine max
  Peptide Sequence Number=SeqID_143577
atggacactagccataaccctaaccataggtcagagacacttttgctttttgtctgtgtgtcagacacacttttgctttacgacagttcacaacttcatccttatctattgacatcatcaaaatctaatgcttcaaaccataaacctaaccctaggtcgtacgtgtcataccctaatttcatctggagactatcattttctaacattttgattattgctagccaaattgagctgcttgacaccagttgccgcacaatccaaaaggtttttcgacgtttcgaaaaagaatacggaaaatacccaaaagggaaaggcaaaagggtcattaggaagctttttctgacccttggctcgcctaggctagcctctggctcacctgggccaccaaataacttcatggtgaagtaa

SEQ ID NO: 26800 - DNA, 297 bp, Glycine max
  Peptide Sequence Number=SeqID_143578
atgccgcttcaaggagaagacgagtcaagaacaagctcaccaccaaaggaagtcatggataagagcttgaaggtaagagaagatgagttgggggagaggaagaaaggtgaacgaaattttgaaagagagaagagggagaataaggggaaaaactcgattcaaggttcattacttcatcaaggtattcatccaaaccctccaatattcaaagagcttgcaaaaactggtggtggatgtgcacatgtttgtgtgggtatgtctacgatggtaatatataactcaaggcatgtgaggtag

SEQ ID NO: 26801 - DNA, 468 bp, Glycine max
  Peptide Sequence Number=SeqID_143579
atgccattgaggggcaggcattttgcagcgtacccttaccaaacactttggggggccttcattaccacccacaaccacaacccttgtcgaaaaatgggggtgtacacgaaagatgagaaattgttgatgcatttcttccaggaaagtcttactagggcagcaatcacttggtggaaggacttggcagctcaagtagcgcctccaatgatggaaagggagatgatcacaatgatagtagacacgttactggtcttctactatgagaaggtggtgagttacatgccttcaagctttgtcgatttagtttttgccggcgaaaggatcgaagtgggtctggaaataggaaaatttgattatcctgctttaatgaatgggaagcctggggaaaatggagagaatgagaaggagggaagaacccatgttgtgactgttgttcctttatggccaaatttcccaccagctcaataa

SEQ ID NO: 26802 - DNA, 267 bp, Glycine max
  Peptide Sequence Number=SeqID_143580
atggatctagaaggaaaagcatctgttggctttggaagctctttgccactcctcaaggtcttggaaggttgcactcacattctactaaaattgaatgttgttggtggccatttgcttcatcagctcttccaaggaaggaagagcttgatatttgctggtggaaggttgaaactgtcattgtttgaatggatgctattatgtgtggttgcatggcagaattatcagcaacttgttttgcttcctggagtgtggaatgtaacgccttga

SEQ ID NO: 26803 - DNA, 1086 bp, Glycine max
  Peptide Sequence Number=SeqID_143581
atggcagtcgctatggctataatgaccaagcagcatctgctgacctacatctaccttctagtttacatttcactttcatcagggtgggtcctctccacattgtattttaattttccatttccaataacactcactatgatccatatggctttttctggtgcggtggcctttttccttatccgtgttttgaaggttgtgtcgccaattaaaatgaccttccatatatatgcaacttgtgtggtccctataagtgccttctttgcagctagtctgtggtttgggaatactgcttatttgtacatttcagtggccttcatccagatgcttaaagccctgatgccagtagcaacatttgttgtggccgttacttgtggaactgagaaattaaggtgtgatgtattctggaacatggtgctggtcagtgttggagttgtcatttcctcctatggggaaattcattttaatgtgcttggtacagtttatcaggtcacgggaatagttgctgaagctttaagactgggtaaaaagcacgtgaaacctttttcatctctatgggatgctgatgttgattttgacctctttgcatttctttttatcccatggtatatccttgagaagcctgagatggaagatccacatatgcagtttaacttctgggtatttttctcgaatgcactttgtgctttcgcattgaatctttccacatttttagtgattggcagaactggggcagtaactattcgggtggctggagttttgaaagactggttacttatcactctttcaactgtcttatttcctgaatcaaagattaccgggcttaatgttattggctatgctattgctttaagtggtgttgttttttacaactaccttaaggtcagggatgttcgcacatctcaacttcaaagtatccaagatgaatcagcaaaggagctgcagacggagaagaaagcagatgatgccatggacaacaaagatgaggcttcatggaatgattcagtttctgatactcatttagatgaagaagcacctctaatctcttcgcggatatctcattttggagttggaagaaagccagcttag

SEQ ID NO: 26804 - DNA, 428 bp, Glycine max
  Peptide Sequence Number=SeqID_143582
atggctgaccaagaggagatacaagaacagatgaaagccgacatgtcgactttgaaagagcaaatggcttccatgatggatgccatgctaggaatgagacaactaatggagaataacgtggccaccgctgcaactgttagtttggctgccaaagcagacctaactctcccagctaccgcgcaccatcctctcccaaacatggtaggacgagaaagaagcacactggggcacatcagcaacccccatctgggacacaaccgagtggcttacccttatggattaccacttaattacacgccactagtcatgcgtgatgacacgggacatgtttcttcccccatcttgaaggggagcttcctcgacagttggacgaggttcacgaggatcgtagagagcatgcccaaggagacatcgatttctaccccccg

SEQ ID NO: 26805 - DNA, 903 bp, Glycine max
  Peptide Sequence Number=SeqID_143583
gcgatcgaggagctcaactaccagccgaacctctcggcacgctccctgcgctccggacgaagcggagtgatcgggctggtgctcccggaactgagcctcagctacttcggggagcttgctgacgcggtcatcgccgaggccgagaagcacggcctcgtcgtgctgatcgagaagaccggcgccgaccgcgagcgggagatcgccgtcctcacgagcccacgcatgcagctcaccgacgggctcatcttcagcccgctcggcatgggccccgccgatgccgcgcacttcgaagtcgacttcccggtcgtgctgctcggcgagcgcatcttcggcggaccggtggatcacgtcaccatgcgcaacgtcgaagccgcccaggccgcgacggaactcctcctgaaggccggccggcgacgcatcgccctcatcggcgcccacgtcgatgaggacgtgggttccgcggctctgcgcacacagggctacgagcaggcactcgtcgcggccggtatcgaggtggatccgtcgctggtgcggtatacgacgctgtggcaccggtcgaacggtgcggcggcggtccgggagctgctcagcgacggtgtcgagttcgatgccgtgttcggtctcaacgacgcgctggccctgggggcgatgcgcgcgctccaggaggcaggcctgcgcattcccgacgacgtggcggtcgtcggcttcgacgacatcgaggaagcccagtacacgctcccgagcctgtcgaccatcgaccccggccgggagcagatcgccgccctcgcggtggaactcctcctcgggcgcatccgcgatggcgggggccgaccggccgagccgcgagaagtgctggtcgacttcgaggtggtggtccgagagtcggcggtgcccgcgggctga

SEQ ID NO: 26806 - DNA, 1164 bp, Glycine max
  Peptide Sequence Number=SeqID_143584
atgaggttggccaagaagctcctcttatgggtagcccaagagctgctgattgttttgatctttcaagttcaggttcagtgcaacacaaggtcacagaagctgataaaaaacttggagtcatttcatggtctgggaccaggagatataaaaaacacagatctttatgcagttcaaaaggaactgtatctgggttctttatgtcaagttgaagacaccccatccctaaagccttggcaattttggatggtaatgatgaaaaatggcaactatgacacaatgtctggtttatgccctaaggacggggaaaagacacagctcaatgattccataatgcaaggaggattctatggtacttatgatttggattctgattgtgagggtagtggaaatggtaatcactcttattacgaggtagcttgggagaagaaagttaatgtgggaagttgggtgttcaaacataagctcaagacttcaaacaagtatccacggttgatattgtacctgagagctgatgcaaccagaggattttctggaggttaccattatgacacaagaggaatgcttaaaacccttccagagtcaccaaattttagagtcaggttgagattagatataaaaaaaggaggaggacctaagagccagttctaccttttagacatgagtagctgctggaagaacaatggtgctccttgtgatggagatgtgctaactgatgtcactagatatggtgagatgatcattaatcctaaaacaccagcttggtgcagccccacagatttggggaactgtccaccatttcatatcactccagataacaggaaaatttatcgaaatgacaccgaaaatttcccaaacacttggagcaatcctcaggcacaagagattgttcagttattgcctcaccctatatggggtgcttatgtaggagatggttgggttggggatccaaggacttgggaacttgatgttggtggactctccagtagactctacttctatcaggatcctggcactcctcctgctaaaagaatatggacttctattgatactggaactgagatatttgttagtgcacaagatgaagtagcagagtggactctgagtgacttcgatgtcattctaacagccagagtcagaattcaaaaactagtttggaagtattag

SEQ ID NO: 26807 - DNA, 321 bp, Glycine max
  Peptide Sequence Number=SeqID_143585
atgttgataaggatagagctctgtttgattatgcaaaattgtttcagttccatacatccacagttgcccggctgtgagcaatttttgtctgtttattttaagaaattcgaacaaaaaatcaagtgcacccctacagaaaagcgcaaggtgttggtgagcaacttctactcaaccaaacagaaaaagaacaaagagagaaaagagaagcacaaacgaattatcatgagccaagttgctccaccgatgacttctgtaaccacaccatattatttccaattgaatgaccaagctggaatcaacatattacagcaaacagcttga

SEQ ID NO: 26808 - DNA, 1128 bp, Glycine max
  Peptide Sequence Number=SeqID_143586
atggaagacgagccatttctcactaccacttcccaacccatcgccgattgccttcttccatcttccaagtccttcaacgacgtcaccaccacacgcgcgcgtgacgtcgccgccgccgccgccgaggagattcaatccgaacaacaacaacctcccaagaagaaaaaactgagccgctgcaagacggcacctgcgatggtcaccatgcgagacctcaaacctaagacaccccaactccccaaacctcaatcaagttccataattcgacaaggcatgtggttactcgccgtgtacctctccataggagtagtcatatactccttcaacagggaccgtttttccggcatcgaaacacaccctgtggtcgacgcactctacttttgtatagtcaccatgtgtaccataggttacggagacatagcgccgttaaccccattcaccaaaatcttcgcttgcgcttttgtgttggtggggtttgggttcatagacatactcctcagcgggctcgtgaacttcgtattggatttgcaagagaacatgatcctaacgggtctgcaaatgggtgcgagtgaaagggaaggtttttctgctcggaattacatcgttgatgtggcgaagggaaggatgaggatcaggttgaaggttggtttggcgcttggggttgtggtgatgtgtattgggattgggagtttggtgttgtactttgtggaagggttggattgggttgattcgatttacttgtcggttatgtctgtcacaacggttgggtatggggaccgagcctttaagacgcttcctggtcgtttgtttgcggctatttggttgctcttttctactctcatggtggctcgggcttttctctatttggctgaggctagaatcgatagaaggcatcggagaatggctaagaaggttttgcatagggaaattaccgtccaggatttgcttgctgctgatatcaacaacactggtttcattagcaagtcagagtatgtaatcttcatgctgaaagagatgggtaaaatacaggaaaaagatgtgttgcaaatttgtgaccaattcaggaagcttgacccctctaactgtgggaagataacactacctcatctcttggggggcagtttatga

SEQ ID NO: 26809 - DNA, 1542 bp, Glycine max
  Peptide Sequence Number=SeqID_143587
atgtgtacggttacatccgcaaagcttaactacatgatcgacgcttacatacaaggcaacaacataaacaatgctcgaaaactgtttgacgaaaacccctcgtcccgcaacctcgtatcctggaacatgatgatgactggttacgtcaaacaccatcaaattcaatatgcccagtacctgttcgatcaaatgcccttcaaagacacggtttcttggaatatcatgctctctggttttcacagaatcacaaactctgatgggttgtaccgctgtttcttgcaaatgggaagagctggtgtgccccccgatgactataccgtctccacattgctcagagcggttataagcaccgagttagatgttttgatcccccagcttcacgctcgagcgctgcatttagcacttaacttgagtgtgtttgttgggtcttcgttgatcagagcttatgccagtttaagagacgaggaggcttttaagcaagcgtttgatgatatattggggaaagatgtcacgtcttggaatgctttggtttctggttatatggaagtgggaagtatggatgatgctcaaacaacctttgatatgatgatgcctgagaaaaacataatttcatggactactttggtgaatggttatatcaggaacaagaggataaacaaagcaaggtctgtttttaacaaaatgagcgagaggaatgtggtgtcttggacggcaatgattagtgggtatgtgcaaaataagagatttatggatgctttgaatctttttcttctgatgtttaattcgggaacttgtcccaatcatttcacgttctcaagtgtgttggacgcatgtgctggttgttcatcccttttgacaggaatgcaggtgcacctgtgcgttatcaagtctggcataccagaggatgtcatctcattgacctcgcttgtggatatgtatgcaaaatgcggggatatggatgcagcatttcgtgtttttgagtccattccgaataagaatttggtgtcatggaattcaataattggtggctgtgccaggaatggaatagctacccgagcactggaggagtttgataggatgaaaaaagctggtgttacaccagatgaagttacttttgtaaatgtgttgtcagcgtgtgtgcatgcaggtcttgttgaagaaggtgaaaagcactttacttctatgttgaccaagtatgaaatccaagcagagatggagcactatacttgcatggtggacctctatggaagggcagggcaatttgatgaagctttaaagtcgatcaagaatatgccatttgagcctgacgtggtgttgtggggtgcgctgcttgcagcttgtggcctgcattcaaatttagaaattggagtgtatgctgcagagaggatccgcaaactggagagcgatcatcctgtttcctactcaattctttcaaagatccaaggtgagaaaggaatatggagcagtgtaaatgaattgagggacatgatgaaggagagacaagtcaaaaagcagaaggcatcgagtaagctctttctgtaa

SEQ ID NO: 26810 - DNA, 294 bp, Glycine max
  Peptide Sequence Number=SeqID_143588
atggatgattttgctaagagtttgtgtggatggagttgggaggagaacaagttgtttgagctagctttggcagcggtggatgagcaacaccctgaacggtgggaagtggttgcagccatggttggaggagaaaaaagtgctggagatgttcaagaacattatgtgatccttctggaggatttactcgttatagaatctggaaaattggacaatacacttggagaagttatgcctgttgtccttgttgagtgtaaggagtccatgtgcttgtcccatgatgatacaagctcgtaa

SEQ ID NO: 26811 - DNA, 258 bp, Glycine max
  Peptide Sequence Number=SeqID_143589
atgttatgtgctcccgggaaagaaattgctactctattcgatgggccaggaacaatcgaaaaaagccagacctgtacgaaatgcgaaacgaaagaaggatcctcctgctgggaattagatcctaagcccccctacagagatgaattgatcgattcatcggatcctaggtcgggactgacggggctcgaacccgcagcttccgccttgacagggcggtgctctgaccgattgaactacaatcccaggaaaagaaataag

SEQ ID NO: 26812 - DNA, 1558 bp, Glycine max
  Peptide Sequence Number=SeqID_143590
atgacaggacttatgcctggagagttgccacatcatggaacacctgatggcaactctggtaaaagttctcaagacaagcaagaggaatcattaggtcgctggtatatgtctagaaaagaaatagaggaacattccccatcaagaaaagatggaattgacttgaagaaagagacatatctgcgcaagtcatactgcacattcttgcaggatttaggcatgagacttaaaaccattgcaacggtctgtatgttccttgctgggaaggttgaagagactcctcgtccactaaaggatgttattcttgtttcttatgagatcattcacaagaaggatcctgctgctgcgcagaggataaaacagaaggaagtgtacgagcagcaaaaagaattaattttacttggagagagggttgtgcttgccactttaggttttgatctgaatgttcaacatccatataaacctcttatggaagccataaagaagtttgttgccaagaatgcccttgcactagttgcgtggaactttgttaatgatgggctgaggacatcgctctgcctgcaatttaagccacatcatattgcggcaggtgccattttccttgctgccaagttcttgaaagtgaagcttccatcagatggtgagaaggtttggtggcaagagtttgatgtcaccccacgccaattagaggaggtttgcaatcaaatgttggaactctatgagcagagtagacttccaccagcacagggaagtgaagtagaaggaagtgctagaggaacaagagctgcttcaaaggctccttctgcaaatgaggagcaggcctcaaagcaaatatcatctcaagccccccagcactcatctgtagagagaactggggtaccacaaagaggaactgagaaccaaagcaacgatgggagtgcagaaatgggcagtgacatcactgatcacaacttggatattagggagtcacataattcagaacagttgactcatcaagataacaagagagaagtgtcaaatagatctaaatctggtactgaacgtgaccaagacataattgttgggactaaggagggtgcagaagtaggaaggagagatgaatctgcattaaacaattctggcagcaatgttggccgaaatctggagcgtcgggaagttccactaggtcattcacccaatgaagcaatcaagattgacaaggataagttaaaggcattggcagctatgggaaagaagagaaaggaacaacgaggcgaaatggcattaaagaaagatgtaatggatgaggatgatctcattgagagggagctggaagatggaattgaattagcagtggaggatgagaaaaataagcgtgagagaaggcagaactggtctaagcctgatgctgaagatcaccatgggggggagaaccatgaggaaactagagacgggtggtacatgaacatgaaggcacagtttcagaaagacatggaggaagacaatgcagaagaagcggagatgatagacgatgcttcatccttgttgaacaatcgcaagagaaggatggggagccctccag

SEQ ID NO: 26813 - DNA, 1779 bp, Glycine max
  Peptide Sequence Number=SeqID_143591
atggttggaggttcgttagcagggttgcaagagcacctcaagttagcccgtgactacgctctcgaagggctctatgacacctccatcatcttcttcgacggcgcactcgcccagatcaacaagcacctaagcactgtagaggaccctttaatccgcgcgaaatggatgaacgtaaagaaagcactttcggaagaaacagaagttgtaaaacagctagatgcagagagaagggctttcaaagacaaccccattggaagacgcccttcttcgcctcccatttcggtcaagtcatcatcgtctttcgttttccagccgttggatgagtaccctacttcatccagcggtcctggtcccgttgatgatcccgatgtgtggcggccgcccagcagggacaccacgagccgcagaccggcgcgtcccggccaagtcggtgctcggaaatcggctcaagacggggcttgggcgcgtggcgctacagccagaactggtgccgctgggcgtggtgctaaggctggcgctaccggtagggttaactccgggacgcgagcgtcgacgactaccgggaagaagggtggtgctgcttcttctggaaaggctagcaagacagatactgctgctgcagctgtaactgttggtcttagcatacttagagtgtctttggttgagcatttgcaaaattgtttttcaagtgacagtttatgttttgatgcttttattctaaaagcaaatattgggttattgattttgactcacaatgttgtttggaaacttgcaatcaaagttgattttgggtataatggtgatgctgaagatggtaagtcaaagaagcttcaatatgaaggtcctgatcctgaattggctgcaatgcttgaaagggacgtgttagaaacctctcctggagtcagatgggatgatgttgcagggcttactgaagcaaaaaggcttctagaagaagctgttgttcttcccttgtggatgcctgaatatttccagggaatcaggagaccgtggaaaggtgtcctcatgtttggacctccaggaactgggaagacacttcttgctaaagcagttgctactgaatgtgggaccactttctttaatgtatcttctgctactttagcttctaaatggcgtggggagagtgagcgcatggtgaggtgtttgtttgatcttgcaagagcatatgcaccaagcacaatattcattgatgaaattgattctctatgcaattctaggggggcttctggtgagcatgaatcgtccagaagggtgaagtctgaacttctagttcaggttgatggtgtaagcaatagtgccacaaatgaggatggtagccgtaaaatagtaatggttttggccgctactaacttcccttgggatatagatgaggcactaaggagaaggctggaaaagcgtatatatatccctcttccaaattttgagagtcgtaaagaactgatccggatcaatttgaagactgttgaggcaagttgtgttgtggcacctgatgtcaatatagacgaagtggctcgccggacagagggatatagtggagatgatttgacaaatgtctgtcgcgatgcttccttgaatggtatgaggcgcaagatagcaggaaagactcgtgatgaaatcaagaacatgtccaaggatgatatttcaaaggatcctgttgccaagtgtgattttgaagaagctttgagaaaggtccaacgaagtgtttctcaggctgacattgaacgccatgagaagtggtttaccgaatttggatcagcataa

SEQ ID NO: 26814 - DNA, 228 bp, Glycine max
  Peptide Sequence Number=SeqID_143592
atgcggaaaggaccactggaagaaggaggaactaaggccattgacagcgttgaaacactcagaacttgtttggaaattatttctattcttgatgcgaaatatgaggatacatttagcaaaagtggcacagaaaggaagaaaaaagaagaaattctgaagcaggcccaatccaataggggcgctaagcgtgcatcaggcgctaagcgagcaactaactgcaggcgctga

SEQ ID NO: 26815 - DNA, 267 bp, Glycine max
  Peptide Sequence Number=SeqID_143593
atggagaatgttaatatttccagaactaatattatgaaagccaaaagtggttcaactactaatgaagttgagaatggatatactgacatgacagaatatcgacaagcaattgttcggctgttgatttcagaatctgtggctgaaggacatgtgatggtagctaagtctcttcgcctttatctgagagctagcctacattcattttggagacaagcagtgtctaattgtattttgacagtgcatctagctgtcatgcagcgcaattaa

SEQ ID NO: 26816 - DNA, 447 bp, Glycine max
  Peptide Sequence Number=SeqID_143594
atggcggctgcattgtcctccgaatcatcgatgatcctgcagcaccgtcgccaatgtttgactcagactttctcctgtcgctgccgaactgcagccaacacgggacatgcagacgtcgaagatatttcatccgcgtcaaataaaaaggttgaggagaaattggaagagtcacgctcaaagattgtgacattgagcttgaaggcgcataaatattggactcatcgttttcctatggaagcgaacttggacgagaccgttctgaagctgaagaagtacattcttgcagatctgagaattcttgcaggctttgagatggacaatgtgccagtagagagcatggtgctgcactcgcattcaacgggtgtggaactgcttgaccatcagcttcttcgagattgtgcagtttcagataatcatgagatcgacctctccgtcaaggaaccctag

SEQ ID NO: 26817 - DNA, 1137 bp, Glycine max
  Peptide Sequence Number=SeqID_143595
atgatgaaagctcaagccaagctgatgaagtgcactggacatcctgccaacactatgacttgtagtggcatcgacttgaagagtagtaaatgcgggagggagttccaactctgttattgttgtcaaagatgtaatggcagaagagaggcacacgcaaagcattatggggaggcgacgactttgaatggagggaatcacaagctattaattcagttggtggactactatgcatttggaataaacaactcagaggtaactaatacatttgttggaaagggttttcttagggtacaaggtgtctggaaagatggtgataaaaagaggttatggactgagattgttaatcttagaaatcgtgtgaagaaggatagatggtgtattgttggtgactttaattctattaaataccttgaggaaagaagagataacttcaatgtggtggttggatgtagggacatgcaagagtttaataatttcatccatgaaatggaagtggagggtattctgttgatggagaaacggtcgggaaacactcaatatgtcatggaaagaagtatatcggatcattgctctatagtcttgaaagtaacaaactatgattggggtcccaaaccctttagggcccttgattgttggttcatggaacacggcttcaaagaaaaggtagcgtggatgtggaattcatatgaagtacaagggagaggggcttatgtactcaaagagaagatcaagctactaaaaaaagaccttaaacagtggaacaaggaaagctttgggaaccttcaaaaacaatctaaggacctagtggcaaagataaatctcttagacttgaagggtgaaaatggaagcttattgcaagaagagatggatagcagaagattttatgtaggtgagtattggaaaattgcaaggagaaatgaatcccttctacctcaaaaatcaagaagtaggtggataaaggaaggtgatggtaatacaaagttttttcgtggtgtcataaattggaagagaaggaagaacaacatcaaagggatttccatcaaaggaagatgggaggaggaaccaagacttgtgaagaaagaggtgttggaattttatcaaaaaatattctatcaagaagcatggatgaaaccatga

SEQ ID NO: 26818 - DNA, 261 bp, Glycine max
  Peptide Sequence Number=SeqID_143596
atgcctcgttacaaggacgaatcccctgcagttcgggtctacactgtttgtgatgaatccagatatttgattgtgaggaacgttccagaactaggttgtggggatgagttgctgaaattgttttcttcctatggagaagtcgaggagtgtaagccaatggatgcagaggactgtgagaaatacactgatgtattttggatcaaattccgccttgtcaacaatgccaggtttcattctgttctttgttggcagatgaagtag

SEQ ID NO: 26819 - DNA, 348 bp, Glycine max
  Peptide Sequence Number=SeqID_143597
atggataagttagagggaagaagaagggaggttttagcacgattgaaccctagaagatctaaagagaccacagcctcaagctctaagccccggattacatcaaagaccaattgctcacaacatttagattctaatgcaagggatgtagagctcaaaggaggttcacacagtggtaattttccaataagaatggtttcctctaatgaggattattttgcttcaaattccatgaatcaaacagtgagtcttgtgcgggataagcttgataagattcaatcaagtggtgagaatacaaaagctggatctgcatcaaagaaacaacgagttgataataggaagagaatttaa

SEQ ID NO: 26820 - DNA, 1173 bp, Glycine max
  Peptide Sequence Number=SeqID_143598
atggatatgcaattggggtgctttggcttttatgtggaatgggttgccagtgtgttagtttatgttgggagttcaaaattccattatcaagcaaggacttcagttaatgttataatcaagatagcagatgatgcatcagaaatcatacacaatgtaacaagagcattagaagacatccaagaaaacttggtggattccggtattagtgctgaggtttctgaaaatcttaactccacggctaagaaaatggataatgctgttgataatatcgtaaagaaaactaggaaaaataagcgcactgttaacagggctttcaaatttgtgtttataataaccattgtgatcataagcttgaatttagttgcagtaccaattttgtcaggtatgtctaactggtatgattctcataatatgttggaattttctgttgaacagtttttggagtacacatgttttggagggcattttacctgtaggtttgttatactgtgctggctgatggcggtgatatgctggctaatctttggattgtatttcttcttagaaaatttttctattgatacgtgcacagttctttgcaacttcgaagaaaatccatataataacagcctaacctccatcctcccttgtgacgaattgcgctcagcgaaagcaattctccctgaagttggtgcagggatctccttcctcatcactaaggtgaattcaaacttggggccaatgtttccaaataatgttgatctgtgcaaccctttctcagcaccacctaaatatttatatcagccagagttttgcccacctaatagtattcaaataggggatatccccaaggtattgaagccttatacctgttttggtgatagtgatgaaaattgtggcagtgatcatttaatgaatggaggtgaatataaggtagttgaggcttacacaagttcaactcagaacttattgaatatgtaccctggtatggaaaacttgataggatgcaagttggtaaaagatgcattctctcaaatccttttcaaacactgcaaggctttgaacaattttgctcgaatggcatgggtagctatggtgtttcttgcagtcatgatggtgttttatgttgtgctaagcacaataaaggcttgtcaagaccatagtagttatcatccttcagatgattctgtgtaa

SEQ ID NO: 26821 - DNA, 483 bp, Glycine max
  Peptide Sequence Number=SeqID_143599
atggcaatagcattcctaaaaggtgttgattgtcacagaatccagcctcagattagtgatcagtgggtgtggaaggcagatccaagtggtcaatactcggccaaatctgcataccaaatgcttagggaggacatctcaaaggagaatcaggacgaggcttttgaggagctgtggaaactcaaggtttcatctaaaattgctgcatttgcatggaggctactcaaagataggctaccaaccagactaaatctgcaaaggcgacaaatagaggtaggagactccaattgtccattttgtagttcgatggaggagagcgcaggtcacttattttttcactgcagcaagataatccaggtatggtgggaatcgttgtcatgggtgaacttggtgggtgttttcccacatcatcccaggcaacattttctccaacacattcatggagtgacacaaggaatgaaagctaacagatggaaatggtggtga

SEQ ID NO: 26822 - DNA, 153 bp, Glycine max
  Peptide Sequence Number=SeqID_143600
atggcgaaaggagaagaggaagtggcgccggaccaagtgacaaaccagatgcacctaacattttttaaaaatgctaaaactgcccttgcactttcttcgcatttgtgttgggtgtgcgtgagggcggttcataaatcgtatgaatcaagttga

SEQ ID NO: 26823 - DNA, 2520 bp, Glycine max
  Peptide Sequence Number=SeqID_143601
atggcaaatcttgttcctggggtgcttctcaaacttatgcagcacatgaacacagacgtgaaagtagctggtgagcacaggtcctctttgctgcaagttgtgagcattgttccagcacttgcagggggtgagttgttcccaaatcaaggattttatctcaaggtttctgattccttgcatgccacctatgtctctctccctgatgaacatgatgatctcatcctcagtgacaagattcaactggggcagtttgttttcgtggatcgtttggaggcagcttcaccagttcctattcttcatggggttaggcctgttcctgggagacacccttgtgttggaacccctgaggacattgttgcaacaactcactcacttgggttccttagtaacggcaaggctaacaagaaaagtccttgttctggacccttggacttagagaggtccaagtctccgaggaaagtgttgagcaatcaccatgttggggagaaggagaagaaggagaaagtgagattgaataatgaagatcaattagacaagaaagcaatgctgtttgctaagagtaaatctcagacaacaaaagcagcagcagctaatgttgctgatgcgaagaaggaaccgttggcgagatggaagtcattgaattcaaggaccattccttcttcccccactagttgctattccttgcctacttcttttgagaaatttgccaatggggtcaagcagcaggcaaatatcaagggagtggacaggctaactgctaaggtgggagtggtggagataggaaagggtgtccgtggaactagtccaaccgggaagagaatttccgtgggaaacccgatcagaaatttggttcagggaattgagcttggagctaaggcgctgcgtaagagctgggaagggaatatggaagtcaagaagaaagatacatccaaattaagggccgccaagtgtgatcctaagccagaggttcgtggctcaactcctaggagaagtacttcaagtgaaaagtttccctctaaagaagagagcaagatgcaaccgcagacaaagtcctccaaggaagagcacaagactcaaacatctataaagagagttattgtcagtggaacaatggaggaacaagaaaaaccaagtaagcaaagagttcctgttggaaagaaattgtcagaagcttctaacaatggattccctggaaacttggtcaaagtttctccaaatagtagaaaagtgacagatgcaagtgttccatgggcttcactcccgtcatctattgcaaagcttgggaggctgagggtgagccttggcataacagtgaggttgctgccttatgacctgaaagtaacaggtttaactcttggaaacaacctctttgtatgcggggataaggctgtgtacatctaccctcccccgagaccgagactaattagatgggagcctaatacactaggttgcctttatgaagtgatgaagcaaagagatgccgcacagatggctgcaactgaggctatacaagaggctgctgctgctgagagtttgctgcaatgtctaaggcagaaaaaggatgggttgtcagttgtgggggctaggtcaatgttgggtccaagcctacctaagtcagattgggatttagctatagacgtttatcatccatcttcttccaaacccattcttctatgggctgagcttagtaattctgctaaggaacaaaacccgcagcctgcagtagaggagttcctaactcttcatgctagcctaaatagtgcacggatgattgctgacttgctatctaaatccaatccagatgattcttcttcagataatgaaagaagcataacagaagaggcactaaaactcaaactagatagacaaaggcgtgcaaattcttgggtccaggctgctttatccaccaatctatcatccttttctatttataaccgcgaacctctatcatccaagctttcagtttcaaccaattctcaaaaccaaaagaatatcctgggaagtaaaccaatgctagtcatggaaaattcaagtgaagattcatcaaaatctcatggaaaaacccgtcagacggctaattccaaaactcctcacaaaacaggtgatatgctagcaaatggacacaagcaactagtccaatcaccgccagagtgggttagaggaaatggccttgatgaggtggttgatttggctgacatgctgcaactgcggtcacgagattggtttttggtgtttgttgagagattcttggaccctgatggggacactagcttgtcaaataatggtcaaatagcaggtatgctcactcaactgaaaagtgtgaatgattggcttgatgagataggatcaagcaagaatgagggagaaccttgccagataccagcagagacaattgacaggctgaggaagaagatatatgaatatcttcttacacacgttgaatccgccgccgctgcactcactggtggatcacaatcatcacctagaatccaaacagcagagatcaaagccaaaaagtga

SEQ ID NO: 26824 - DNA, 1332 bp, Glycine max
  Peptide Sequence Number=SeqID_143602
atggccaatggcaacactagtcatcgcttcaagctcttgcttttccttctaactctgcactcttcattcgctgagattttcttcgaagagagattcgaagatggatggaagagccgttgggtgctatccgattggaaaaggagtgaaggaaaagcgggtaccttcaagcacacagcaggaaaatggtctggggatcctgatgacaaaggtcttcagacatataatgacgccaagcattttgccatatctgcaaagatacccgagctaagcaacaaggacagaaccctggtgctgcagtattctattaggtttgagcaggacattgaatgcggtggcggttacatcaaacttctttctggttatgtcaatcagaagaagtttggtggtgataccccttatagtttgatgtttggaccagatatatgtggttcacagacaaagaagctccatcttatactatcataccaggggcagaattaccccattagaaaagatctgcaatgtgaaacggataagttgactcatttctatacatttattctaaggcctgatgcctcttatagtatccttgttgataatcgggaaagagattctggaagcatgtacacagattgggacatccttcctccaaggaaaatcaaggatgtcaaagcaaaaaagccggctgactgggatgatagagagtacattgaagaccctaatgatgtcaaaccagagggatatgattcaattccagctgaaatccctgatccaaaagccaagaagcctgttgaatgggatgatgaagatgatggactatggaagcccccgaagattcccaatccagcatacaaaggaccatggaaacgcaagaaaatcaagaaccccaactacaaaggaaagtggaagattccatggattgataacccagaatttgaggatgatcctgatctttatgttctcaaaccaataaagtatgtgggcattgaagtgtggcaggtgaaggcaggttcagtttacgacaatatcttaatttgtgatgacccacagtatgcaaagcaaattgtggatgaatttatggctaataatagagagtttgtaggagctaggaatcatagtatcaaagcattctcattatgtgtaaaatctcaggctgaaaaagaagcttttgaagaagcagaaaaagaaagaagggctcgggaagaagaggaggcacagagagcaagagaagagggtgaaagaaggaggaaggagagggatcataaatatggaaataggaggcatcgtcgaaggccggatccccgtgatatggatgattaccataaactcaaaaaatggcaaaatatgcagtga

SEQ ID NO: 26825 - DNA, 402 bp, Glycine max
  Peptide Sequence Number=SeqID_143603
atgcgaacatgctttagtaaagagacaaaacttccaactgatcagagcaacatatgctttttggatgaaaaacaatgtgtctatcggggaaggagacatttcatttctaaacgaccatttagaggaaacactgggtccaacaaagataggaaaaaatcactcaaagtgtatcaatctcacacaggaattttccttctatttgtgttttcttccgagggtaaggattatggtgagttaggattttggctcaaggcttgtagaacggctggtcatgatacatgcgggcgagcgagggcgaggctcacgggtgcgctttccaaaggaggaaaggtgcacggagtcgccaccaacgtttatttgtggaaaacgtcggaaaaaactgaaagaaaccggtcaaaatga

SEQ ID NO: 26826 - DNA, 339 bp, Glycine max
  Peptide Sequence Number=SeqID_143604
atggcagtggaagaccggttcgcgaatttgaaccctaagacgtgtgtggttttaggcggcagaggattcgttggaagatcgttggtgctgaggctgttgaaactcggtaactggatcgtccgaatcgccgattccgctcagtctctccaactccaccactccgagtctctcctccaacaagctctctcttcttcttctcgcgcttcttacttccacgtcgaccttcgcgataaacggagcattatcaaaggtgcgcaattttgtttgtgtaacactctgaatccgcgtgattttctttcaatttcgtttgaaatgaaatactctgtttatggaaaataa

SEQ ID NO: 26827 - DNA, 1320 bp, Glycine max
  Peptide Sequence Number=SeqID_143605
atggggttggaatcggtgggagatttagcgattaacgtgattctgaaaaaattaggagcccaagacattgcgagagtggcgtgtgtgagcaaaaggttcagttcttccgcttccgatgacactctttggatcaatctctgcttcaatgaactcgctttgacacaacccctcgatcatctcggaaaccctctctcttccttcaaggatgtgatggatgtcctgttgcaaaagactgttgatgatagacaccttgcgtatgctaaagaatgctatctagcatggagaggagcttttgttatgtacccttggtctcttgttaagcgtgtaaaaaggtgctgggatagaataaaaacctggttgaccaataattttcctgaagcggaggccactctttgtaaaggtgcaactgaagctgacattcaggagttggagaatgtattaaaggtgaaattgcctcttcctacaaggatcctttatcgctttcacaatgggcaagaatttgcaaaggcagatccagaaactagtacatttggcagatctttgggtctaattggtggctactccttctatggtcatttggtgaatgtttatctattacctatatgtcagataatcctagaaactcagcaaactaggcgtcgcttgagctttttaagaagatcaaagtatgttcttgtggctgcttcatccacatacagtagaaagttgtttttcctcaactgtaccaatggtcaactatatgtcgggaccaggtctcctcttaccgaaagagacataatcccttgtgtacctcatgacctgattagtttacatcaggaattgaatagttcagagcaacaagatgccatgctactgtggttagaagaacatggtcgccgtttagaacacggctttatcaaacttcatgatgaaggaaatggcaaaagcattaatcttttcccagaagaaccccatatttgttcaacggctgttactaatggtgtgaaggttcgcgcttctgcactggttatccctgagttgatggatcttcaagatgaccttggagagtacttatttgcttattcaatccgcttgtcccttgaacctcaaggatgcattattaatggaatgtccttcagctcttgccagctccattggaggcactggatcatccgtgctaatgatattgttatatctgatgtcagtggaaaagctgttataggacagcttagttatgctggtagtggtagtttactttatagcttgcaagcagttgagtcatccttaggttcaactctgggcgttgaagccggaaggtacttggtggagcttatgggatga

SEQ ID NO: 26828 - DNA, 2832 bp, Glycine max
  Peptide Sequence Number=SeqID_143606
atggcaaaggcatgtaaacaactttgggtgggtggtattagtcaggctgttacaaaggaagatttggaagctgaatttcagaaatttggtaaaattgaggattttaagttcttcagagacagaaatactgcatgtgttgaatttttcaatttggaagatgctactcaggccatgaaaatcatgaatgggaaacgaattggcggggagcatattcgtgttgacttccttcgatcacaatctacaaaaagggatcagcttgattatgggcagtttcagggaaaaaacttggggcatactgatgcttattctggacagaaaagaccattgcattcacagcctccaatggggggaaaaggtgacagtcaaccaagtaatattttgtggatcggttatccgcctgctgttcagattgatgaacaaatgctccacaatgccatgattttgtttggtgaaatcgagagaatcaagagttttcctttgagaaattattctattgttgagtttagaagtgttgatgaagctcgacgtgcaaaagagggccttcaaggacgcctttttaatgatcctcgaataacaattatgtattctagcagtgacctagtacctggcagtgattaccccagcttttttcctggaagtaatggaccaagacctgatgtattgctgaatgagcatccatttcgaccattacaaatggatgtatttggtcataatcgtccaatggttctaaataattttcctggacagttaccacctagtggtattatgggactaaatgtaccaatgcgaccttttggtaatcacggtggtgttgaatctgttatttctggccctgagtttaacgagattgatgcgctccataaatttcaggatggtagctccaagagtaacatgggtccaaactggaaaaggccatctcctcctgcacagagcactaggcttcctaccagatcaacgtctggagcatgggatgtacttgacaaaaaccatattccaagagattctaaacgttcaaggatagatggacccttgcctgttgctgaagccctatttccttttaggaatattgatgatcgggggttagctctagaacaagcatatgggattgatccagctattgatggaaatggttctggtccatatgtaaacattcaaggaaagagtcaccttggtccagttagctcaaggattacagctggagtacatgatattgtccaacctgatattgatcatatttggcgcggagttattgcaaaagggggaactcctgtttgccgtgctagatgtgtaccaattgggaaaggaattgggactgagcttcctggtgttgttgattgctcggctaggacgggattggatatactcacaaaacattatgctgatgcaattggttttgatattgttttttttctgcctgatagtgaagacgattttgcttcatatactgagttcctacgctatcttagtgcgaaaaatcgtgctggtgttgccaaatttgttgataacaccaccttattcttggtgcctccttctgattttctcacaagagttttgaaagtcactggacctgagcgtctatatggtgtggttcttaagtttccaccagtgccaagtagtgcacctatgcaacagccatcgcatttgcctgtaccgacaactcagtatatgcaacatattcctccttcacagactgaatatggtttgattcctgttaaagaggaacaggttttgccaatggattataacagaccgttgcatgaggattctaagcttcctgctaaaccagtctatccaccagcaggtgggccccctccagttcattctgggcctcccgattattctactaataatactgttgctgggtcccaagctggagttgcattaacacctgagcttattgcaactttagcttctttacttcctacaactacacaattacctaccactgatggtgccaagtcagcagtaggttcttcgaccatgaagcttccatttcctcccatgacaccaaatgatggaaatcaatctcatcaaattgcagatcaatccactcatcctcctcaacagttgaggaacatgtataacgttcacaatgctccctatcagccctatccaccattatctgctcctgctggcaatcctgctcaagtgtctggcagttctcatatccaagatactgctgccaacatgcagcagcagcaaggtgctgtttcatcaagacacatgcctaatttcatgatgcctactcaaagtggacaggtagctgtatccccccatgccagtcagcattaccaagttgaggtctcccccagcaatcagaaaggctttggagtggtgcagggaacagatgcctctgctttatacaattctcaggctttccagcaacctaataacaattctcaggctttccagcaacctaataacaattctcaggctttccagcaacttaataacaattctctggctttccagcaacctaataacaattctcaggctttccagcaacctaataacaattctcaggctttccagcaacctaataacaattctcaggctttccagcaacctaataattcttttgccttatctaatcaaactaatagtgctaatgcttcacagcagcaaactgccatgctgtatacagtggaccaggtaaactcggacacccccaatcagcaacttcctatgtttggagtcagtcaaggacaaacagaggtggaggctgataagaaccagagataccagtcaacgttacaatttgctgccaaccttcttctccaactacaacagcaacagcaacaagccccaggaggacatgggccaggacaatga

SEQ ID NO: 26829 - DNA, 516 bp, Glycine max
  Peptide Sequence Number=SeqID_143607
tttatcatagggactggtgataatctttcagatttcacattttctgaaaatgttactcatgcccatatctgtgcagaagaagccttaaatttccaaatggtttctgcggctggaaaggcatttttcatcacaaatcttgagcctatgaaattctgggaatttctctcgcttttgttagaaggtcttgaatatcaaaggccattcatcaaacttcctgctaagttggtacaatatattctatcagttttaaagtgggtacataaaaagttggggcccagatacttcagttatcctttattagttcacttttttcagttagcttcatacacccgaactttcaactgcatggcagctcagaatgatattggatactcaccaatagtctcccttgaggaaggagtcacattaaccatagagtcattctctcatttatccagagactcatcttttccaagatgctgcagtttcactgaacagtcaaaagcggataagctgctgggtggtggaaaaggttga

SEQ ID NO: 26830 - DNA, 723 bp, Glycine max
  Peptide Sequence Number=SeqID_143608
atgaacccaatttccaacaacaacctctatccggcaacaacagtgctgtttttttttttcgttttttcttcctcaactgtttttctctcctttttctcctcttttcaaatgttcttcatctggatatgggcaaatagacagtctgctgcaagatcaaaagaaaggaagatgcgttacatttccgagcttgaaaggaaagtgcagacattgcaaactgaagcaacatccttgtctgcacaattaactcttttgcagagagatacacatggaatgactgctgagaacagtgagttgaagttgcgattgcaaaccatggagcaacaggtccacttgcaagatgcattaaatgatgcattaaaagaagaaattcagcatttgaaagcactgactggacaagttatgccgaatggaggaccggttaattttgcttcatttggtggggggcaacaattctatcccaacaatcaggctatgcacactcttttagctgcacaaaagtttcaacaacttcaaattcattcccaaaagcagcagcagcatcaacttcagcagcaacagcaatttcagcatcaacttcagcagcaacaacagtttcaccagcagcaacaacagctgcaactgcaacaacagctgcagcaacagcaacaacaacagcagcagcaacagcaacaacaaacagcagcaacaggaacagtaacatcaacaaacgggggacatgaatag

SEQ ID NO: 26831 - DNA, 207 bp, Glycine max
  Peptide Sequence Number=SeqID_143609
atggacaacagattgcagggtccactggtatattacaggaacaaaatgccgtcatggcaccgccataataacggttatgcaataacactggtgaataggaaggtggatagatggttccttcttagaagggcatttcatataagcaatttattccacaaaaacacatcaacaaccccatgcaaggtggacagaaacgtgcaacagtag

SEQ ID NO: 26832 - DNA, 822 bp, Glycine max
  Peptide Sequence Number=SeqID_143610
atgaagagccacattgtactcctgtctcctggagaacatggtaatgacaatcaatccgataccttccagttagaagatttggctttgtcaaaaagatcccaaatgaaattcgatgccttgaaatcgaaatcagttagactggacatcaactttaagtccccatcacatactggactccagactacagaaatggattgctcagttacatatgtagaatgcagaattggatgcctaccagtgaaatggtctacttattttaacaacatcgatgagaagaaatgcaacaaaaactgtacttcaaagaagcttgatgccatatttatgcaatgccttaatgttaaggggttgacagagcaatttccagctgctacacctcttgctttggtactaaaacagtttttggctgatcgaagccttgatcagtccgactctggtggcttaagttcctactgtttggtcttactaattatacgatttcttcagcatgaacaccatcttggctggccaatcaaccaaaattatggaagtcttctaatggattttctttacttttttgggaatgtgtttgatcctcgccaaatgagaatatcagttcagggaagtggactttatataaaaagagaaagaggttgtagcaataatgcacctgaaatgcctgtggatgacaaatgtactttcaataacaatgtggcatgtgcattttcagaagcttactctgttcttgaaaatgaactcaaattcctaaatagtgatggtgggtcatgttcaaggccaccttacagactgcttccaaaaatcattccaagtcttgatatatcataa

SEQ ID NO: 26833 - DNA, 978 bp, Glycine max
  Peptide Sequence Number=SeqID_143611
atggccggccctgatgatccaaagaaatctgaatggatagatagaataaaatctgaaggatccattccactccttgatccagataactgttcaaatggttgggcttcacctcctggagctgcattcaagattagaggtcctgagtatttaacaacaaaggctaagattcctgctggtgattatctgctcaagcctcttggatttgattggattaaaagttcagtgaaaatgggtgagatattgaagcattcgaatagccgggttaggaaggtcattgataatgagtttccagctggtgataaaccttttgtctgggcattcaatattcaactcccaaccaaggataactacagtgcggtggcatattttacaaacaaagagcctattgctgaggggtcactaatggacaagttcttgaaaggtgatgatgctttcagaaactcaaggcttaagatgattgccaacattgtcaatggtccttggattgtgagaaaagcggttggagagcaagcgatatgcataattgggcgtgcccttttctgtaaatactgtgtggcagagaatttcatagaagtagatattgatattggatcttccatggtggcaactgctatagttcatttggcatttggttatgtgacaactttgactgttgatctggctttccttattgagagccaaactgagtcagagcttccagaaaaactcttaggtgcattcagattttctaacctcaatcctgcttcagctagacaaattgacccatcatctgttttgagcactggtggtttacaaaaatccttatctaaaagattgtggaagtcaatagggcagattcttcttcctggttctaaagaggatgactctacttctgatatacaggaggaattgaagggaacggaaagtccatttcaggttgttattcttttaacaattcatttcaacggtagagctaaaggcattcttcacaagacttaa

SEQ ID NO: 26834 - DNA, 1125 bp, Glycine max
  Peptide Sequence Number=SeqID_143612
atgttatgctatgtgatagcagttagggttttggagttgccggcctccataaaggatagaaataaccatgatgaatgttgggaaagcaacagtgtagacaatggtgctgaatccatggaagaagttcatgagctagaggtaattatgcatgataacatcaatgggggttttgaaccttgcgagccagcatcagggatgtcatttccttctaaggaagctgttaaatcattttataggcagtatgcttctagaatgggatttggtttcaaaccctacgaaggcaatgatggtcagagtaaaaaaaacactagcatgcatgtgaacagaacaatagaaatcaatcatgaagcaaaggtggtgatgaacaagaccatccaatctcttgcttgtgacgagggagggcacagaaatttatcatttgttgaaggtgatgtgaaacattatgttctgaaggaaagacatacaattggaaaggaaggtgatggcaatcctccaaaaggtattgtgactggccaatgcaaagcaattcagctagtctttccaacaacccaacataggtggtgcttatggcatgtaataaaaaaaatccccgagaagttgaaaacaaacaccgaatacaataagaatataaaaagtgccatgaaaagtgtagtttatgataccttcacagaagctgaatttgaagatcaatggagtcatttcataaaaggattcaacttacaagacaatgaatggttgagtgagttgtacaatgagctaagtagatgggttccaattttcttaaagaaggatttttgggcaggaatgtctaccactcaacgaggtgagaatgtacatcctttctttgatggatatatcaactcaacaacatctttgcaacagtttgtccaactgtatgatattgccctctatgacaaggtagaaaaagaatttgaagcagatttacgatcattcaacacgactattcattgtcggtcaaattcaatgattgaaaagctattccaatctgcttatacccatgcaaaatttaatgaggtgcaagctgaatttagagcaaaaatttattgttctgtgtcccttgggcatgtggaagcatttgtactcatgatgtgttggaggacataa

SEQ ID NO: 26835 - DNA, 369 bp, Glycine max
  Peptide Sequence Number=SeqID_143613
atggcagtggctggtgttggcaccactgcttcaacttatgagcatcttgtcaagggttattgcaatgttggggatgttgattcggctgttcttggtagggttcaggaagctctggagtttgtgaggtgtgcagttggtaaatttgatttgattccaatggaaaagagctatgaggccttgacaaaggggttgtgttttgaggggaggatggaagaagcattgaaggttcaggcagagatggttggaaaagggtttcaacagaattctgaaatgtatggtgcttttgtagatggatatatcaaacaagggaacgaggaaatggcagaagcgttgaggaaagaaatgctccaaaatcagatgcagaaataa

SEQ ID NO: 26836 - DNA, 306 bp, Glycine max
  Peptide Sequence Number=SeqID_143614
atggggttggttataccatggagtttcacattagcattggtagatggatattctgttctggtcaaatgccccattcgtcaaccaggaatactgttgattattgttgtgggagattgggtattatcaaccctcacactagcagcagcttgctcaacagctagtgttgtggatctccttctcaacacccatgggtctttttgccctccaaagctttgtagcaggagcaaagtacatctcgagtgcaatgaaagtcatgctcagcttcatagcaggtacacaaaatcgacagacaaaataaacagttga

SEQ ID NO: 26837 - DNA, 435 bp, Glycine max
  Peptide Sequence Number=SeqID_143615
atggcagtgcaagaacgcaagaatgacaacttcgagagagtgagaatggcagcgcgagtatggcaacacgagaagggtgacaaggagaacacgatggggtcgccacagagagtgtgtgagagtgagagtgagaaggatagcgccagagtgaaaaggagagcaagcgaaaacgagaaaaatggttgggtcttcaataaacctcgattgagatggacggttgatcccaatgacgtcgtcgttgccttcaaagtcagtgggattaggttttccaatcctgtgggccccactcactccaactaccatccgatagagagagccgtgccgtcaactgggttgactttatgggactaccccacgtggatgggttgcctgaccataggctttttccgatccctaaccccgttttttcttaacgccgttcccaaatcgccataa

SEQ ID NO: 26838 - DNA, 1410 bp, Glycine max
  Peptide Sequence Number=SeqID_143616
atggacaacccacaccaccgtcaattgaccttcttcctcagccatagtatagatcacacagatcctccttctgtcaaagaaatggatttcttctcaacttcatcggcacctgatcataaaaataacactagtaccagtgataccaatgatgattatcagaagcgtgatgatcaacatgacactcatgatcgccatggaagcatcaccgccgatggatcaccaacacgcgccactgaccaccatgtaaacactggactgaatttaacttgtgcaagtgctggaatgacaaaatcagacaatagtgaaaatcctgaaactgagaatgtggaaacaaaaattgtggacccaggagcaagcacgaaattagacgtggtcaataatgcatcggtttcggatgaaaagactgatcaagatgtatcggtttatcgttcaaacaacgcggaggtaatgtcaaaaacacatgatcgtgatgacgaccctcaattgactaaactgaatcttggaaagcaggcttgtcctgatgctgcagaagatgttcttgaccggtcctcttcacagagttggggatcatccaagttagaggaacaacccaaaactgcagaacaacttcctgcagaacagattcctctcagaaaagccagggtttccgtccgtgctagatcagaagctcccatgataagcgatggatgtcagtggaggaaatatggacaaaaaatggccaagggtaacccttgccctcgtgcttactatcgctgcactatggctgtaggatgcccggtccgaaaacaggttcaaagatgtgcagatgacaaagcagtgttgataacaacctacgaaggcaatcacaaccaccctttgccgccggccgccaccgccatggcaaatactacgtcagcagccgcagccatgctgctatcaggttcggcagccccaagcaaggaagcgctaacaaactctgcaggatattactcttcttcttcaattccctatgcttcaatggcaaccctatcagcttcagctccattcccaaccatcactctcgacttgacccaaaaccccaacaacgccatgcagctgcaccgagtaccagcaggccatggcgccacgttccctctgccactgcatgcggcagctgctggtccccacctactaggtcaccccttgttcttccaacagaagcttccaccggcagcattaatgccccttcttcaacgacaaccttcgtcgtcgatggtcgaaacggttagtgcagccattgcttcggatccgaacttcactgcagctttgatggcagcaatctcatcaatcattggagtaccaagaagcagtgatgataataacaatggaaatggtgctattccagggtcaccacagcttcctcagtcatgcactactttctccaccaactag

SEQ ID NO: 26839 - DNA, 147 bp, Glycine max
  Peptide Sequence Number=SeqID_143617
atgtatgaagacaagccttcctatacaatgacatattataaaaagggagaggtgatgattcaagtgcttcagggcatagttagtctacgacctggtatgagatggtcggttctgttgcatcctagaaggtatacagactatgtttga

SEQ ID NO: 26840 - DNA, 816 bp, Glycine max
  Peptide Sequence Number=SeqID_143618
atgtggaagctaccatctacagaaagaataacccaacttggagagttattattctcaacctcgtttttggcccaacccattgatccacctaagcctaagcctatttccaacttcgtttcattgcgacgtagcaacaccagtgtgaactcgaaagaccatactagcgacacccccaccaaaaagaagacagagtcgtcaaatccagtgattgctccgtcggggcggacgctaagtgtgcaggacaggatcaacctcttcgagaataggcagaaggagtattctggaggcaagccgtcgaagctccaacacctcttctccaacgtgctgcagcgatggagcagcaccagtgacataagaatcaacgttagtagcggcgagagtaaggactccgatagccccttacccacgccagcatcctctatttctcaaaccaagttcattaaatttgtgaaaaccgatcaagggtcttctcaggaaacagggaaagtttcaattttttatgaggacaagaataaggggtttaaggattacataggtgttggtgtttatgaggcaacattgaagaaaggttcatctgaggttgttgttgttggtcctatgttgtcttttggggatgatgatgtgaagttttatggtggggcgaaaagtcatgtgtttgaaggtggcaatggactcaaatttagggatgattctgttcgtgttgctcaatcttcatcgaatgaggttgaggactcttcttcattccctaacaaggaaaaggattcccaaatccaaaaaatgaagtaccaaaaaccattacctagtagaaatgaataa

SEQ ID NO: 26841 - DNA, 219 bp, Glycine max
  Peptide Sequence Number=SeqID_143619
atggtggcagttattcagtggcagtggaagcacgttacttccattctctatttttctctgcctcaaccagcaaccaaagacacgaagaagcaactagagctagttcatgaaagaggaaacccaccaagttcaccattacacatggattctaacgtaacatattcgcgtttcaagattaatcagtatttaaatgatttgaacaagaggactattgtttga

SEQ ID NO: 26842 - DNA, 351 bp, Glycine max
  Peptide Sequence Number=SeqID_143620
atgtggatgcctgaatgtattttggttgttggctcaacaaccccacaacgcaaattcacctacctggatcaccaccccaaatccattaacaacaacacaaattcaaaaacaacaacaaaacgaatcaacgatagggtgggggtggggccgatgcaatacagattgacgacaaagatgcttggaactcttaggatgggtgtgagtgcagtctgggggtggtgcaagggttttggatttggatttggatttggtgcaagggttttggatttggtgagttggcaaaataggaatttcataaaggttggtagcctaaatagcaaaatatgtagtgggaatagttgttcccaatag

SEQ ID NO: 26843 - DNA, 273 bp, Glycine max
  Peptide Sequence Number=SeqID_143621
atgaatgtagtgaggcgtagattgttgcacactcttcgcggcggcgccgccccgtcggaaacactgaagagaagagcgttggaattggagaagaagagaaagactcggcactcgaagaccaaggaccagttcatcgtcacggttcccgaatccctctccttcctcgacaccgccaccatccccatgtacttcgccgccatcggaatcgcactcttggccaagctcctcatgacgcgattcatctcgtcgcacaccacgtgttcgatgaaatga

SEQ ID NO: 26844 - DNA, 2493 bp, Glycine max
  Peptide Sequence Number=SeqID_143622
atggcaatgttgaagaacaacgaccaaatcccagcgaagctaccaatttttgatggaaccaactatgagaggtggacggcgcaaatgaaggtggtattcagatatcaaggcgtgcttgatatcataagcaccgacatcacaccattagagatgaaccccacgaaggcacacagggcaacccaccgtgaacaaatgaagaaagatgataaagcaatcttcctaattcatcaatgtgtggattcaaatgtcctagagaaaatcattgactatgagatgaccaaagaagcatgggatgtgttggctacaacttacgccaatgacaagcaaaccaagaaggtgagattgatggcactccaacgtcaattgggtttgcttcagatggaatcaaacgaaacggtggcacaattcgtaaacaggttgatgattcttgcaaaccaaatgaagagttgtggtgaggtggtgaccgattcgatgaaggtggaaaaggtactcaccaatttaacaccaagctttgatcatattgtctttgtaattgaacaatcaaaggacctagaaacgttgaaattggagcaattactgggttctttggaagcacacgagttaaagatgaagaacagagaaggtatcaagaaaaaagagaaggattccgagaaagtcctatttgctaaaaatcaaaagaaaggtggtggtgattcttggaagaataagaaagggaaaggcaagtggaggtataacaaacaagaaagtagtggttctaaaagtgagaatcaaaagaaagaaggagaaaacaatggaaatggaaagaagaaatcaaaggagcacattcagtgctataactgtcaaaagtatggtcattatgcatatgagtgtagtaatcctaaagtgcctaggaagagaagtgaagaagcacaatttgcgcgtgactctgatgatgaagaagcagtgatgttaatggccactgttaatagtgaaacaggcgttaaggaatggtggtatttggacactggttgttcaaaccatatgacaggacataaagattggttttgtaaaattgatgaaacaatgaaaagaagcatcaaatttggtgatgatatgtcaataatggctaaaggaattggcaaggtggccataagaagagtagatgggagcaaggtgaccatcagtgatgtcctatatgttcctaacatggaaagcaatctgctaagcttgggacaattgctagagaaaggattctcaatgcatatggaaggtgaacacatggaagtagctgattctaattggaaatgtgtcttgaaaattgatgtgtctaagaacagaacattcaaggtgggtgtaagcaccattaagcataagttcttgactgctcaaagcaatgccagtgtgtggaagtggcataaaagacttggacatttgaacttcaacaacctaaacaagctgcagaaaaagaacatggttgtgggactatcttcaattgaagtaccgaggcaagtgtgtggtagatgctgtgaaggaaaacaaccaaggaaggtttacaatgcagtagttccaactagggccaaagaaaagcttgcagtgattcactctgatgtgtgtggcccatttgaaatcaaatctcatggagttgaaaagcaatctggttgttcaattaagatgcttagaactgatggtggaggagagtacacttcacttgaatttgagaatttctgcaaggaagaaggaataattcatgaggtaatggttccatacactcctcaacacaatggaactgctgagagaaggaatagaacattgttaaatatggttagatgcatgctgagagagaagcatcttctacatgatttctgggcagagacagtatccatagttgctcacatcttgaatagatgtcctacaaagaggcttgacagtttgacaccagaagaagcttggagtggactcaagcctagtgtgaaacacttcaaggtatttggctcactctgttacaggcatgtgcctgaacagaatagaagaaaactggacttaagggctcaaaccatgatcttggtaggttatcacagtattggggcctataaactttttgatcccttgagcaagaaaattatgataagtaatgatgtgattatggataagacaaaggaattggactggaacattggtatggaaagacaaaccaataaaacagtagaagttgaactaggagaagaaatacaggatgaagttcagattgacagtgaacaatatgtgaatgatgagcaaaatgtgaatgatgggccagatgtgattggggttgtatctttgagaaggtcactaagacagatatctccaccagtgaagtttcaagactatgatgtcttccctgatgctactatcaatgttaatggtgagctgatgaacttagtgctgttagtagaagcagaaccaatttcacttgaagaggcactagctagtccacattggagaaaggccatggaagaagaattgagatcaatttag

SEQ ID NO: 26845 - DNA, 288 bp, Glycine max
  Peptide Sequence Number=SeqID_143623
atgacaaaaattcttgcatcttatgggatatcatggaacctacaaaacgaggtccaagaacccaaaatagattctttcattaaagatgttctgacaataaagggatgtgatgggtggtggcagtacgatgattcaaggtctcaagagctgctggagcggaagataaagaatgcccctagagggcgaggtagtgtcaaaatgtcacacgagaggagtgggaggagtatcgagaagtcaggcccaggactccgtttgagtccacgcttgcccgccctaattccaaaataa

SEQ ID NO: 26846 - DNA, 567 bp, Glycine max
  Peptide Sequence Number=SeqID_143624
atgattattgatgagtctcttttcttttctctgacacaactacccagtcaaggtgcaccttttgagggtacccttgttgacgactggaagtttgattactctagtcatgatgcccgccacatggtctacattgaccaggcggatatgaccggcaaactgcttgttgggtcattgacatttgattgtcgcatcatgcactatatcattgttagaattttgatgtctcgttcttttaatctcgctcaagcctctgaggaggacttgattctgatgtgggctttcttgatcgatcatccaattgactgggcccatttgattcattatcgcatgcataaggcattgcgatctggtgcacctctcccttaccctcagcttgtgactttatttcttcgacattttgaaattcctttggattatgagccttttgtgcaagttaaatgctcctttgctattagtgctagtgcggtaacctcctttggctaccgtaaggacatggatgggcagtggttgaagaaggacacgcaacctccgcaagacgaacgtactccctctcctctgcctcaatga

SEQ ID NO: 26847 - DNA, 1344 bp, Glycine max
  Peptide Sequence Number=SeqID_143625
atggcaacttcgttattccgcagcataaggagagctttctttgctctcagattctcgtactctacctcgttttcggtctctcccaggtcagttgttgggaggactcagatgtgtgtttgttctccgttgaggcactgtgtcccggtgggagagcaaggttattggtggggtttgagaaatttgagctatggcagggtgaaccttgtgataacgggagggaagaccaagtttgagactcatgaggaagagcctccgaagaaggacaagtggacgacaaagaagaggttgaagatgcagaggaagagagagaaggagaagaggagagcggccaacaggaaggacccccgtcaactcggcatcaaagggaagaagaagaagcagagatttgcctgtgcagaagagagaatcaagtacaagattgaaaaagccagaattaaggaagcattgctcattgaaaggctcaaacgatatgaagttcctaaagctcagggtcctgttgtaaagcctgatgacttgacgggggaggaacgattttatttgaagaaaatggctcagaagagatctaattatctacaaattggcagaagaggattatttggaggggttgttctcaatatgcatatgcattggaagaaacatgagactgttaaggtcttttgcaagccttgtaaacctggtcaagtacatgagtatgcacaagaacttgccagattgagtggtggtattccacttcaaataattggagatgacactataatattttatcgcggaaagaactatgaacagcctgaggttatgtcaccaattgataccctgtccaagaaaaaggcacttgaaaaatccaagtatgagcaatcacttgagtcagtgaggcgcttcattgctatcgctgagaaagaattagagctatattgtaggcacgttgcactctatggtgatccaaacaaccgaaatcccttatcaatgatggacggcccaagtggaaactcaaaggaaaaaggtaatcatggaattagtgatgatttttcagtcagtctttcagagactgaagcagactccacggaaatggagctatcagaaatagaagatagtcttgaagatgaaaacatgtcaatgaatgaatcagattctgaagaggacagcatgttggattccaatggtaatcaagaaagagagtcaagttacctttttctccctagcgagatggtatcagagtacatcatgaggccatggatggaccttgtgagagtttgttattgcatgtgcataagaattcccaacatctatagggacctgaaaatagcacctctaattccaattccaaatgcaagtactggatattaa

SEQ ID NO: 26848 - DNA, 501 bp, Glycine max
  Peptide Sequence Number=SeqID_143626
atggcttccactaatgctcttcctcccaccggcaacggcctcatcgtgagcttcggcgagatgctcatcgacttcgttcccaccgtctccggcgtgtccctcgcggaggctccgggattcctcaaggcccccggcggcgcccccgccaacgttgccatcgccgtcgcgagactcggcggcaaagcggcgttcgtcgggaagctcggcgacgacgagttcgggcacatgctggccggaatcctgaaggagaacgacgtgcgatccgacgggatcaacttcgaaaagggcgcgcgcaccgcgctggcgttcgtgaccctacgcgccgacggggagcgtgagttcatgttctacagaaaccccagtgccgacatgctcctcacgcccgaagatctcaatctcgaactcatcagatccttagtgtttgtgtttcacgcgtgtggaaatgatgggcttaagtcaaatcattcttcttccactggattgtttcattttgacttctga

SEQ ID NO: 26849 - DNA, 109 bp, Glycine max
  Peptide Sequence Number=SeqID_143627
gttcaataagcaagtttgtggaagtgctgattttgagccactcgctaagccaattctctggctcaacgagcaatccgctaagcgcaacagttcatggctaagcgcgtag

SEQ ID NO: 26850 - DNA, 888 bp, Glycine max
  Peptide Sequence Number=SeqID_143628
atgaatcagttattcatcaattccatagactgttgtgtagaactggaatatcacctgtgcactgaaaatcttataccagattcttttgttaccgcagtggaggttgagattgatggctctgttactgtcgaaacagtaggaaatactgctatgggtgaggtcagtagcatagctgatgacaacagagaaggtggaagttctgttgaaccaaatgacaaacaagatcaacatgataacatgactcaagattcctctggagggatcactatcccaactgcaattcccacagtatcagttgtttcagttgaagagccctatgtgggtcaggagtttgggtcagaagcagcagcacatgcattttataatgcttatgctacagatgttggattcattgtacgtgtgagtaaactctcgcggtcaaggcgtgatggaactgctattggacgcactcttgtttgcaacaaagagggtttcagaatggctgacaaacgtgaaaagattgtgaggcaaagggctgagaccagggttggttgcagggcaatgattatggtgaggaaacttagttctggcaaatgggttattgcaaagtttgtaaaggaacacacacatccgttgactcctggcaaaggtagaagggatttctactatgaacaatatccgactgaacaagataaaattcgggaactatctcagcagttggcaactgagaaaaagcgatctgcggcctataaaaggcatcttgaattgatatttgagcaaattgaagagcagaacgagaacctttcaaagaaaatacagcacatagtagacagtgtgaaggagatggaagccaaagaagaacatagtagacagtgggaaggagatggaagccaaagaagaacatattag

SEQ ID NO: 26851 - DNA, 846 bp, Glycine max
  Peptide Sequence Number=SeqID_143629
atggatcctatggagcttaagcgtgttttccaaatgttcgaccgaaacggtgacgggagaatctcattgaaggagttgagtgattcattggagaatctgggcatcttgatcccggacaaggaccttgctcagatgatcgagaggattgacgtgaacggagacggttgcgtggacatggatgagtttggggacttatacgagtccatcatggaggagcgtgacgaggaggaggacatgagggaggccttcaacgtcttcgatcagaaccgcgacggtttcatctccgtcgaggaactgcgaagggtgttggcctccctcggactcaaacaaggggggacccttgacgagtgcaagaagatgatcaccaaagtcgatgttgatggggatggcatgggttgcgctggcaaagtggagaaacaacttagaaaaattaagggagtaactgatattaacatcaacgtcaagagggaactagttgaagttaagggcgtggaagatgcttcaatacttatagtggctcttaaacatgcgcttaagaaaaaaaagaatcttaaagtggatcttattgaacctaattctgctaatgctaatgaatctatagaaaatgttgatgcccaacattcggaaggtgttcacgaagctaatgataatgaggttgatgcccaacattctgaaggtggtcatggagatgatgataatgagattcatgtcgaacattcggaaggtgaccatgaagctagaatagatgttggtgcccaacactccataggcgatggtagaatttacggaatagtatcatcattgtttggttggttgaaagtcttgttgttcaagttgaagttttga

SEQ ID NO: 26852 - DNA, 132 bp, Glycine max
  Peptide Sequence Number=SeqID_143630
atgcggaaattgattaaggaaaggatggaaaataaggtggttaatctcgtgggtcttaataaggttaagtggtggctggacagaaatatagaaatggcaataacggaagctacagggctccaaatgaggtga

SEQ ID NO: 26853 - DNA, 219 bp, Glycine max
  Peptide Sequence Number=SeqID_143631
atggatgccaaggacagaaccgcttcaagtttcaaaattacctatttatgtaatgtagcaatacaatggtctcactctagaaaggaaatatgtatagcaacaacactaagtagaggtgttcattcagttatttatttgattcttgctttcattttggatcgtgctgctcatcatcacagattcccgtttgagattggatgcaatgattcttgcggatag

SEQ ID NO: 26854 - DNA, 1613 bp, Glycine max
  Peptide Sequence Number=SeqID_143632
tgataccttctttccatttctatgatccgaacaattctcagcttgaaggctccaaaagcctcatcacttggttgatcctaatcaccattgtactctacaccctttattcttccaacattatcctcttcaacaatgaccaacaagattgccccactatcaccaccaatttaaacgaggctacccaagaaaaccttcgggtaagtacttacaacaatacatcctcaaaaactatagctaccgatgatgaaagtgttgaaaagaaaaaaccattagtagagaaacgaccaagagaggataatgatgacgacgaagaagaaggagaagaaaaaaacaaagaagaagaagaaaacaaatcccccgtggtagttagattaacacccaagcaaatgtctgagagacaagacactgagcttaaacatgttgtctttgggatagctggttcctccaacctatggcacattagaaaagagtacattaagatatggtggaggcctaaggaaactagaggggtagtgtggttggataaaaaagtgaggagtcaaagcaatgaagggttacccgatatttatatctcgggggacacttcaaaatttaggtatacgaatcgtcaagggcaaagatcagcgttaaggatatcaagggttgtcactgagacattcaagcttgggatgaaagatgtaagatggttcgtgatgggggatgatgacacgatgtttatggttgataatgtggttagaattctttccaaatatgaccatagacacttctattatattggaagctcatctgaaagccatgttcaaaacattcatttctcatatgccatggcatatggtggaggaggatttgccataagctaccctttggcccaggaactagcaaagatgcaagatcgttgcattcagcgctaccctgctttgtatggcagtgatgatagaattcaagcttgcatggctgagctaggggtgccactcacaagagaacctggctttcaccagtatgatgtatatggagatctactaggccttctaggggcacacccagtgtctccacttgtgtcactgcaccaccttgatgtggtgcaaccaatattcccaaggatgacaagagtaagagccctgcggcacctaatggagtctgtgaatcaggactcaggcagcataatgcaacaatcaatatgctatgacaaacaaaatttttggtcaatatctgtttcgtggggctacgtggttcaaatcttgaggggagtgctgtcccctagagaattggagatgccatcaagaacctttctcaattggtacaaaagagctgattacactgcatatgcattcaacacaaggcctgttgctaaacacccttgtcagaagcccttcgtttactatatgaccaacactcattatgactccaccacaaaacaagttgttggtgtttactctcgtgacaaatccaaatcccctttctgtcgtcaccgaggagggattgttgtagaatattgtcatcacgtaagagcacagatactctatacatatgggtgggcaattgtcaagagggtgaagttactgaattatagcattgtgaaccctcacattgttttgtcttcaatcactgtttga

SEQ ID NO: 26855 - DNA, 420 bp, Glycine max
  Peptide Sequence Number=SeqID_143633
aaaggaaatcctcccactggtgtgggaactagccttgcactggagacaataattcagaattgtcctgtagatttcaagcccaatagaaacgaagccagcatcaatattcttgtttgttctagaggaggaggtggtcttctggtggagcgcatggagctagttgctgaattatgggaggagaactttaaggctgaatttgttcctacacctgatcccagtcttacagagcagtatgagtatgctaatgaacatggtatcaaatgtcttgtcatcatcacagatacagatttctccttgacaggttctgttaagatttggggaagtgatgagaacgaatatggtcattataaagctggtggacaggtggatgaaatggttgtacgatcagagattgctatggaagattctgataatgaatga

SEQ ID NO: 26856 - DNA, 2754 bp, Glycine max
  Peptide Sequence Number=SeqID_143634
atggggttctcattaaaacaccgattaatctacggtttcaatgtgaaccaatgttcaactaggcttctatttgagctggtgattttgtcacacttgtggttgcaagttacaagccttggttccatgtcatccattgccatctcttacggcgaaaagggttctgtgttttgtggtttgaaatctgatggctctcacacagtgacatgttatggatccaactcagccataatctatggaacaccaacacatttttcatttcttggcctaacagctggagatggctttgtatgtggtcttctaatgggttctaatcaaccatactgttggggcagcagtgcctacattgaaatgggagtgcctcaacctatgatcaaaggagcacagtacctagaaatcagtgccggtgactaccatgtttgtggcttgaggaaacctatgactggaagacacaggaacatttccttggttgattgctggggatacaacatgaccaagaactatgtgtttggtgcacagattcaatcaatctcagcaggttctgaattcaattgtggccttttttctcagaacaggactgtgttttgctggggtgacgaaactaatagcttagtgattagcttgattcctcatgacatgagatttcataaaatttcagctggggggtaccatgtgtgtggaatctcagaaggggtgagctccaaaactttttgttgggggagaagcttgaaccttgaggaagaaatttcagtgtcacatgctggtcaaggaaatgttgatttggcaccaaatgaccccatgctttcggtagtgggagggaagttccatgcatgtggcattaagagttatgaccgtggagtgatttgttggggatttatcatcaaaccaagcactccatctcctaaagggattaaggtttttgaagttgctgctggtgattactttacttgtgcagttcttgctgtgaaatctcttatgccttcatgttggggtgttgattttcccacctctcttcctttagctgtttcaccaggaatgtgccaacctgctccatgtgctcctggctcctatgccattgatcagcataagagtctttgcaagtcaccggattctcgtgtttgcatgaggtgcagtggtgcttgtcctcctgaaatgcatctgaagagtgcatgcaatttagcatctgatagagtgtgtgaatataactgttcttgttgttcttcatccgaatgcttcttgaactgctcctcttcatactccaatgctgctgccgccgagaagaaaagtgaaaaattttgggctctgcagctgccagttctcattgctgagattgcttttgcagttttcgtagttagtattgtgtcaataactgcagtgttatacatccgctacaggctaagagattgtgagtgctcaaaagggtcaatggtgaagaaacttaatggaaattcttccctccaaaacgagaacaaggtgaggccagacttggaggaacttaagatcagaagggctcaaacgttcacctatgaggagcttgaaactgcaaccagtggattcaaagaagagtccatagtagggaagggaagtttttcctgtgtgttcaagggagttttgaaagatgggacagttgttgctgtaaaaagggccatagtgtcccccaacatgcagaagaattccaaagagtttcacacagaacttgacttgctctcaaggttgaaccacgctcatttgctcaatcttctagggtattgtgaagaaggtggagagaggcttctagtgtatgagttcatggctcatggctctttgcaccaacacttacatgcaacaaaccaagtgttgagagaacagttggattggataagaagggtgacaattgcagtccaagcagcacgtggaatcgaatatctgcatggctatgcttgccctccagtgattcacagagacatcaagtcctcaaacatcctcattgatgaagaacacaatgcaagagtggctgattttggtttatcattgttaggccctgcagatagtggttcccctttagctgaactcccagctgggactcttggttatcttgatcccgagtactataggcttcactacctcacaacaaaatctgatgtttatagctttggtgttctccttttggagattctaagtggtagaaaagccattgacatgcaatatgaagaaggcaacatagtggaatgggcagtgcctcttatcaaatcaggagacataaccgcgattttggacccggttttgaagcctcctcctgatcttgaagcattgaagagaatagccaatgtggcttgtaagtgtgtgagaatgagagggaaagaaaggccctcaatggataaagtaacaacagctttggagagaggtcttgcacagttaatgggaagtccatgcattgagcagccaattttgcccactgaggtggttttgggaagcaacagattgcacaagaagtcatctcaaagatcttcaaacaggtcagtttctgagacagatgtggcagaaactgaggaccaaaggtttgagtttagagcaccctcatggataactttccccagtgtgacatcttctcaaaggagaaagtcatcagtgtctgaggcagatgttgatgggaagaacaatgcagaagggaagaacatgggcaatgttggagggggtggtgatgttttgagaagccttgaggaagagattggtcctgcttctccaagagagaggctgttcttgcagcacaacttctaa

SEQ ID NO: 26857 - DNA, 786 bp, Glycine max
  Peptide Sequence Number=SeqID_143635
atggcaactaactctctccattactccatccaacaccaccaatgttcactcaccaaacgccaccacccctcagacaccccaccccccacatcacttttcctcaaaccccctacaccccccatacaccacaacatcactctctcgcacactccttcaaactcatatatcacctattccatctctcaaaccacaccttcctccaccacctcccaaaccaccccgtccttcgacctcctccgccaccatctctccaccaataactttcagctggccgatgaggagacgcgtcgtctcctcatcgtgcttgctggcgaagccgcacagaagcgcggctacgtcttcttctcggaggtgaagttcatctccgagagcgccctcagggccatcgactccctctggagggagcacagcggcggcaaattcgggtacagtgtgcagaagaagctactggagaaggccaacggagacttcaccaagttcttcatcaagcttgggtggatgaagaagcttgacactgagatggagcaatacaactacaggtccttccccactgagttcatctgggagctcaatgatgacaccccagaggggcatttgcctctcacaaacgctctcagagggacacagttgcttaataacgttctcaaacacccagcttttgatgtagttgatgacaaagaagaagaagaagatggtgagaacaaggacaatggggcaatcacagataatggttcttcgtcaaagacattgggtcagaggatcttcaaaccggactatagcttctaa

SEQ ID NO: 26858 - DNA, 675 bp, Glycine max
  Peptide Sequence Number=SeqID_143636
atggaagtgtctgcatcagcatcgaagaggaggaacaacatagggataaaaaatttgttgcttattctcttattctttcacttttcttccacaatcactgctatcaggaaggatgttggctttcaaatcattcatccatgcaaaaccaccgttcaaggaagatacctcctctcagatgacaacggttgtgtgcgtaatgctacgtctgttaactcacgctctcgctgctgccctcaaagaggggagaaagtctcttgtcatggatgcaatcttctttcacaatgttgcaactcttatgaatattgtgtttcctgctgcttcaatcctgctttgataagtaaggaacaagtggtgaagatgaaggttgccaagcctgctactgcaagttctccgtctgctgactggttcttaagtgacccaaaatctcctgagcatgttgtaggacttattcaagtgtttttgactactgtgctgggagatgttgtcatagttctgagagcgtggaaactcaagtatccaataaaattgactaaaactgtgcattttgaggtccatgaaaatgcttatattagtgacttccaccactgcttttctctgccttcaagttcttctgggaaaaatagtactctcacagaagcaagactgagtggcatcaatgttgttgttgggaggtga

SEQ ID NO: 26859 - DNA, 1041 bp, Glycine max
  Peptide Sequence Number=SeqID_143637
atgcagaaatcagaggatacaagcatatatgataaagttttaaatgctatctttgacgaagagatgttaagcacaaaacacattcgccagaacagttcatccattcagtacactgacttcgaaactgaggtgcgagattatgttgtagatgcgaacagggaaattttccgacagcattgtgcaaagcacctagaaatacctacaatgcgattattggatgattgtccacagtttaatagaaatgcagttaaacttctgacccatggaggagacatgcttgaactttgccacgagttgcgtttgccttttgtgaactggattatttctaaccagaaatcttcattcaaacgatatgagatatcatgtgtcttcagaagagcaattggacattcatcaccaaaccactaccttcagggagattttgacattattggtggtacctcagcattgacagaagcagaggtcataaagttatccttgatagcactattatactcggtagtttgctatacaacttggttcactattgaagctccagtcctagatttcattagcatggtcacaagggacatagtcacttgttttttccatgaagattcatgtgacattcatctcaaccatggtgaccttctggatgcaatttggtcatggattggagtaaaggtagaacacagactcaaagtagcagagcttctttcaatgatgggttctttgcgcccacaatcctcggaaaggaaatcaaaatgggttgtgataaggcggcagcttttgcaggaactgaatttagcagaggctatggtaaacaggttacagactgtaggtttaagattctgtggatctgctgatcaggcactcccccgactcagaggagctcttccatctgataaacgtgcattcaaggcacttgatgaattgtctgagcttgtgagtctcctgagaatttggaggattgacaaaaatatctatatagatgcattaatgccaccaactgaaagttatcatagagatttgttttttcagtactatgattgcattttgtaa

SEQ ID NO: 26860 - DNA, 225 bp, Glycine max
  Peptide Sequence Number=SeqID_143638
atgttgcgattattattccacttgctattgaagatttctctgttcaacccaggaaagaagttctggaacctgtttcatttgcaacctatgcgtgaccagaagggagaagtgcagtattttattggtgttcaacttgatggtagtcaacatgtagagcctcttcacaactgcatcgcagaagatactgcaaaggagggagaacagttggtttggtccctattctaa

SEQ ID NO: 26861 - DNA, 1311 bp, Glycine max
  Peptide Sequence Number=SeqID_143639
atggggcacagttcgaagaagaagaagcgcggcggcgggagcggtcgccggagcaaggggagaacgcagtccaaagaccacgcttctcaattcggctctgacgattacgaccagctctccgaagagattaccgcattatgcgcaattttcgaagaagactgcaaggttcttccaggatcgcctcctcgagtagttattaagctcaggccttactcgaaggacatgggttatgaggacctagacgtttctgctgttcttgctgtcaggcaatgccccaagttgcagattactccggagaaagggttatcagaagctgatgctaaaaagcttttgtctctcctccaagatcaggctactttaaatgctagggagggacgagtaatgatctataatttggtagaggctgctcaagaatttctgtctggtattgagccaattgccaaaacaaatgattctaagcttttacactcgatggtggaaagcaatgaagaattgtttcccaaggatatgacatctgtaaataaaaagggttcttttgtttacggttttatagaccttttcagtggttgtggagaaacatggagttggagttttggaatggatgaaactgcagtaaaaagttcttctctttctccatctaagttagatgcctcaaaaccactggagaagaaatctgatagtaaggaaacaccattaataatgcaagaacttcctgccaaattagatactgttggagaagttagtgaagacagcaacaatagtttatctttgacttcttcaagtagatctttggtggaggattttgtagggaacaaaaatgaaggtgagaaagagtattttatcgttgatgagtatacaacagaacataatgaaggtattaatgaaagtgagtcttcagagtctctgtcttctgaatccttgcctcatcaccaaccctctcaaacagttgaaaaggatctaataatggttcacatgcttcgccttgtttgtgcttctaagggaacatttgctgactgtttgccacaagtggtaacagagctgtgcaatttaggtatcatttctgactcagcacgcgatatggcatctgaaccaccttccattttcaacaaaaccttcaatcgtgttttccagaaacacctggcttcatccagaatatctcaattttggaaacctgatattggaggctcaaacacagttccccatggttctcgatatttgaatgattttgaggagctacgacctcttggtaaaggaacttcatggatttctgttttaagttatatgtataattctgtgatgtcatactcctag

SEQ ID NO: 26862 - DNA, 357 bp, Glycine max
  Peptide Sequence Number=SeqID_143640
atggcaaagctcagagattcggtgagtttgatgatgaaaggagtagcaagaagaagaaaggtttcagaagcaaggaagaagaaaggtttcagaagcaaggaagaagaagggttttggaagaagctgagggggtttttgtttggagttctggcgctatttatggagagcaagagtctggtcaggacctgctcgaatcaaaaagagaggagagtctttaagaaggaattcccaggttcaaagaagtatttacgaagtacaaagctaagacaagaaagaggacttcgagccattgggcaattcgaactggtgtatggacgagtcgaagtcgaggcagcaagagttctggacttagcgtaa

SEQ ID NO: 26863 - DNA, 2514 bp, Glycine max
  Peptide Sequence Number=SeqID_143641
atgggggttatgtccaggcgggttgtgcccgtctgtggtaacctctgttgcgcctgtcctgctcttcgggcaagctccagacaaccggtgaagcgttataagaagttgctagctgatattttcccacgctatcaggaggctgaacttaatgatagaaaaattggaaaactatgtgactatgcttctaagaatccactaagaattcccaagattactgataacttggagcaaatatgttacaaatatttgcgttatgaaaccttcggctcagtggaagttgtcttgtgcatatacaggaaattcttatcgtcatgtaaggagcagatacctgccaatgaagataaactgaattcagagtccctggacctgttagtacagggaattcccaaagtagaagaccctttaacagatatcactaagaaggatcctttgttgctgaaagctgtgactggaactgagatagactgtgtgttggatactgctaaagatcctacatattggtcaaaggtttgcttgtataatatggtcaaattggcaagggaagctacaactttacggcgtgtccttgagcctctttttcactattttgatactgaaaatcaatggtcttctgaaaaaggagttgctgctcatgttttgatgtacttagaatctcttttagcagaatcaggagataactcctgtcttctgttgtccattttggtcaagcacttggatcataagaatgttgctaagcagcctatccttcagattaatatcattaacactacaacaaaacttgcacaaaatgtgaagcaacaggcttcagttgcaatacttggtgcaatatctgacctcattaaacatttaaggaagtgtctgcaaaattcagctgaagcttccagcattggaaatgatgggcttaagctgaatactgaactccaatttgccttggaaatgtgtatattacatttttccaacaaggttggagatgttggacccattcttgatttgatggctgtggtgttagagaatatctcaagtacaaccatcatagcaagaacaacaatctctgctgtttatcaaacagcaaaattaatcatgtccattcctaatgtatcatatcacaaaaaggctttccctgatgctttgtttcaccaattgctcctggcgatggctcatcctgaccatgaaacacgagttggagcacacagcatcttttctttagtgcttatgccatctccattttctccccagttagaccaaaaaacaaaggggtatcagaaggtaccaagcgaaagcttctccattcagcatgaaagctttttaggagcagaacagatcaatgggaaacctatggaaggaaaggcagtagttggtgttagtgggaaatatgcagttcatccatatcatggtcacatcttttctggtgctctaactgatggaaaacatgagctaagttcttttcggttaagcagtcaccaagtgagttttttgctttcttcaatctgggttcaagcaacatctgtggagagtggccctgcaaattttgaggcaatggctcacacttatagcattgctttattgttcactcgttcaaagacatccagttacatggctttagtaagatgtttccaattggcattttccctcatgagcctctctttggaccaagaaggaggtttacaaccatctcgcaggaggtctctttttactttggcatcgtacatgcttatattctcagccagggcaggcaatttccctgagctaattcagaaagttaaaacttccctgactgagacaactgtagatccttttcttgagttgattgatgatgtcaggctgcaggctgtttctagagaatcagagaacataatttatggatctcaagaagatgatgtttcagctatgaagataatgtcagcagtaaaattggatgacaaacagttgaaagagactgtaatatcatgcttcttgactaaattttcaaaactatcagaggatgagttgtcaagcataaaaaagcaacttgtacaggggttttcccctgatgatgcgtatccactgggacctccattgtttatggagacaccagggaagtcttctccacttgctcagattgagttcccagattttgacgagattgtggctccattagctttgatggatgaagagacatggcccaaatcaagtggaagtcagtcagatcataaatcatcactatctagcaatagcccggacattctaagtgttaatcaactcatacaatcgctggagagtcgagactgggtttcttcttttaaagatatgattttatatttggttcaggttttggaaaccgcacgacaagtggcaagtttccccatttcctcaactcctgtatcttatgatcaaatgaagaaccagtgtgaggcacttgtaactgggaaacaacagaaaatgtcgattcttcacagtttcaagcaccagcaggagactggggcaatagttctttcaagtgaaaatgaaataaaagtttcccctctgccaattaag

SEQ ID NO: 26864 - DNA, 174 bp, Glycine max
  Peptide Sequence Number=SeqID_143642
atgggaatacctcaatcgcaagacgtagatgacgtggatggagagggaccgtttgatgatggggggcagcgaaaagaccaaaaactcccaccgcaccaaacagggatgaacgcagagagtgaggccgcaaggaagaaaagtgaggatttagagagagaaagagaagatgactga

SEQ ID NO: 26865 - DNA, 282 bp, Glycine max
  Peptide Sequence Number=SeqID_143643
atgtatccaaaacggtcaggccaagatggccctgattccagacaggtgcgctcaagtgataggatcaagacaaggccaaacgtttatggccggccatatttgtattacaaccaaaaccttaggcgcaccaggaaaagcaagatcaagacaaggacggcagcttcacagattgctaagatgttgcgtccggggaatcgaaaatcaaaagattctaatactaatattgtccgacgtcacatggatgccaatgaaatcccccatccccccgccctttctaagtaa

SEQ ID NO: 26866 - DNA, 4161 bp, Glycine max
  Peptide Sequence Number=SeqID_143644
atggcaattgagaagaacagctttaaggcgtccaggcttgattccgagtgttctcctcgaagtagggaaagtatgtccagtgacgaagaggtgattcggcggcgtaactctgccgtggaatccgacgacgatgatgagtttgatgatgctgattctggggcggggtctgatgattttgatttgctggaattgggtgagactggggcggagttttgccagattgggaaccagacttgcagcattccgttggaactgtacgatcttgctggccttgaagatgtactgtccgtggatgtgtggaatgactgcttgagtgaggaggagaggtttgaacttgctaagtatcttcctgacatggatcaagagacttttgttcagaccttgaaggaggttttcactggttgtaacttgcattttgagagtcccattaagaagttgtttgacatgctgaagggtggtctgtgtgagccgagagttgcactttacaaggagggcttgagttcttttcagaagcgacagcactatcatctgttgaggaagcatcagaacaacatggttagcaatctttgtcagataagagatgcttggcttaactgtaggggatacagtattgaagaaaggctgcgtgtcctgaacattatgaggagtcaaaagagtttgatgtatgagaaggaagatttggaagttgattcttcagatgaggagtccggtgaaggtatatggagcaggaagaacaaggataggaaaatttcacagaaaacggggcgctatcctttccatggggtgggtcctggtttagatatccattcacgaggacgatcagtggttagggagcaagagaagtatgggaagcaaaatcctaaaggcatactcaagttggctggttcaaagccaccttcagtaaaggacccaactggtcgctcgtcttctgtctaccatgctttggatgtgaatcctgggctaaatggttcaacttctgctctttctcaacagaataagtcggtgggatatgattcagggtcaatgcacaggatgagggatcagctgtggaatggtgataacgaggaaatgtcatatggagtccatcaagatcggaatttatcacgtagcaacctgatggacaaatctagttttcggaaagtgggaaagaggaatgaccttctgagaggtgatgagatggatactgacaatttgatgggtctgtctctgtcttcaaagactgatctacatggatacactagaaatgcaaaccaatcttctgatatgaaaattttcccggcaaagccattttctaagaaaggtttgtatgaatattctagaaattctaagtatctagaaaatgttcaacaatttgttggtagtgatcaggctaagcctagagtgaggagttcacagttatcgcttaaaggcactatggtggactcagcagattacgatgaacttttctatagcaatgaaacaccaggacaggaatttggtatggattcttcatttaaatatgatgattggtatcgaaagggcaagaaatggaaggcagggagagagtctccggatctcagttacactccttatagatcttcctcgccacaggttagtgacagacttctatcctctgacttcagggcaaaatcattgcaggagaagataagagggacttctatgcagaatggagaaaaagatccaatgcctttgaggggtagtcatatgcttttaagaggtgaagaaactgaatcagactcatcagaacagttgggtgatgatgatgataacactcctttgttacagggcaaatatgcttacttgatgggtactgctgctggttctcgcacaaaattgttgaaatctcacctagatcccaagaaggccaaatttgtttcagatttgaagccacatgtaataacacaatccaaaaagaagggtggctttgcagagcgggggcaaatgcatggtgtagaaaattacctttcaaaagtaaagcagaagggtgaaatacgcaatggtggtccttttcagaaacaggctggtaaatttattgaagaaatctatccctctggatcagatatgattgatgatgctgatgatgattggagacaggtatacaagacaggcaagaatggccgaatacgaggggatcctattgaaaggttagacatgccctcatcaaatgcatacacggctgagcgaaagaagaaagggagaactgaccttgatcattccattctgaggtctaaatatttgcatgattatgctggtgatgaggacaactcacttgaaagaagacggttggttgtggataataatgaagttggacaaagtaggcatgggaggaaaggacagaaatatgtttctgcatacaagggtgatcaaaatgagagatctgaggcaccaatgcttggttgcaactctgcaacgaagaagcgaaaaatgaaggatgaggtagtagacattggtggaagagatgaagatggcaatcttttgtcaaacaccctgacaaatgatttgacttattcaaaaagaaagtcgaagaaaaagatagaggctgggatggttagttcagaaatggataattctgaattacgtcttaatgatatggggacagcagatatagaactggaaaccaagccacagaaaaagacattcactttgatcacaccaacagttcatactggattttcattttctattatacatcttctttcagcagtccgcatggcaatgattagtccacatgcagaagacgatttagaaatggggaaacctagagaagagctgaacaaagcacaggaaggcactactacaaatggtgatctttctaacagcaagacggatgccaactgtgagtctgctgaccatccgaacatgccttctcttactgttcaggagattgttaatcgtgtgagatcaaaccctggtgatccttgcattcttgagacacaagagccactgcaggatttgatcagaggtgttctgaagatattttcttccaaaacagcacccttgggagcaaagggttggaaggtactagcagtttatgaaaaatccaccagaagttggtcatggactggcccagttattcataattcacctgaccatgatactattgaggaggtgacatctcctgaagcttggggtcttcctcataagatgcttgtcaagttggttgattcctttgccaattggttgaaatgtggtcaggaaactcttcaacaaataggaagtcttcctgctccgcctttggaattgatgcaagtcaaccttgatgagaaggaaaggtttagggatctgagggctcagaagagtcttaacaccataagacctagctcagaggaagtgaggacttattttaggaaggaggaggttctcaggtactcaattcctgacagagccttttcatatactgcagctgatggtaaaaaatctattgtggcacccttgagaagatgtggtggtaagccaacatcaaaagcccgagaccattttatgttgaaacgtgatcgaccaccacatgttacaattctttgtcttgtaagagatgctgcagctagattacctggaagtattggcactagagcagatgtttgtactttaattcgagattctcaatatattgttgaagatgtttctgatgcacaaattaaccaagtagttagtggagccttggatagattgcattatgaacgtgatccttgtgtacaatttgatggggaaaggaaactgtgggtttacttgcatagagaaagagaagaagaagattttgaggatgatggcacttcatccacaaagaaatggaagaggcagaaaaaggatgctgcagatcaatctgatcaaggaacagtaactgttgcctgtcctggaactggggagcaaagcggatatgatttgtgctcagatctcaatgtggatccaccaccatgcattgatgatgataagggaatggaacctttgcctactgatacaaggccaaatgcagaggcacatgttgacgtcaatcgggcttctgaagaaggcaatgcttgtgacggtaattcaatggcttgggaggctcttgatttaaatcctactcgagagttatgccaagaaaattcaacaaatgaagatttggatgatgaatcctttgggagagaaaggcccgttggactattaagtgcaagcttgttgtga

SEQ ID NO: 26867 - DNA, 492 bp, Glycine max
  Peptide Sequence Number=SeqID_143645
atggatgtgaatgaaaattcaattttcaaatctcaaaataaagaaaaatgtcagtatattattggcaatactgtacaagttggtgtagatcaagaaaaaaactatctatctctgaagtataattctaatgcctatgcaagtgctgttaaggctttaaaggttgattcaacaaggatgctcattgctgaaggtggagtcaacaatcttgcttctttgcacaataattatgccaatggacccaatacctcatctgaaaaaggcatactagttaactatactccgactgcaaatcattctaactcagatctagagaagctccaaattctttcagattcaaaaaagatattatctcaaactgccctagctgctttgatacgaaagaggaatgaattggcccttcagcagcgcaagatagaggatgagattgctgtttgcgataaaaaaattcagagaatgctaaccgggtattcccatggtgttgggatctcatga

SEQ ID NO: 26868 - DNA, 2961 bp, Glycine max
  Peptide Sequence Number=SeqID_143646
atgatgcagatgatggccaaaaaggagattgagggggatgctgagggggaagatgaaggtgaggacgaaggtgatgaagatggggatgatgaagagggtgaagaagagcaggatggaagaaggcgctatgatcttcgaaatcgttcagatgtccgcaggttctctatggaggaagggaaggcccagccaagatctcctcgaagagtgttacatcaaggtatgggaactaaggtcagcagggatgtaaggaaaggtggatcacgagttcataagcgtcatcgtttagcgaggcctgaagattctgatgactcccttcttgtggatgagctggaccaaggcccagctattccatgggggcgaggtggcaacagatctggtcctccttggctatttgggggcttagacatgcatggaacaacagctttcggattaaatcttgctgcatcaggttggggtcatcagggtgatgcggtggctactctaacttcggggattcaaactgctggaccaagctctaagggaggggcagatatccaacccttacaggttgatgatagtgttagttttgatgatataggtgggctctccgaatacattgatgctcttaaggaaatggttttctttccattattgtatccagatttttttgcaagttaccacataactccacctaggggggtattgttatgtgggccccctggcacagggaaaacattaattgcaagagctttggcttgtgctgcttctaaagctggccagaaggttagcttttatatgcgtaaaggagcagatgtgttaagcaagtgggttggtgaggctgaaagacaattgaaactactctttgaggaagcacaaaggaatcaaccttctattatcttctttgatgaaatagatggacttgcacctgtgaggtctagtaagcaagaacaaattcacaattccattgtgtccactttgcttgctttgatggatggtcttgactctcgtgggcaagttgttttaattggagctaccaacaggattgatgctattgatggagccttacgacgccctggtagatttgaccgtgagtttaactttcccttgcctggttgtgaggcacgtgccgagatattagacattcacactcgtaagtggaagcatcctcctccaaatgagctgaaaaaggaacttgcagctagttgtgtaggttactgtggtgctgacctgaaggctctttgtactgaagctgccatccgtgcattccgtcaaaaatatccacaggtttatactagtgatgacaaatttgtcattgatgttgattctgtcaaggtagaaaagactcattttattgaagccatgtctactattactcctgctgctcataggggagctatcgtgcactctaggccattgtctctagtagttcaaccatgtcttcagagacatttagagaaagccatgagtattatatctgatattttccctccagcttcaattacatcagagttgaccaaactttcgatgctctcctacgggtctgcaattccacttgtgtatcggcctaggcttatgctttgtggtggtgaaggtacagggctggatcatcttggccctgcggttttacatgagctggaaaaatttccagtacattcattgggacttccatctcttctgtcagatcctagtgcaaagacaccagaggaggcattggtacatatatttggtgaagctagaagaacaacaccatcaattctctacttaccacaatttgatgtttggtgggagactgctcatgaacagctcagggctgttctcctgactttgctagaagaattaccatctgacttgcctatcttactgcttggtacatcctcagttacacttgctgaagttgaggaagtgcccacttccattttccctcatcgctcaatttataaagtgaatatgccatgtgccaaagataggactttgtttttcaatcttttgatagaagctgctatgtcaatattgttggagggaatcaacaagaaatctcaggatgcaggatgcctccctgaacttcccaaggctccaaaattggctagtggtccaaaagtgtctgagctaaaagcaaaggtggaagctgagcaacatgcacttcgtagattgcgaatgtgccttagagatgtttgcaaccggattctgtatgacaaacgatttaatgccttccattatccagtgacagacgaagatgcaccaaattatcgttcaattatacagaacccaatggacatggctaccattctgcagcatgcttacaatggagaggattacaatggtgctaggattgttagtagagcttgtgagctccgtgatgcggtgcatggaatgctctcacagatggatccagcactggttgcatattgcgacaagattgctagccaaggtggcccagttcagttgtctgatgaattaggggattctactttccctgctactcctgttgtgcagctgggtcagagtactagaatgagtgctcgacttcgtcatgtccaaccagaggttaatatggatcagagttatgaagtattgaagcgaactaagaagattgccgaagtgcatgcagaagaaaagtcacaacaagattcggtgccatcaaagtcttccctggagcagcaggcaaatgacacaaattctgaaaggctggaacatgtgtcaattgaaggagatttgcatggaacttttacaaataaccttgctgatggcaacagtcctgatgatgtcacagtgctagacggtgaatttttaggagaagtagagtctgtcaagcagctttttgtgaagcgtagtgaaaattacagcattccacaacttgaaaggctttacacgagaattatgaagggcgtgtttgaaaccaaaaataaaggagtgagtggggatcttaagtcttcggttttgaagtttctgttgaattttgtagaggatgatgcaaatttctaa

SEQ ID NO: 26869 - DNA, 1563 bp, Glycine max
  Peptide Sequence Number=SeqID_143647
atggaggcaacgcagagaagattgggtggaggaatggtgccggtgtcgccgtcgcagactccgcgctccagcgataagccggtgcgagatctgcgatctgcggattcgaattccaacagtcacagcaagtatgacaaggacaaaggcgtcaatgtgcaggtcctcgtgaggtgcaggccactgaatgaagatgaaacgaggctgcacacgccggttgtgatttcgtgtaacgaaggtagaagagaggtttcagctgttcagaatatcgccaacaaacagatcgatagaaccttcgcatttgacaaggtgtttggtcctaactctcaacagaaagaactgtatgatcaggcagtgtctcccattgtgtatgaagtgcttgagggctataactgcactatttttgcgtatggacagaccgggacagggaagacatacaccatggaaggaggtgcaagaaagaagaatggcgaatttccgagtgatgctggtgtcatcccaagagctgtgaagcagatttttgatatattggaagctcagaatgctgagtataacatgaaagtaacgtttctagagctttacaatgaggaaataacagatcttttggcccctgaggagacttcaaaatttatagatgataagtctaggaaacctattgctctaatggaggatgggaaggggggtgtttttgtcaggggtttggaagaagagattgtttgcacagcaaatgaaatttacaagatattagaaaaaggttctgcaaagaggcgtacagctgagactcttcttaacaaacaaagcagccgttctcactccatattttctatcacaattcatattaaggaatgcactccagagggtgaggaaatgattaaatgtgggaagctaaatcttgtggacctcgcaggctctgagaatatttcacgttctggtgcaagagagggtagagcaagggaggctggggagataaataaaagcttgcttacacttggacgagtgattaatgctctagttgagcactcaggtcatgttccatatagagatagcaaattaaccagattgttgagggattctttgggtggtaaaaccaaaacgtgcattattgccacaatatccccttccattcactgtctggaagaaacccttagtaccttggattatgcacaccgtgccaaaaatatcaagaacaaaccagagattaatcagaaaatgatgaaatctgcaatgattaaggatttgtattcagaaattgacagactaaagcaagaggtgtatgcagcaagagagaagaatgggatctatataccacgtgatcgctaccttcatgaagaagcagagaagaaggccatgactgaaaagatagaacgcatggaactagaagcagagtctaaggataagcaactggtggagcttcaagaactctacaattctcagcaacttttgaccgatgaattgagtgttaaacttgaaaaaactgaggtaaaagtggccatgcttaactgcttcattctttcgttctggacttttgatcctttcaggaatttaactgtttatatcctaacataa

SEQ ID NO: 26870 - DNA, 852 bp, Glycine max
  Peptide Sequence Number=SeqID_143648
atggctccatcagatgtttgtctatccgaggatgcagttcaggtattcatagagcacttggttgacccgttgctgccagcaaaagcatctgtccaggataatcccacaccatctcaacagaagttagttgcaaatcaggtgcgttcaactgtcttactgtacaactactaccataggaagcagcaccctgagctagcatatcttccatttaatgaattttgcaagttggctgtggttttgaggccacctttattagcatatatgcaattcatgcaaaatttaaatgaagaagagctcactgatgtagagaagcagctatcattgacagaaaaaatgattatggaagcatgtgatgtgtgtaaatgtttggatgcatcaaaggatgctcctaatatagagggatggcccattacaaaagtttctatgcttttaatcgacagtaagaaggagaactgctttttgctgtttagttccattaccagtggggtatggtctgtgattgaaaaaggtctggacacctccagtcaaagttctctggttgaaaaaggtctgaacacctccagtcaaagttctctggttgaaaaaggtctgagcacctcctatcaaagttctgaagttacatcaggatcaaaacagtacaaaaagaggagagtcattaaaaagtctgcacaaaaggaattaaaagttgatgaagatgtatttctacaagttgggtattctgctgtaaaggaagccacaggtatcaataacactgatattatgcttttggaaagtggcactgtctattctgagagcaaagagaaggcagcttctcgcttttatataatgcagtgctaccggacgatcaattaa

SEQ ID NO: 26871 - DNA, 150 bp, Glycine max
  Peptide Sequence Number=SeqID_143649
gtaggatttggacaaccaatttgtacacctctaagacatcgttgtggagaatgcagcataagtgagttatgcccctcagccttgaaggagatctcttactcaagcccatcttccaagtccaaaaagtatagaatgaacaagaagctttga

SEQ ID NO: 26872 - DNA, 388 bp, Glycine max
  Peptide Sequence Number=SeqID_143650
atggcagaatcgtctaaaaagcgaaagggaacgtcctccaccaccgccgctgctggccatcgatgccacggaccacctaaagcacccacagtaccagttcctcctcccttgtcatctccacgatcatctactttattttcttcagatgatcaacgtctacgtcaaggtgcacgttttgaggataccattgttgatgactggaagttcgattattctaatcatgatgctcgccgtatggtctgtaatgaccaggctgatatgaccgatgatgaaccttttgttcaagtcaaaaggtcttttgccattggtgctggtgtagttccttcatttgattactgtaaggatcgtgatggacaatggcttaggaaacaagacttaccacatgagc

SEQ ID NO: 26873 - DNA, 558 bp, Glycine max
  Peptide Sequence Number=SeqID_143651
atggagaattggcgaacagcgctaggcaatcaattcgcggggctccaaactcgttggtggaggatgcatgaacgacaatcaattcatggggctccgaataaaagtggagaatggagaattgcactaggcaatcacttcgcgtggctccagactcattggtggaggatgcatgaacgacaatcaattcatggggctccgaataaaagtggagaatggagaattgccctaggcaatcacttcgcgtggctccagactcattggtggaggatgcatgaacgaaaattaattcatggggctctaaataaaagtggagaatggagaattgcgctaggcaatcacttcgcgtggctccagactcattggtggaggatgcatgaacgacactcaattcatggggctccgaataaaagtggagaatggagaattgcgctaggcaatcacttcgcgtggctccagactcattggtggaggatgcatgaacgacactcaattcatggggctctgaataaaagtggagaatggagaattgcgctaggcaatcacttcgcgtggctctag

SEQ ID NO: 26874 - DNA, 276 bp, Glycine max
  Peptide Sequence Number=SeqID_143652
atggaacacaaaaattctctctcaggttctcctgaaaactcacaattggaagcaccagatggagctttggaaaaatgtttattggtaaaactacttgacaagaatgtggcctttgtcaccatgaaggagaggttgaaggcgatctggaagttggaagatggatttgatctaatggatattaccaatggctattatctagttaatttggatatgggaaaggatcaagataaggccatcaatggaaggccttggatgcttttttttatctctacctaa

SEQ ID NO: 26875 - DNA, 180 bp, Glycine max
  Peptide Sequence Number=SeqID_143653
ggacagcgagtcaggtggcaggcggagataccttatggtcgtccgcaccattcgttaaccaaggagaacgaattcgatggtttttactctagtcgtccagagacatcaagcccgacgacgcacgagattcttctttgttgggcggggatgatcaagttcgatagcatgtggaaacgttga

SEQ ID NO: 26876 - DNA, 309 bp, Glycine max
  Peptide Sequence Number=SeqID_143654
atggctaatgataaagctctaaaagatcttggtgtgaaattcaacaaggtccaaaaatacaaggccttgatgaactatccctctacatttcattgctactatgtccagaggcaagggcaaggaaagatttgtcttatgcaagggaggatgaagctagacttggtcaatgttgttattgacaacatgttcaagaccaagaggattggatccttcaagtgtccttatgcaatactaatttctaggatccttgatcacatcaaggtggatacctgtgacaccctctaccccgacatatatataaataaataa

SEQ ID NO: 26877 - DNA, 189 bp, Glycine max
  Peptide Sequence Number=SeqID_143655
atgaatcaaatggtgaagggctttggaagggttgcagaatctcttgatgacttggccttggatgtccctgatgctaaaattcagtttgcaaactatgttgaaagagcaaaggccaatggatggaacatgcaacagagaatggcactcactaataataataataatgtgggaaatcatcagcaatactaa

SEQ ID NO: 26878 - DNA, 157 bp, Glycine max
  Peptide Sequence Number=SeqID_143656
ggtggtgtgcagcttggtgttgtagtgtgcgtgatggttggacatgtgttgatgagaacggcacgcgacattgttgggatcgtggttgtgctgcgcgcggctgacatcttggggggtagggaaggtgaaagagaaagaggaggttttgcattgaagg

SEQ ID NO: 26879 - DNA, 273 bp, Glycine max
  Peptide Sequence Number=SeqID_143657
atgtacaaagataattggacccaaccttggcccctgggctcagaaatctaccctaagattcatgagaaccctagggtcttcttctgcagctctagctcaatcctcttagagcctctagctcatggctctggtgactgggtgttgctaggtgcacccagtagtattggtggagcacccaacattcctataaaatgccaaaaatgctcctggttcctcgcacacttgcggatcaagttgatccgtaagtcattcacggataaagttgatccgtaa

SEQ ID NO: 26880 - DNA, 824 bp, Glycine max
  Peptide Sequence Number=SeqID_143658
ttggtgccgctaagcgcaatcctttaaggagcttagcacatatccttgcggcagatgttcagcttagccagctaagcggaccatgtctcgctaagaggccaatggcttccagaaagagaaagagtattggaagacatatactgcctaagaggaaggtagaaatataccatattgagctggacgagtttaaggctgaattggagaggcgtaacttccataaacgcctcaccaatttagttgacaacagcatagatctagctttggtgaaggagttttatgccagtctttacagccccgaaggaccttcaccaaagcaagttagggtcagaggccacgtggtgaagattgatgcagacaacctcaacacctttctagagacacctgtggtactagctgagggccaccctaggaagattctcaggaaagatttaacaactctttctcaagtgttgagtgttctctcgtactccaatctggctcctacttcccacacctcggacctgacaatggacatgaatgtgggagctctcatctctggtcagattacatctatggcccagtgtaactcttctagacttgggttccctgctcttatcacctctttatgtaaatccaatggggttgcttctgacagcctggtctttgaatgcctgagcccggtcagtaacttggcctatatcaggaaaaactgttggaaccctgatgatctgacagttactatcagaagggccaggagagcgaggacaaggccaactgaggccccttccacatctacagctcctcctccagcacgtaccctagcagctccttctgcctcaactcct

SEQ ID NO: 26881 - DNA, 342 bp, Glycine max
  Peptide Sequence Number=SeqID_143659
atggagcatgaaacattccttgcaacttggttggcagagattgatttctctcccaatggcttggatggtggaagcagtcaatattgtatcatcatcatgattttgcaaagaatattactcggtgaaagagcagtctatgcaatgatgctggtgtttccacctgaattttctcctttgaaaactattttatttggaaatccttcccaagacaccgttgaaccactgatggaggctttggaggaagattataaagatggaaatgagataaatgaatcaaggcagtttattggaggagtattggatcttgaaaagagaatcaatagactaggtacattgacttag

SEQ ID NO: 26882 - DNA, 377 bp, Glycine max
  Peptide Sequence Number=SeqID_143660
aaaacaccgagactttttcaagtctcacaagttatccagaactacgtaggtctgagttcctcattggaggatacgtaggagcaagagcctcgcttttgtcgaccacaccgccttttgttgccatgacccaagagctggtagcccgcggagacaccttacggttatccgcaccttgtcattcagtgaccccaagtgtgattgacgagcagaggccaatgtggtcatctgcgccctttccggagatgtcagcattttccgatggagacttttcaagtctcacaagttatccagaactacgtaggtctgagttcctcattggaggatacgtaggagcaagagcctcgcttttgtcgaccacaccgcttttgttaccatga

SEQ ID NO: 26883 - DNA, 537 bp, Glycine max
  Peptide Sequence Number=SeqID_143661
atgcataaggcattgcgattaaaagctccattgccatatccacacctagtcactctcttccttcaacactttaacatccctcttgattctgaaccttatgttccaatcaagagatccttcttaatcagtgctgctatgattgcatcttttggttaccataaagggcatgatggctcttgggtaaaaaagggtgctcaacccattgataaagaaggaaacttaccagtgggagaagattcctctcttcttcaaaggattttggacaggttcgatggtcttcaaacctttgttggtgaaaggtttgatgctttggagttacaagtggacatgcgattcgatgaaatggagtcaaggatcaccaaggtcgaaggagatgtctcttacattcgcacatgctttgatctaccaccaccactgccaccatcatcttatatttctattatttttaatattattagaattaatgaagcattgggcttgaatctagcattgggcttgaatctagaattgggcttggacttgaagagggcagactaa

SEQ ID NO: 26884 - DNA, 267 bp, Glycine max
  Peptide Sequence Number=SeqID_143662
atgaccggccctctcgatgagtcgatctcttgctttctcataaaggtggacccttgggtactagtacctaacacctttagaggactgtatgtcctcgccatcagaggactgcacatcctcgcctgcagagggctgcacgccctcgcctttagagggctacgcgtcctcattttcagtgtgctccatatccacaccttaagagaatataaggtcctttgcccttatatgcttaaccgagacttgcgctcccggttaaggggccagtag

SEQ ID NO: 26885 - DNA, 1305 bp, Glycine max
  Peptide Sequence Number=SeqID_143663
atgagcacggcgaggagtaagcatgatcatctatctgttgcgtcgcctgctgttgctgatcatcaccctgctcttactctcgctgggctgctgcagtttgatttcggtgtttccagcaccaacggtcaggcaattgatatacagctgcgcgaggtgtttcccgccacgctggaactgtgcgtgctggcgtttatgctggcgctgctggtcggtattccgctcggtatctgcgccggcgtgatgcgcaataaatggcaggataaagccatcagcgcgctggcgctgctcggcttctcaatgccggtgttctggctggcactgctgtttaccctgctgttttcgctgacgctgggctggctgccggtttccggccgtttcgacctgctctatccggtgcagaacatcactggttttgccctgattgacgcctggcttagcccttcaccgtggcggcacgagatgctcgtcagcgcgctgacgcatctgattctgccggtgatcgtgctggccgtggcaccgaccactgaagtgattcgcctgctgcgcaccagcaccagcgacgtgatggataaaaattatgtcaaggcagcggcaacgcgcggcttgtcgcgcttcaccgtgattcgccgtcacgtgttgcacaacgcactgccgccggtgatcccgcgtcttggcctgcaattctccaccatgctgacgctggcgatgatcaccgaagtggtgttcaactggcccggactggggcgctggctgattaacgccatccgtcagcaggattacgcggcgatctccgcaggcgtgatggtggttggcgggctggtgattctggtcagcgtactgtcggatattatcggtgcggcgctcaacccgctgaaacacaaggagtgcgccatgattggcctgtacggcttcggcatcctgctgtttctctgcctgttcggcgggctgctgtccccttacggtatcgaccagcagtttctcggctatcagctgttgccgccgtcgtggtcgcgctacggcgatccgtttactgagcggcgtggcaccgacggttggctctgcgctgctggtaacggtgctggcagcaatctgcgcgctgctgctgggcgtgctggcggggattacccacggtttgcgctcggcggtgatgaatcacgtgctggatacgctgctgtcgattccctctttgttgctggcgattatcgtggtggcctttcttggcccgcgactggagcatgcgatgctggcggtactgctggcgctgatcccgcgtctggtgcgcgaaatctacacggcggtgcatga

SEQ ID NO: 26886 - DNA, 447 bp, Glycine max
  Peptide Sequence Number=SeqID_143664
atgtcggggcgttcctccactcgccaatttcccagctggaaatcaggagggcatggtcgtaccaaatccaacgtactcggaacatcatcttcgttgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 26887 - DNA, 549 bp, Glycine max
  Peptide Sequence Number=SeqID_143665
atgcgcaagaaggcacaagccaaccagaaacataacattgcccctcacgtgttgtctcgtgagggttatgaatattcagaaaacaagttgatggatgagaagagaaagaaaaaactagaggaagctgctcaatccggaagcactgacaccgtgattgatcctctatctcccatcagacaacacatgaaatggaagatggcccgcacaaagaaaactgggcaaatgacgtctcaggcagcaaaggaaattgctgagaagattgaatcgttggaggagcagtcgtcatacggtttcttcgttgccattgggcgaccagaacaccgtagtcgtgtaggtgttgttggagttggtgtcacgatcaagaaatactttggactggctccaaggacctcccgtatgtcttcctccatggctcccgaagacctggagcagctgatgcaacaaattagggaccagttggaggagtcgatcactgaaaaagtgactcaacggctaatgttatcctttcaagccacagtccatccagagatccgagcaattgaaatttga

SEQ ID NO: 26888 - DNA, 276 bp, Glycine max
  Peptide Sequence Number=SeqID_143666
atgtataatagtataataacctatattggtctccactgcagtgcacattggcaaatggtcgtcattttgcctaaggaaaatgttgtcatctggttttgttcattgcatactaggccagacaactacctcaaaggaataattaacagtgctttgaaggacttgacgatactccacaaagtaaatccaaggctggtgctaggtggattgttgttaaaacaaaaaggaagcaccaagtgtgggtattacgtcatgcactggatgtcaactataatctaa

SEQ ID NO: 26889 - DNA, 192 bp, Glycine max
  Peptide Sequence Number=SeqID_143667
atggataagagcttgaaggtaagagaagataaatggagggagagggagaaagggggcacaaattttatgcctcaaataggctcatacttaacccatgggcctaaaatctaccctatggctcatgagaaccttagggccttctcctgcatctctgacccaatcttcttagagtcttctatccagtgcccgtag

SEQ ID NO: 26890 - DNA, 1055 bp, Glycine max
  Peptide Sequence Number=SeqID_143668
tgggcggctgagatttgtggcgtcagcgcggcaacaatcaccgattttgcccgccagctgcacggcaagcgcgtgctggttaccgtggcgcacgcgttgcagcgcgcggaacacggtgagcaaccggtatggctggggctggtgctggcggccgcgctgggccagccggggctgccgggcggtggatatacctatgcactcggcgcactcggccattacggtaagcatcataatctggtgagtttcccggcgctgccgcagggcaggaacggtattgaccggctgattccggtggcgcgcatcgctgatatgctgctgcatcccggcacgcagtttgattacaacggccggcgtctgacctatccgcacatccgtctggcctactgggcgggcggcaatccgttccatcatcatcaggatctggcgcggctgcggcaggcgttttgccagctggatacgctgattgtgcacgagaccgcgtggaccgccagcgcgcgccatgcggatatcgtgctgcctgccactatgacgctggagcgtgaagatatcggcggtgcgccgaccgatcgtcatctgtttgccatgcagctggtggcacaaccttacgcgcaggcgcaggacgactacaccatttttgctgaactggcacgtcgtttaggccgtgaagaggcgttcaccgaaggacgcgacgcccgcggctggctgcgccatcactatgcgcagctgcaggaaaaactggccgcgcatcaggtgacgattcctgacttcgaccagttctggctgcagggcgtgattgaactgccacagctgaaagatggcgggcggatgatcaatgcgtttcgggccgatccggcggcggcaccgctaccgacgccgagcggcaaaatcgaaatcttttccgccaccatcgccagctttggctatgaaaattgccccggccatccggtgtggcgcgcgccgcagcagcagccggatgcggagcatccgctgtggttgatcgccaaccagccggccacgcgtctgcacagccagctggattttggtgactacagcct

SEQ ID NO: 26891 - DNA, 660 bp, Glycine max
  Peptide Sequence Number=SeqID_143669
atggcgtggatcggtatcgcgatttacggcgcctgggcgctgggtgcgccgctgggcgtggcgatttatcacggctggcacttcaccggcatcgccatggcgatcatcgtggtaccgctgctgccgctgatgtttatcacccaggtgcgcgccgtcgcgccgacctcgactaaacggacaccgttctacaaagtcatgggcgcggtgtggcggccgggactgggtctggcgctcgccagcgtcggctttggcatgattactgcttttatcgcgctgctgtttgcggccagggcctggggcaacgcgtcgctggcgttcaccgcgtttggcgtggcgtttatcgcggcgcgcctgttctttgcccatctgccggataagctgggcggcgcgcgtgtcgcgctggtatgcgtgctgattgaagcctgcggtcagctgctgatttggcgcgctgatgacgcgacgctggtttatctcggcgcggcgctgaccggttttggctattcgctggcctttccggcgttcggcgtggaagcggtacgccgtgcgccgccgcacacccgcagcctggcgatgggggcttacgtggcgtttctcgatatcgcgctggcagtcaccagtccgctggcgggcgcgctggccgcccaccgcggcgtggcttcg

SEQ ID NO: 26892 - DNA, 240 bp, Glycine max
  Peptide Sequence Number=SeqID_143670
atgcagcaaaagctatcaaattgtgcagcaaattttgccaattatgcagaaaaatggttgtgcagtgctagtcacgggaaagatttctgtattaggaaccctcggttaaattttaaggcgatccaatggttaacgaatcggaacgaagagaatgttactgagggtagtttcatgacaaatggaattgaattgtttggatattgtgaaagcttggaggggttgatggggacccggtgctga

SEQ ID NO: 26893 - DNA, 828 bp, Glycine max
  Peptide Sequence Number=SeqID_143671
atgcactttcttattgcatgttggtggctacatgggaggcaggttttgaatgtacccccaacctcacctttgttcggttatttagctcctggtgatgttattctgtcagtagataatgtaaccatcagaaatgcacaggaatggttgaagcttaatacattgacatataacattaagcttaataatgtaaatgtttctcagcgctccggaaacttgggggttatcaacagaatgaaaggttactgtgttcccagttttatgatggatgaaagcaaaattactgaattgctggaaaatcaacatgcttgtcccagtgaacttactgcctttgtaaaatctttatgctctgctaatgttacactggatgatggtcagagcgaaactgatcttttgaacagaggatggaatatgtactgcttaaatgctaaagatgttgtcaaacgctataggtgtggtgatgactggggactagctataaccaagggaggtggctgtacgtgctctcaggatgaattttgtttagctccagttcaggagcctggatcggtatgggttgagattgcatattcaaggacttctcatgaatgtttgtcacatgtacaaaacagatttccattttctgaaacttctggtgttaaggaaactaattgtggtggtacttttatttttgttggcgatgtcatctctatggcacattcgattcagctaacatcatatcagcctcgctggggaccacaaattgttgcatattttccaaatttactggaaaggattttaatatggacatttcatgtctctctggctctggctcttctcaatggtttgcct

SEQ ID NO: 26894 - DNA, 1086 bp, Glycine max
  Peptide Sequence Number=SeqID_143672
atggcgctcaacggcgccagcgaagcgctgatcggcatcgccatcggcatctacggcctggcgcaggcggtgtttcaaatcccgttcggcctggtgtccgatcgcatcggccgcaagccgctgatcgtcggcggcctgctgatctttgccctcggcagcgtgatcgccgccgctaccgactcgatttggggcgtgatcctcggccgcgcgctacaaggctcaggcgccatcgccgccgcggtaatggcgctgctctccgatctgacccgcgagcagaaccgcaccaaggcgatggcgtttatcggcgtcagcttcggcatcaccttcgccatcgccatggtattgggccctatcatcacccacgccttaggcctgcatgcgctgttctggatgatcgccgtactggcgctggccggcattgtcatcaccctggcggtgcttccgcaaggtgctgagcaactcgcgcctgctgaagctcaacttcggcatcatgtgcctgcatatcctgctgatgtcgagcttcgtggcgctgccgctagcgatggaaaaagccggactggcagccagcgagcactggatcgtttacctggtcaccatgctggtgtcattcgccgccgtggtgcctttcatcatctatgccgaaaaatatcgccgcatgaagcaggtctttatgggctgcgtggcggtgctgttttgcgccgaagtgctgctgtggctctccggcgcgcacctgtggggcatcatcgccggcgtgcagctgttcttcatggccttcaacggggcgggcttggtgtttatcgccggcgccgtgttggccgcgctctggttcctggtcagcagcaccatgaaagagccgccgtatgtcagcagcctgcgcattacgctgtcggaactggcggtgaaggattcggcgctggaaagccgtctgaaggcgcagcccggcgtggccgaagcgatcgtggtgccggaagagcgcagcgcctacgtcaaggtggataccaagcagaccaatcgcggtcagctggaagcgctggtcaattcgctataaagcatcagggccggcaatgccggccccgtagagattaa

SEQ ID NO: 26895 - DNA, 120 bp, Glycine max
  Peptide Sequence Number=SeqID_143673
atggtgcccacaaaagaggatgacaaggaaggtggaattggtgccgaggatgcaccggtggctccgggacgtggtgttctagttgccgcagcggaggtggatgaacccttgcgcttctag

SEQ ID NO: 26896 - DNA, 576 bp, Glycine max
  Peptide Sequence Number=SeqID_143674
atgggggcatacgtaaaagatgaaaaattgttgatgcatttcttccaggaaagtcttattggggtagctgtcacctggtacaccaatctagagtcttcccgggtctgttcctggaaagacctaatggttgcctttattaggaaggatctggtagctcaagtagcaccaccaatgatggagaaggagatgataacaatgatagtggacacattaccgttgttctactatgagaatatggtgggttacatgccttcaagcttcatagatttagtgtttgctggcgaaaggattgaagtgggtctgagaagaggcaaatttgattatcctgctttattgaataggaagcctggggcaaatggagagaataagaatgagggagaaacccatgttgtggatgtcattcctacatggccaaatttcccaccagctcaacaatatcaatactcagccaatatcagaccttctcattacccaccaccccatcagccaagaacacccaatcatctacaaaggccacccccaaattggctgcaaaatccacccgatgcacatccaagaccaaaacaccacccctag

SEQ ID NO: 26897 - DNA, 144 bp, Glycine max
  Peptide Sequence Number=SeqID_143675
atgttacttccttcgggcccagaagaagagtcagtatcactatcatggtttttgaccaaacaagtctcgtattcatctgataagtcctcaagattggagattatggcaaataactccacaaatggtagtgatgaattgttgtaa

SEQ ID NO: 26898 - DNA, 531 bp, Glycine max
  Peptide Sequence Number=SeqID_143676
catgggatcaagacaaatgcctccgctcaagaaaaggttctaccaagtcaagatcaagggtctagaggtcaccagtttacaagaatgaagggagttaatggggcagctccagcggcaagccttgcgcaaagcctacgggccttggcaagtcaaaacgagtggcctcctttcattgatatcctagcgttgttaatattcggagtggtcctctttctaaacatggatggtttggtggacctagcagcaattgacgctttcctcgcctttcaccacaacaaggaaagcccagtcgtcgtcgtcttggctgacatatacgacacatttgatcgaagggtttcagtgaccccaacgcaagggtgcttcaaggagtccacaaggcatgagaggtggtgtagagaaaggacagagaacttaggggaagtagcaacgggaccgtcgacggctatcatagccgctaaagaggaagaggctaaagccccagaggaaagcgaagaggtgcaagccctcaaagcagagctcgagaaagcctaa

SEQ ID NO: 26899 - DNA, 972 bp, Glycine max
  Peptide Sequence Number=SeqID_143677
atgtggagcgagcaggcgcatcgggccgtgatccagcagacgttgtctgacgaggatctgtgtgatggtttgctcgacagatgttgtgagccggggtgcccggatgcgcccagaagcgcaggccggtcaccttccggtgtagcagtctccggcggtgctcctaccggtcctctaggtcccgaggggcgcctgctggtcatggacaaggatccggaagccattgccgttgccgagcgcgatttcgcgccggacccgcgcgtgtccatcttccgtggcagcttcgcccagctgctgcagtgggatgcgacggccgaaggcctggacggcgtgctgttcgacctgggcgtgtcgtcgccgcagctggacgtggccgaacgtggcttcagcttcggcaaggacggcccgctggacatgcgcatggatccggacagcggcgaaagcgccgcgcagtggatcaaccgcgtcgaagaccgcgagattgccgacgtgctgtggacctacggcgaagagcggcagagccgccgcatcgcccgtgccattgtggcccgccgcgagaagcagccgttcacccgcaccgccgaactggccgagctgatcgcctcggtgatgccgcgtggcaaggacaagatccacccggccacgcgcagcttccaggccatccgcatccacatcaaccgcgagctggccgatctggaagccgggctcgatgcggcagtggaacggctcaagcccggtggccgcctggcggtgatcagcttccattcgctggaagaccgcatcgtcaagcagtacatgaaccgcctggccaaggcgccgccggccaatcgccgcctgcccgaggcggtcgcgttcgtgccgacgctggacctgatcggcggtgccatcaaggccaccgacgaagagctggccgccaacccgcgcgcccgcagcgccgtgctgcgcgtggcgcaaaagcgggaggccgatgcatga

SEQ ID NO: 26900 - DNA, 828 bp, Glycine max
  Peptide Sequence Number=SeqID_143678
atgcatggcattgccgatatcgcaggctggcgctggcttttcgcgctggaaggcattcccgcagtggtgcttggttgtctggtgctgtggcgcttacccgataagcccgacgatgctgtctggttaactacaccgcaaaaacactggctgcgtcagcgcctcgaacaggacaatctgggtgttaccctgaataagaaccactcctggctgcaggcattaaaagatcgcacggtgttattgctcagtctggtgtggtttttacaggcgttcggctccatcggcattacgttgttcatgccgttgattattaaaagcatggccgcagagcagagcaattttattatcagcctgttatccgccctgccctttgtgatggtctgcgtatttatgtatttaaacggacgccattccgatcgcagcggtgaacgcgcctggcatatgggcttgccattaattttatcgggcctggcattaaccggcgcgatttattcgggcagcctgctgctcgcctatattttgctggtcttgaccgtcgggcttaactttgccctgacgccaatattctgggccgtgaccacagaaaaattagctggcgtagccgctgcggcatcgattgcctttatcaatacggtggcaaactttgtcggactgggtttaccgccgctgctgggaaaaatgaaagatgcgacgcagagttatcactcaggattgctgattgtggcgatagcgctgattgtcggcggtattctcggtattattatcgcccgtccatcgggcggtgccggtgccagcaaaacccgcgcgcagcatgtcgaaaccgggcactga

SEQ ID NO: 26901 - DNA, 370 bp, Glycine max
  Peptide Sequence Number=SeqID_143679
cgaactcagtcatgagcgacacattgtgcctggcgccgcgctggtggtccacgaacgtgtcgatgcgctgtaccgcaagcagggcctggcgccggaaaacattatcgcctgtaacgacatccgcctgattcgcagcctgatcgcgcagggcaccggcatcagcgtgctgagcctgctggacgtaatgaccgaggtgcaggagaaccagctctgctttgtaccgctcaggcacagcgtgatgcgaccgctgaccctggcgctgtgtactgcgccgtcgcgccagctgtcgcgggcggcgcagatggtgattcagcgcatgaccgaggtgatagaggcgatggccagcgtcaggcccgcaggcgggccgtaa

SEQ ID NO: 26902 - DNA, 555 bp, Glycine max
  Peptide Sequence Number=SeqID_143680
atggatggcgctaaagcgcgcgacctatacccggccgtcggggcaaggaccaagcccccgatgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 26903 - DNA, 312 bp, Glycine max
  Peptide Sequence Number=SeqID_143681
atgaagcttcattctctagctagttaccttagccaggagatactggcagagcaagaagttgatagagtgcatggattacctgcgcagcatccggtgaagttcaacaatatggtggttatatcactgtcaatgaaactcaaggaagagcactgttctattggtttttcgaggccactcacaaaccagaacaaaaacccgttctcttatggctcaatggagaatcacaaaccagaaggtcaggaagtgagtgcagtaggagtaaacattgataatcacatgaatgaaggcagtggctggattaactcagcataa

SEQ ID NO: 26904 - DNA, 201 bp, Glycine max
  Peptide Sequence Number=SeqID_143682
atgacggcgacagcgacgaagtctatttcattgaagcccttaggaagagacgggaccgtgaggcgccatttggcggaggagattccgattgtggtgcctaggtacgccatcaagcctctagcgacaatggcattggaaagtaataaagtatttttaaagtttacctacactaagttcgggtttgtagataaaggtgtatga

SEQ ID NO: 26905 - DNA, 1125 bp, Glycine max
  Peptide Sequence Number=SeqID_143683
atggcgaaatcggtcgaagacacgctgtttttccgcaatcacgtggcgctggcgatcaacgaagtgggtgccgaaccgctgccgcacgcgttttcgcttgaacgctttcatcgcgaaatgcaaacccgcttgcagcaccagccggatggcctgtcgggtacctccacgcacgataccaaacgcggtgaggatgcacgtgcacggctgtataccctgagtgaagcgccggcgctgtgggcggagaacgtgacgcgctggcgccagatgaatcagccgcacgtggtcgcgctggcggacggaccggcgcccgaaccgccggttgagtggatgttgtaccaggcgctggcgggcgtctggcccaccacgctgcagccggaggacacggcggcactggacgcgctgcgcgatcgctttttgccgtttgtggaaaaagccctgcgcgaagcgaagttacgcaccgactgggcggacagcaacgaagcttatgaaaatgccgtgctggagtatgcccgccagctgctgtcacccaccaatccggcgtttctgcaggacttcagccacgcactgcagccgttcatccgggccggactggttaacagcctgagccagacggtgatcaaactgaccgcgccgggcgtgccggatatctatcagggctgcgaagcgctggatttcagcctggtcgatccggacaaccgacgcgagccggatttcgctcagctgacggcgcagctggatgtccacgccgcgccggatttcgccagccagcaggactggctgagcggccggctgaagcagcagatggttgcgcgcctgctgcatctgcgccgcgaccatgcgcagctgttccgcttcggtgattatcaaccgctcagtgcatcgggcgaacatgcggaaaaagtgatcgcctttgcccgtcaggacagcgactacgcgctgctggtgattacgccacgactgattttcaatggtgcacagtggagtcatacccgcctggcactgccggaatcgctggcgcatcgccactatcgcaatgtgctgaccggcgagaccgtagtgattaatgacgatgttacgctggacaatgtgagctatagcgcgccgctggtgctgattagccagtag

SEQ ID NO: 26906 - DNA, 2076 bp, Glycine max
  Peptide Sequence Number=SeqID_143684
atgtctaacggtaaacctttagaaatcaccgctggatcggggcaccagctcggcgccaactttgatggggacggcgtcaattttgcgctgttttcagcacacgcggaacgggtcgaactctgtctgtacgatgagagcggtcagcatgaaatcgcccgcttcgatctgccggaatatacccacgaaatctggcacggctacgtgcccgggctgaaacccggcgcgctgtatggttatcgcgttcacggaccgttcgatccggaaaacggtcaccgttttaacccgagcaaattactgattgatccctacgcccgcgagctgcagggcaacatcgactggaacgaagcgcacttcgcttacgatttactgcacgaagataaagatctgacgctggatacccgtgacagcgcgccgtttactcccaagtgccgggtgattgacactaatgagtttgactggcaggaccataaccggcccagcattccgtggtccagcacggtgatttatgaaacccacgtcaaaggtttcaccctgcttaatacggcgattccggcagagatgcccggcccctatgacggcatgacccacaaatccaccgtcgactacctcaaaagcctcggcgtgacgtcagtggaattgctgccggtgcactggttcccggacgaccagcatctgctggatcgcggactgaaaaacttctggggctataactcgctggccttttttgcgcctgccagccgctatttcggcccgcgcggtattcagggctttcgcgacatggtgcgcgctttccacgatgccggcatcgaagtgattctcgacgtggtgtataaccacaccgcggaaggcaacgaactggggccgacgctgtcgttcaaaggcattgataacttctcttattaccgcacgctgccagatcagcatcgttattacatcaacgataccggcactggcaacacggtgaatacctcccatccgcgcgtgctgcagctggtgacggattcgctgcgctactgggcagaatcgatgcatatcgacggttttcgcttcgacctcggcaccattctcggccgcgagccggaagggttcgatcagcgtggcggcttctttgatgccatgacgcaggatccggtgttgtctaagctgaagctgatcggcgaaccctgggacatcggcccaggtggctaccaggtgggtggtttcccgcccggctgggctgagtggaacgacaaatatcgcgacacggtgcgtgagtactggaaaggcgacaacgtctcaaccgactttgccgcgcgcctgcttggttccggcgatctgtacgatcaacgcggccgccgcccgtgggccagcgtcaattttatcaccgcgcacgatggctttacgctgaacgatctggtctcgtacaacgacaagcacaacgatgccaacggggaagataacaacgacggccataacgataaccgttcatacaactacggtgccgaaggccccaccgacgacgaaggcatcaacgcggtgcgcgagcggcagaagcgtaactttctcgccacgctgtttttctctcacggcaccccgatgctgctggcgggcgatgagtttggccgcagccagatgggcaacaacaacggctattgccaggatagcgagatttcctggctgcactgggaagatctgccggcttccgctgatgcgttacgcgattttacccgtcagatcatcgcattgcgcgcgcagcagccgctgctgcgacgcgaaagctggcgcgacggcatggagattaaatggtttaacgctggcggcggtttccagcaggcggaacagtgggacgagggctcgacgctcggcgtgtacatcgggcgtccggacctgcaaactgaagaaggtatctggcacgatgtgctgatgctgttcaatccttttgaaggcaatgtgccgttccgcatcccgcagtttggtgaaggcggctgggtgctggagctgaccacctccgacagcgccagtaagggattggtgattaccaaagagaaggatttcgagctggagggccgcagcctggcgctgttccgccggccgtga

SEQ ID NO: 26907 - DNA, 1278 bp, Glycine max
  Peptide Sequence Number=SeqID_143685
cgtgactggcagggacggccgtggcatgaaacggtggtctacgagttgcacatcggcacctttaccgccgaaggcaccttccgcgcggctatcgaaaaactccccgcgctggccgacctcggtatcaccatgatcgaagtgctgccggtatcgcagtttggcggcacgcgcggctggggctatgacggcgttctgctgtatgcgccgcactcggcgtatggctcaccagatgatttcaaagcctttgtcgatgccgcgcacgcattgggactgtcggtggtactggatattgtgctcaaccactttggtccggaaggcaattacctgccactgctggcaccggcctttttccacgaagagcgcatgacgccgtggggtgccgggattgcgtacgatgtggacgccgcgcggcgttatatcgtcgaagcgccgctctactggctgaaagagtttaacctcgacggcctgcgctttgatgccatcgaccagattgaggacacgtccagcaagcatgtgctaatcgagattgccgaacgcattcgcagcgaaatccactctcgtccgatccatctcaccaccgaagacagccgcaacgtgatcttcctgcatccgcgcgatgcggacggtaacgcgccactgttcagcggggaatggaacgacgattttcataatgccattcatgtctttgccaccggcgagacgcacgcgtattaccaggatttcgccgacgtaccggagaaattaatcgcgcgcattctcaccgagggctttgcttatcagggcgagctgtcaccacagagtggccagcggcgcggcgtacccagcgcaggccagccgccggtcgcgtttgtcgatttcatccagaaccacgatcaggtgggcaatcgcgcccagggcgaacgcctgattagtctggccggtgtcgatcgcaccaaagtgctgctcgccaccctgttgctgtcaccgcatattccgctgctgtttatgggcgaagagtacggtgaaaccaacccgttcctgttctttaccgatttccacggcgagctggcgaaagcggtgcgcgaaggacgtgcgcgcgaatttaccggtcacgccggtcatgacgatacggtaccggatcccaacgctgaagagaccttcacgcgttcgaaactggactggggcaaagtggaaaatcccgcaggccaggcgtggctgacgcttacgcgccagctgctggcgttgcgccagcagcacatcgtgccgctgctggcggatgcccgcaggcataacggccag

SEQ ID NO: 26908 - DNA, 536 bp, Glycine max
  Peptide Sequence Number=SeqID_143686
atggcggaatatacattatcggtttatctggaaaagagtgaattcaatcgcggccctcatcttgatggcgcggagggtgcagaggcgatagccgcctttattttgcggcctgagcatgaggaagcactggctagcggattagcgcattttaccggattacccctgattgatctgcgcggagacagcgcggtagtcacctcttatttacatgaatcgctgggagttaaaacgcattgcgggtcaatggaaaattcatcgcaggacgttgattccggtggacgtcatgcagccagaccacgatgtgcagcgacgtcatcaatgataatccgctacgagactggcggcgcaggttggtgtccagcatggcaacagtctggctattcctttcagccaaatcctttggtgatgtacttgccagtaaccaccggaacgatgaccaataaacctgatttgaccgttgacgatattaccgtcattgacaacaaattattgaaacgcgccgtcagcgccgcagcgctgggtaataccatggagtg

SEQ ID NO: 26909 - DNA, 236 bp, Glycine max
  Peptide Sequence Number=SeqID_143687
atgattaacagcgcggagtatctggctttacgggcttttgtcgtggttgctcagcaactgaatttcagagccgctgcggaaatactaggggtatccgcgtcagccgtcagtcagcaaatcaccgcgctggaagcacaactcgggcaacgtttgctgaaccggaccacccgggcggtatatcttaccgatgatggcaagtccctgtttcttcagactgcacccattatggctaatct

SEQ ID NO: 26910 - DNA, 2964 bp, Glycine max
  Peptide Sequence Number=SeqID_143688
atgaccggcattccgattgcgctgattatcggcacgccggtttccagcctgttgttagagctgcacggatggctggggctgcgcggctggcagctgatgtttctgctggaggccattccggcgattgcgctgggattgatcgtcccctttgcgttgcccgatcggccggaagatgcccgcttcctcagcgcagatgagcagcactggctggtgacaacactggctgctgagcggcaaaaactgccgtcgcgcggccacggcggtctgctgaaagcgctgttcagcccgctggtgttattgttcagcctcacctattacggactggcgaacctcaacggcgcggtgagcaccttcctgccgctgatcatcagcgaaaccggcttaagtcatgttcagaccggattcatcaccatcatcccttacgtatttggtctggccggcatgctggtgctgggacgcatagccgatcgtcccgggtcgcgtctgctggccaattatctggcgctgatcttctcctttgtcgggctgttatgcgttgcgtggttcgataactcgctggtgaaaatgatgtttttgtgctgctcggcatttggctttttcggcgcgatgccggtgttctggggattgcccgcgcagtttatcccggcgtccgtagtggcgggtggcctcgccctgatcaatgcgctgggcagtattgccagtgtggtgaatccgtgggtcatcggcgtgatacgcgaccgcagcggcagttataacggcggattttactggctggcggcgatggcgatgctctcgatcattaccctgagcatcatcttccgtcgtcagcgtttaccggcttaccaggccagcaatgaacaacgcgtgatgccgggagagggcgatttctgggaggagcgtctcgcgcgtcccaccgatatctatgcgcagtttcgtaccgtgaataatcatgacggtggcgttcagctggaagacggttttgccattaccaccgtgtttcttgagatcgtttctgatgagggcgtggacgggctggcagggccggtgccgcatgccgttgcatcaatcattcatggccagctgcgaccgttgttgctgggtcaggatccgcgcgacaccgagcgtttgtgggatcagatgtaccgggcgcagattcatgggcgtcagggcgatggcatgctggcgatcagcgcggtggattgtgccttgtgggatttgcgtgccaaatggatgcagcaaccggatatggcgcgggtgcacgagcgggcgctggagtataaggcgctgggatatcgcggacaaaaatggtttttccgccacggcccgatgagcggcagagaagggctgaagaaaaacatcgaactggcaaaaacgctgcgcgaagccgtgggggatgattacgatctgatgtttgattgctggcagtcgatggatgtgacgtatctgcttgaactggcaaagggcatcgagccgtatcgcccgcgctggctggaagagtgcgtaatggctgacagaatcggcagtatgcaacgactcaaagataaactgtcgatcccgatggcgggaggcgaacatgagtacacgcgctggggcttcaaacgcttctttgaatccggggcgctggatgtaattcagcccgatatttactggtgcggtgggctttcagaaacgctaaaaattgccgctatcgccaccctgtacgatttgcaggtaatcccgcacggtcattccagcatcgcaacggcccatttcagcaccacgcaatcgccgatccacacgccttatcaggagtatctggtgaaatggaacgatattcatcagtacttcctgcgcgatccgctggtgccgcaaaacgggttaatcccggtaccgcagggacccggcatgggcatggcacttaatccagcgcatattcagcagcagacatactttgcccatcgtcattctgaccccctaaatgctcgctgtttaaaggacgctcgccacgctatgcccgccgataaactcatcattgactggtcatcgaaaaacatcctccgcccgcagtcattgagcagcattctggccgatcatattcgggacctgatcgtgaattgccagattgcacccggtgcattaatttccgagaacgacattgccacccagcttaatgtgagccggacgccggtaagagcggcgctgcaaaagctggagatggagcgtctggtgcaaattatcccgcagcgcggcacttttgtgttttcgttcaatgagcgggagatgcgcgaaacctgtgagatgcggcaaattctggaatcaggcgcattaaagctggcgctgcaacacgatcgtcaggcgctgatcgcgcgcctgaacgaacagctggcgcgtggacgcgatgcattacaaaacgcgccggagacctaccgcgaaaccgatgcggcgtttcatatggcactgattgaagccagccagaacagcgagctggtcggtttttacaaaaccagcatcaaccgcattcgcgcctttctcaatcacctgacgcgcacgccggatgagtttcagggttcgcaaaacgatcatgaagcgatcgtggcgcggttaactaattacgaggatgaacaggcgctggaacttctgcactggcatcttggcggcattatgcgcatgttccagcgtcagaacatcgctgaaaagcggtcacgcctcaagcgctgcaaccaccgccagacccgccagctccgcgctggccagcagttgctcaacgctgtggccctgacgcgctctggcagaaagtccggacatcacggtgctgacaaaatcggtcaggcgctgcgcgtcttgtgggtagcgggccgcgatatagcaccggatggtgtcctccgcggcgcgatgaaacaccctggccgcctcgcgcgcctgctgatcctgacagcgaatcccttccagcaccaggcaacccgtaaacagctcatccccggcata

SEQ ID NO: 26911 - DNA, 508 bp, Glycine max
  Peptide Sequence Number=SeqID_143689
attcagtggaaatccatgtgaaagtcttggatcactctgtaaattgtcatctctttggattgatggcaataattttcaaggagttgtcaaggaagatgatcttgcaaatcttacaagcttgacggattttggtgcatcgggaaacaatttcactttaaaagtgggtcccaattggattcctaattttcaacttacctatttggaagtgacatcatggcagttaggtcccagctttccattgtggattcagtcacaaaaccaacttcaatatgttggactatctaacacggggattttagattctattcccacttggttctgggaagcacattctcaggacaagccaatgcaattagaatttctcaatcttgcatcaaataatctgtcaggagaaatacctgattgttggattaattggccatttctagtggaagtgaatttacaaagcaaccattttgttgggacttccccccatccatgggttccttggctgagctgcagtcattag

SEQ ID NO: 26912 - DNA, 258 bp, Glycine max
  Peptide Sequence Number=SeqID_143690
atggcttccaactcccaacaattcagtgcaagaaatgatgctattgtccttagaggagtccataaggtggccacagattcatcttcatctactgaaaataaaaagcttgagggaaaacttgatgccttggtcaacctagtaactccgcttgccatgaatcacaaatctgcacctgttgcaagacaagaaacaagagcctccattcagggtctgacaaatcagatgggtcagatggctactcagttgaaccaagcttag

SEQ ID NO: 26913 - DNA, 885 bp, Glycine max
  Peptide Sequence Number=SeqID_143691
atggaatcaagcaatgtgaagaacaagtcaagtggaaaaagaaagatgtctagtgaggacacaagaagttacttcgcatggaacttggaaatggagcgtgtgctagctgatgtgcttagagatcaaagaaatttgggcaataaaggtgatagaaattggaaagcagtagcatatagtactgcagctcaaattttgtccaagcattttggagttcacctcatggcagataatgttaagaatcattttaggctttggagaacatggtatggaattgtgagtgacattcttagtcaaagtggatttgactgggatagcacaaagtacatgattaccgttgaaaatgaaattgcatggaatgaatatgttaagtcacatgaagaggccaaacgatttcgattcaaagtcattcctaattgggatgatattgttgacctatgtgcaaaggatagagctactggactcggagcagaaaatgcattagatgcaaatgatatcatgagcaaagaaacaaatgaagaggaagcaattcatagtgtgagttttgacttagagggatcaagttctgccacgagaaaaaacattcgcccaagtaagagtggagagaaagaagggatgatttcctcaatgaaagaagtagccgagtcattgaaagaatttgttgaagtgactaagaagaagatggagaacaaaaaaaagatggagataaaagaagttcaagaagcggtacatgaagtggtgagtgagctagataatatacctaattttaatggtgcacttagacatagagcaattgattggttgacagaaaatctcattaagtttgcgattataaaagctcttccattggatgagaaaaaagattacatcttatcttttatgccttga

SEQ ID NO: 26914 - DNA, 894 bp, Glycine max
  Peptide Sequence Number=SeqID_143692
aggactacacgtcatcacatccagagggctacacgccccacctttagaggactacacgtcctcgccttcagagtgctacacgtccttgccttcagagggctacacgccctcaccttcgaaggactacacgtcctcgccttcagagggctacacgtccttgccttcagagggctacacaccctcaccattagaggactacacgtgctcgcctttagaggagtacacggccttaccttcagagggctaaacgcactcgccttaaaaggactacacaccctcgcctttagaggggtagacgtcttcgcctttagagggctacacgccctcaccttcaaaggactacacgttctcacctccagaggactacacaccctaaccttcagaggactacccgccctttccttaagagggctacacgccctcgcctttagagggctacacacgctcaccttcagaagaccacatgtcctcaccttcaaaggacaacacgtcctcaccttcagaggactacacgtcctccccttcagaggactagacgccctctccttcagaggactacacgtccccgccttcaaagggctacacgtcctctccttcagaggactacgtgtgctcaccttcagaaggctacacgccctcgccttcacagggctagatgccctcaccttgagagtactacatgtgctcgccatccgaggactacacgcccccgctttcgtggggctacacgccctcccttcagaggactacacgtcctcgccttcagagggctacacactcttgccttcagaggagtacacgtcatcgccttcagacgactacatgtcctcaccttcagaggattacacgtgctcaccttcaatggactacacattctcggcttcagagggctaa

SEQ ID NO: 26915 - DNA, 203 bp, Glycine max
  Peptide Sequence Number=SeqID_143693
atattcctaagatatgtttctaccgactgaccgttgggatcttgaaaacaataacttttggtctcccgcaaagcgaggatagcgcgttaagcacaatcccaaccgaggggaattgcgctaagtggcccaaagccgcgctaagcccaattccaaccgagaggaagtgcggtgagcgcccagaaggtgcgctaagcgagccttag

SEQ ID NO: 26916 - DNA, 639 bp, Glycine max
  Peptide Sequence Number=SeqID_143694
atgcatctggattttcagcttgtcgcggaactgatgctgcagattgaacagcatggcgccccgcatcctcccgtcgcgccgcaaagcatgatgtcgagccccatggacggcgcggtaaaaatggccgtacttcgcttacttgaagtcctggctaacccgcttgaggcggcaatcctcggcccggcgcgggtgcgtgagctttattttcgcgtgctgacaggcgcacagggcaacgcaatgcgtgccgcgctggccttgcagggccagtttggcaaaatcggtaaagcgttgcagcacatccatgccgcttacgcggagccgttaacgctgacgcagctggcgatgagggccggcatgagcgtgccgacctttcatagccatttcaaggcgataacgcagatgccgccgatgcagtatgtgaaatcggtacgcctgcaccaggcacggatgctgatggtgcgccaacaaatcaccgccgccgccgcgagttacgccgttggctatgaaagcccatcgcaatttaaccgcgaattcaagcgtctgtttggcctgccaccggcagaggagataaagcgtatgcagcatcacttcgccattccgcccgcgcagcctgcctcggtatttgtttcatcgcactga

SEQ ID NO: 26917 - DNA, 330 bp, Glycine max
  Peptide Sequence Number=SeqID_143695
atgccggatagcggcagggagaagcggacccaaaaagggatagtggatagtgggatgaccaacttttttaataaacccctatttgacatgaacagaataccccccaaaggatatcaacagcaagagagcagagaaaaatgtttcagagtttcggagtacaatggttggccagaaacatcgttgggagctctgggtcagaactcagaaggtttgcatagaagagagaagacatcaatgtcatttagccttccaaaggcatgtgagtggaaaatagggttagataaattaaaaagggtgaaacgcgaaatcccaagattggcccccacttaa

SEQ ID NO: 26918 - DNA, 282 bp, Glycine max
  Peptide Sequence Number=SeqID_143696
atgggccgatgggctctatattgggcagtgtatacccctatccttacgggccgtgattgctatttgtttggaaaaacaaaaagagctatgattaagaaatccatgttgagaggcatcatgtttccgggaatgttcatgcgcaagcctgacaaagctgcagcactgaagcagctgaaatctcacgcggccatgttcgggacatgggttgttgttattcgagtcaccccttacgttcttcactttctctgcgccgagaaagaggaacttaagctcgagctttag

SEQ ID NO: 26919 - DNA, 1203 bp, Glycine max
  Peptide Sequence Number=SeqID_143697
atgggaaaacaacccactggcctcaacttcaccaacgacgccgacgtggagcagagcagccaccacaatactcgtaaaactactctaaaactaaaaccctattcctctgtttttgttattcccacgatgatgcctccttctcagccacctcattgggccccatctcccacaccaatcctcagcaagtctttcctacccccgacgtcaaactcgccggcggttgacttcactccgcccttaatagcaatggtcgtcgtcgtcgccgccgcgtttcttgtcgtcacctactcccgcctcatcgcgcgccacctcagaccacccgtccaccgcctcctccgccgcttccgacgccgccgcttcctcccctcctccgtcggcgacctcgagtccctcccctacgattctcccttcgacggaccgcacgtgttctccccctacggtttggacgaaacggttattaaaacaatcccgttctcgctttatacagcgaaatacgacgcgcgttttgatgagtctcgctacgactgcgccgtttgcttgctcgaattcgaagacgaggattacgtaagaacgcttcccgtttgttcacacacgttccacgtggactgcatcgacgcgtggcttcgctcgcacgctaactgtcctctctgccgcgctggagttctctgcaccgattcacctttcactccgatgatggccgctagaatccgaccgagcctcgacgacgacacaattctccaccgtatcagtatagatcctctcatcgatctgccgccgcagcctgcgtcggcggtggctatatcctccgtgtcggagattactccctgcgtcgacgagaacactccgaggaggaaccagaaccatgcgaacgttaactcagaggattgttttagggattttctgctgaagaggtcttactcgtttggatttgaacggagtctggcgtcggagaggatggtgatggaaccggcgacggcgtcgccgtggcgggatgaagtcaccgttcttccggaggaggggttttttcccgttgtcggagtcgagcgtgaggtacggcagcggggggagctcgtcgcggcggagcaagtcgatagcgagtccgatgtttctgcggtcctcgggggtggcagccgcggcggcgttctcgtcgagccggctgaggtgcggggatcccgaggcgctgctgtcgccggagaggtttaa

SEQ ID NO: 26920 - DNA, 294 bp, Glycine max
  Peptide Sequence Number=SeqID_143698
atggatggactacctggctctgtgggcaccagcgctagcttcagtctgagattgggtcagaccatgttctcttctgcttcccttctctttatgtctctgggggttgaattctacagctacacggctttctgctcaaaaacaggagaaagagtaattaattttatgccaaggatgatattggtggatgatttatttcttagcaagattcctcttggagtagacatttctacttatgggtcaggttgcttaatcttagtgctgtcatttctttatggactggcggaagagaattaa

SEQ ID NO: 26921 - DNA, 1002 bp, Glycine max
  Peptide Sequence Number=SeqID_143699
atgacggtagcagcaggaatgggttacgctctgctagcgttaggaccctctctctccatcttcgtttctgtcatttccaaaaaacccttcctcattctcaccgttctctccagcacactgctgtggcttataagtttgattgtgctgtctggaatatggaggggggttttgcctctcaacacaacagcttggtggccttttggaatactcattttctcatctgttgcttttcaagaagccctcaggcttttctcctggaaaatatataagaggttacaagatatgttagatgcctttgctgatagaatatcaaaaccacatcttcacctgacagataagatgctgattgctctggctggtgggttgggtcatggtgttgcccatgctgtgttcttctgcatcagcctattaactcctgcatttggtccagcaacatatttcgttgacaggtgttcaaaagttccatttttccttctttctgcgattattgctcttgcatttgtcacaatccacactttctcaatggtcatcgcatttaatgggtactcagaggggaacaaagtggatcaatattttgttcccattgttcacgttgtcgctggaatggtgatttgtgaagttggcaagatgattaaccccaacatggtaggatgtagagaaaggaaacagtccaaacaaagtataactctggtgaatttggcccctggcggttgtgctgttggcattcctcttctttatttggttgcaatcttgaccttgattcattgtgggaggatggtttggagaaaattgacagaaaacccaatcaggctggttcactcgtattgcttagtgctcgctattcctgttggaatacacaggataccaaaagttataatgcacaataggtttttccttgacgttatgctcccatctttttacaatgggttactattcggggcctcaagtcaactttctgcatttgtcagtttcacttgtcgtcactgcagtcaggcttactga

SEQ ID NO: 26922 - DNA, 1602 bp, Glycine max
  Peptide Sequence Number=SeqID_143700
atgggaagctgcatatcaacgcaaggcgtgagaacacgcaagaggtcgaggagcaagaattacaagccctccacgccaagagggcacgagccggcgcgaaggtcgagcgtgacggcgcgtccgctgaacgtggtgtcggggccgagtcctgggaacatattcgacaagtaccagttcgggaaggagctggggcgcggcgagtttggcgtgacgcaccgcatcgtcgacgtggagagcggggaggcgtttgcgtgcaaaacgatagcgaagacgaagctgaggacggagattgacgtgcaggacgtgaggagggaggtgcagatcatgcgccacttgcctcagcaccccaacatcgttgcattcaaggaagcttatgaggacaaagacgctgtttacctcgtcatggagttgtgtgaaggtggtgaattgtttgataggattgttgctaagggacattacaccgaacgtgctgctgctgatgttgccaaaaccatacttgaagtttgcaaggtgtgtcatgagcacggagttatacacagggacttgaaacctgaaaatttcttatttgcagattcaagcgagactgctccattgaagtcaattgattttggcctttccaccttctatgtgtctggggaaagattcagtgaaattgttggaagtccctattacatggctcctgaggttttaagacgtaactacggaccagaaattgatgtctggagcgcaggagttattctttatattttactttgtggagttccacccttttgggcagaatctgaggaagggattgcacaagcgatcatcaggggcaaagtagatttcacaagagatccttggcctaaagtttctgatgaagcaaaacatctagtcaagcgcatgcttgatccaaatccattcacccggataacagttcaagaagttcttgataattcctggatacaaaatagggagcatggtcgaactatttctcttggagaccaagtaagaatgaggatcaagcaattctccttgatgaacagattcaaaaggaaggttcttagagtggtggccgataacctgtcagatgagcaagttgatgtgtttaagcaaatgtttgatatgatggataaggacaagaatggaaacttgtcatttgaagagctcagagatggcctttcaatgattggacacgccattcctgaccctgatgtccaaatgttaatggatgctgcagatattgatggaaacggcaccctcaactatgatgagttcatcacaatgagtgttcatctgagaaagatagaaagtgacgagcatctctctgaagcgttccgttactttgacaagaaccagagcggatatgttgagtttgaggagttgaaagatgccttatcagatgatgacttggaagccagtgacgaccaagtggtcaaagacattctaaatgatgttgatttggataaggacggtcgaatcagttttgaggagtttaaggcaatgatgaagacaggaggagattggaaattggcctctcgccaatattcaagagcattgttgaatgcattaagcttcaagatgttcaaagacacatctagcaattctgttaagtgtaactaa

SEQ ID NO: 26923 - DNA, 1029 bp, Glycine max
  Peptide Sequence Number=SeqID_143701
atgtgcagagtgcactcgcaaagcccacatccatggcttagcgagtttgtacattctaggcacacacaggttttttgggtttttgatgaacacgctaagcgccccactagtggcttagcacgagctcaagttctgggctcaattgatgaatgcgctaagtgccccactggcggcttagcgcatgttcgaattgctggaaaagggcttagcatgcagtctcgcactaagccccaatggcttccaagagatggcgaatcggacctagccaggcatatggagaggattccacctgggactcctctcaagtcatctcagagacagtgtcgcaacctaccctacgatgggagtgcgagtgaaaagccaaaaagttgtttatgcatgtggaagggtgttgcccttgctcctatgtatcctcaggccttttcaccccttgatcagcctcccttcacgcctatttataggaaaaacaagcatttaggaccatggcagctcgcccaggcaaactggagttcgccccggcgagctatttacttaacatggaagtcttttggtggcccaagtgagccagaggctagcctaggcgagctagagtccagaaaattccctaaaatgacccttttgcccctccctgggggagcagctttctacctactcccagtacctccacacctatccagattatcaagccattgcggccaagctgtgcaccccaggaggatgatttttgctgaatgtcgagggagctctgtggaggattttgtggaaggacctcaccactttggcttagtcctggacgtgctttcgtacttcaacatcgctccaacctctcacacttctgacattaatgttgaccgagcttgcctgatatgtgggctcatgatgaaaatggacatggatttgggcaacatcatttcacagcaaattacccagatagccagtccagcccacgctactcaggatgcaccaccagtcatcccacctcttgccgcaccttttcctattggctcttcctcttcctcctcaacctag

SEQ ID NO: 26924 - DNA, 801 bp, Glycine max
  Peptide Sequence Number=SeqID_143702
atggtcttagaatcagacgattattctgaaatagatctttttaaacaaatccaaaaagccaaacagaccaaaacagttaatacaaatccaaaaagccaaaagaccaacatccctcaacaagacaagaaagactatattgatgcctggactaatgtgttttggcatcagaacaacaaatacaaacattcatggctaatctacttcaaaaataataccgtttacaattttccgaattggtttacccaatggtggacttatttcggtccgattccacaaattttccctgaagaggtccaacaaggattccaacaattttgcaaatttttcaatagccaggaatcaagaatcccgaccgatttgatgtacttttccaactttgcgctatcatggattttttcatggcagtacaggcatggaaaaacagaaaataataaacaatacccacctttgcaaagacatgcatttgtcaaatggtggactcagtttgatacttcaaaggcggctcctgaccaagtcaagaactggtttcagagtcaccctgaattgctcaagccagctaacccagaaacatctctattttttaaccaaaaatctcaactcgcagcatttctggcaagctccaaatccaaggatagtcttgcaaagaacctcaaagaagttctccaaatgcttcaacaagaagaagaagatgaatcttcaaagaaagaagttgaatcttctgaagattttgatgaccaagatgatgatcccttctaccagaatgaggatgactatttcggcatctcacttgaagaagattaa

SEQ ID NO: 26925 - DNA, 333 bp, Glycine max
  Peptide Sequence Number=SeqID_143703
atgtctcgcaaagaaaatatgatatctgagttacacaccagaaaaggaacatggaaaatagctgtgcgtatcactgatctttggcaagctcgaaagcaaaatagtaaacaaacaattgagatggtgttgatggaccaaacgggttcaaaaattggagctactctctaccaagaactcttcactgaattgcgggacaagttacagtgtggttcttcgtatttgattcagaacctgaggattgttgacaaccaatctgaatacagagtcagcccaactccatatttggtttatttcctaaaaactacattcgtcaaggaaattcatcgtccataa

SEQ ID NO: 26926 - DNA, 405 bp, Glycine max
  Peptide Sequence Number=SeqID_143704
atgcaagaacatccactatatgcaaagttgagatttaaaacactttcttttaaagaagaattagatgcattgttcaaggatgtgatggctatgaggaaattcagttatgcaccttcttctaggacattatccaatcctatacaagaaattgaagatttgcatcgcccatccttcgaaaatgacaatgtagacctagaggaagcattaggggatagtgaagaattagtactagctgctgcaaggatagttggtgcaataggtagaattgcttgtgcatctaagtcgcgttcaactacccttaacacactagttgttcttggcacatcaatttctaaagtgatggaggaaatggacaaaatagaggaaattacaagtgatgaggattggcatgcccgatgctcttaa

SEQ ID NO: 26927 - DNA, 330 bp, Glycine max
  Peptide Sequence Number=SeqID_143705
atggaatgcacgcacgcacgctctcgctttgtgttgttctcttctccgtgtgagtctgataaagagaaaacccaaatgggctcgctagttcgggttgttgggcctcattgcgtcaaacgttgcagggatttgctaggggcacccagcagcattgctggtgcacccagcaaattttcaaaatggcaaaaatgcccttcagcctttttgcgaactttcttcggctggcactcgcggaagaagaactgcggaagaaccatcttccgtggaactacgcggaagaacttcttccgccagagtcaacggaagaaggttcttccgtgggttaattag

SEQ ID NO: 26928 - DNA, 267 bp, Glycine max
  Peptide Sequence Number=SeqID_143706
atgtgcatgggagaaggagtggttgctagagaagttacaggaggggaaattgtaggctgtgccggaaaaggagaagcaaataacgaagttgtcaagggagagattgagcagaagaaagccaaaattgaactagtgacagaaaagactgaacaagtgaccaaaatgaatgagtacgtggtgaccaagaatatatggcagaagaaaacaatgaaaaatataagacaacttctaaaaatcatttcaatccctaaacatatttatttttaa

SEQ ID NO: 26929 - DNA, 207 bp, Glycine max
  Peptide Sequence Number=SeqID_143707
atggacgaagatcaatggatgtatgatagtataatatcggaagaagttgatatggatgatcaaaatgaacaagaatgtggtgtgaatgaacaacatgttgattgtttggatgcgtttaatatttctcaggtgtttgtacccgagatgatgttttgcagtgggctcaatccattgctcatgaaaatgaatttgtggcggtcattatga

SEQ ID NO: 26930 - DNA, 495 bp, Glycine max
  Peptide Sequence Number=SeqID_143708
atgacagtctctgatttcactgttctatattcttccctcatgattggttttggggattgggccctgaaggaagaaaaatatgctgcccgccgatccatactgcccgtgctacaggctgaagaggatgagagatttgttaaagagtggcataaatatctcgagtatgaggcagaagtgatgaaggatgtgcctggttggaaagttggtgaaagtgtgtatcactctagtagatgggtgcccccagcaagtgctgctttgcgaaattttaaaacaagaatgcattttgaatttgtactttatgtggcatggcaatcgcacctctctctgatgtataccaccagtatgactgcacattcttggcataggaaattgtactgcatcgaagctctgatttctagaagaataaggtggaaacttaattggggtaaagaagggttaattccaacatttctcaaatcgtcttggccattgagcaatttggaaaatctttcatga

SEQ ID NO: 26931 - DNA, 150 bp, Glycine max
  Peptide Sequence Number=SeqID_143709
atggtgctgttatctcacgtaaaaaatggcctggccaaaggggaaaccaccacggagggtggtgcctcgccctcggcaccactagtgcaagatccagcgatgcaaggccacctcgaggacaaggatggtcatgcggcagggacactatga

SEQ ID NO: 26932 - DNA, 426 bp, Glycine max
  Peptide Sequence Number=SeqID_143710
atgccggaggtgtacaccgtgaaggtggaagaggcaaggccagcaactcatgaaaagccatcagcaggtcctgtctacagatgcatttatgccaaggatgctttgactgttttaccttctcattttgaatctccatgggaattcttcagggtcaagataggttggtctagaggtggagcaaggatggctattattcagttcggacagcttaccatagtgctcgtacgtagtcaggtagcaagggaccaatacaaggtgacaggaaactggaagcatttgtggaagcttaagttaccctcgaatgtcaaacatttcctatggagggcttgtcaggattgcttgccgacgagactgaagctacaacaacgtgatgttgagtgcccgagctcatgcatgaactgttctgcaggcctagaaaatggctag

SEQ ID NO: 26933 - DNA, 225 bp, Glycine max
  Peptide Sequence Number=SeqID_143711
atggcaaggggaaagggatctccatctccattgacgacctcgacgactttcaagggtgatgacctcgtcgactttcgagcccgacagcagtggcccgatggagcgatgttgatggctccagggctgggcactggaggcacaatgagcggtgctggtgacgcaatgagtagcattggtggcaaaacagaaaggatcgacactgctgtgaagggagagagaagttga

SEQ ID NO: 26934 - DNA, 1881 bp, Glycine max
  Peptide Sequence Number=SeqID_143712
atggatgataaacaagaaaatttgttaccatcctccttgcctagtcagttgttatcaattgatgaggaactatggcggatgattgaagagagggcgcaagagatattatggacaattcaacccaatgtattatctgaggtgaacagaaagaatattattgattatgttcagaggctgattggagagtattgtggtgcacaggttttcccatttggttcttttcctctaaaaacctatcttcctgatggagatatcgacttgacagctcttagtcatgaagatgaagaggaggatttggtacgagcagtatgcaatatacttaaaagtgaagatgactctgaataccaagtaaaagacatagaacatatacgtgcacaggttcaggttgtgaaatgtacagtgaaaaatataccagttgacatctctttcaatcaaatggctggactctatactttattctttttggagcaggttgaccaacttgttggaaagaaccatattttcaaacgcagtgtgatcttaatcaaatcctggtgctactatgaaagtcgaattcttggtgcacattgtggcctgttatcaacatatgcgacagaaatattagtcttatatattatcaatcgttttcattcgtcagtgcggggtcctctagcggtgttatacgtatttttggactactacagctcatttgattgggagcataattatattagtatatggggtccaaaagtcttatcctcccttccagaaattgttgatacaccagaatatgatcagggtgaattcttgctccagaaagagtttctaaaaaactatagggatatgtgctcttccaaagcaaaggcatctgagacaatgaccaatgcatttcctgttaagcacatgaacatcttggatcctttaagaaataataacaacctaggtcgtagtgtcaacataggcaatttgagtcgaataagacttgctttttccctcggttctcaaaggctaaagcaaatcctcactctcgcgggagaaaacatgggtgcagcacttgagaagtttttcttcaacactttggaaaataatgggaaaggggaaagggcagatgttggcgttcctgtttctccatttggtactggaagatttgaagagtctgtcctcagtggagattacgatagttactatggttggtcacaatatgttcaacaatatcctaattatgccatgccagtaacaactgtaccttcccattttccatctccacctcatcaggacaatatccttgcactatcgacacaactaaactggagtgaaggcgattttcctgcattatcagcacagcaaaattggagtatgttttatcaaagtggtaccaatgtatatatcccaggacaaacactctttcatccaacttacagccttggaaaaggaggaagatcacgaggaacagggacatatatacctgacttgagttataattgctactgggatatacatgcgaaggcaaacaggccaaggagatttccttatgcaaagcacaatgcattactcaaatcatctcccaaaagtcagcaagagaaagagtttcatactgagacaaaaccatttgagctttcagatgaagacttcccccttattccaaacgtttacaaggctacaccgccaacacaagctcaagagtctactccgttaacaaaggttcattctgagacagacaaggatggtaattcaaggttgtctgagctcttaaatgaagatttcccccttcctttgtcagcacaagtcaaagagtctgctccattggcaaaggttctttctaagacaaacatggatggaaattcgcggtcatttgagctctcaaatgaagatttcccccttcttcaacgcactcacaagtag

SEQ ID NO: 26935 - DNA, 237 bp, Glycine max
  Peptide Sequence Number=SeqID_143713
atggatttggatttagtagcacttgccggcggtgacacgtttttctggcaagagagtgcaactggccgttgggtggttactcatttggggcattatggttatattgacgactgccactcgtgtggaaattcccatgatttttcttgggatcaacttgatcagatgagttgctcatgcagtatgccaaaggtaaaggaagatttagaagggaaaagctacgaatatacttggagatga

SEQ ID NO: 26936 - DNA, 156 bp, Glycine max
  Peptide Sequence Number=SeqID_143714
atgtattatgtaaaaacacaactaaaattgatgttacggcaggagaaaaagaaggagaatcaagtggaggtggagatgaagccttgtgggaggaagcagaaagtgacaccaatgtggatcatggaggaaggttctttaattgtgatggacttctag

SEQ ID NO: 26937 - DNA, 321 bp, Glycine max
  Peptide Sequence Number=SeqID_143715
atgactacgcaacaaaatgaagatgagatttgcagccaggttagcaagattctagaagctttaccgttaggagttgtcctctggcctcagtacaattcacgcagtgcatttggttttgtcattttttcaattcctccaaggcacaaaaagccaaaatctgacaaggctattaagaggtttctgaatatactcttcccaaactctgaagaaaaatgcagtactgtgtttgtgtttcctgtgctatccactctcaatctcatgctaggttcgatgctaggaggaagtgtgagtctccacaaggattcatcaggcgcaaggtaa

SEQ ID NO: 26938 - DNA, 549 bp, Glycine max
  Peptide Sequence Number=SeqID_143716
atgtttgatgaaaaaggggagaggatggtggtgctgaggaagaattgctcccatacctatcctggaagcatcgatttctatcacaaatgggacggagaagtctgtggcaaaggagcatttggacagtttgaggacaaagctgttgtcggaaagaatctaaaagattttgtgcaagtgttccaggtgatcagaaaaggttttactatagaccaagatatcgtcgaagaagactataatgaagttccgcaaataaggcccaaaattggtgttcatagtttcctgaaaggaagaaagggcgttgcaaagcccaaacggcattaccagaaattcataatggccgtggagaaccggggaggagaaggggcttgtactaggacaaatgatgccattttgaagcatcgtattgacctgggattcaatttcctgcttctggaaatgggggtgaatggaatggttggtggtgcgggatggaggaagttgtgttggtggtcagaaaagggttgggaattggttgatgatggagaggatagtgggatgagtagttggtag

SEQ ID NO: 26939 - DNA, 1647 bp, Glycine max
  Peptide Sequence Number=SeqID_143717
atggctgaagagagggcacaagagatactatggacaattcaaccaaatgtactatctgaggtgaacaggaaggatgttattgattatgttcaaaggctgattagaggttactatggagcagaggtcttgccatttggttctgttccactaaaaacctatcttcctgatggagatattgacttgacagctctcagtcatgaagatgcagaggaggatttggcacaagcagtatgctatgtacttcaaagtggagatgaccctgagtaccaagtccggcttgtgaaatgtacagtgaaaaacatagcagttgacatctctttcaatcagatggctggaatatgtactctacgctttttggagcaggtcttatacatatttttggactactatggctcatttgattgggaccataattatgttagtatatggggtccaaaacccttatcatcttttccagaaattgcagagacactggaatgtgatcatggtgaattcttgctccagaaagagtttctcagaaattataggaatatgtgctcttttccatcaagggcaaccaagactatgacccatgaatttcccgttaagttcatgaacatcttggatcctctaagaaatgacaacaacctaggccgtagtgtaaacatagccagcttacatcgattcagatttgctctttcctacggcgctcgaaggcttaagcagatcctcacacttccaggagaaaccatgggtgcagccctagagaagtttttcttcagcactttggacaggaatgggaaaggagaaagggcggatgttgatgtaccggtttctccgtttggtattggaagatctatagagtctgtcctctgtggagattgtgaaagttactttggtggcttacaatatgttcagttgtatcgtaattatgccttgccagtaactgtacattccagttctccatcgtcaccttctcaggatgatatccttgcgtcatcaacgcaccaaaactggagtatgttttaccaaggtggtactgatgtatatatcccggcacagacactctatcatccaacttacagccttgaaggaagagggaaatcacgaggaactggcacatacatacctgacttgaattataattcctactgggatatgcgcacaaagccatccaggccaaggagatttgcttcttcaaagtacaatgcattgcccaaatcacctccgaaaaagctacaagcagaagaggttcattctgagacagacataaatgctatttcagattcaaggctgtttgagttatcaagtgaagatttcccccttcttccatgcaattgcaaggatataccgccaacacaggcccaagattctactccattagctaagtttcattctgagacagatatggatgttacttcgcagttgtttgagttctcaaatgaagatttcccccttcttccaaagatttgttctgagacacacatggagggtagttcgaggtcgtttgagctctcaaagaaagatttcccccttcttcaaagcatttgcaagactgtcctgtcagagtctgctaagttaactaagcaagccaagagtttcccatcctctaaagagtctaaactgaaaaatactgagtttggatctttcagaaatcacaataactga

SEQ ID NO: 26940 - DNA, 342 bp, Glycine max
  Peptide Sequence Number=SeqID_143718
atgtccatatctcaagcaacaaccctgttaatctctggaccatatccggatatacttttgaccaaccaaaatgcatttggtttcaaatatacgacgcaagtgacgtacgctcgttgttattggaaagagatctccagtcacccatcattaattgcaggtcatatcagccattctattttctggaaaaatctagctcctgatcatgaaggaggtggtgaaccacccaagggttcattgggatgggctattgacatacattttggctattttgaagcattaatgcagaaggtaaggtgcagtgctataggggtctggatgggtggcgagttgtccagatcctga

SEQ ID NO: 26941 - DNA, 192 bp, Glycine max
  Peptide Sequence Number=SeqID_143719
atgattgagttcgagtctattcgtgtttacgcacttaagactaaaggattgtgtaccctcttgatcgggggggcacaatctcaatcatattgtaaccatttagggtatgctctcaaagatcttcggagcaacaaccagatcaagatatgggaaaccgcccccaagatatcagggggtgtatttgatgcatga

SEQ ID NO: 26942 - DNA, 306 bp, Glycine max
  Peptide Sequence Number=SeqID_143720
atggaggcacgagtggtggaggcaaagatatgcgaaaagtacagcaaaacatggtcagggtggtgtggcaactctaaccactgtgacaaccaatgcaagaaatgggaaggtgcaaaatttggatcatgtcactgggacttgggcggaaggcttgtttctgctacttcaactgtccaggtttatgtgctaagcgcagcaagacatggtctggttggtgtggcagctccaacaacagtggcaagcaatgcaggactaaggaaggtgcaattcattgagcttgtcacgttaacgttcgggcttaaatga

SEQ ID NO: 26943 - DNA, 807 bp, Glycine max
  Peptide Sequence Number=SeqID_143721
atggctgcacctgcgaggcctctgttcgttctcttcggatcctccattgtccaactcagtttcagccatggtggttggggttctcatctttctgacatctactctcgtaaggccgacatattgttgcgaggatactatggatggaactcgcgacgtgccctccaagtccttaatcaagtttttccaaagcttattatccttcttacattatataattttctgtatcccacttcccaggatgctgcaatacaaccttctcttgtgatagtttattttggaggtaatgattccatgggtcctcattcgtctggcttaggccctcatgtgcctcttcatgaatatattgaaaacatgagaaagattctgattcatattcagggtctctctgaaaagatacgtatcattgttctcagttgtcctccagtcaatgaggaaaaagtgcgtggaaacactagtgagctggtaagaacaaatgaattgtgccaaagctactcagaagcttgtattaagctatgcaaggaactggatgtcaaagttgttgatctttttaatgcactgcagaagagagatgactggatgaatgcttgtttcactgatggtatccatttagcagctgagggaagcaaaattgtggttaaggagatattgagagtgcttaaggaagcagaatgggagccatgcctccactggaaatccatgcctactgaatttgcagaagactcaccatatgatcttgttgctgctgatgggaaaactacactgaatccttctgagtggactttttacagagagattcagtgggattag

SEQ ID NO: 26944 - DNA, 195 bp, Glycine max
  Peptide Sequence Number=SeqID_143722
gtgcaatgcgctatgtgccaccagaagccagtcacgttgatgtcgatgaggaagggtgtcgcgcgatccatgcctatgaggaagtgactcaaaggagcgtgttttcgagacaaagtgctggtgaaggagggcaagaagcgagtcttcatgtgtttggatatgcaagtccttattccaccattgaaggaaaatgtg

SEQ ID NO: 26945 - DNA, 1215 bp, Glycine max
  Peptide Sequence Number=SeqID_143723
atggaagatcaatacgtaaaacgaagcgtaactacaggatgttacaacgtagatgtgtcaaatcccaatgatatatggaaaagtgaaaacatcctgtttttctaccttcctaactttgcagcccaagttgcttttatgttgttgtccactcgtcttttgtactacatcctcagacccttgaaccaacctcgtcttgtatctgagattttgattggtattctgataagtcctgaactatttggaatatctgctttatctgaggttctgacccctataaagtcaatcctaactactgaaaccatatcatatgtgggactcgtttactctgtgttcctggctggcttggacatgaactttgacacaatcctaggagcaagaaagaaggccacaagcattgcaattgctggcattgtcatcccaatggtattgggtgctggcatatatgctttgactctaagcatgtacaagggacctgctgagtattgggcaaatttcaacaccactaatgcttatatgttttgggccttaattttaagtgtcacaggttttcctatggttagtcacatccttgctgatctcaagctcctctacacaggacttggcaaagtggcgttaacaacagctatggtcagtgacttctataattgggtcatgtttgcaatgttgattccattcgccatcaacggggcaagcgccatctactcggtgcttggaaccataggttttgcgcttttatgcttctttgttgtgcggccttatttggtacagataatagtgagcaaaaccaataaaaatgagtgggacaattatgggttgttctttgtgatcatgggatcttatgctagtgcacttgttactgatctcctagggacacaccctgtggttggggctctggtgtatggaataatgatacctcgtggtaaatttactcagatgctcatagagaagtcagaggattttgcagctgtttatctggctccattgttctttggtagcattggaataagactcagaatagtatatgttgtaaacactcaaggtttgggcctggtgcttttgattttgttcctctctttcatcccaaagattttaagcactgttatagcgactcaattttatggcatgtctgttcttgatggtgtctcaattggactgcttatgaacaccaagggcatcttaccagtattaatgctcgtcaacgcctgggacaagcag

SEQ ID NO: 26946 - DNA, 1007 bp, Glycine max
  Peptide Sequence Number=SeqID_143724
attttgagtgtggagtccttctcaattttgacagtagctgttgttatgatgacaatgatggtgcctctaatcatcaatgccatatacaagcctaggaagttatacaagcaaagtaaactaaagaccatacagaacttaaagggcgacatagagctgagaatactagcttgtgttcacaaccctcggcaagccacaggaatggtcaacattctcgatgcatgccacaccacaaaactctcccctctgcgcgtttttgcgcttcagcttattgaactaactggaaacaccatttcccttttggcttctcatctcaatcagcacaaccaacagcagagtggtagagcacaagccctcacaaaagcacaagaagacttggagagcatcaccaacattttccaagcatacacaggcacaaatgagaacaccagtgtggagacatttgctgcagcatcaacttactcaaccattcatgaggacatatacaacgtgtcgcaggagaagcaagcgaacttgattctccttcctttccacaaacagtcaaacatagagggcattctggagacaacaaacactgcattccaagacataaaccgaaatgtgatgagggatgcaccgtgttcagttggaatctttgtcgaccgtggactaggatcattgttcaaggtgaacttgcgcatgctcatgcttttcattggtggcccagatgaccgcgaggccttggcggtcgcgtggaggatgtcaaagcatcaaggggtgcaactatcagtgatgaggatccttatgtatggtgaggctgcagaagttgatgttttgtcgtcccatcttgagtctcgcggactgttagccatggtgctagacagtgaaaggcaaaaggaattggatgaagagtatgtgagtgcatttaggctcaaggcagtgagcaatgaagattctattaagtattcagagaaagaagctcgttgtcgtgatgatattcctcgagtgcttaaagagattgaagaaattgg

SEQ ID NO: 26947 - DNA, 1017 bp, Glycine max
  Peptide Sequence Number=SeqID_143725
atgtacaaccacaccttaatcgatatggaattagattttttaactgaggcaaagaatagtgagaggtgtttggagaacttccacaagttgtctcctcatattgcgaattatgtatatgcaccaaaagtatattggaatctgagtacctcgaagctgctgacaatggaattcatggagggtgcttatgtaaatgatgtaaagaccattcaaaaacttgggatcaacctgcatgaactttcaacattggttagtcaaacttttgctgaaatgatgttcaagcatgggtttgtgcattgtgatccgcatgctgctaacttattggcatgtagtaatgtcagctctaatgcattaaaatgtgggagcttgatgaggggtgcaagaaatgacactcatcaggctgcatctatagttctccactggagaaaaccacagttgattcttttagaccatggactctataaagagcttgacttccaaacaagaactaattatgcttcactatggaaggcattggtatttgctgatgctaatgcaatcaaggaatacagtacaaagttgggagctggggaggatttatatgcactttttgcgggagttctaactatgaggccatgggatagagttgttgacccatctatggatcatttagttatacagggaaatgagagtgatcgattagaactgcagatgtatgcttctcagtatttccatcaaatctcggagcttctaaggagattaccacgagtgattcttctaatgctaaagacaaatgactgtttacgagcagtcaataattctctgttacagggatcatctttggagacattttttgtaattggaaaggtttcttcggaggctgtcattgaggcaaagatgttgcaaagcaaatcacttttaacttggctaaacgttaaattggataagattttgctggaagtacgactttggggaatgcaggtggccttgtggcttttacaactaagaaaatctttgtcttggtctaaccaagcattatag

SEQ ID NO: 26948 - DNA, 630 bp, Glycine max
  Peptide Sequence Number=SeqID_143726
atggtagtttactcaattatgatttgtgtttattatgaatattcactgtggggactcctggaagggagtagtgagagggagagaatcaaacatgaagttcacctccggtcagcacaaaaacttcaagatctgtgtttcaagaatggaggggtttatataaagcttgggcaacatcttgggcagttggaatatttggttcctgaggaatatgttcggacaatgagggagtctatgctaaatagatgtcctgtatcttcttatgagcaagtatgcaacgtattcaagaaagagcttggagacacaccagataaaatattctccgagttcgacccagtccctatagcaagtgcttccctggctcaagttcatgtagctcgcacgcatgatggccaaaaagttgctgtgaaggttcagcatactcacatgactgatacagcagctgccgatcatgccactgtggaattggttgtgaacacattgcatagattttttcccagttttgattataggtggttgattgatgagattagtgaaagtttgcccaaggcaagttgctatttaactttgaagcatatgcctaaaaatatatccatgcttatttggtggattttgcttagtggaccagcttaa

SEQ ID NO: 26949 - DNA, 228 bp, Glycine max
  Peptide Sequence Number=SeqID_143727
atgcaatgggctgattgccctgaacttggtgttataggggacatagtggcatcaaacagttttggttcaagctcttcagtgcttgttgtacagcaatatggttttgggggaatggtgtttgataatagtaatgctgccacacagcagcaacctagggaagtagtgcctgcagatgatgatgatgattctggggcacttgctatcaaggtagaacagcatcatcagtga

SEQ ID NO: 26950 - DNA, 258 bp, Glycine max
  Peptide Sequence Number=SeqID_143728
atgttggcggcggtggcggcgtcacggaagaggcgatgggggacggtggcgcaaagcttgagcgccgtttcggggtcgtcggaggttgcaatgagcgccgccgtggcgccaccgcccacggcggaggcaacaagagagagcttggctcctgcgcgccataaccaagccatgtggaggttgtggcagcgacctagaggctcgagggaaggaattggtgacggcgtcaagaaggtgcgatgtggtgaagaggaagactga

SEQ ID NO: 26951 - DNA, 1776 bp, Glycine max
  Peptide Sequence Number=SeqID_143729
gtgggtccctatgaatggatcacatatcaggaggcttatgatgctgccatccgaatgggttccgccatgaggagccgtgatgtcaatcctgtaacccatcttgctctatttaagatactatgtattgggaaatatggagaccgttgtggcatatatgggtccaactgccccgaatggataattgcaatggaggcttgcaatagttatgcagtaacatatgtcccattatatgacaccctgggtcctaatgctgtggagtttatcataaaccatgctgaagtttcgattgcatttgtacaggataacaagtttccttctgttttgtcatgccttgatcggtgttccagtcttaaaactgttgtgagttttggtaatgtttcaaccacacaaaagaaggaagctgaggagcttggtgcatcttgcttctcgtgggaagagtttctccagttgggaaatatggatttagaccttccactgaaaaataagactaacatctgcacaatcatgtacacaagtggaacaacaggcgagcccaaaggggtcattattaagaatgaggctttcatgactcaagtgttgtctattgaccaaatacttaatttaactgacagagtgggaacagaagacgacgtgtacttttctttccttcctcttgctcatgtatatgaccagataatggagacctattgcatttacaagggctcctcaattggattttggcaaggcgatgtcagattcttgatggaagatattcaagcactgaaaccaactctattttgtgccgttcctagagtttatgatcgtgtttatgctggtaaggctagaatgcttcttgtactagcgctcttatcttgcaagttgggatatctggagaagggtcttccccaagacaaagcagcacctttgtttgataagcttgtgtttgataagataaaacaagcattaggtggacgggttcgtctcctgttatcaggagctgctcctttgcctaggcatgtggaggagtttttgagggtcacttttggagctactatgtcacaaggatatggtcttaccgaaagttgtggtgggtgtttcactgcaataagcaatgtgttttctatgatgggaacgattggagttcctatgacaaccattgagtccaggcttgaatctgtgccagagatggggtatgatgcactctccagtgaagcccggggagaaatttgccttagagggaataccttgttctctggttaccacaagcatcaagatcttactgaagaggttatggttgatggttggtttcatacaggtgacattggagaatggcagccaaatggagccatgaaaattattgatagaaaaaagaatatctttaagttgtctcaaggagaatatgttgctgtggagaatattgaaaacaaatacttacagtgcccccttataacatcgatttgggtctatggaaacagttttgaatctttcttggtggcagtggtggtccctgaaagaaaggcccttgaggattgggcagtgaagcataattctacagatgatttcaaatctttatgtgaaaatccaaaggcaagaaaatacattttggatgagctcaacaacactggtcagaaacaccaacttagaggttttgagctgctaaaagcagttcatttggaaccaattccctttgacatggagagagatctgataacaccaacattcaagttgaagagacctcaattgctcaagcagtataaggagtgtattgatcaactatacaaggaagcgaaggcatag

SEQ ID NO: 26952 - DNA, 180 bp, Glycine max
  Peptide Sequence Number=SeqID_143730
atgccgctcttccaaattttcaaatcacagaaaaacgagttgaaaagcataagcacagttttgatacagttttgtgaaagggatagtggaggatactgcagagagctagggatatttatcattcagatggaaatggttccaggagagacaaatagcctcaacaattggacaagggactag

SEQ ID NO: 26953 - DNA, 507 bp, Glycine max
  Peptide Sequence Number=SeqID_143731
atggctgattttcttgctggtagtggaaagaagcatattattgttctctccagcttagattttggaaaatggcaaaaagttgacatgtcaaggaaattgcattgtgaaacttcccattctgatattggcgatcatattagtggcttgcagattcattacctttctagtgccaacagcaatggaacagatgaaaactgtgaacagcttgggtggaagaaacttcaggagtatgacccttctcaaaagcattggaaacatcttagtgatttagctgaaggaaatgtaactctggaagatattacttctgtagaagatgagctagaagaagaaaattattatgctagcttgccttttgctgcacttttttcttttctcaaggctaaaggtttgaaggtcacatgcttgttatgttattgctcagaaggggacaacatatcagatgcttttcaattaggcgatgcagtatgtaaacttctccagctgaatcatcctattactgctaaataa

SEQ ID NO: 26954 - DNA, 129 bp, Glycine max
  Peptide Sequence Number=SeqID_143732
atgttgaatgtccgaagcaatacggcaaggattgttcacttacacgtacatgttcaagacagagtagctgggtgcaactacgagctagcaaacatgctaggaagcaactctgcatttttagccaaatga

SEQ ID NO: 26955 - DNA, 645 bp, Glycine max
  Peptide Sequence Number=SeqID_143733
atggatgaggctgtcgaaatcatggatacccttgggaaaatggaacatatagttggccctttgtggcttgttatacttttgttaaatgcgattttggccaatcatataactctcgaaagagagattccagatgacatcgaactcaagattgaagcagctcaattgattttcctgacacccagcaaggagttttatactttccatagaaatgcagaggattcttggccttggagtgggtgctggtcgggtctttattctacagcctctgcatataaagggctacccaatgaggttgcattggaggagggggaaaatttatttcctctagtgtggaatttacaagtgccaaataaagtgaagtgcttgatttggagggccctgcgagataggttgccatcgaaagctaacttagcaaggagaaatataattgtgaatcctactgaattgctatgccctttttgtaatcatcatattgaatccttgaatcacatttttatttcttctcctttagcctcggatatttggtcttcatgctactcttggatgccacctgttttcgctattgtatgtccgagctctctcaagagccactgttggctgcatttcgggctaggaaggaattcaactgaacaagatatttggtga

SEQ ID NO: 26956 - DNA, 285 bp, Glycine max
  Peptide Sequence Number=SeqID_143734
atgcgtagcagagaagaagagatgatgtttttgttgaacaagaagaaaaatgcctatagcattaatgttattcttgatcttcttaattacttggtgtcatcctcctttttcttcatttcgttgttcatcttgtcagatggaaaagattgctacgattgcaaccaaggagaagccaacaaagaggagaaatgtgtcagctgcgttgcaaccaaggagaagccagcaacgaggagaaatgtgtcagctgtgcctaaagactctgtcatgcttaagaaagactcttaa

SEQ ID NO: 26957 - DNA, 510 bp, Glycine max
  Peptide Sequence Number=SeqID_143735
atggcttccgcaaacaccaccccacttgtggaactttccactgccatcacccttctcatcaaactcagctccaaaaatcaccacatctggcgcacccaaatcacccatctactccaagcctatgacctttacggatacgtcactagggacatctcttgcccccctccgactgttggtgatggagatatcgccattgtcaatcctacttacaatcggtggaaatgccaagatcactatgtgtttcttacttttcttggttcctgcggtcacatagcaaaaacatgctatcgccttcatggtcatctagctgagcatcctcgtcatcaggcgaatcttattagtcatgaagatcaggctgacacttcttggcttcttgactcaggagcctctcaccatgtaaccaactatatcaatcgtctctccatttctagcgactacactggtctagatcaacttcatgttgccattggtaagggtctttccattaaacattttggctctattctataa

SEQ ID NO: 26958 - DNA, 944 bp, Glycine max
  Peptide Sequence Number=SeqID_143736
tcagagggctacatgccctcatcttcagaggactacacgtcctcaccttcagagggctacacgccctcaccttcagaggactacacgtcctctccttcaaagggctacacgtccttgccttcaaaggactacacatcctcgccatcagagggcttcacgccttcacctttagagaactacacgtcctcgccatcagagggctgcacgccctcaccttcagagggctacatgccctcaccttccgtggactacatatcctcaccttcagaggactgcacgtcgtcgccttcagaggacaacacatcctcgccttcaccttcgtagggctacacgtcctcacctttagaggactacatgtcctcgcctttagaggactacacgtcctcaccttcagagggctacacgcactcaccttcgtagggctacccgccctcaccttccgaggactacatatcctcaccttcagaggactacacgtcctcgccttcaccttcgtagggctacacgccctcacctttagaagactacatgtcctcgcctttagaggactacacgtcctcaccttcagagggctacacgcactcaccttcgtagggctacccaccctcaccttccgaggactacatatcctcaccttcagaggactacacgtcctcgccttcagaggacaacacgtcctcgccttcacctttatagggctacacgccctcacctttagaagactacacgtcctcgccttcagaggactacacatcctcaccttcagagggctacacgccctcgccttcataggactgcacgtcctcacctttagaggaccaaacatcctcatcttcataggactacacgtcctcatctttagaggactacacgtcctcaccttcaaaggactacacgtcctcgccatcagagggccacatgtcctcgccttcagaggatcgcat

SEQ ID NO: 26959 - DNA, 351 bp, Glycine max
  Peptide Sequence Number=SeqID_143737
atggcaatttccaaactcagaaatgatacaaagggtttcgttctctaccgaaaccgcgaggcaagttggaagatttcgcttcagttgaagggttcctctcggcgtggggtttcaacggagaacaatggcggtttatggtggctactggtggctaaagaaggagaagaaaatggcgtttttcctaagctacttggactacaaggctcaaaacgcacaagcgagcaatgctctcagaaatggaaacgtcgcgcacactccagatatcttctcaaagatcccaacggtcacatcgtggacaagtgttttgtgaagctgcagaccaaatttcgagaagctccaacggttaactaa

SEQ ID NO: 26960 - DNA, 966 bp, Glycine max
  Peptide Sequence Number=SeqID_143738
atggcctctagaggaactggaacgctgattttggtttgtctcttatggcttttcttcctatgcgccaccatagctttcttgcagctcaacttcgtagacaaaggaaccaccaacaacaacccttcctctcgcagtagtaacttcatcgcaactcaacagcatagcgctgatacccctttggaacaggatttggagggtgtcacccacaaggtgtattttgatattcagatccatggcaaattagcggttggaatcaatcttgatatgtataattcccttggtagtaagaactacaaatttgaacagcatctcatttcaggagagaaaggagtgggaagaagtgggaagtctcttcattataaagggagcacattccataggattataccgagctttatggtccaagggggtgatttcacccgtggtgatggaagaggtggagaatcaatctatggtgataagtttgctgatgaaaactttaagctgaagcataccggaccgggatacttatccatggcaaattctggggaagacaccaatggctcccagttcttcattacaacagttaaaaccagctggctggatggacaccatgtcgtattcggcaaggtactttccggtatggacgttttgtacaagattgaagcagaaggaacgttgttggcaaacgttggtgaaattggtgttgagatcagagtagagagagacaaccttggagatgttgccgttgagttcctgaatgagggacacgttttttaccatgttgtcgtgcatccgagactgctgggtggcccacgcctcgggatccccgacgtcctccgcctcctcgccgtccgactccccggtcgtcgtgctcaccgttgttgtcgtcgtggcggggtggtggcggtggcggcgctggtgcttcttggagcggcggtggttggaggggtcttccatggtggactctgcggcggaggaggatga

SEQ ID NO: 26961 - DNA, 426 bp, Glycine max
  Peptide Sequence Number=SeqID_143739
atggaaacatacataatcaaggtgttaaatttcttgaccaaaaaaggtgaagtctacaaggcagagccacccttggaccttaaggaagccttttccaagtttgctggaggagagaatcaaatgaagaaggatcagcttcttcggttcatggtggaacaccagggagaaaataatattagcaccatggaggatttggataaaatagttgaaaagtttttgcaactaagaaattcttgttctagcaccaaaactagctccacaagaattgtagatgtttataggaaacaaggattgagtctcaatgacttcatcgattttctgattcttgatgatttcaacggtcccttgaaagacaaggtttgcactttctctgacagattgaggcagaaaaattctggaaataagctattgttgtgtgcattataa

SEQ ID NO: 26962 - DNA, 318 bp, Glycine max
  Peptide Sequence Number=SeqID_143740
atgttgctatgcataacttgcaaactgattttgtctggtcatgagatcagcaataagtgtttgaagcacagaaatcttgctgcacctagaaacaagcacaagttcaaagtacatcatgatatgaatgctcccttgtcacattatttcatgtatacgggacacaattcctatctgactgggaatcaacttaccagtgagagcagtgacgagccaatcatagaggctttgaaacaaggcgtacgagtaattgaactagatttatggccatccaagtcttcaaataatgatggaattaaagtggttcatggaaggtactag

SEQ ID NO: 26963 - DNA, 574 bp, Glycine max
  Peptide Sequence Number=SeqID_143741
atggctaagtactatgatattgatgatattatcattgaggaagagactgtgtcagttatatttcagagggctgcatctggagtgggaatagatcccagttcttcaatccttattgaaacaggttcaaaagttgaactgccgttttggcttgctcatgagttacagttgagacaagcagtatcagtcaatgttcctccttgtttcaatcaaaaaacaaggcaggagctccatgctgattctgcagcacatgaactcatcctcctccgccgcagagtccaccatggaagaccgccgctcgaagaagcaccaccgccgtcaccgccaccaccccgccacgacgacaacaaccttgagcacgacgaccggggagtcggacggggaggtggaggaggcggaggacggcgacccggaggcgtgggtcaccctgaacaaggggttccggcaggtgcagtcggtgctggaccggaaccggctactgattcagcaggtgaacgagaaccagcagtctcggatgcacgacaacatggtaaaaaacgtgtccctcattcaggaactcaacggcaacatctccaag

SEQ ID NO: 26964 - DNA, 189 bp, Glycine max
  Peptide Sequence Number=SeqID_143742
atggccaagagaagtggtcgagttacgtgttgtattgtgccttcaacggttcgctgctttgtgctgtgccttcaatggttcaatggattgatgcttaaagctatgccttcaatggctgagatggttgcgtactcacagctggagtctcgcacggagctctcggtgcgaatgcaggagagcgagcactga

SEQ ID NO: 26965 - DNA, 351 bp, Glycine max
  Peptide Sequence Number=SeqID_143743
atgaagaacggacgaaaaccttcacggatttgcttacggaaacatctcggaagcgaaaaagggggaggaggttgccgcccagctcgcccaggcgaccttagctcgcccaggcgagctgggtggcaacctcctcaccctttttcctataaaaaggctgaagggggctgttctaaggatccctcagccccctggctatgtatttcagctgttttgggtgaaaaaaattgtttccgtgaagaaaatcctagccgaggtgcttccgtaacgcttccgagatgtttccgtaagcaaatccgtgaaggttttcgtccgttcttcatcgttcttcatccgttcttcgttcttcaacgg

SEQ ID NO: 26966 - DNA, 273 bp, Glycine max
  Peptide Sequence Number=SeqID_143744
atgcccttgcgggataggattgcatcacctggtggctttgtctaccctctcaagtcccacgaaggacacttttaccttcgcccttgtgctaatgatgtaatcgacattgttaccttcctcgagcattacctttatcacaatagttatctgactcccatcacttctttgttttcgataagctatattctctctaatttaggaacttggcctaggggttttgacccttactataggtggctcaaacgagtatttgctacaaaagaagttgattag

SEQ ID NO: 26967 - DNA, 318 bp, Glycine max
  Peptide Sequence Number=SeqID_143745
atggctcacaccaagaaaactgggcaaatgacttttgaggcagcaaaggaaattgctgacaagattgatgtactgactactgccattgggcgacctgaacatcctggtcatgtgcgtactactggagctggtgtcacgattaaacaatactttggaccggctccaaggacctcccgcacatattcgtccatgctgctcgtgtcaacacaaagaagagttatgttgatccctcagggaatgatccagacacgggtgactcagagaaatgcgggttgtacgttgaagaaaatcccccccccccccgcctggttgccatag

SEQ ID NO: 26968 - DNA, 636 bp, Glycine max
  Peptide Sequence Number=SeqID_143746
atggaaggtgccgttccgcagcgggcgccggctgaaggcctggaacgggaacgtggtgtctctcgggctggccagcggtttcatcgagccactggagtcgaccagcatccatctgactatcagcgcggtggtgcgcctgatccagttgttcccgttcgacggcctccgtgcgtcgctggtgaagctgtacaacgatgtcatccgccaggaaatggagcacgtgcgcgacttcatcatcctgcactatcacgcaacgcagcgcaccgaaccgatgtggaaggcgtgtcgcgaaatgcgcgtgcccgaatcgctgcaccaccggctgcatgcgtggcgcgagcgcgcacacgcctggcaggaccccggcgagctgttccgcgtggaatcgtggaccatcgtgctgctcgggcagggcatcgcgcccggtcctgcccacccgctggcgcgggcagtgagcgacgccgatctgcgcaccctgttgaagggcatccagcagccggtgcagcaggccgccgcgcagatgccgacgcaggcggagttcatcgcgcagtactgcagcacgctttttccgctgcagctggttacagtgcggcaacaccggtggcgatgacgcgagcggtggcaaggaggggctga

SEQ ID NO: 26969 - DNA, 297 bp, Glycine max
  Peptide Sequence Number=SeqID_143747
atggctgatatcaagttccgcccgcttcatgaccgcgtcgtcgttcgtcgcgttgaatcggaagccaagaccgctggcggcatcatcatccctgacaccgccaaggaaaagccgcaggaaggcgaaatcgtcgctgttggcgcaggtgcccgtgacgaagctggcaagctgatcgctctggaagtcaaggctggcgacaaagttctgttcggcaagtggtcgggaaccgaagtcaagatcggcggcgaagacctgctgatcatgaaggaatccgacattttgggtattgtcggctaa

SEQ ID NO: 26970 - DNA, 264 bp, Glycine max
  Peptide Sequence Number=SeqID_143748
atggaacccaaccaatttgaaacctacgtcctcgctgtgccaagaacaagaagcaacctttcatcatctaacaaccaagaagtaatagttatccccgacgtcgaatcgcagaatcgcgtacaagaggacggatcaaacaaacgccgcagaaccgaagaagaaggcgaggcggcggcggcttctcattccaaagacattaatgagcctctcgtttgccctatttgcatggacatttggaccagtaggcggagaacatcacatctg

SEQ ID NO: 26971 - DNA, 459 bp, Glycine max
  Peptide Sequence Number=SeqID_143749
gattcgatccgctctccattattctggcgtattgtccgcgccttcggcgcatcgcaagcgcgtattttcgacacgagtgaagagctattacaggcattgtcggctggcagcatcgatcttgcctataacgtgtcgttgtcagacgtgagcaaatggcaatatgacgcacgggattttacagtgatcataccacaggattacgtcgtcgctctaccctggaccgcgctcatcccagaccgaagtagacacgcaaacattgccgaacaggcaatcacatatcttctgtcttctaacggtcaggcgatccttcaacaaactggtcttgtatcggaaacgagcccttcggatgtagcatcgctgcaacctgtcgagcttgggccggagcttctggtttatctggatggattaaaacgaagccgctttctcgacacttggtttcaactcactgttcatgagtaa

SEQ ID NO: 26972 - DNA, 213 bp, Glycine max
  Peptide Sequence Number=SeqID_143750
atgagcgtccggggcttgctaatcatgagccccaaccgactgccgcaagatttctcgatttgttgtttcctggatcaagataatgtgggattcagattgtacgagctgacaagccagtatggaggtttggaggcccccaacaccctcgattttcgtcccgatggcaagagggtgacggtgttcttgctatccattcgaaagacgaaggagtaa

SEQ ID NO: 26973 - DNA, 690 bp, Glycine max
  Peptide Sequence Number=SeqID_143751
atgattcaaaatggatcttattctatcgttgatcagagatttctctatgaaaaatatgaatcggagtttgaagaaggggggggagtcctcgacccacaacagatagaggaggattttttcaatcacatcgtttgggctcctagaatatggagcccttggggctttctattttattgtattgaaaggcccaatgaattgggatttccctattgggccaggtcatttcgggacaagcggatcatttatgatgaagaggatgagcttcaagagaatgattcagagttcttgcagggtggaaccatgcagtaccagacacgagatagatcttccaaagaacagggcttttttcgaataagccaattcatttgggaccccgcggatccactctttttcctattcaaagatcagccttttgtctctgtgttttcacatcgacaattctttacagatgaagagatgtcaagggaacttcttacttcccaaacagatcttcctacatctatatataaacactgtttgggaacgtccggtgccaaagtcattgaatggcatatactcctcggggagggtgcagggcggacgatttcaaaacagattacccattcattcgatagagaagatcaccaagatttcgtgattcgctgccgaacttattccaattcaataagagatctcaatattatgccttga

SEQ ID NO: 26974 - DNA, 378 bp, Glycine max
  Peptide Sequence Number=SeqID_143752
atgtctcccttctccctttccaagagaattcaatggactaaccgcctaagaattcttttgattcttccctttgaaaccctccaatgtgttaccacaaaggatataccctccaatgtgttacgaaagatatctcaggcggttagtcctttgaaactttgtgaaggggaaacaaaagatatctcaggcgggagaagagagacacaaaaagaatttaggcggttagtccttggcaaattctttttggcaaagggagaagagaatgaaaaagatatagcacactcttgttttcaaggtttagaaaccagaaaacttttggcaaaggaagaagaagaagaagttcaagaagatgttcaaagagtttcaaaggttgtaaaataa

SEQ ID NO: 26975 - DNA, 127 bp, Glycine max
  Peptide Sequence Number=SeqID_143753
atggtggaaccatcaatgaagcgcaaaggttcttcgagtagaagccaacgacattccgaggttcaggatactccaattccttcctccatttcctcctcctcagaacatcggaagaacaacgtatacg

SEQ ID NO: 26976 - DNA, 255 bp, Glycine max
  Peptide Sequence Number=SeqID_143754
atggacatgtgtcttgcaaagttgcaaaccaaatttcgagaagatccaacggttaacgaaggctgcgcagcatttttaccgagtcagcttcatgaatttaaaattcctgtgacaggtcctgtgactgagtatcctcatcctgagtgtcctcctcatctgactggtgtagaagggtcctttagaagatcaagtaatggtgtagacgattctactggcatctcatgcactggtgtaggaggatctgctggctgttga

SEQ ID NO: 26977 - DNA, 305 bp, Glycine max
  Peptide Sequence Number=SeqID_143755
tgtctacactggggaatcagtgatagcaacaacttctccagatgacgaatcagaaagatcagcaattcctccaactggggaagcaggggggtcagctttttcttcaactggtgaatcaggaggggcggcagcttcatctgatgatgcatcagagatgataatcagaggtggagatgggggaactacttcaagctcaggagaaggaggtagattcaccactagagttcatggctcggctggcattggttcaacccgtgccggtgtgggctctgaaggagcagcctcattggttctcaccaatggaa

SEQ ID NO: 26978 - DNA, 860 bp, Glycine max
  Peptide Sequence Number=SeqID_143756
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcggacgggtgcaaaatatcatgattgagcatcctgtctatggggaaatccagacctatttgaaattgacttgccgtcgcgatgtgcagcaatttttagagcaagtctcagagagcgattttcgtgccttatccgagctaacaaatggagttcactacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 26979 - DNA, 321 bp, Glycine max
  Peptide Sequence Number=SeqID_143757
atggccctggggtttccagctcttgttacgggcctctgtcagtcctacagggtgcccgtcccccccagcaaggtcatgccatcgcgacatagggatcgcgcccgcaagacacccagtggacccggagaagtccaacagggtcttggggtttccagctctaattacgagtctccatcagatctacgaagtgcctgtcacccccagcaagcgggcaacagacgcaccgtcgccacctccaaagcccctcagctcatctacaaaacctggagcgttgcctacgacccgtggtcgaccagtaggcgaccaagtccaaagccaaag

SEQ ID NO: 26980 - DNA, 602 bp, Glycine max
  Peptide Sequence Number=SeqID_143758
agggaaccattgatgttgctattgttaaagaattttatgctaacctctatgaccctgaagaaaaatcgcctaagcaggtgagggtgcgagggcacctaattaaatttgttgctgacgccctcaacatcttcttgaagacaccagaggtcatagaggaaggggagagctttcctgcctactccaggtttgctaatctgaggcctgttcctcaagagcttgcagcccgtctatgtatccctaggaggggacttgagctgaatgcagccaagctgcgtttgaagattttgaggaagaatctgactactctggcccagacctggagtgttctatccttttcaaacttagccccaacatcccacacttctgacattactctggatagggctaagttgatatacttgctcgtcatgaagatggatatgaacttggggtccttcatctcaggtcaaatctctcttatagcacaacacgactccttgaggctaggtttcccagtcttgattattgccttatgcaaggcgcgaggagtcacatctgattctttgacctttgaatctctgagcccaaccattaatttggcttatattaaaaagaattgctag

SEQ ID NO: 26981 - DNA, 237 bp, Glycine max
  Peptide Sequence Number=SeqID_143759
atggttaaagaattctatgccaacttatatagcccaaaagaccaaagccctaagcaagtgagggtaagaggacatttaatcaggattgatgctgacagcctgaataccttcttagagaccacaatagttttggaggagggtgagacactacctacctattatagatttacgaggatgaggattgatcctcaagagtttgctgcccgtctctacatccctggtaggggtttgttctga

SEQ ID NO: 26982 - DNA, 309 bp, Glycine max
  Peptide Sequence Number=SeqID_143760
atgacaaccatcatcttatctatctttgtgctttcatcaagtaaatacttttggcatcatcaaaacctacatgattcacagaatgatgataagtgcttgtggtattttgacaatggagcaagtaaacacatgttcggttgcaaagagaaatttcttgagcttgaagaaaatgtgaagggaaatgtttcctttggtgattcttccaaggtgaaaatccaagggaaagactcaagatctcaaacagagaacagagcgaagaattcaaccgttgagagacaacagatacctggagttgaagactatatatag

SEQ ID NO: 26983 - DNA, 180 bp, Glycine max
  Peptide Sequence Number=SeqID_143761
atggactcgggaaggttccaagttagtgtaccaggtaacaactaccccagtaagactttctttggaaggaatgtatcagcaattcctcatcttttgcgtatgcccccatcttccgataatacatctttagatggtgtagctgggggtgatactgagggccttccgaagtgttttcaaggg

SEQ ID NO: 26984 - DNA, 222 bp, Glycine max
  Peptide Sequence Number=SeqID_143762
atgcatctgcgtgatcaaggaagcctcatttacaacaaagagaagaacaagatgaaagattgcaaaaatacaagtggtgaggatgtctccttcacctctaggatctcacaatcactcacaaactcatctcaagctcttagaacggcttctgcttcaagctctagtctctgcagatctttacacaacaaaaactctctagaacttggacctttctctctctag

SEQ ID NO: 26985 - DNA, 243 bp, Glycine max
  Peptide Sequence Number=SeqID_143763
atgtggactaacagatgtaatatcataggcataggagatttcaccttaccttctccaacatataccatttcgaatgataggggaatgattcaaggcgggccaagcagcaagagaagggctatggtactggacggattggcccacttagaatataaagaagaggaagacgccaagagacagaaaagggtagagaccaaccaccgaaacaagggactaagagctatgggtcatcccaggaactaa

SEQ ID NO: 26986 - DNA, 417 bp, Glycine max
  Peptide Sequence Number=SeqID_143764
atgaccgccaacttgttggcgcacacccgcctgttcaaggccggcatcgcgcgcagcggtgcctacaaccgcacgctcaccccgttcggtttccaggccgaggaacgcaactactggcaggcgcaggacgtctaccagaagatggcgccgttcaattatgccgacaagatcaaggacccgatcctgttcatccacggcgtggacgacaacaactctggcaccttcccgatccagagcgagcgcatgttcgccgcggtgaagggcctgggtggcaccgcgcggctggtgatgctgcccaacgaatcgcacgcctaccgcgcacgcgaatcgatcatgaccatgctggccgaaagcgagcgctggctggaacagaccatcggcccggccgagcagggcaaggcgaagaagaagcgctga

SEQ ID NO: 26987 - DNA, 201 bp, Glycine max
  Peptide Sequence Number=SeqID_143765
atgggtttccctttgccagcagtcacttaccttgccgagaatttatctggtctgaagattttccattccctttctttcattgacccaacgtgggaacccaatcttgatatctggggcgaaacaaatttgggtgtcaaggtgtcgatttcgggccgaacttccatattattccataaggcatgcgtgacaatgatgatttga

SEQ ID NO: 26988 - DNA, 171 bp, Glycine max
  Peptide Sequence Number=SeqID_143766
atgaagaaagggttttgcaaagaagtagcaaggggttctaatgaggacactactaagggcaaggaccatgaagcacttgaaggtcccatgaccagagacagacttaaacaggcccaacacatcatagagacaaggctggtcatttgtatagctgccattgatgatgattga

SEQ ID NO: 26989 - DNA, 117 bp, Glycine max
  Peptide Sequence Number=SeqID_143767
atgcctcccctccttacggtgacgttctctgcttgcccagcgccgggaaagggacaacgatcggtcggtcgtgaccctatcctccatttgcatccgtccctaagtacctgcaagtag

SEQ ID NO: 26990 - DNA, 162 bp, Glycine max
  Peptide Sequence Number=SeqID_143768
atggtacaccttagccttactgcccttcaccacacgggtcttactgctatattatcaaaggcacatcggagaccggcttacaaatcccaggttttcaaaaacgaagaagcagaagcggcgacagagccgcacaatatcgacaaagatgaagaagggagatga

SEQ ID NO: 26991 - DNA, 447 bp, Glycine max
  Peptide Sequence Number=SeqID_143769
atgatgaaagagatgtgtgaggatttcaagatcaaacatcacaattccaggccttataggcccaagatgaatagggcagttgaggcggcaaataaaaacatcaagaagatcgttcaaaagatgactgtgtcatataaagattggcacgagatgctccctttcatgctgcatgtgtacgggatggaggtcgtgttgtcgtttgaagtagaggtcccctccttaaggattctggtggaatccggattgaaaaagtcggaatgggcccaagcacgctttgatcagctcaatcttatagaaggtaatagattggcagccatgagccacgggcgattatatcaaagacgggtgaagaatgctttcgacaagaaggtacgagcaggtgttggacccgtaatcaatcaaccatcatccagcatctgcctcaagactttaaagaagcgctactag

SEQ ID NO: 26992 - DNA, 692 bp, Glycine max
  Peptide Sequence Number=SeqID_143770
atggttgaggtgaccgagactgatggcgtacgctccatgcacctgggttctcccaccatacaaagcagcatgaaagtcaaagatccctttgcgctggtgctggcttattcatggggggcactgagcagcctgttgttcaagccagatgccagcaagttggtattggttggtttgggtggcggttcgattgcaaaatatgtgtggaaatattgtcagcagatccagcaaaccgtgatcgaactgaatccgcaagtgattcaagtggcgcgtagtcatttctttgtgcctgacgatgatgagcgtttacagattatcgaaggtgacgggattgcttacatccagcagcatccgggccaatgcgactggctgatgatggatgcgtttggcagtaacggcttaccgccagatttttgcacacagtccttctttgatgattgcgcggatgcactgacccccaatggcctgtttacgattaacctctggggctcggacaaaaagtttgatatctacatgcagcgcatggagcaaacgtttgatgaccgtgtattaatgatgccgaccggcaaacctggcaatatcattgtatttggttttaaacctgagcttgccatgccggacctggcaacgttgcgtaagcgcgcacaagatgcgatgcagtcccatcatattaattttatcgatttaatcgaccg

SEQ ID NO: 26993 - DNA, 159 bp, Glycine max
  Peptide Sequence Number=SeqID_143771
atgaagacaggtgaagctttgaaacatgcattatcaacacaaagtagtgttgaagtagtcaaagatgaaaggcaccttaaaagcactaggaggtttaaaacgttgagaagcttgtggaagctcttagaagctgtcctgcaatctgtcaccataggctag

SEQ ID NO: 26994 - DNA, 288 bp, Glycine max
  Peptide Sequence Number=SeqID_143772
atgaggattggcaacactccttttcaaaatgtaatgccaagtggaaatggaagtggtattgctgggaatgctgtgcctagcatgtttgttcctccaataggaggaccttcacctctctctactaaccctttaatgaggcctccttatatgggatcttcagatgctactgatctctcaccagctgaaatttactgtcagcaacatgaagttacagcaacgggtgacaacattccacctcctttcatgacatttgatgctactgggttccctccagagatattgagagag

SEQ ID NO: 26995 - DNA, 303 bp, Glycine max
  Peptide Sequence Number=SeqID_143773
atgcagtcgaggttccaggtcaccgacggcacctccttctggaagcgcacatttgttttgatactaattttaatgatagacattagggtcacctttaatgtcgacgccagagaatcttcagcttcagaagctgaaagccaccgtgaacaatcatcattacccatggatatccctaaagcctacggaaatggagaagagttaaacccatctccacctcactctcatccttacaaagttacaaataacctatcctctatccacaacaaagaaataaatatttcccatgttacaaggagccaataa

SEQ ID NO: 26996 - DNA, 264 bp, Glycine max
  Peptide Sequence Number=SeqID_143774
atggaaccagctacagaggagttgattaacaaaacacaactggttcgtacaaaggttcgtgatcatgcaggaaaactaggcagtaagtgtcgaggtcaccttgtcatgcacaggcaagtcccccctccccacagtaatcagtctgagtctcaagggagttccaaaccgagtggcatgcccccaagtacaagtattcctcctcatgagaaactacaagtacttactgacaaagtttataatatttccatgcaatatgaagtatga

SEQ ID NO: 26997 - DNA, 210 bp, Glycine max
  Peptide Sequence Number=SeqID_143775
atgaccgaccctctcgatgagtcgatctcttgctttctcataaaggtggacccttgggtactagtacctaacacctttagaggactgtatgtcctcgccatcaaaggactgcacatcctcgcctacagagggttgcacgccctcgcctttagagggctacgcgtcctcattttcagtgtagctccatatccacaccttaggagaatataa

SEQ ID NO: 26998 - DNA, 759 bp, Glycine max
  Peptide Sequence Number=SeqID_143776
ccaacaaccccaagctgatcatgcacatgtctctcaacccatggggggggacacatgaaataccccaccacaatctagctgactttgagccttgcctcggatacaccactgaggggcaagtagttggtgtgggaagagcccctcttgcaatatctaaaaagggaaagttggatcaaatagaggaaaggctaaggacagctgaaggaggtcaagattatgcctttgctgacatggaagatttgtgcctagtacccgacatggtcattcttccgaagttcaaggtaccggaattcgataaatacaaggggacaacttgccccaagaatcacctaaaggtgtattgcaggaaaatgggagcatatgcgaaagatgaaaaattattgatgcatttcttccaagaaagtcttactggggaagccatcacttggtacactaatctggaaccttctcgagtccattcttggaaggacctaatggttgcttcattaggcagtatcactcaagtggcacccccaatgacggaaagggaaatgataacaatgatagtagacaccttatcagtgttctactatgaaaagatggtggactacacaccttcaagctttgcggatttagttttcgccggcaaaaggatcgaagtgggtctaaaaagaggcaaatttgattttcctggtttgataaatgagaagcctggggcaaatagagagaatgagaaggagggaggaacccatgttgtgactgttgttcctacatggccaa

SEQ ID NO: 26999 - DNA, 513 bp, Glycine max
  Peptide Sequence Number=SeqID_143777
atgcttggggatggaaatgaaggaatgtctacactacctggattgaatcagatacaatttgaagggttttgtaggttcattgatcggggcttaccagaagggctttttaagtttccaaaaattgaggatacagatcaagaaattgaatttcaattatttgtagaaacatatcaattattagaacccttgataaacgaaaaagatgctgtatatgaatcgcttacatattctgctgaattatatgtatctgcgggattaatttggaaaagtagtagggacatacaagaacaaactatttttgttggaaacattcctttaatgaattctctgggaacttctatagtaaatggaatatacagaattgtaatcaatcaaatattgcaaagccctggtatttattaccgttcagaattggaccctagcggaatttcggtctatactggcaccataatatcagactgggggggtagattagaattagagattgatagaaaagccaggatatgggctcgt

SEQ ID NO: 27000 - DNA, 897 bp, Glycine max
  Peptide Sequence Number=SeqID_143778
atgtccccacgtttagccaataaaaccgccatcattaccggtgccggcagcggcatcggcagcgccatcgccaccctgtttgcacgcgaaggcgcccgcctggcgctgtttgatcgcgacgcacacagcagcgaagcgctggcggcgcagctgcagcagcagttcggccagcgctgtctggcctgcgcagccgatgtcacgcagccgcagcaggttagccgcgcggtacagcaggcgcagcaggcgctgggggatattgatatcctgatcaactgcgcaggcgtaaacgtttttcgcgatccgctgacgctggacgaggatgactggcagcgctgcatggacaccaatctgaaagggccttacaacctgatacgcagcgtcctgccggcgatgctggcccgtcagtatggcaacatcgttaacgttgcctcagtgcacgggcacaaaatcattcccggcgcgttcccttatccggtggctaaacacgggctgatcggcctgacgcgttctctgggcgtggagtacgccgcgcagggcatccgcgtaaacagtatttcgcccggtttgatcatgacgccagccgctgaagcctggctggcgagctgtccggatccgcaggccgagcgcgcgcgtcaggcggcgctgctgccgtgtaaacgcatcggcgagccggatgaagtggcttacacagcgctatttctcgccagcgacgaggcgcgcttcatcaatgccaccgatatcctgatcgacgcggaatcgccggttacggatgcacgcgccggcaacgatcggccccctctgccaccggatgggcggcgatatcagcgcggtcagtgcggattgtcgcagtatcgacgtcaaagcgcttgtcgcggtcagccagcagcgccggattga

SEQ ID NO: 27001 - DNA, 1031 bp, Glycine max
  Peptide Sequence Number=SeqID_143779
cggccacaaagtcaccaacaataccgacaccgataactggtatcgcctcggccagctgttctttccgacggcgaatcagcagtgggtgatggagctgattggtaaagccgacgctacccagccaaccggaacggccgcctcgccggtcaatctggcaggcaccgggaaaacgtggattaacctgcagcggctggaaacggtatgggctgacgcctgccatatggggcagccggcggtgctggatattcgctacagccgcgtcggcaccacgtatgccgtggtatgggtgaagctgcgcgccaacagcggcgacacgctgattaacctgaagaccaccggcccgacgcgttttgaagctggctcctgctcgctgttccagcctgacttctcggtggtgacggataccaccaaaatgggcaccctcaaaccggcggcgcgctttggcctgcacaatggcgtcgcgggtattggggctaacgagaaaggcgtgcttaccgtcgcgacggcagcagcaccttttggcgaggctgcggcctcgccttttttttgtgcctggcgcgagagggcgctgttcgcggcgtttttccgcgtcaaaactaaggccagcccggctcagttggtagagcagcgcattcgtaatgcgaaggtcgcaggttcgactcctgtttccggcaccagtgatgggcgtcaggataatcacaatctaaaagaggcgcattgctcgggcgctgcaccctgcgccgcagtgctattcactgcggcgttcatatcttccttacccagcaatcagcgcccgtggttccagaaacgcgctgatacccgcctgtcccatctcccggcctatgccggagtggcggaaaccgccgaacggcgcgcgcggttcgtgtgccagcgtgttgatcatcacgcggccggcgatcagctgttctcctacgttgcgcgcatgctgttcatccgccccgattaccagtgccgacaggccgtaattgctgtcgttggctatggcgatggcttcggcttcatcgcggtag

SEQ ID NO: 27002 - DNA, 717 bp, Glycine max
  Peptide Sequence Number=SeqID_143780
ttgtcctcccatggaaggaaggtagataaatttgataggcctgctccagagattgaaggcttagtggctgccacaagattaagttctctaattgcatgttccttggacactagtgataggggacttgtatctacttttgtggagaggtggcataagggaactagtagtttccttctaccggtaggagaggtcactatcaccctggatgatgtggcatcgttgctacatctgcccattataggcaccttccatagctttgaggcttttcatgtggacgaagtcatggacctattagttgacttgcttgaaggacctgttgcactggtccatatgtatgagaatttgaatgacgcgtcaaagagaagcgccatgcaacttgcaggatatatcacacttttacagattatcatgagaggaaaccacgtgcttgttgttggaggtctgggaaggcattaccaatgtcgaagtatcgtgatctctttatttttcggacatatcagatggggttcgtccactgtcatataccgatcagagagggttgtgcgacaatttgggtatgtgaaaaccattcctccacaccctggtgctctgtctctatatatagaggatattgatgatagatggattcagttttctgaataccttgcaccagatcctcctagacatccacctgtggtgcacgaggagacatttgttgaaccagaccctcctcaatag

SEQ ID NO: 27003 - DNA, 753 bp, Glycine max
  Peptide Sequence Number=SeqID_143781
atgtctcggcattcaagaataggggcttctccttacgagattacgtatggtaagaaacctcttactatcccacagtatgttacaggaacatcgaaagtgacagcgatggatgactttctgactaaccgagaggttgtttttgccttatatcggaagaagctgttgaaagcccgggaggttatgaagacatcgactgataccaaacgcagagacatgaattttcaatgtggcgattgggtaatggtcaaattaaggcctcacatgcaatcatctgtttcaaacacaactcactccaagctcgcaaagaggttttatggtccttatcagattgtggagcagattggtaaggttgcttataaattgaatttacctgccgggtctcgcattcaccctgtcttccattgttccatcctcaaaccatttaagcaaacttccacctgtatacctttaccccttcctgctaaggctgttgacagcaagcctctaatttcacctctcacgattgtcagtaccaagtgggaccagaagtcctcatctcccaaacttttagtgcttgtccaatgggaaggactatctctagatgatgccacatgggaggactgggaggagcttaagtccgacttcaaccttgaggacaaagtcatttttgatgttgtaggggatgaaatacagagcaagataccacaagtgaaaatgacaagtagacccaagaggaaaatatcaacaccaaaatatttagcagattataaatga

SEQ ID NO: 27004 - DNA, 456 bp, Glycine max
  Peptide Sequence Number=SeqID_143782
tcattcggggttcccgtcactcctagcaaggtgatccgaccgctgatcactcgggccttcattgagaagtattgcacgcctaggcaggcacagggtgatgcacctcaggccacagacgcaccgccaccacctcatcaggctgatcccgtcgggtcactaggcatggagcgttatctacaacacttggttcgccagcaggcggccaaccaccgggggcaggtgcagatacatgagtgtctctaccagctcagccttagtcagcagggacagggtttcgctcctattgcgtgccctactccagatcagtttagggctatggtcgcatggcccgaagattggcccgaggcccaggcaggggaggcgcctgcaggagctcccgacgatgcagaggaggcccgtatggataaggagatgatggacttgctcggtttcttgggtggaagcggagccacgtga

SEQ ID NO: 27005 - DNA, 874 bp, Glycine max
  Peptide Sequence Number=SeqID_143783
gaaagaacgcgctttagggctcccttaccgaacgcgtgccagagctagagtaatgagtgaaatagaggaggtgcaagagcagatgaaggctgacatggaagccatgaaagagcaaatgaccacaatgatggaagccatgatgagtatgagaaaaatgctggaggtcaacacgactacagttgctgtcacaagtaccgtcactgaggtggaccagactcacccatctgacctcaatcaagtaaatcctccagtctcggatatagtagggcagggaggcaaagccattccttcccaccatatggcttgccatacgccacccgatgttgcacacactcccgatgagaatgtcgacaactccgcacctatgcccattctgtgccaacaacctcaatctggtcagacacatgtccctcaacccatgggggagacacatgaagtacccaaagaccacactctagctaactccgagccttgccttggatatgctactatgggagtccctcctgctatggtggaaagggagaaattggatcatatagaggaaaggctaagggtcattgaaggaggcagaaattatgcctttgctgacatggcagaattgggcctagtgtacggcgtggtcattcctccgaagttcaaggtgtcggactttgataagtacaagaggactacttgccccaagaatcacttgaagaacatgtttaagagggagcatgaatctttcaaagaatatgcccaaaggtggagggatttggtagctcaagtagcgcccccaatgatggagagagaaatgataacaaagatagtagacacattaccggtgttctactatgagaagatggtaaattacatgccttcaagtgggatcctctag

SEQ ID NO: 27006 - DNA, 150 bp, Glycine max
  Peptide Sequence Number=SeqID_143784
atggagtcaaaggattttgagtatggtctctatttgaaaaaagatctagccaaggctaaggatgtcactaagcaagtggagtttgagagctccacaatcagaatcattagtgaccataagcaatttgaagcaactgatgagactggttag

SEQ ID NO: 27007 - DNA, 441 bp, Glycine max
  Peptide Sequence Number=SeqID_143785
atggctccgagaaagttttccgcaaagagatctaggaaggacgccgtggttgaagggactagtgccactcccgagttcaacagccatcgtttcaggagcgctgggcaccagcagcgtttcgaggccatcaaagaatggtcattccaccgagagagacgcgtccaactcagggatgatgactacacagatttccaggaagagatagctcgccggcgttggacgtcgctggtcactcccatggcaaagtttgacccagatgtagtcctagagttttatgccaatgcttggcccacggaggagggcgtgcgggacatgcggtcatgggtaaggggccagtggattccttttgatgcagacgctctcagtcagttcctgggagactcgctagtgtcagaggaaggccaggagtgcgagtatagtcagagaaggaatctgggctga

SEQ ID NO: 27008 - DNA, 687 bp, Glycine max
  Peptide Sequence Number=SeqID_143786
atgactcatcctccacatgctgtggtacctaggctgtgggaccttcatcttccctgtgaagagaaggctgagtcccaggccaggctaccatctcctgaaacttctcaacttaaggaatggatcctggaggtgccaccacatgccaagttaatgatggggctcagacactcaaaagttaggttgtcagagacaacccctctggctctacatagagcggtgatcagagcaggaaacccaagtctagaagtgttagactgggatatagaagttatctggccaaaaataagagctcctacgttcatgtccatgcgagagactagaccaaagatcagcctagctttgtccactgtcagatcagaggtatgtgatgtgggggtcaggttggagtatgagagaacactctacacttgggctaaagtagtaaaatctttgctgagaatcctcccaggatggccctcagcattcaagatgaaccctcagcctggtatgcataaggcagcctcaatctctctgtactctatgggcagcctgcagtatctggagtatatgggcaaagtctcaccctctgccaacaccacaggtgtctctaaaaatgtgttgaggctgtcagcatcaatcttcactagatggcctctgactttggcttactttggtgaagggccctcagagctgtatagatttgcatag

SEQ ID NO: 27009 - DNA, 171 bp, Glycine max
  Peptide Sequence Number=SeqID_143787
atgttgtgtacatccctctgttgcacttttgcgcatctacatcacgtcgtcacgcatgcgttgtatgttggtctcgtcttttgtcacgagaagccagaaggtccatatcaccttcttaactgcacacatggggcactgcgcccccaaatgcacaactgttatctcgcctaa

SEQ ID NO: 27010 - DNA, 471 bp, Glycine max
  Peptide Sequence Number=SeqID_143788
atggattctctcattactaggcttctccgtgtacctcatgcgttgaaggatgaaaatctcactgatgctgtggaaacatcagccatggtggcacctcgtgggagagggggaggccgtaacagtagaggaggccacaatggaagaagtggacgtccgcaatgcacatattgtaagaggatgggccacactcaagaaaattgttactctttgcatggcttccctaacaaagtggcacaggtatccaagtcagaaaaatctgagtctaagttttctgatgaagaataccaagagtatttgaagcttaagtccgagaaatccagcaatcaagcatcatcttcatcagtaccatgtttctcaacaacatgtgtttctcaatcaatcggaagtcctagcccttggatacttgacttaggtgcctctgatcatatctctggaacatgggatgggtcaactgattggagaaggacgtga

SEQ ID NO: 27011 - DNA, 801 bp, Glycine max
  Peptide Sequence Number=SeqID_143789
atggcgcgtgcggcgtccagtagagcagcggagtcaaactggccgtgtgccagaatcattgtgcacatagtaaatctctccgtgaggtcaaagcgggaacagcaagaagggcgtgaaacaccgccagaatttcgtcgcgactggcggcaggcagacgcagcgtggcgagaatcccggcgtggcgcgtcagatcggcgtacagcgatgagcgcggcgagacctccagcgccgttcaggcaggccgcgtccggcttcaacctgaaaggctacctcggcccagttgatgccggtgacctcttccaccaggttcaccacgcccatgccggacaggcgaaagcccatttcgagaaagtgcggttcgccgttcaccataatgaaatcaatgtggaaagcgccgcgccggtagccgaaggtttcacagcagaagctcatcaggctggtgaaggcggcgggcagctgctgcgccgccatcgccacatggccggattcgtaaaagctgatacagccgtcggcctcggtatgctgctcaatcaccttctggcagcaggtcagcgccaccgcgtgtccattctccaccacgccctgcagcgaatattcgtcaccggccagccagctttcgacgataaagccggtaaagccgcgtccgccatagttcatggtgtcgagcagccgggcaatcaccgcatccagctggctggcctcttccaccagccagatgcccagcccgccgccgccgtcgaccggtttgatcacgcaggggtagagcagcgcatcccgcgcgtcgccaatgctgagcggtga

SEQ ID NO: 27012 - DNA, 132 bp, Glycine max
  Peptide Sequence Number=SeqID_143790
atggatacttcattcacagacaatgaaattgaacaagagcataagtgcaatgctggttgtcgttgcagttcagagaaagaaaaagaaaacaaattatacagttctgctgcagttgcataccgatgcatatag

SEQ ID NO: 27013 - DNA, 570 bp, Glycine max
  Peptide Sequence Number=SeqID_143791
atgaaagaaagaggacagaaattcttcaagccagattgccactcgaaatcattctcgactggcaatatcccaccccacatgaacaaagaggaaaagaccgaaacacccagcttcctctccaaaaacaccaccctcgagaaaatcctattggttcgtgatcgtggaaagacccggtggatcgttcggtcctgccgaccaacccgttttcggagccccatgaattgcgttttcgttcatgtgtcctccaccttcgagtttggagctatgcgtagtgattgcttagtgcaattctccattctcaacctttttcggagccccatgaattgcgttttcgttcatgtgtcctccaccttcgagtttggagctatgcgtagtgattgcttagtgcaattctccattctcaacctttttcggagccccatgaattgcgttttcgttcatgtgtcctccaccttcgagtttggagctatgcatattagtgcaattctccattctcaaccttttttggagccccatgaattgcgttttcgttcatgtgtcctccaccttcgagtttggagctatgcgtag

SEQ ID NO: 27014 - DNA, 468 bp, Glycine max
  Peptide Sequence Number=SeqID_143792
atgaataaggagaggaacagactcgtcttcgaacatgagactacgctggacaatgtccatgctagcatctgtggcgggagcaaaagtttcacccatggagaagacaaggaagtggtgagagaaagagaggagtgtggggtcttcttctccgagatcaacaatctcaagaatacctttgtgctggtcaaggagaaggttctaaggcttgagatctcggtgaaggacaccttggctatggcaatgagcaacaccctttcagatctgggagaccaaaccctaggtagtgtcctcgctcgtgatgacctcgtcaccctctgtcaaaacaacttcaacctcctcgactgcgacgtggttagtgaggtggaaggcaccatagtggtggtcggagcgtgtgaggggatctcgatagaggtagagagggagtcagagagcgagagagagatggagaaagagagaggagaggcatag

SEQ ID NO: 27015 - DNA, 660 bp, Glycine max
  Peptide Sequence Number=SeqID_143793
atgcagcttgtgttgcctgttacaacagtgatagagccaacatgtgcttctcccttgcactcaaatcctcacactctacttgggtatgcaaaccattcaacaacaccccaattcaacacttcttcaacaacactccaagaacgccaagtccaagcccatttaattgttgcttctcacaacctcttccttcataatcacaccccttctaagctacacacttttctttatcttcatggcaccccagatgatgctattcttgatgctgctaactttcttcactcactaatctcaccacttttcccaccgcaggctcaactctctgtggatctcattgcacaacttcttgcaaaggacagactcaactcctttggcttaatggacccgtattcctgtaatggccctcagagatctattaaggcttatgctatttaccccaaagccacgttcttcaaccatgactgtgttcccaatgcatccaggttgattgaggatgttgatgaggggaaagaggttttgcatcagctatttcaggattggtgcaagattgaagttaattgggatggtgaagaaaacaacagtgaccttccacacgtgcaatttcttagcaagtatgtttgtgagaggaatcaatatactaaaagcacctttcctgaattttaa

SEQ ID NO: 27016 - DNA, 1104 bp, Glycine max
  Peptide Sequence Number=SeqID_143794
atggcttgctttctcccatgcccagacctaggtaccaatctgattgtttcaaaagaagagttctttagcttccacaacattgatcgtcaactcttcacccgtttggtggtagtactaggccgtgacaccagccaatctacacatgtcatggccttcattatgtggcttgaaaagcaatgcaaggatatgaaaatgataaagaacatgctccaatggtctgacaccatgattgatagccttgcagatgaggtcatcttggttttgaattgcgttgagagttctcaattcccttatgatgatgttgttaacgatgaaaccttgcctttgatcaaaaacatcctacaaaacaacgttgcaaatctcaaatacttttatgataaccgtgtgactatcatcggagcagtcaccaagttacttaacaatgtttgtgtcagggccttcatagatatagtgcatgaagtgcaatatatgaaggctatgaaggaacaaaacttgcagatcgcaaatatctatggaactgatccatatgcaaaacaagcagtatattatactccactgcctagtgttacttttgtctcccaacaggttgcaataccaacaccacaatggagtgaagggaactcaagttctcaggagaccaatatcaatcctcctttagagacttgtgatgtttcataccaaacagattttaatcaaaatttgaacgagctcttggccatgctgaatgaaactagtattactactagtgctagtgatgggaaaaaggaggtgctggttgatgataggattatctttatgacattctctaaagggtatcctatttcggaggctgaagtaagagagttcttcgcaagaaggtatggggatatcattgaagcatttcatatgcaagatgtggttccaccgcaacaaccattgtatgctcgcatagtgattcgcactgaggccatacaattcattgatcatttgcttgagagcacaaataaagtgaagctctccatcaatgggaagcacgcttgggcaagaaaatatgttcgcaagggtaacaagtcaccaatgacttctcgagcaccttccccaacttcaacaagaccatcttattga

SEQ ID NO: 27017 - DNA, 471 bp, Glycine max
  Peptide Sequence Number=SeqID_143795
gcagcatgttgtggaggcctctggtaatcgattaccaggctgtgtaatcgattacacagaggaacatgccactagtaatcgattaccaatcgtgatggcagcgcagttcatccatgatcgagtggagatggagtgtctcgagggagcttgggagaccctcgaaggcaatgcgaggaacccgctcgcacgattcagcgtactagtggagtggatactacccacgcctacaccataccgtctagtggagccagtccaagtgatcgagctgacgtcatccgaggaagaccctgaggaggatcccaaggagctacctcctgagcctgctgtggatgctcttgactttctagagggtgatgaggacccactccctgaggtggattctcccgaggacgtcatgtcggcatctgaggcagactctacggaggatagtggtcctggagagatggcgatcagtggaggctcttcatcata

SEQ ID NO: 27018 - DNA, 267 bp, Glycine max
  Peptide Sequence Number=SeqID_143796
atgggcccgaaatctaccctaaggctcatgagaaccctagggccttctcttgcatctttggcccaatcttcttggagtcttctatccaatgccctcggggataggattgcatcaggcaactccctgcgcccccatggtgatcagcctgagtctcaagagagttccaaactgagtgacatgcccccaagtacaagtattcctccttatgagaaaccacaagtacttattgacaaagtttatattatttccatgcaatatgaagtatga

SEQ ID NO: 27019 - DNA, 312 bp, Glycine max
  Peptide Sequence Number=SeqID_143797
atggttgagaagacaaagaaaagactaaaagaagctgccaagtctggaagcattgagggcatcattgaccttccatctcccatcagacgccacgtgaagtggaagatggctcgcacgaaaaaaactggacagatgacgtttgagactgcaaaggaaataactgacaggattgaaagcgtcacaaggattgttcgtcctccatggacatcaggatatcctgactgctgtcattgggcgaccagagcacctggttgtgttcgtgctgttggtgccggtgtcaccataaagcaatactttggatcggtttcatga

SEQ ID NO: 27020 - DNA, 210 bp, Glycine max
  Peptide Sequence Number=SeqID_143798
atggagaagtttctaaggaaggacatcattgatatgaaggcgaatggtttggatgatcgtgcttatggaagggccctagtggagaaagacaaagcccccgagtggagaaggatgacagatgatgtgatcctgactaggagcagatcgcttgatacaggttacagggtttggatgaggccacttccggtgaaggaagataagtcagggtag

SEQ ID NO: 27021 - DNA, 391 bp, Glycine max
  Peptide Sequence Number=SeqID_143799
atatggaaaaaccgaaaacagcaaacagtacccaccattgcagagacatgcctttgtaaaatggtggtcacaattcgataccccaaaggctgctccagaacaagtcaagaactggtttcagagcaactctgagtttctcaagcctgctgatccagagacatctttgtttctgaatcaaaagtctcaacttgcagcgttcttagcaagctcaaaatctaaagagagtcttgctcagaatcttaaggaagttctccaactacttcaacaagaagaagaagaagaactccccaagaaagaagccgaatcatccgagaataatgatgaccaggaagatgatccattctaccaaaatgaagatgactgctttggtatatcgttagacgatgattag

SEQ ID NO: 27022 - DNA, 321 bp, Glycine max
  Peptide Sequence Number=SeqID_143800
atgagagtccctctcattcatttggtccaacaaaacaagtttcatggacttgaccatgaagatccatatgcacatttgactacctttgttcacatctacaacattgtgaagatccaccaagtggatgatgagtttattcgtcttattaagctaatgtctagcacatggcctgatgatgaagcaaaaatcaacactttgctagctggattcaaacctaagaccaaacacatgtttgacgctttagttgaaatcaagatcatgcacacaactctcgaggaggccaaggaaattattgaaaacatggcttccaatgactatgaa

SEQ ID NO: 27023 - DNA, 288 bp, Glycine max
  Peptide Sequence Number=SeqID_143801
atgtggggttaccttcccggatctctgccgcagaggatgccactgttgatgctggttctcgttagggttccgccctctggttactcttggaaggatgtttgcggtggtggttgtggattcgccatggctatctctggtatgtggtttcatatggatgtagttatgcagtatatggatatacaatcaaaaaaaggctcaaagaaaaatacaagtgggcccaaaatctggcgtgtctatgagaggagaggcaagataggaaaagagaaatatgagggtgctgagtattga

SEQ ID NO: 27024 - DNA, 348 bp, Glycine max
  Peptide Sequence Number=SeqID_143802
atggttctgtccaaaaccgcctcggagacagacgtctctgttcattccaccttcgcctctcgctatgtccgcacctcccttcccaggttcaagatggcggaggaatcgatcccgaaggaagccgcgtaccagatcatacacgacgagctgatgctggacgggaatccgaggctgaacctggcgtcgtttgtgacgacgtggatggaacctgagtgtgacaaactcatcatggctgccattaacaaaaattacgtcgacatggatgagtaccctgtcaccactgagctccaggcaagtatcacatataccatacttgatattaatcaattattaatgtcgttcaattaa

SEQ ID NO: 27025 - DNA, 1092 bp, Glycine max
  Peptide Sequence Number=SeqID_143803
gttaagcgtgttaacaagtttgattcgcttggttcggagataatcaaaatgccgaagcagtttagctacaaggagctgaaatctgctaccaagtgcttcaatgcgaataggatcatcggtcatggcgcgtttgggactgtgtataagggggttttgcccgagaatggggacattgtagcggtgaagaggtgcagccatagtagtcaggggaagaatgagtttttgtctgagttgtctatcattggaagcctgaggcatcggaatcttgttcggcttcaagggtggtgccatgagaaaggagagattttgctggtgtatgacttgatgcctaatggaagtttggataaggcgttgttcgaggctaggacgccgcttccctgggctcataggcgcaagattttgttgggcgtggcttcggcattggcctacttgcatcaagagtgtgagaatcaggtgattcatagggacattaagactagtaacataatgttggatgaagggttcaatgccaggttgggagatttcggtctggccaggcaaactgagcatgataagtcaccggatgccacggtggctgcggggacaatggggtacttggcacccgagtatctccttaccgggaaggctacggagaagactgatgtgtttagttatggtgcagtggttcttgaggtggctagtgggagaagaccgatagagaaggatgccaatgggggtggtaaaggtgggattagctgcaatttggtagaatcggtttggagtttgcaccgggaaggtaggttgctaatggcagccgatccgaggcttgggggtgaatttgatgatggggagatgaggagggtgctcttggttgggctggcttgttctcaccctgatccattgactagacctactatgaggggtgtggttcagatgctggtgggcgaggctgaagtgcctcttgtcccaagaaccaagccgtcgacaggttttagtacttcccattcccacttattactgagtttgcaagatagtgtatctgactgtgatggtataatcaccatctctacctccacatcagagaacagcttcaatcttggagacatagtctga

SEQ ID NO: 27026 - DNA, 1647 bp, Glycine max
  Peptide Sequence Number=SeqID_143804
atggctgcctttcatggctgtcatgtcagcccacaacacccgccaaatcacctatttccatggcatcctttccacacaaccatccaccatcaatcatttctgcaagacccattccttttgtttcattacacacattctccttatgtacatccagctcaatcccttgggattgattttgagagcacccacaaacctttgctcggcttgttcggtatagagggaactcttcctccatcatctcccaccttacccctgaaaatggaaagcaatttccactctgccttacctcttgagagcataaacaacttccattgcgataacagtcttcctcctctcgtgctcaaggtaaggaaccgcgccgacgagacagtcccttgtgaggccacggaggaacttgtccttttaggtacaccagagttgtcgtccaaggtgtcccctctgtcgatcaaacaagttgtggcacaagcggttttgttatcgtcacaaccagtatcaacgtcaaagttctcgtccaagctgccttctctggtgacgaaacacgttgtggtgcaagtggttttgttggaggtatttcgacaccgccatatccgccttggtaagctatcgtcacctctacgatgtgcttttcgacccagtcttcggcgtcgctgttggacttcaaattgttgggatagtcagagtcatccaggaaccaacaccaaggacacactcaagcgttgggttccttgcgcgagtgtcatcgaagagaaagaagtgaattgtaagatctgttattctattggcatgttctgttcattgttctgtcacacattctcgacgaggacgtcacaacactgcgagaaccacaagttcctctctcgaaagtcattcttagggagttgggaggcgtcacgggaactaaaggaggcgaaggcgcagctggcgtggctgcaaagggaatacacggagcaagtgatgggggctcaggaggaatccataagagagatagaagccatgaagatgcaagcctacttgttgggggcaaaggttggatatgactctctatttttcgcacagattgattaccaagacaaagccaagagaaaagatgtgaaaacttttgaagttatgtggcggggctccaagagctttggttcatcatcacaaatattttttggtgcatttcctgagaaagaacctcccagtaatttctactatgaagtaaatgatgattttcccattgttcaagatgatgttagtttatttgattacaatgtccctaaaagagtaaaggagtttgtggcaaccgcaatatcacataccaatattatatgcacaaatcatataatgtggacaatgcgaatagatttcaagtaccaatatgcacaaacttggtttcagcaattggacaagtttattcactatgttaatcaagatgattgtgtaaatgcatataggaccaggtatcttacaagtaggccaacaatcaaaggttatgtcagatttatgactggctattacttggcagcaagacagttgaaatattttaaagggaagagtcccttatttcccaaaactggctctttggctgaagccttgcctagtgctcaacatcatgatgcggtactttttgttataaattcaactcttacttttgaagtttcttaa

SEQ ID NO: 27027 - DNA, 450 bp, Glycine max
  Peptide Sequence Number=SeqID_143805
atggacacaaaaccatgggaaggtctggatattgataaccctaacctcccattgtttgtgaaagggagtatctccaatgcaccatccatcatttcaatacttgcgggtgtgattccagaaataatgaacaattgtgtagtagaagaatcactatcaactcaagaattcataaatcgtgtcaaacatgagtatgaatgggattttcttgtcaaaccttggattagagttgttcaattttttaaatcaaccgatcttacagacaagattatgcgcatcatgcatcataaagtgattgagtatgttgatcatgggaaagacattagtgttggttccgtgttagctttgcgtaaggtatacataattcctaaaataattgtcccattaaggcgtatattttgtcaaatactaccttttttacatgatacacaagtcttttccgctaaagattga

SEQ ID NO: 27028 - DNA, 204 bp, Glycine max
  Peptide Sequence Number=SeqID_143806
atggcaaaggcagttgcaaaggtgtattggggagatccaagggagaagttgtgtaatgctgtagaagatcttcacctggactttttggttgttggaagcaggggtttaggtcccattaaaagcgtaagcaataatgtgatgacaaatgcttcttgccccgtcacagtggttaagggaaaacaatcttccaattcccatcattaa

SEQ ID NO: 27029 - DNA, 1857 bp, Glycine max
  Peptide Sequence Number=SeqID_143807
atggcatgtttggttggtgccattgtgatcctgtggtgctgcataagccatgtcacatctgatgcatcggatcaccgttacatgaaaggagattccgttcccttttatgccaacaaggtgggaccctttcacaatcccagtgagacataccgatatttcgatcttcccttttgctcgccagctaatgtggaagaaaagagggaagatcttggtgaagttttgaatggggatcgattagttgctgctccttacaaattggacttccaaattgacatagaacctgaaagttactgcaaaaagaggcttacaataaaagaggttgctcaattcaggcatgctgtcttgaaggactatttctaccaaatgtactatgatgacttgcccatttggggtttccttggaaaatttgacagtgaagacaaggatgatcaaagtggggccatagtccacctcttcaagcatgtccattttgagattctgtacaataaggatcgcatcattgatgttttcattcgaaacgatccacaagcagttgtggacctgacagaaaataaggaagtagaagtggacttcacatattctgccaaatgggttgaaacagatactccatttgagaagaggctggagaaatactcacagacatcctcactgtcacataacttggaaatccattggttttctgtcatcaactcttgtgtaactgttctcctcttgactggattcctggccataatactcatgcgtgtgctcaagaatgattttgttaagtttactcctgatgaggaagcaattgatgaccaggaggaaagtggatggaagtatattcatggtgatgtgttcaggtacccaagattcaagtctttgtttgcagcagcacttggaacaggaacccagctatttacacttacaatcttcatctttatgctcgctctagttggtgttttctatccatacaataggggagctttgtttactgcactggtgatcatatatgcactaacgtctggcatcgcgggctactatgcagcttccttctattatatgattgaaggaaaaaattgggttaaaattttggtgttgactggaagtttgttctctggacctttgtttttcacattctgctttcttaatactgttgcgctcgcctataacgccaccgcagcgcttccattaggaacaattgtggttattttcctcatatggactcttgtaacctcacctttgctagtgctgggtgggattgctggtaagaatagccaatcagggtttcaagctccttgccgcaccaataagtatcctagggagatcccacaagtaccttggtaccgtacaactcttgctcaaatggctatggcaggtttcttgcccttcagtgccatttacatagaactctactacatttttgctagtgtctggggtcaccaaatttacaccatatacagcattttgtttattgttttcatcatcctgttgattgtcactgcttttgtcactgtggcattgacatactttcagcttgctactgaggaccatgaatggtggtggaggtatgtaaactttttacatgagagtgccctcactgttttcctaatccatattcctccgtctgctaacggttttgattttggcgtgattaggtctttcctttgtggtggatcaactggcttgttcatatatggctactgcttgtattactattatgcaagatcagatatgtctggcttcatgcaaaccactttcttttttggctacatggcttgcatttgctatggtttctttctcatgcttggaactgtgggtttccgtgctgctttgatctttgtccgtcacatatatctttctatcaaatgtgaataa

SEQ ID NO: 27030 - DNA, 111 bp, Glycine max
  Peptide Sequence Number=SeqID_143808
atgagagataaggttaagtttagatgtgagagaagtgatagggacgacccatggaaggtggatagcttagcaagagtctctaagatagcaacctggagaagagtggaataa

SEQ ID NO: 27031 - DNA, 135 bp, Glycine max
  Peptide Sequence Number=SeqID_143809
atgggtggccacaagggtgcttgtggtggcattcttagatatgagaatgggaattggataggtggtttcttcaaaaaagatttggtgcttgtagtgttttgtttgcagaacttagtgttattctcttggccttga

SEQ ID NO: 27032 - DNA, 537 bp, Glycine max
  Peptide Sequence Number=SeqID_143810
atggctatggagaatgaggaaggaaatttcattactgatccacaggagttcaagcatttggtgactcccttagttatattcaatccactccatcaaacactgagattaaaaatgcaatttgacatggacaaactgaagacaccaggacctaatggtatccatgccatgttctttcatatgcattgggatgttattgtggagaacccatctatgctctctcaatatcatcctataagtctttacaacatggtgtacaatgagatttttcattcaacgaggaagctaaaaggtatgatggttgtgaaggtggatcttgaaaaagcttacgataagcttagaagggaatttgtcaggcataccttacacgacattggttttcatgatcactttgttaacttgattaatgccctagctaggggattagccactcatggtcatgagggctttacaatgagaggaggggtgcaaacttgggcttgggccttcgtagtcacgctgagcgcgaagcctcacgctcagcgtgcgttctgcgcttag

SEQ ID NO: 27033 - DNA, 171 bp, Glycine max
  Peptide Sequence Number=SeqID_143811
atgtctcattccgaggagggttctatgcgccctgacaagggagattttgatgctgtcagtgaccagaaatcaagtattccccttagtggcgttgttcatcttgtcgtcggctctgccacctctgttggtggcgtcactgctgttaagggaaggcctcatccatcagtataa

SEQ ID NO: 27034 - DNA, 222 bp, Glycine max
  Peptide Sequence Number=SeqID_143812
atggcgactccactggggagagcgaggccatctgtcatgatcgccacctatcgcaacctacccttcagcgggagggcgaggcgaaacaaaaaagaagtgtcttccaaaaaggaaatgcgcgggagtcgccaccaatatttatttaagggaaaatggtcgacaatggtgttgcccttgctcctatgtatcctcaggtgcgatgaggaattcagacctatgtag

SEQ ID NO: 27035 - DNA, 465 bp, Glycine max
  Peptide Sequence Number=SeqID_143813
atgtgcaaggctactcacctgaagacaaaaatcatggggcgtattcttattattgcaaaattgggcatggtatcacatgcctttcattgcactgagagtcaatcgtcaacccacatatggagtggtggtgagctacaacatatgggaacaccttatggtgatcttataggatatagatccaaattggataatatgagacctgaacagggttccaagatgacctataaatctttaaaaactccacaagatcaacatgattgtcatcatcaaaaagggagagattgtggaagcaatgtcttccaagattattttgatgatgccaaagaatcaagagttaagcaagttccaaagaatcaggagtcaaaaagattcaatcaagtttccaagaatcaagattcaagaataatcaagattaagattcaagattcaagattcaagaatcaagagaagactctatcaagataa

SEQ ID NO: 27036 - DNA, 228 bp, Glycine max
  Peptide Sequence Number=SeqID_143814
atgattgcaatacatcaagaatttgtaaggctttttagggaacacgaagatgacatcctttctacgcaggttaacgatgacgatgacaatgatgaggttgttacaagatccccatcttctccaaatgtaaacaacccccagccccccaacaaatgcttgatttcttcaaccgtaaaagtattccaacatagtctaaaggaatactacgggttgggatgcaattcatga

SEQ ID NO: 27037 - DNA, 327 bp, Glycine max
  Peptide Sequence Number=SeqID_143815
atgaatcgtcataatccagacagccaaagcaatccacgttgtcataccctaatttcgtccggggacctttgctcgatgacgtgcgaccattctttggtcctcgtgaggtgcttggcacccatcattaggcaatttgtgaaattccaggacatgccggaaaaccaaaaaaatattgatgcacaatcccacccaggcccacttgggccctctggaatattcctccagaaggcggttgcttctggaggaagcaaccctgctcgcctgggcgagctgagctcgcctgggcgagctgggcggcaaccacctcccctattttgctataaatag

SEQ ID NO: 27038 - DNA, 489 bp, Glycine max
  Peptide Sequence Number=SeqID_143816
atggcgtcgtcggagaataaaccttcttctcactcttctcctcctgcacatgcgtgtttgcataagttcaggctctatgagactctttcgaacttctacatgataggaagggacaagagcaggacttattggagagtgttaaagattgaccgtctagatccctctgagctgaatgtgcttgaagattccaccacctatacagaaagtgaatgttctgacctgttgaagcgtatacatgaggggaacaggtccactggtggactgaaatttgttacaacttgttatggaattgttgggttcataaaatttttgggcccttactacatgctgcttatcacaaaaagaaggcaaattggtgcaatcagtggtaatacagtatatgctgtctcaaagtgtgagatgattccactgcaaagttcttctgttcattctaacatcaccgattctataaatgaaaacaggtctttacaatcttggatgttatattga

SEQ ID NO: 27039 - DNA, 2130 bp, Glycine max
  Peptide Sequence Number=SeqID_143817
atggcttccgctttcgctttcgctcctccttctccccctcctccaccaaggaacggtggctctcctataggttcttcggtagttatcactgcgaaggagtttttgcactccatctcactgaagcttaacaattccaactacctcctttggtgtcaacaggttgaacctgttctcaaaggacaatgcctttttcatcttctcactgaatcacagattccgcctctatcgtggcttcaatctactatttccgacaaggtgcttccacggctctttggttgcaaaactgcatggcatctttgggacaaactccacacgcacttttactccattgttcgagtgaaaaagcaacaattccacgatgatttacgtaacatttttctaaacaatagttcaatttctgactatttgttttgcattcaaaccattattgattctctctcgtcgattgtagagcatgtgtctgaatctgatcatgttgacattgttcttaatggtttaccagatgagtttgagttgctcataacctttgtgagtggaaagtttgagtcgctgtctattgatgaagttgcgactctccttctggctcatgagactcaaatcgctcgcaagaaaacacttgcctcatccattgctttgattaatctcgccgaaggagcaaaacctaattttagccccaattcggggcaacaagattctcatcctcaagtttatgttgctcaaggttctggctttgatactatcttagaatgtgggtttggacctattgggaaaaacaagacatggagaataggtgaagtatttacatggcagggccatatgctctgtggctctggagtcaataagccaatgggatggaggcgaggtgtaaatgacaagggtagagtagctaatgatgtggagacagaacaaattgtatttgaggatgttcctgaaggtcttccagtccaaatatgctctgttgtccagaatcggggttcaatccctctcttctggtcacaggaaacttcacgtctaaatcttaagccggatattatattgtcaaagaaagatcagaattatgaagccactagacttcactttgaaaatcttgtcaaaagatacgggcatcctgtaataattttgaatttgattaagtcacacgagaggaaacctcgagagtccatacttcgttctgagtttggtaaggctattgatttcattaacaaagatttatcacaggagaacaggttgaggtttcttcattgggatcttaaacattttcagagcaaagcgacaaatgttttgctacttctgggaaaagtggctgcatatgctttgacagtaacaggttttttatattgtcaagtgccaccaactcctagacctgaagactgtataaaatgtccatctattagttttgcatacggaaatatcgataagggaagctttcaatccacaagacaagctgatgtcgacaacaaagatggtaatactttagagaggaaacctagtggagaaagcaaccttgctaacggaaaccattttgtcaagccacctatgttccagaggggggttctcagaaccaattgcatagactgcttagatcgcacaaatgttgcacaatatgcatatgggttggctgctcttggccaccagcttcatgctctgggaattattgaccacccaaaaattgaccttgatgatcctctaagtgatgatttgatgggattttatgagcggatgggtgacacacttgcacaccagtatggtggttctgctgcacacaaaaagccacaactgggtaagcctgctctttgggatttgggctcagatcaacattatgatatagggagatatggggatgatgatgcaagcttatgtggtaactctgaattatggctttttaggtcatttgtcaaaaggtgtttctcagatggaagcatcattgatggcaattctacacctatgtcaaccccaaatccaaagcttgaaaaattctcaaagctaggtttgcaggaccaatcagaagaaggaagcaaggctttttgtgagtcatcgcctgaaatatcaacttcttctgagactgagagtgacatgtcattttcaagtccaagattcgaatatcaactcattgttgacccaactggatag

SEQ ID NO: 27040 - DNA, 777 bp, Glycine max
  Peptide Sequence Number=SeqID_143818
atggacaacaaacacaaatacttcaaatccatcaacattgtcaacagaactttccctcaattgaataaaactgttaagtcttcactaacacttccctccccaaacacaaaactatttttccacgtaaagttcaacttcaatcaatacgatcacaatgagaggaacgaaatagattcatacaccgttgcatcatcatcatcatcagtggcagcgaggacgacactgtttattccccagaggcaaggccttgcagtggtcaacgtcgttgaccaactcatggtccctgaacccaataagaaactgggccaacccttcaagaaacagcgcggcctgctaaacagtcctgggaggcgtcagaggaggctgcggcgtctagggcgtgataataggtttgaaagtgctggtggagcatctcgacgtgggtggagagaatggtggtggagtcgccggagatggagccggggaggacgggactgctgcttgtggctgcggctgaagagtggcgccaccacggatttcagcatttttcttcttggagggaaatcttgtttttgcggtggcggggttcaacgttcaacaacggttatggtttttgtggcgggacacggaagagttgttatggagagagcctccatagttcccatggttcataaactcccattcaaacagaccccaaaggttgcatttatgtttttgaaaaaaggtcctgggctattggctcctctatgggagagattcttcaaaggaaatgaagcagggttgtttttgacaaaatga

SEQ ID NO: 27041 - DNA, 234 bp, Glycine max
  Peptide Sequence Number=SeqID_143819
atgggggaaatgtgcgaggaatttaagatccaacaccacaattccacaccctacagacccaagatgaacggagcaatggaggcagccaacaagaatatcaataagattattcagaagatgaccgtgtcatacaaggactggcataagatgctccctttcatgctacatgatgttcagggacgggtacgagcaggcactaggttggtggtcagcagatcatcatcccgcgactga

SEQ ID NO: 27042 - DNA, 186 bp, Glycine max
  Peptide Sequence Number=SeqID_143820
atggaagaattcatgatcatgatgggtacgttgcactttaagaggttgtcattcttcaatttcgtgaaaaggataactgaaaaagttgaatgtcatattggggcaatgatgggctctcatgagttttgggactcagattcccttcaaaaaagagcaaaggatacagtgatggctggtatctattaa

SEQ ID NO: 27043 - DNA, 318 bp, Glycine max
  Peptide Sequence Number=SeqID_143821
atggcacaccctagtagcaacagtgtatgttgggttttcttcgagccagacttccaagaacagtgtagagggttttgtgggttcgagcgaggacaatgtgggttttccggtagtgtagggggttctgtgggttcgagcgaggacaatcggtttccggcagttttcaggtgggaggagaaagagaagagcgatttcaggcaggaggatgacaaagagaagagggagggcaaggttttcgagcgcacgcggcttgtgaaatctcaatttttaacctataaacataacaacatcggtttttttatggataaccgatgttaa

SEQ ID NO: 27044 - DNA, 1401 bp, Glycine max
  Peptide Sequence Number=SeqID_143822
atgaccttggaagggattttcattgagcccacctcaaccactgcccctgatctttctcttcacataagccccccaaccatctcctcctcttccttgatttccaatcatggaagtaataatttcccttcaagaactactactttgtttcaacaagcccacacagaactctctcttggaaggaatttcacttctgaaacgccaacaccaacaccgacaccaacaccaacaccacacaacccttattatcaaagcctaaaccacttccatcatcttcaccatcaccacaaccacaacaacaacaacaacactagtactagtgttaatacaacaagtactaccactactaatactcccttgaatcacataaactatggagtttcattgcttgatgtgtcatcatcagacaccttgaggccaatcaaggggattcctgtgtatcacaaccgttcattcccttttgtggctgccatggaccatgctagagacgatgacaacaacaacaacaaggatcatcaccatcatcacaagatgtgcttatataataatcatcacaacatgccttcttatcacccctctctctctccctccacagctgctccttctccttcaccttactttgtggatcccatgtccctcttgaacaacggctccaccgtggcggcatgtagggctgccaccgccacaaggtttaatgggttctccggcgatgctttcaaatcttctcatccactgcaccaatatggggttggtccttcagaggcttcttctgggttcatgagatcaaggtttctgcagaagcttcccaacaagaggagcatgagagcacccagaatgaggtggacaagcaccctccatgccagatttgttcatgcggttgaacttcttggtggccatgaaagagctactccaaaatcagttcttgagctcatggatgtgaaggatctaacactagctcatgtgaagagccatttgcagatgtatcgaactgttaagaccactgacaaacctgcagcatcttcaggccattcagatgggtctggagaggatgatttgtctccgatgggtagcaccgccgatcgtggcggtcttcggcaatttcccaaccacagaggacggccggaatggcaggcgcaacaagacatggactacccttccaccacccctatcctatggagtaattcttcaagttgtggagagtcacggctaagacctagttctaacgacatagatggtctcagatcacctatcctccagtcacaaacaatatcaggagggcatcaaattcaggagtgtgattcaacccaactcaagaacaacatggcgggttctaatttgaagaagaacccaagcttggaattcacattaggaagaccagattgggatggcaaagaacaagcctag

SEQ ID NO: 27045 - DNA, 165 bp, Glycine max
  Peptide Sequence Number=SeqID_143823
atgggcagatgcagaggatgggttggattcctttataccgtgtggctggtaactagcaagagccttggattggcaaagcaatctttgagtgtgactggctctgcaattactacttactcagctgcttggggtacccgtaaccttgcagacaaaaattcaatttag

SEQ ID NO: 27046 - DNA, 192 bp, Glycine max
  Peptide Sequence Number=SeqID_143824
atggaggtgacaaggtttggtatggcgatcgtgagtgagagagaactcggggttaggttgggcttgcaatggtttgagaatttcttcaaatctcttcgccagctccatcattcccagatttatcgagtgaaccggagcggtgtgttttcatcaaatatatcgatgttgttcttaaaacacaagagagaataa

SEQ ID NO: 27047 - DNA, 348 bp, Glycine max
  Peptide Sequence Number=SeqID_143825
atgtcacaatctgatcattcctctgcttttaccacacccagattagttctcaagaaggttttggccaaatctcaacatgaaggggatggagctgttgttagaagagggattggaaggagcgagttgaagaacttggatcccttcctaatgttggatcacttctcagtatctcccccagcaggatttccggatcatccacaccgaggttttgaaatcgtcacctacatgctagagctagctggcattcttttggatactgcgaatctaagggaccctcgttgctcctctaaagataagtacatggcttcattattgatcaatggtgctcctctaatcacaaggtattga

SEQ ID NO: 27048 - DNA, 168 bp, Glycine max
  Peptide Sequence Number=SeqID_143826
atgccttcgctcgatcgtgctatttcaattgtccaagattgcgatctacgtggtcaagaagatcttctaggtgcagttggtgagttggatggagatggattttatgtatcgggtaaggtgatctggtacggggcatgggacatcaaggtcgggaaacggatcaattga

SEQ ID NO: 27049 - DNA, 369 bp, Glycine max
  Peptide Sequence Number=SeqID_143827
atgactacactgttgttggcttgtttttcggttcttcctcataccatgtacgatcaacctagttgtagtttgaactttttaagcagtcatatagctaggaaagctacactgggaacagatgtctccaattccaaagcagtttttaggttgatttcagaagcaagccactttcacttgatcttgaaatttgagaagaatgaaaatccaggtagatttagttccaaaattgggagggacaaagatgaaacaactcaaacaattcatgaacttggtggcatgtctcctttctactctatggttattccactttatcacttcctagcaaaacagaaggatagagtaaatatcccagtgcaagctcagaaatag

SEQ ID NO: 27050 - DNA, 639 bp, Glycine max
  Peptide Sequence Number=SeqID_143828
atggtgagctgcactgttgcactttgtggacaagcccaactcaccagatactacatcgcatggcaactcattaaatgtgacaacgacggctccctccactccttctacgtcaaatccgtcaaggaaatgccctactacatctccgtcctccaaatcagcgccgccgactccgaggcacccaccgccgccccctccgccatcgacccgatctccattatgtccaaacaaggctgcaaggccttcacggaccttctaagaggctccaaggcccttccatctttcaaggaaaacgttgacggcggcttaacggttttctgccccacccacagcaccgtcagcggtttcgcggcaaagtacaagaacctgaccgaagctcagaaggtttcacttctgttataccacacgactcccgtatacgagtcactgcatatgctcaagtccagcaacgaaatcatgaacattctggccatagagggagcgaacaagtacgacttcacggtgcagagtgaaggggaagacgtgaacctcaagaccaaagtcaacacaacagtgtacatgacactgaaattatcaataataatacagtgtgctaacacttatgtaaatataggaactactttttacatttcaaaaagatag

SEQ ID NO: 27051 - DNA, 252 bp, Glycine max
  Peptide Sequence Number=SeqID_143829
atgggagaagaagcgaagaaggcttatgtagaggctttggagttggagccacagtcaaatgtggctcaagaagcgctcagcaggttggggaaattcagacatttacttgtggtggagaatggagaagttttgggtttactagacatagcaaagtgtttgcatgatgccattgcccgtatgaaaaaggcagctgagaaaggaaaatcaattgcagcagctgttgaaggagttgaaaaacactggggaacctga

SEQ ID NO: 27052 - DNA, 1047 bp, Glycine max
  Peptide Sequence Number=SeqID_143830
atgaccgaagaattcgctgaaaaaaacttggaggccagagctgaagcatatctaagggacacagtgctccctaacatatcaagcacagtacatgttcttcactgttgtgaggctcttcgtcccatatctgaacaaataaaccttgtcaacaagctaatcaacgcaattgcgaacaacgcgtgcaaagaacagcttacaactggtctactaaaactagatcacactttcccttctaaaaccacaccaaccatggagccagaaacaccctcagattggtgggggaagtctttcaatgttcttagtcttgagttcttccaacgagttgtgtctgttgtgaagtcaaagggactaaaacaagacatgatcagcaagattttgatgaactatgcccatggttctcttcaagggattggtgttagagaccctcaagtggtgaagggaagtcttcatgacttggaatttcaaaagaaacaaagggtggttgttgaaaccattgttggtttactcccaactcactcgaggaaaagcccggttccaatgggattcctctcaagtttgttgaagggtgcaatagcagcatctgcatcaactccttgtaaatctgatttggagaggagaattagtctgcaacttgaccaggccattcttgaagacatcttgatcccaacaaactcacctcaaaactcccataacacaatgtatgacacagactcaattctgaggatcttctctatttatctaaacatggacgaggaggatggcgaagatagtgacaactacattgatgagagccaaatggtgtatgattttgacagtcctggatctcctaaacaaagctcaatcataaaggtatccaaattgctggacaattatctcgcggaagtagcactagactcaaacttgttgccttcaaaattcacagcacttgcagaactgcttccagatcatgcacgtgtggttagtgatggactctatagagctgttgacatcttccttaagacttgtagtcaccaatgtgtgcctgttgtctgtttccttatgatatag

SEQ ID NO: 27053 - DNA, 432 bp, Glycine max
  Peptide Sequence Number=SeqID_143831
atgaaaccaaactttgatcctgaagtggaggctaatgcagaagatgaatctgaggtttcttccaaagtatctattcaagaagcctgtaatgattcttgttgtgacaacctcattaacatttccaacatcacaaatccaatagggattcatcctaattcagaagctatttcacttgactcaactctcaactccatgaattgtgagccaggggaaagagattcaataggattctcattctcaagcaatgaacctgcctctcaaactacagcaccaaccattccacgagtcttcccttgcaatttctgtcagcacaagtatatcagctctcaggatcttgatggactcattgatgaacacaggagggagagagaattagcaaaaaggacaatgagaatgcactccctctttttacttcctgactgttcaatttga

SEQ ID NO: 27054 - DNA, 1684 bp, Glycine max
  Peptide Sequence Number=SeqID_143832
atgaaacctttagccttgttggccattggtgtcttcaccatgatgactctcttggcaagctctcaagaagatgatgatgcttctgttatgctggctctcaagaacagcctcaatccgccgggctggtccgacccggacccgtgcaagtgggcccgcgtcagatgctccgacaacaaacgggtcacccggatccaaatcgggcgcctcaacctccaaggcaccctcccaacaaccctccagaagctcacccagttagaacacttggagctccaatacaacaacatctcgggcccactaccttccctcaacggcttaagcagcctccgcgtcttcgtggccagcaacaaccgcttctccgccgtccccgccgacttcttctccggcatgtcgcagctccaggcagtggagatagacaacaacccgtttgagccatgggagattcctcagagtctccgaaacgcttccgggcttcagaacttctctgccaactcggccaacgtcagaggcaccatgccggacttcttcagctctgatgttttccccgggttgacgcttttgcacttggctatgaacagcctcgagggaacttttccgttgagtttctctgggtcgcagattcagtctctgtgggtgaatggacagaagagtgttaacaagctcggtgggagtgttgaggttctgcagaacatgactttcttgacccaagtttggttgcaatctaatgctttcacgggtcccttgcctgatttgtccgcgctgaagagcttgcgtgatttgaatttgagggataacaggttcactggtcctgtttcgactttattggtgggtctcaagacgcttaaagttgtgaacttgactaataatttgtttcagggtccaatgccggtgtttgctgatggggttgtggtggataatattaaggattcgaatagtttttgcttgccgagtccgggtgattgtgatcccagggtggatgttcttctttctgttgctggggttatggggtatcctcaaaggtttgctgagagttggaagggaaatgatccctgtggtgattggattgggattacatgtagcaatgggaatataacggttgttaattttcagaagatgggacttagtggtgtgatatcgcctgactttgctaaacttaaatccttgcaaaggataatgttagctgataacaatctcactggttcgattccggaggagcttgctactttacctgcgcttactcaattgaatgttgcgaataatcagctttatggaaaggtgccaagttttaggaaaaatgtagttgtgagtacaagtggtaacattgatatagggaaggataagagtagtttatccccgcagggtccggtgtctccaatggctcccaatgccaagggagaaagtggcgggggtccaggaaatggtggcaaaaagtcttcttcccgtgtgggagtaattgtgttttcagtgattggggctgtgtttgtggtttcaatgattggtttcttggttttctgcttgtttaggatgaagcaaaagaagctgagcagggtccagagcccaaatgcccttgttattcatcctaggcattcaggatccgataatgagagtgtaaagataaccgtagctggttcaagtgtcaacgttggtgctgccagtgatacgcgaaccatgcctggcagtgaggcaa

SEQ ID NO: 27055 - DNA, 630 bp, Glycine max
  Peptide Sequence Number=SeqID_143833
atggggttcctcgtgcaatttgttgtttttatgttattcccttggtttctgagtgtgagagctgaggaaaattactcatcacagcattgtgatttcccagccatattcaactttggtgactccaattcggatactggttgcatggctgcagcattttaccctgaggttttgccatatggtgaaactttcttccatgagccagttggtagagcttctgatggtcgccttatcatagatttcattgcccagcatctaggtttcccattcttgagtgcatacataaattcaattgggacaagttataggcacggtgcaaactttgctgcaggatcatcaaccattaggcgccaaaaaaggacagtctttgagggtggcactcctttcacttttgaaatacaggttgctcagttcaaccagtttaaggcacgcaccagaaagttcttcaaccaagatgcacaagggaaaaactccttcagaggacactttcctaggccagaggactttgccaaggctatctacacatttgatattggacaaaatgatattgctgctgctattaacaaagtggacacagaagattctcacgcagtgatctcagacattgtggattattttgaaaaccaagttcaa

SEQ ID NO: 27056 - DNA, 407 bp, Glycine max
  Peptide Sequence Number=SeqID_143834
gccccattggttgcttgccagttgccatgcccgtgcacaatgccatgaacactactccaggggcaggttaccttgatcaaaacggctgtataaattatcaaaacgacatggcaagagagtttaataaaaagctcaagaataccgtggttaaactaagggtacagttcccagatgcctcattaatttatgtggacatgttctcagctaagtatgagctaatcagtaatgctaataaagaagagatcatgcaaatcgcagctcgtattggcgctttccttctcgacgcgacacctggcagtggtgtcaccagcttcaatggcgttttgcaggagcttggactcgccagtttgactggcgagttgaggttgggagtagccagtagcactggcgatttgagcttgaagtag

SEQ ID NO: 27057 - DNA, 261 bp, Glycine max
  Peptide Sequence Number=SeqID_143835
atggctggtagcaaaatatcttgcacgcatgaaatggtcccgagaaagcttccatcaaagaggtccaggaagggcaccaccagagaaggctccagcgcggccccacaggccgacactgacttcaacaggcatcaattttcgagtgcagagcatgagcagcgctttgaggccatcaatggatggtcattcctcaaagagaggtgggtacaactaagggacgatgacagcaggcgactaatcacacaggtcaggggcggctga

SEQ ID NO: 27058 - DNA, 420 bp, Glycine max
  Peptide Sequence Number=SeqID_143836
atgggtgtaggacacaatgatcagaaagttcttattctagcagctacaaatacaccttatgctctagaccaggcaataagggggcatttcgataagcatatatacatacccctacctgatttaaaggctcgccaacacatgttcaaggcatgggcaatatacatgatgatgttcattggtcttattgtgtattgtgaacctagcaaatggccttacaatgtgcacctaggagatactccccataacttggctgaaagtgattttgaacatttggctcacaagacaaaggggttttcaggttcagatatatctgtctgtgtgaaggatgttttatttgaatctgttcacaaaacccaagatgccatgtttttctttaagaatcctgaggatatgtggatcccatgtggaccaaagcaatag

SEQ ID NO: 27059 - DNA, 399 bp, Glycine max
  Peptide Sequence Number=SeqID_143837
atggacagagcaaggaaaaactactggaaccctgaggatccttctattacatttctagggtcccacaaggccaaggcccaggctccttctgatgcaccagttccagctcctacacctgtagcacccattccagctcgtgcctatggtgtggagtattcatcatggcatttgcctggtgatgcagagtatgcagaatctatctcaacaacagctgattatgagcatgaaggagtatctggcactgagggcactccggaggttgaggaggctattgaggacactccagaggctaaggaagcttcaggcgcaacagaggcagacgtggatgatgattatgtagcagacatcactgcagcactggggacttgggatccatggcccacaccagctcaggattga

SEQ ID NO: 27060 - DNA, 234 bp, Glycine max
  Peptide Sequence Number=SeqID_143838
atggcgctaagccactgttgctgttattctgttgtcgcgctaagcgcgccatgcatgtgcctcttagttatttctgtaagatttgtgtctaaaatcgcttgggagcgatataagaccaacgttcatcacaggaacatcttccctgagcagaatgtggaattggcttattcacattatgacgaattcctttgggaattagaatgccgccagtggcataagaaccttacaaggtag

SEQ ID NO: 27061 - DNA, 504 bp, Glycine max
  Peptide Sequence Number=SeqID_143839
atggggattcctaccattgcggggaagagtaagaggtcaactttcaattacatcaagaaaaagatggggaagaaaatcttatcttggaggggaaagtatctttccttagcaggcaaggaggtgttgattaagccagtggcccaagcggtgccttcttatatttgttcccagtttcattgtgcaaggagttgcagcaaagggaataggtggaggattggggatgggtctcaaataactgtttcgttagaacattggctacgagatggagataatttaaaggtgacaacagtttctaatgaggaagtggctaatcttactgtgcacaatcttatatgtcttgatggaggaggatggaacactactatggtgaatccaatgttgaaagatgaagacactaaccatgtactaaagcatgacctggctgtcaaaagagcaatctccttaccacctgtgattcgtgaattccataagggagaaccccataggtgccacttgcttgattaa

SEQ ID NO: 27062 - DNA, 237 bp, Glycine max
  Peptide Sequence Number=SeqID_143840
atgccttttagaggcttgaaaagtgcaacaaaacgaactatgttttctgcattttctggaaaatgcgatgaactcgctaagcgagcgtgctgcgttaagcgagttcatcagtactcattgtgtatatatgcgttttctgaagaactcgttaagcgcgcttaccacgctaagcgagttcatcctttgaggatgaacactcatcctcttgatgaactacctgtggctaagcgaggctga

SEQ ID NO: 27063 - DNA, 1317 bp, Glycine max
  Peptide Sequence Number=SeqID_143841
atggttttgtcatggacaaaagggagagtgttccggcgtgccagaaaggggaaagagttgaaaaatttcggtggcgacttggagatagacattgcgatccccacccacttccggtgcccggtaacattggacatgatgaaggaccccgtgaccgtttccacgggcataacctacgaccgcgacagcatcgagaagtggatcgagtccgggaaccgcacgtgcccggtcaccaaaacggagttgacaaccttcgacatgatcccgaaccacgccatccgtaggatgatccaggactggtgcgtggagcaccgttcccacggcatcgaacggatccccactcctcgtatccccgtcaccccgtacgaggttgctgacacgtgtacgaggatcttgtcggcggcgcaacacggggacgagaacaagtgcgtggagttggtgagcaaaattaaagcgtggggaagggaaagtgagagaaataagagatgcatagtttctaacggtgctgctttagcactagcgaacgctttcaactctttctcatcgcgtgggttgttaattgagaagaacgtggttgtgttggatgagattctgggtgctttggtatggatgcgtcctctttctgaagagggtagatccgtgttggggtcatcgagttctatctcttgcatggtttggttcatgaacggtaaacaattatccacaaggcaaaacgctgctttggttcttaaggagatgcatgttgaggctttggtgaaatgtgtaggagtttttgaggctttgattaacatgattaaggagcctgttgggagtggttccaccaaggcctgtttgtcaacgattttcaacttggttaataataaaagaggcgtgacgacttgtcaaaggtttgtggaattgggtttggttgatgtggtgttggaggttcttgttgatgcggagagaggggtgtgtgagaaggctttgggggtgttggatagcgtttgtgattgcaagcaaggggtggagatggcaaaggctaatgctttgactttgcctcttgtgattaagaagctcttgagggtgtctgagttgtgttcaagcttcgcggtttcggttctttggaagctttgtgacaagaatattgaagaaggggtgttgattgaggcgcttcaaatgggggtgtttcataaactacttgttttgttgcaagtgggttgtggtgagggaaccaaagagaaggctacggagttgttgaagttgttgaatagttgcaggagcaaagctgagtgtgttcatcattcttcgttggatttcaagcatttgaagaatcccttctaa

SEQ ID NO: 27064 - DNA, 336 bp, Glycine max
  Peptide Sequence Number=SeqID_143842
atgtctttcgctctcatcgaagcctgcaagaagcgtaaacggttgccgaagtttttcaggttcaactcgttcggcgaccctggtgttgttccaattgcacgttcgggtcccttccgcgataacgttcgcgttttccttcaagaagctggcgatctcgaagactacactgtctccgggaaccccctctggtgcattcttctcatccacgacaactcgtacgctatggctcctctttacaccatcgaagaacacgtcgaccactcttcgcaccccttctgcgatcactgccgctgcgtaggttcgtttccgaatttcgccttcttgggtttggtttga

SEQ ID NO: 27065 - DNA, 2187 bp, Glycine max
  Peptide Sequence Number=SeqID_143843
atggagtttgggtttttccgtggcttgcctgagaatctctttatactggacatcattggacaaatagcttttcttgtagatattgtcttgcaattctttgttgcttatagagacagtcagacctatcgtatggtctacaagagaacccctattgctctgcggtatctgaaatctaacttcatatttgatcttcttggatgtatgccctgggacatcatctacaaggcttgtggaagaaaagaggaagtgaggtaccttttgtggatcagattatatagggtgcggaaagtcgaagactttttccacaagttggagaaggacatacgtgtcaattacattattacccggattgtgaaactgatagtagttgaactctactgcacccatacagcagcctgcattttctactatttagctactacactacctgaatcccaagaagggtacacatggataggaagtttaaaactaggtgactttagttattcacatttcagagaaattgatctttggaagcgctatacaacatctctgtacttcgctattgttacaatggctacagttggctatggagatatgcatgcagtaaatatgagggagatgatattcataatggtatatgtttcatttgatatgattcttggtgcctatttgattggtaacatgacagctttgatagtcaagggatcaaagactgaaaagtttagggacaagatgacagaccttatgaaatatatgaacagaaataggctcggaagggatatccgtgaacaaataaaaggtcatgtgcggttacagtatgagagtagctacactgaggcttctgtcattcaggatatccctatttctattcgagctaagatatcccaaacattatatttgccgtacattgaaaaggtttctctttttaaaggatgctcttcagaattcatcaatcagattgttattaggctccatgaggagttctttcttccaggggaagttataatggaacaaggaaatgttgtagatcaactatattttgtatgtcatggagtactggcatgggacaagctgagtgatgctgagttttcttatttatttgtattgtatcaccttaagaaagaggaagtaggcatagctgaagatgggactgaagaaactgtttcacttctgcagcctaacagttcattcggagaaatatctattctttgcaacattcctcagccatatactgtccgtgtttgtgaactgggtagactcctgcgacttgataaacaatcatttacaaatatcctagacatatacttttatgatggaaggaaagtgttatacaaccttctagagggaaaagagtcttttcgagataagcagttggagtcagacatcacatttcatcttggaaagcaagaagctgagcttgctttgaaggtcaatagtgcagctttcaatggggatatgtatcagctaaaaggtttaattcgagcaggagctgatcccaacaaggcagattatgatggaaggtcacctttggtaaggagcttgcaacttgtgatgtcttgtaaatattctggtgctttctcttcatctatgatgttgctgcatcttgcagcatctagaggatatgaagatatcacaattttccttattcaagaacgtgtagatgtcaatattatagataacttcgggaacacacccttacttgaagcagttaagaatggacatgatcgggttgcttctttacttgttaaagaaggggcctctatgaagatcgaaaatgctgctgaaggtttatacttcatggcaaagttgctattagaagccggagctagtgtttttacacgagacagatggggaaataccccgcttgatgaagctcggatgtgtggaaataagaatctgatcaagctactggaagatgcaaaatcttctcaactgtcagaatttccatcccaagaatttacagataaaatgcatccaaagaagtgcacagtgttccctttccacccgtgggatccgaaagataatagaagacatggaattgtattatggattccacactctatcgaagagctaatcaaatcagcagcagaacaaatagaaatttctggcggttcttgtattttatcagaagatgctggtaaaattactgatgtggacatgatcaaggatggtcagaagctgtatttagtccatgaaacacattag

SEQ ID NO: 27066 - DNA, 384 bp, Glycine max
  Peptide Sequence Number=SeqID_143844
atgaaggaacatatgtctgtagtatggaaaccatttcaagtgatgaccatcactaaccttgttgctgatcatgacgatggacaccgtggctggtcatcggaattacgcactaaaaatcgtccaaacagaaggtcaggaggatccctgtacttgcacgacgccaataaccccactgcttggcaattaccggtgagaggcagacaaggaaacgatgataataaatgcgaagacaatgacattaatgtcaatcatgaggctgattctacatgttatgaatttatggcaacagttttcagaaattcaaatttaatttccccaatcaattctagaccagaatcttctaccatcaaccatggttatcaaactctcgagttaactcgctaa

SEQ ID NO: 27067 - DNA, 258 bp, Glycine max
  Peptide Sequence Number=SeqID_143845
atgtcggtgaacccagggttgttggtattcatggaggacctagagggtgtaagtgtagctagtccgtcgaggttgaggtcgtggcatcagcaacgagcgataaagggggagttgtcgtcgttgagcagaacatgcaaggtatgtgatgagggtgcttggcgccacaggaaagaagaagtgttatggttaaaggccttaatgaggagaacgagtgtatgtataagtctagattatgccttagtgagagggaaaacctaa

SEQ ID NO: 27068 - DNA, 231 bp, Glycine max
  Peptide Sequence Number=SeqID_143846
atggctattgagggctttacaactgggggtgaagaaatgggctttgggccttcaaaggcgcgcttagcgcgttcagatcgtgcgcttagcgcctgctataggcttaacgtgtgcttctgttggatcgtgcgcttagcgcgtggctcgcacttagcgcgcgtaatgaatcctgcatcctcgtgcttaacgcctcgcttagtgcctgtgctggcttgcacgcttagcgcgtga

SEQ ID NO: 27069 - DNA, 842 bp, Glycine max
  Peptide Sequence Number=SeqID_143847
atgtcacgaccgtgggaggaccttcctatggacttcattgtcggccttccgccttatcgaggcaatacaaccattttggtggtcgttgacaagttttcaaaggggggaggctgttttcaccagcctgaaaaagaagcttttaaagtctcaagaacgaatgaaggcatagcagattcccacagaagagatatcaactttgaaccaagcaagtgggtcatggttaaactccgtcctcatcgtcaagttacagctattggcccttctcattcaaaattggccaaacatttttatggcccctttcagattctttctcgaataggtcaggagcaggaccagggcgagcaacgattgaaggtgttggtgcaatgggaagggctgcacctagatgacacaacatgggaagattgggctagccggcaaaacacctatcaccttgaaaacaaggcagagaccaaaaaggagaaccattattccaacccacctgaaggattatgtctaagtgggactaaggccttgtgcaaatggttttggcattgtgctagcctagtggtgcttggttggtatcgggatagcttagtaaggcttgttgtagtgaacatccacatgataggatcagacaaggtcacaaaaagtaggaatttcactcgggttgtcctggccctgacagttccaactgagaaaactcattggccttggcaggcctggctaggtgtaagggaagggttaaggtttgtggaagggatagggtttggagaaaggctaatgtttggattggagttggtgtttggtgaagatatgtgtttcggtggaggggtgggtgggtgtatcattggaccattaag

SEQ ID NO: 27070 - DNA, 468 bp, Glycine max
  Peptide Sequence Number=SeqID_143848
atgtcacaaccaccaacggtagaggctctaattcataaatttcactctcagtttcaggttccagcatcgttacctccttgttggacaaccaatcatgcgattaacttgcgtcccaactcagaaccggtgaatgtgcatccatatcgttactcctactttcagaagggtcacaccagtgcaggaaaaggtggatgccattcaacaatagccgacaccgcaatcctttcgagcccttcgtgggcttttggggcttacgggtttctaccgatgcttcatcaaggggctgcctttcaacaactaatggacgcagttagctatgctccggtattacgcctatccaattttttgattccatttatggttgagactgatgcttcaggggtaggcataggggttgttctatcccagttgggtcaccccatagctttcttcagcaagaacgttttgcagaaactctgtcacacataa

SEQ ID NO: 27071 - DNA, 255 bp, Glycine max
  misc_feature (224)..(224): n is a, c, g, or t
  Peptide Sequence Number=SeqID_143849
atggcgatggccatggttatgactctgaaacccaaactctggaaaacaaaaacaagtcctcattgtcttcgtcttcgtctttgttcctgcactcaccttcttccattttcctcatggtcacactttccctacaaagaccacgaccttctctgcgaaatctccgaagccatcaacgattccgagaccaaacacgagaagggttactctgagaacccgagacttanacgaatcctcccttccctcacgccgcgccac

SEQ ID NO: 27072 - DNA, 441 bp, Glycine max
  Peptide Sequence Number=SeqID_143850
atgaatccttttcttgaaaggagggacaatgtttctagagcagaaaggtggaagccgccccctcatggagctttcaaatgtaatgtcgatgctagcttccataaggaggaaaacgtgactggtatgggaatgtgtatcagggatgaaactggaagagtggtggctttaaaaacataccaaagaagaacatcgtgcatggcagttcaagagggtgaagcattagctcttgctgtagctatggaattcacactctcactgggatttaacaatatcgatatcacatttgaatctgattttgtatttgcaaagagacaaatcaatggtgtagctcatgagcttgttagagctgcaccattcttccctagtctctacacttcttatcaagtgataccttgtattgaaagtttggtgatgaatgaaatgagtcaaatcattctttag

SEQ ID NO: 27073 - DNA, 717 bp, Glycine max
  Peptide Sequence Number=SeqID_143851
atgatgctggctcagggtgttaggcctgacttggttacttataatgcattgatcaatggtctttgtaaggttggagatttgaaggaggctaggcggcttgtgaacgagatgactgcgagcggtttgaagcctgacaaaatcactttcactacactgatagacgggtgctgcaaggatggggatatggaatcggcgttggagatcaaaaggagaatggttgaggaggggattgaacttgatgatgtagctttcactgctcttatctctgggctttgtagagaaggtagagttcatgatgctgggagaatgttgacagatatgttgagtgctggtttcaaaccagatgatcccacgtacaccatggttattgattgcttttgtaagaagggtgatgttaagatggggttcaagttactcaaggagatgcaaagcgatggacatgtaccgggagttgtcacgtataatgcactaatgaatggactgtgcaagcaaggtcagatgaaaaatgctaaaatgctgttagatgcaatgcttaatgtgggggtggctccaaatgatattacatataacattttactagacggtcatagcaagcatggaagctctgttgatgttgacatatttaattctgagaaaggacttgttacagattatgcttcatatacagcacttgttaatgaatcaagtaaaacttcaaaagatcacctaaagagatga

SEQ ID NO: 27074 - DNA, 171 bp, Glycine max
  Peptide Sequence Number=SeqID_143852
atggatcatggctatggacaaaaccaagtccctggaagtgggggaggaggcggtggaggaggcggtgacaatcaaggtgttgttggtggggtagcaactacttcccaaaagctgactaccaatgatgttttatcttatttgaaggaagttaaagacatgtttcaggactaa

SEQ ID NO: 27075 - DNA, 531 bp, Glycine max
  Peptide Sequence Number=SeqID_143853
atgggtaaggttggagaggtagctcttaaaattgacattatcaaagcatttgatcaggttaattggaatttcctttttggtgttcttgacaaaatgggattcaatgaaaaatgggtctcttggatgaaactttgtctccgaactatgcaattctctattattgtcaatggtgatcacgtagggcaaatttctcgcgagagaggacttagacaggggctaatgatacaaaaatttcaattgttaaggagatcctacacatttatggacttgcttcagactgactttggaatcgcatcaaccactggactagcaaacacctctcaaaagcggggtacatctacttgggttgttgtgactgagaacaagagagggtacatctgttgtggatcagttctagtggagggtacatccactaggttgttgaaagagaacaagggagggtacatcccttatggatctttgcttgtaaaggaatttacaaggttgaaaagaaatctcaaggaccgcaggtcgtttagggactggatgtag

SEQ ID NO: 27076 - DNA, 1557 bp, Glycine max
  Peptide Sequence Number=SeqID_143854
atggagagagggaaatatttggcattggtgggaggaggggctcttttgggctctgtctctaccttctttcttcttaggcttcttcaatctcagaaaagaggtgtatcgcagtgcagtaagaatgttactgctgacttcaatggtgttgacggatgcactattgccagaatgaaaattgatagggtggttaatgaagatcttctgaaagatgagattgtttcagaacagctgactaggatttctattaatccaactgtttttgggtggaatgttaatgctgtaactaggaacattcagttttttggctttgagtctcagcagaaagtgactgcatcatatgtagtggtcattggtcttggaggtgttggtagtcatgctgcttctatgctcttgagatcagggattggcaagcttcttcttgtagactttgaccaggtttctctttcatcactaaatcgacatgctgttgcaacaagagcagatgttggcatctcgaaagctcagtgccttgaggagcatttttcatctatctttccagagtgccaaatagttgccaaagtgctattatatgattcatccactgaagaagaaattctctcaggccaccccgactttgttttggattgtattgataacattgatacgaaggtggcacttcttgctgcatgtgtacgtaggggtttgaaggttctatctgccacgggggctggtgccagagctgatccaacaagaatacgcattgccgatctaagagagtcaactaatgatccattatctcgagctgtaagacaccgtttgaggaaagattatggcattgaaggtggtatcccggttgtgttttctttagaaaaacccaaagctaagctgcttccatttaagggtacaagtggagaagaggaaaacccttcagattaccagatagtaccaggttttagggtccgtatcatccctgtgctaggcaccatccctgcaatatttggacaattcatggcatcctttgttgtgacagagttagcaggagtgcatgttcaaacagaacctgtagtcaattttgacatggatcattaccatactcttcatcaacgccttatcgagcatgaggagtcattgtatggaacatccatggaagtgcaggtagatgttgaagaagtgatgtatattgttaaagaattatggcatggaagaagtgctagagagcagcatgtgaaagatgttggacgaggaatgtggcgatcagttaacgaattaatgcttgtaaggtgggaccgcacaaaaccggcatctatttcaaatttgattcttttgaaattcaaagaggtggatgagcatgaatctcgaacattggaagatataaaggaaaatgaaccagaatttcacagtagagttagtgctgtgttaaaacgagctgaacttgactttggtctctccacctttttgaatcttattataatatttgtattcaattgcatggagatggtgagcaagcctagactgaaacacaggataagattgaaaaagtcactatcgaggaagaagaaaaaggtcttaattgaataa

SEQ ID NO: 27077 - DNA, 243 bp, Glycine max
  Peptide Sequence Number=SeqID_143855
atggatgctccggttaagaaaaaggcattgtctcgtcctagcttgagtcctcagaagaaagacaagtgcatagtttttccccttgtgagctactgttgcgcttgtttagacatgcctcaacttaaaactctgctttctcaagatgtctttcattttgtctactatggccttgtttggataagtttctttcttttggagaagttaaattatgagagcttctatgaagttaagtgcatatgttga

SEQ ID NO: 27078 - DNA, 768 bp, Glycine max
  Peptide Sequence Number=SeqID_143856
atgtcgttactctccgatcttatcagccttaatctctccgacaccaccgagaaggtgattgccgagtacatatgggtcgggggatctggcatagacatgaggagtaaagcaaggactctctcaggaccggttaatgacccttccaagcttcccaaatggaactatgatggttccagcactggtcaatctcctggagttgacagtgaagtgatcttatttccacaagcagctttcaaggatccattcaggaggggtaaaaatatgctggttatgtgtgatgcttacactgctgctggggaacccattcctaccaacaagagacataatgctgcaaagatattcagttatcctgatgttgttgctgaagaaccctggtatggaatacaccttgttgcagaaagatgtgcaatggccacttggatggcctattggtggttttcctgggccccaggtgaaaattcgttatcttcaatcattaaaatggaacatttggtgtctaatggtccatactattgtggtattgatgctaacaaggatttcggacgtgacattgttgactctcatttcaaagcctgtcttcatgcggacattaacattactggaattaatgcagaagtgatgcctggtcagccttatggtatcaagacaatgttgagtactagacacaagaggattactgagattgccggggtagtgctttccgttgatcctcaaccgattaaggtggataattccactcatccgggtttctacatcgacaagagttga

SEQ ID NO: 27079 - DNA, 495 bp, Glycine max
  Peptide Sequence Number=SeqID_143857
atgactctccttcctttcttcaaattcaaacctccatcgggagtgctccctttggcaatggtgttctcaaagatgcattcatgcgccaatgccagcatgagcttctctagcatcccagcgcactccacaatggtggaacacccaagtcccaatagaggccttcatggaggtgttgtcgggaatgaaggtgaaggatccagccacaacaatgaatgcatgggaggcttagcagcgaccattgacgatgttcgggtcataggacaaactaatctagctataaatgacacccaaattaaagagcatggaggctttctcaagttagatgctctattgtttggaggaggtcatgacacgtcaggagcaacgaaacagagtagtgctccatgtcaaagcggagttgcttcaaggtgcagagggatagcggtggagggtgacatgggggtggtgaagatcagcgacatagagaggtgtctccttggcaaggaggaacaatga

SEQ ID NO: 27080 - DNA, 3594 bp, Glycine max
  Peptide Sequence Number=SeqID_143858
atggcgacgccgctgacgggactgaacggcggcggcggcggagtggcggtgctgacgaatccggtgaacaaggtggattcctccgccaatggcggtggcggattcggccggtcgctgtcggagtcgccaattctgatattctcgttcttccacaaggcgattcggaacgagctcgacgcgctgcaccgattggcgatggcgttcgccaccggaaactgctccgacatccagcccctcttccaacgctaccgtttcctcagatcgatgtatagccaccactccaatgccgaagatgaggtgatttttccagctctagatatgcgtgtgaagaatgtagcacagacatattcccttgaacaccagggtgaaagtgatctttttgatcatctatttgagctgttaaactcttctatccataatgatgaaagtttcccaaaggagttagcatcctgcacaggagctctgcagacgtcagttagtcaacacatggctaaggaagaggagcaggtatttccactgcttcttgagaagttctctcttgaggaacaggcatctttagtttggcggtttctctgcagtattcctgtgaatatgatgacagaatttcttccatggctttcatcatctatatcacctgatgaatctcaggatttgcagaagtgcttaagcaagatagtgccggaggaaaagcttcttcaaaaggttattttcacctggatggaagggagaagtagtgctaacacagttgaaaattgtttagatcattctcaggtgcgatgtagtcctaatcctttaacccatcagaatgggaaaataaaatgtgcatgtgagtccacagcaactgggaaaaggaaatattctggatctagcatagatgtttctgataccatgagaacacatcctatagatgaaatattgctctggcataatgcaataaaaaaagagttaaatgagatagcagcacagtctagaaagatacaactctctggagatttcactaacctgtcagctttcaatgaaaggttgcagttcattgctgaagtttgcatatttcacagtattgcagaggacaaggttatttttccagcagtagatggaaagttttctttctatcaagaacatgctgaagaagaaagccaatttaatgagttccggtctttgattgaaagtattcaaagtgaagaagcaacatctagttcagaaactgaattttattcaacattgtgttcacatgctgaccatatattggaaatgatacagagacatttccataatgaagaagttcaggttcttcctcttgcacggaagcactttagcttcaaaaggcaacgtgaacttctctatcaaagcttatgcatgatgcctttgaaattgattgagcgtgtcctgccatggttgattcgatcattaactgaagatgaagcacagatgtttttgaaaaacatgcaattagcagctccagcaatagattctgctttagtcacacttttctgtggttgggcttgcaaggctcgtaaagatggtctgtgtttgtcttcaagtgtatcaggttgctgtccggcccagcgatttaccgatattgaagaaaatactgttcaatcttcctgtacttctgcttctgcattgtctggtagagtttgctcggtattagctgaatcagatgggacccaacaaagatcagtcaagcgaaacatatcagaggtgcacaagaatgaagatgtctctaaaacttcagaaattgaaagtattcagaaacaatgttgtagtgcccggtcttgttgtgtgccagctttaggagtcaacaagaataatttggggctgggttcactctctacaaccaagtccttacgctctttgtctttcactgcttctgccccatcccttaattctagtcttttcatatgggaaacagacaacagttcatgtgatgttggctctacagaaagaccaattgataccatatttaaattccataaagccatacgcaaagacttggagtatttagacattgaatctggaaagctttgtgatggtgatgaaacaattattcggcaatttagtggaagattccggcttttgtggggcttatatagagctcatagtaatgctgaagacgatatagtatttcctgccctcgaatccaaagaggcacttcataatgtgagccattcttacacgctggaccataagcaggaagaaaaattatttgaagatatttcatgcgttctttctgagctttctgtccttcatgaaaacatgcaaatgacccatatgtcagtggatttaagtgaaaatgattttggaatttctgatgccaatgataatatcaaagagtacaatgagcttgcaactaagcttcaagggatgtgcaaatctattagagtgaccctggatcaacatatttttagggaagagctcgagctctggccattgtttggaaaacatttcactgtggaagaacaagacaagatagtgggccggataattggaactacaggtgctgaagttctccaatcaatgttaccatgggtaacttctgcacttacacaggatgaacagagcaaaatgatggatacatggaaacaggcaactaaaaacaccatgttcaatgaatggctaaatgaatgcttgaaagaaactcctgtatctacatcacagacagaagcgtcagagcgtagcacttctcaaagaggtggtgattatcaagaaaacttgaacctgaatgagcagatgttcaagccaggttggaaagacatattccgtatgaatcagaatgaacttgagtcagaaatccggaaggtttatcgcgactcaactcttgatccaaggagaaaggcataccttgtgcagaatctaatgacaagtcgctggatagccgcccaacagaagttacctaaggctctatctggggagtctagcaaacaaatagaaggatgctcaccatcatttcgggacccagagaaagaaatatttggttgtgagcactataagcgaaattgcaagcttcgagctgcttgttgtggcaagttatttacttgcagattttgtcatgacaatgcaagtgatcactcaatggatagaaaagcaacattggaaatgatgtgtatgcagtgcctaactatacagccagttgggcctatatgcatgtcaccttcatgtaatggacttacaatggcaaagtattattgcaacatttgcaaattttttgatgatgaaaggaatgtttatcattgcccattttgcaatatatgccgtgttggacaagggcttgggattgattatattcattgtatgaaatgcaattgttgcctggggataaaatcagcatctcacaagtgcctggagaaaggcttagaaatgaactgcccaatttgctgcgacgacctgttcacatcaagtgcaacagtgagagctttaccttgtgggcattacatgcattcatcttgctttcaggcgtacacttgtagccactacacatgtccaatctgcagcaaatcattgggagatatggcggtttactttggtatgcttgatgctttattggctgctgaggagcttcctgaagagtacagggatcgctatcagaaaaaataa

SEQ ID NO: 27081 - DNA, 717 bp, Glycine max
  Peptide Sequence Number=SeqID_143859
atgggaagcaggaatggttcaggttatgaagctgaaatggtatccatattctctcatattgagtcccctgacagatcacttcatgaccatataattgaagctcttagcaagctcactgttgaacaaggaattccttatgttaccaaaaaagtacaagaagttgcagattgttatctaaggtatgaatttaggtacaagaagctgcagattattggtcataacttagttaaaggaagtacatggaagttggcttatatggaagcacatggaactcccagcgattttcgacagcgttttccgccatcaccggcaacattggagcaaaaaaatgtcaagttcacgggcctgacctcgacggtggacgtgcaaacgaccgttgctcttcgcggaagcttcctcgcaccaccactgcacctcctcaacgaagaagaagaagagccacaaagaagacgcaggaagaagaaggcgcaggaagaagaagcagcaagaagaagaaatgtgatgaagcaggaagatgaggaagatgaagaagtaggaagaagaaggagagaactgatccgaaagaagaagaagagaagcgcaaacgcagggagggagagagagaggaaattgatgagtacattccaaggcatggataggaagttgtggagcactttcctagggcttggaattggtttctttgaccttgagacctacacactccacttaggaaagtga

SEQ ID NO: 27082 - DNA, 792 bp, Glycine max
  Peptide Sequence Number=SeqID_143860
atggaagatgaatctctgaaaaagaaagataacagcattgcagaacaccataaatcagagttagcttcaattctaacccaaagtgaggactgccagctgcagccccatccccagcctgagcctgaccaggagcctccttctcttatttcttttgaaacaacagaaacctctgctcaaatagaagttatcagacaaccttctcctccacctgtacttgctgaagtacaagatttggtccctgcagtgtcaccttgtgttaatgaggcagggtgtaagacagagattccgtcattagataatagtgttcatgccgaggatcctctacaactgcacatttcagctgctttgatggagagttttatgaagcttgccaagtcgaatacaaaaaaaaatttagagacttgcggtgtccttgctggtttgcttaaaaacagaaaattttatattactgcccttataatcccaaagcaggagtcaacatcagattcttgtcagactacaaatgaagaggaaatatttgaagtgcaagataaacggtctctttttccccttgggtggatccatattatgctgccagaatctgttgcaatagtcatggcgccaagagatagttcgagaaaccatggcatttttcggttgacaacccccggtggaatgtctgtgattaaacaatgtgatcaacgtggctttcatccacatagtcagcctccagatggtggtcctatttacaagacatgtacagatgtatacatgaacccagatttaaaatttgaggtcattgatcttcgatga

SEQ ID NO: 27083 - DNA, 183 bp, Glycine max
  Peptide Sequence Number=SeqID_143861
atggttaggaccagaggattaggtcgtgccttaggtcaggtcactcgcagagttgctgtgactgcggatcacgtcgatgagccagtcatccctgacccagacgttcaggatgacccgatgggggcaccagctgttgtggaggacattcctgcggacgcaggctcagaggcggctgaggattag

SEQ ID NO: 27084 - DNA, 672 bp, Glycine max
  Peptide Sequence Number=SeqID_143862
atgaaacaaggtgctccttgtagagacacattgttgcatgactcaaattctgacttcgagttcatcacaagcaccgaccttgagttcgaatcgtcttcagcagatgaactcttctctaatggggtgatccttccaattcaaatgcaagaaaaaaccacagctagaaaactcactcaccatgtggaatctcctcacccaaaacttcctcctcgtccgtgtgcctcaagtgttgacaaagtgaagaaagaaaccattagagaactcctagatgtgaattctgataatgagaagaagcctcattccaaatccttttggggattcaatagaagtaaaagtctcaattgtgatacaaagaagaacttggtatgctcttcacctcttttgtcaagaagcaactcaacaggttcagtgtcaaatccaaagagagtgagttcaaacaagcatccatcagctgctaaatcatcatcatcatcatattcattttctaccttaaatatgtatcctatgcaaaaatctccttcaggtaagagttatggagggtcttatcccaatggccttaggattaatcctgtcttgaacgtaccgacaccttgtgtttcgaagggaagtgcaaatctcttaggtttgggttcatttttacgtgttgggaaggttaagaagagcaagaagtga

SEQ ID NO: 27085 - DNA, 6222 bp, Glycine max
  Peptide Sequence Number=SeqID_143863
atggagtcaaatgatagtggagatctattattacatccaagaatgacagaattgccatcaagatcttccacaagcccttcaaactcatcttctcctgtcagggaagaaattacatctgctaaggatgaaaaatccagtacacaaaaaacaataactggaagaattgctcaaatctttagtaagagctctgatatgtcttcaactgcatcccgtagaagcattgacttggaccaatctgaaattagtaaagtagaagttagtgagatgaaggctgaggatcagtcctctaatgagacttttgaagaagctatgagaaaacttcagtctgcagatcaaggcagtgaaattcctagcaatttaccagcaggggtgtttattgatcaacaatatgtcattgcaccagaagacttgaacgagctactattttcatcagattcaaattttctcaagtcattggcagaagtacagggcaatacagaactcgaaataggaccttggaagtttgagaatgatggggaaatcttcaaaagattagttacttacgtcaaggctcctagtaaattaattaaggctgtcaaagcctatgaggagcacacatatttaaaagctgatgggaagaactttgctgttctagtcagtgttagcactccggatgttatgtacgggagcacctttagggtagaagtactctatgtgatcacacctggaccagagttgccgactggagaacaatgttcgtgtctggttgtatcgtggcgaatgaattttttacaaagcaccatgatgaaaggaatgatagaaaatggggctcggcaaggcatgaaggatagctttgatcagtatgccactttgttatctcagactgttaaacctgctgatctgaaggaccttagttccaataaggaacaagctttagcgtcattacatgcagaacctgaatcagattggaggcttgcagtgcagtattttggtaacttcacagtatttgcaacagttttcatggggttgtatgtgcttgttcacatttggttggctgcaccaagcacaattcaagggcttgagtttggtgggcttgacttgccagattcaattggtgaatttgttgtctgtgcagttttggttcttcaaggtgaatgcatgctgggtaaaatctcacgcttcataaaggccagagcacaaaagggtagtgatcatggaatcaaagcacaaggagatgggtggttgctaactgttgccttaattgaaggaagcagtttagcttctgttgattctagtgggttgtctgatccctatgtggtgtttacgtgcaatggaaaaacaagaactagttcaatcaagttccagaaatctaatcttacatggaatgaaatatttgagtttgatgcaatggatgatcctccttctgtgctggatgtggtagtttatgattttgatggaccttttgatgaagctgcatctctaggacatgctgaaattaattttctaaaagcaaatatagcagatcttgctgatatatgggttccccttgaaggaaagttggcattggcatgtcagtctaagctgcacctaagaattttcttggacaacactagaggtggtaatgttgcaaaggactatttaagtagaatggagaaagaagtcaggaagaagattaatttgcggtctcctcaagcaaattcagcatttcagaaactgtttgggcttccacctgaggaatttctcatcaacgatttcacctgtcatttgaaaagaaaaatgcccctgcagggccgcctatttctatcagcaagaataattggatttcatgcaaatttgtttggaaataagacaaaattcttttttctttgggaagatattgaagacattcaggttattcctcctacattctcatcaatggggagtccaataattgtcataactcttcggaagggtagaggtgtagatgcaaggcatggtgcaaaaacacaagatgaacaaggcaggctgaggtttcattttcagtcatttgtgtctttcaatgttgcacacagagcgagtggacaacagtggtcagagggagaggaaaacagagggaaagggagagaccgagagtgggatcccaaaacgaactacgacaacaacaagcttggtcaatttcagaggtatcaccaccataactggagggataaggatgacatcacaacgttttacttcacacgcttccacgaacacataattgaagaggatctttgggctcagttcaagaaatggggggacgtgagggagattttcatccacaaacacaggaacaaaggaggtacaagatatggttttgttaggttcaaaggggtactggacaaatacagactagaaaaacagcttgacaacatcatcttagacggactcaagatgtatgttaatattccaaaatacgggagaggaaaggcgagggtcaaggagtgtatctccaaacttggtgtcctgaaggaaggccatagcaaggaagttgaggctgggcgacacagagcagtacaacataggaatccacagaagttatatgccaaggtggtctccactatccaaatggatgacggtaagatgaagcaccccaaactcccacaactgagatacgttgacacccactcctcagtacaccttcaagtggcagtgggggaaaagaaatggttcacagatgcatgggtgggcaggtttaagaaattgcgggctctggaaaggatagaggatgacataccttgggagttaggtgtgaacgtcgtgccgaaatatctcggcgacaacatggtactccttcttgggttggcggacaacaaagcagagcatatcatcgccgaaaagactcagcatggcacatctccattccactcactagaaaggtggaacccgacgatgagactgggtcatagacttgtgtgggcccaatgttggggtatccccattgaagcatgggacttagggaacattcgtaaaattgtggtggccattggagagcttgttgaggttgacgacgatgttgaagagataaggaggatggatagggccagaatcctcatcaggaccccgtggaaaccgttcttccatcacactgtttcagttaccataggcaaggagcttcatcaagtggttattgtcgaggagggggcgagcaacgacgggaggcgcaatttctcgggtcgaagaccgtcatactcattggaagagcttgatttcgatggtatcgacggagagtcaatgatatctccatactcgccccggtacgagatccggcatcaaccaaacaacccacatgatgacccagaagctatcgtagacagcgatggtgttccccgcataggcatcggtatacccatcggaagagcaacagacccaccggaagcaaaccactccgacgacctcggcggcaaccctctgaacgcggctcatgtgcagtcgatctcgtgccgggggaggaaagcctcccccaacgaagacacggttcctgtcgctaccgacaaaccgagggttatggagcaggaaggaaaaggcaagggatcagagacaacaatcaacaatggggaaataaatgtaggtgaggcacaaaaaaggaaacagcaaggggaaattgaatcactgacagagacagttgttcacccagaagctacaataagggaaatagttgttgaggatgtccaatttcaaatgagagttgaccatcaaggggaaattgaatcactgacagagacagttgttcacccagaagctacaataagggaaatagctgttgaggatgtccaatttcaaatgagagttaaccatgaccatgaattgctaacaccaccaacaggaatccaagacttacaaaatgccgaggatgggccaaacaatggggtgtttattaggagaaaggggtgtaaacagcagatggcccaaaaggaccttactaatggaaaagctacaaagtctatattttcgggaattaaccctcacacagaatccataggaacagccacatcaaaacgatcaaaagaagccgactcacagatacctataaaatccattggagctgatgaagggcagattgaagaggcattaacccaatgggagcttgcaaaactcatgtgggtgtctacagattcagagcagacaacaatcatccataaaattattgacatggagaccacagacaagaaagaggctgaggatttggggcttgggaaaggggtcaaatgggctgctgttcggaggcttgcaagaaaaaacaaaatggacatcttatgtattcaagaaacaaagaaggagcaaatcgataaacctatgtgtcaagccttgtggggagacatggatgttatccctgaaggaatgtggtgcttcttgggagatttcaacagcattaggcatccttctgaaagacaaggtgtgtctcacaggggagtggaagtagctagcatcaacgattttaatgaatggatatctgaaatggagtttactgaaattcctagtgataaatcctttgttcagacagtcatagagtgctggagaaatgcccaaccaaaggggtggggaggttatgttcttaaagaaaaaattaaaaacctcaaggagatattgaagtcgtggaacaaggtgcactgcggagacacactcaacaaagtacataagattgaggcagagttaaatagctttgaagatgcaagttctactagacagctgagttctcaagagttggtgacccgcaagaaattgcaggagaagttatgggcagcagcacactcccacaaacatacaaacaacgcagttaaaggcataatggctaatggctcatgggtagatgaccctagaagagtgaaagaggaaatctacagattttttgagaacagattcattgaacctgaacaacacaggccaatcctagatgaaaccagattctttgggattgatcagcagcaaaatgacatgttggtggcaagcttcactgaggaagaaataagagcggctgtttggaattgtggaagcgaaaaaagcccgggaccggatggtttaaatttcaaatttgttaaacaattttgggagatgttaaagcccgaaattagccggttcattgctgaatttcatgctaatggggtatttccgaggggcaccaatgcatctttcattgctttgatcccaaaggtgaaggatccacatcatcttaatgaatatagacctatctcattaataggctgtgtttacaagatcgtggctaaactcctagcacatagactgaagaaggtgttgccaaacataattgatgagaggcagtcagcttttatcactggaagacagctgctgcacagcgttttgatagccaatgaggcggtggaaaaaggcggaacaagccatgcctcgtttttaaagtggattacgaaaaagcctatgactcggtcttcctccatgtctctcctggtcaacggtagccccacaaatgaattttatccccatagaggcctcagacaaggtgaccctctagcgcctctactcttcagtattgtcgcggaaggactaactggacttatgagagaagcactggacaagagcctctacagcagtctcatgaatgtgatgacaataaaatccatgttgagagtttttgaacttgcgtccggtttaaagataaattttgcaaagagcagctttggggcaatagcacacgagcataggaagattgcatgggtagactggaagacaatatgcctaccaaaagataaaggtgggctgggaatcaaagaccttaggaccttcaatgcagctctgttggggaagtggaggtgggaacttttccacaagcagaaggtaccatgggccaaagtgatcgactcaaaatatggtagtcagaaatttaggttttgggaagatccatggacagctgatgaattgtcactaatggagaaataccctaggatgtatcgcatttcatgccaacaaaagcaattgatgatgcagatggggagtagcatgaacaatggcaagtggactcatacagggaagacacctggatttggaaacctaacacatgaattatggaaactcaaaattccagcaaaagctgcagtattcgtttggaggctcatccgagatagactaccaacaaagaaaaatcttagtagaagacaggtggtgatgaatgacgtgttgtactcatccgagatagactttgtaatgcattttaatcaatggtcatcgaatctcaaggaagggtttagaagctag

SEQ ID NO: 27086 - DNA, 210 bp, Glycine max
  Peptide Sequence Number=SeqID_143864
atgccattgaaaaagcacgaaggtgaagagaaggacctgtcggaggatgttgtcagcgatgcggtagtagaatcggagggagattcggttatcgacatcgactttctgagcactggcagcgatgttgatcctgttcctgtccgaagaagaagaagacctcatcgtttctcgaaacgcagcgtttcaccgtcgtcgtcgtcgtattcctag

SEQ ID NO: 27087 - DNA, 825 bp, Glycine max
  Peptide Sequence Number=SeqID_143865
atgagtgaaaaaaagaaaagcgtacctcagtacctgaaaggggaggggttcctcagtgtgcatataggcattttgaaggtggcatgtttgggatgctcatacttagaatcggcagtaggcaagtggatcacacttagttatgtgatgatgggatgcaaggcccttactggattactggtgttagagtttcatgctgatatctttcgtgcagagaagaatattattgacctatatgtcatgcttttaagattttctagtttggtgtctgagacaataccacgccaccgagactatagatcatctccacaaaggcagaaagaatcattgaaaaagaaattgttaatttcgttgaatgaactggagaacttgaaaccagtggtccaacagaagatcaatgagcttaacaacaaatttgcataccaacaaaatggacagggaaaatttatttcaaataattcactggatttttctcctgtgaaaaagctaacttcggctagttatggcctaataaaggcagtcagacctactgctggggagtttgtttaccaaggatcaaggagccaacagttctcttatgtcaggcctgtggaagagcatgtacgaagactatctctaactcttccacctccaaaggaggaaactctctcaagacattctatccttggtcccaacgggctaaaagggcattggagaccacctatcattgataaagggatcaagtatccaagcaacatagatctatcccctgttgaattaccgaggttattgtctattttaagcttctacagtgcttttctctatttttggccttctagttttttttaa

SEQ ID NO: 27088 - DNA, 309 bp, Glycine max
  Peptide Sequence Number=SeqID_143866
ggattgatgctaaatggtcaagaagtggcggttaagaagctgtcattggaatctaggcaaggagttagagaattcaccaatgaagtcagactattactaagaattcagcacaagaacttggttacattactgggttgttgtgcagaagggcctgaaaagatgcttttatggagtcttgctgttggaaatagtcagtgggagaaaaaaaccatgatgtgcagcttggttcagaaaaggcagttcaatatatcattagagtggggactaagctccaaggggtctcccattaggggaatgcttaagccttaa

SEQ ID NO: 27089 - DNA, 921 bp, Glycine max
  Peptide Sequence Number=SeqID_143867
atgtctactccttcaaagagcataatctgttcaagggaagatgattatgaacttagaagagggccatggagtgttgaagaggatgatcttctcatcagttacattgccaataatggggaagggagatggaatttgcttgctatacgttcaggattaaggagaacaggtaagagttgtagattgagatggctaaattatctaaagccaaatgttaagagaggaaatttaacctcggaagagcagcttttgatttttgaactccactcaaagtggggcaacaggtggtcaaaaattgcgcatcagctgccgggcagaacagacaatgaaataaagaactattggagaacaaggattcagaaacgagcaaaatatctgaaatttgaggcacacagaaaatcaagatttgtagaatttgtcaagggtctacagatgacaagatatcttcataaagcacaagaatcatctccttcagccatgtcaatccaagaccaagcaattcctttaccttttgatggtgttactattcctcattattcatcatttgggattgggacaacaccaacaacacaaatcacttgccagggaggtctcaatcatttgaatcagcaagaccaaaactcagaatctgaacacaacaatggttcatgcatttcctcttcagaatcagcaaatatcccatatatgagtcagcctttgggacacactactagtcaatttcaggccttagataactgtgactttggcatctgttcatatgatggctatagcatagataacaattcctatgacatggatgccttgaacttgacaaccacaatggttgctgagaatctggaactgccagtgtttgatgtccaaatatcagaaccctattttatgaacatggatgaattgtggcaatttaggaacatacaaagatga

SEQ ID NO: 27090 - DNA, 207 bp, Glycine max
  Peptide Sequence Number=SeqID_143868
atgggcgaggaagagaaaaaattagaggaaaacaaagtggaggagaaaaaagcagagaaagaagaaaagaaagaagagaaaaaatcagaggaatcaaaagatgacaaggaatctaaggaggaatctgcaccgccagaaatcgtgcaagacacaaccttcgcaatgcatggacactttaagcacgatttctggcatcttttaagttag

SEQ ID NO: 27091 - DNA, 822 bp, Glycine max
  Peptide Sequence Number=SeqID_143869
atggctgaattcacagaaaatatgcaattgcaaagcaatattattagaccctcccagtttccattcttagagattgatccaagcatggaactcctaaaccagttcatagggatgaaccaacatgtcctagaaaactcaaacttgagtactatgcacaacttggtgcctttctcctgtgacactttcttgggccctcaagagcctgagtttccaggaaacttggaagaaaatttccctgcccttgtcaaccacaatgcacttcctgtttccctcccaattttccaagcagaaaatgagatccatgaaggtaaaaaaaggaaatcagtggatcttcctgagacaagttcagctaactcaactcctgcagtttctgagagtggaagcaagatcaaacatagttctggaagagggaagagagtaaaaagcaatgtaacagaagaggagaaagcaaaggaagtggttcatgtcagagccagaagaggtcaagctacagatagtcacagtttagcagaaagggttagaagagggaaaatcaatgagaaattaaggtgcttacagaacattgttccaggatgttacaagaccatgggtatggcagtaatgttggatgaaatcataaactatgtgcagtctttgcagcatcaagtagagttcctttctttgaagcttactgcagcaagtacattttatgacttcaactccgagacagatgctttggaaacaatgcagagagcaagggcatccgaggcaaaagagctaggaaagtataagaaagaagggtatggaggagtttctttctttcaaccagcatggcccctttga

SEQ ID NO: 27092 - DNA, 732 bp, Glycine max
  Peptide Sequence Number=SeqID_143870
atgagtccttcacaattccatgcaaagaaaccaatcacctccgccaccaccaacaacaacattaatggattgctatcatcaccacctttgaaaatcaacaaggaatctcatttcatcaaaaaatcatcatcttcatcatcgtcatcgtcatcatcaacatcatcatcccttgttaatagtgccatgacacgggcaatgccaacgtcattgtacaaacaaccacaacaacaccaccacccggtaattatctacacacattctccaaaggtcatccacactcagcctaaggatttcatgtcattggtgcaaaagctcactggcctctctcgctcaggagaggagaaagaggagggtggcaaccaatcgccacaacaactctcgaaccaagaatttgggggtgatgttgcggcggtggtgggagacaaagaaagtgatagaaaaaatgtgaatattgtgaaaaatgaggacaacgagacatcatcggtaataaccgaagaaaacaattgtagtagcgtgggagaaaaccaagttaactcttgtttcatgaccggggagccatcaatgctagagcctaagttgaacccttatgtgacaaattttccggttatggcgccgagctcggcggagtttgtgtgttcgagtcagccattcttgaattactcggactctttgttcttctctcataacttgagaacctcattggaagggatgaaagagttccttgagcattga

SEQ ID NO: 27093 - DNA, 195 bp, Glycine max
  Peptide Sequence Number=SeqID_143871
atgaacaaaaaagggacaacaatagtccatatgatcaatgccggcgatcaaggtgtccatgccgatagccaaggcaaccctcccgacggccaaggcgccacacaaacaaaaatgctaagttgccatcatcctgtctccccattagttactatcgcatttcatcactcatctgatttccgcaataagcttatctga

SEQ ID NO: 27094 - DNA, 1392 bp, Glycine max
  Peptide Sequence Number=SeqID_143872
tacgggagataccaacgcaaactgctcgtggaggacttggataagaaatggaagcgaatcatactgaatgtttcgcccatcacaccattggagcactgtgagtggctgaataagttgttgacagaagtctggtccaactattttaatcccaagttttcaataaggatatctgctatagttgagaaacgtttaaagctccggaaaccaagacttctagaaagagttgaactgcaggagttttcactgggatcgtgccctcctagcttggctttgcaagggatgcggtggtcaactattggtgatcagagatttctgcaactgggttttgactgggatacaaatgaaatgagcattttgttgcttgctaagcttgcaaagccattgattggaactgctcgaatagtgattaacagtcttcatatcaagggtgatcttcttgcctcacctattctagatggaaaagcacttctgtattcttttgtatcaactcctgaagtgagaataggagttgcctttggaagcggtggaagccaatcacttcctgccactgaatggcctggtgtttcttcttggctggaaaaactttttactgacaccttggctaaaaccatggtggaacctcggcgtcgttgtttcactttacctgctgttgatttaaggaaaaaagcagttggaggcattatatatattcgagtgatttcagcaaataaactttctaggagttgctttaagacatgtaggaggcaaccaaatggtacatccaatggttgttcagaggataattttgatgataaggacctacaaacatttgtagaggtagaaattgaagaattaaccaggagaacagatgtcagactgggttcaacccccagatgggatgcaccatttaatatggttttacacgataatgcaggaactcttcgtttcaatctttatgagagttgtcccaacaacgtgagatgtgactatctagcaagttgtgaaatcaagttgaggcatgtggaagatgattcaacgataatgtgggcaataggacctgattctggagtcatagcaaagcaagcacagttttgcggagaagaaattgaaatggttgtcccatttgaggggcacaactcaggagaggtgagcgttgtagtaaaagagtggcaatattctgatggttcacatagcttgaacagtctccggagtagcagctctcagcagtcaattaatggatcaccaaattttcagttaagaactggaagaaaaattaatgtaactgttgtggaaggaaaggatcttgctgcaaaagacaaatctggaaagtttgacccatacatcaaattgcagtatggaaaggtgagttgtactgcatatctgcgagacactgacagttctttcattacttga

SEQ ID NO: 27095 - DNA, 447 bp, Glycine max
  Peptide Sequence Number=SeqID_143873
atgggacagtatactcctttggatcaggtgctaatttctgtcttggccatggggatgagcatgcagtggcacttgattcaaatggatttgtatatacatggggcaagggatactgtggtctgtgcaaggaagaggaaaacatttgttctagttaattctggtttagtctatggctttggctccatgggatttggcagcctcggattcctgtatagaagggtatctaataaagtattgaaacctagaatcttagataccttgggagctcaccatgtttctcaaattagcactggcttgtacaacactgtggtgatcactagcaggggacaaatatttggctttggagacaatgaaagagcacaacttggtcatgacacattaataagctacctagagcccactcaaattttcattaaagatacatttgaagatgtagaaagcacctga

SEQ ID NO: 27096 - DNA, 501 bp, Glycine max
  Peptide Sequence Number=SeqID_143874
atgtggaccaagtactgggatcatgtgtcaagaagctttctggaaaaccaaagcttgatgacaatagagcaacaaacaaataaagttatggccatggttattatccaaagcattacgaagaataacacttgcatctctactttcgataaggttgcagttttatttgaactaatcaaagggcttataatggacttggatggaacaactctggatgatgttgatgaagaagatttcaatgaggagcaaaattgtgtcgctcgcctcatacgcatgcttcataatgatgaaccagaggaaatgtttaagataacgataattatgttcatagtcaaattgaattgcatcggtgtttctctattaagtgattcatataacacgactcattcaccttcagataatatgtaccgtaaagaagcatattatgagtggaggaccaaggagcttaccttttacagttccttccctgatattttctgcactaagggtatctttcttccttga

SEQ ID NO: 27097 - DNA, 459 bp, Glycine max
  Peptide Sequence Number=SeqID_143875
atgcaaagctattgctcccatgatacgcatgttgtcaacttgtgcttctatcacttgcaaccaaaggcaggaaaagaaaggctagtacagaaatccatactaaaagaatggatagagaaattcaggaaatacccgaggcaaaatgatatcaacaacacatggaagcttaattttttacaaaaggagctccttgaggtaatcatctgcaacatctttctttgttttccattctttggctttaatgaatccttctgctatccacaagtgaatcaatctcatgcgctgaatcagatagtccttaggaaagatgctcaagtacaagaaacaatatttcaaatgttaaggtgcttttgggaaggtttaacagcagttagtgctttaaacaaggaaggtttaacagatttggagatgctggagtgttgtccaactggcaatataaggctatacattgcaatgtag

SEQ ID NO: 27098 - DNA, 258 bp, Glycine max
  Peptide Sequence Number=SeqID_143876
atgcaaccttgtttgattattctttggcatcatcaaaatcatgtattcatacattcacaacaattagccaaacaaatggctaaaagacccagctttggagccaacatagagaagaaccccaaggaggaatgtgtggaagcaatgacttccaagatcattttgatgatgccaaagaatcaagagttaagcaagttccaaagaatcaggagtcaaaaagcttcaagaatcaagtttcaaagaatcaagcttcaagaataa

SEQ ID NO: 27099 - DNA, 198 bp, Glycine max
  Peptide Sequence Number=SeqID_143877
atggctcgcacaaagcgatatgggcagatgacctctacatcaacacaacaaatatcagacaaaattggacaagtgtcacaatcaaccagtactttgaataggccttacgtgggtccaacacttcctcaacatcaatcacccaacagtaattggctgatatcatgggtaacctcaaggaagagtggaggaaagaagtag

SEQ ID NO: 27100 - DNA, 474 bp, Glycine max
  Peptide Sequence Number=SeqID_143878
atggccaatgcaatggctggaattgatcctttgggagaattggttaagaatttgtttgatgcttaccaaaagccaattgagttgccgtgggatgggacgaaatttgggatacctaaaagtacaagcttaggttatggttcagtgtatggttttcttgagcctcagtctatacaccatgcaaaggacagacgtcaagaatgtcaacaatacattgaaacatgggtcaaaggaatcacattgacaagtgtacttaggaccttacttgaatcaagtcatgttcaaactggaggctatgagtatggatattatgtcatgcattggatgtggtgcatagtccgtggcgatttgaagaatgaatggaacatgtggttttttgatggaacagcgttagatggtgaggccatgacaacactttgcaagaaatgggcagcatattttctacaagttaaaaatatggaatttagacaaatttag

SEQ ID NO: 27101 - DNA, 1555 bp, Glycine max
  Peptide Sequence Number=SeqID_143879
atgagtagtgtgactagtgggggtgataatcgaaaaatatccaaaggtcgtcggtcatcatcattagaggaagaagctggagttggaggtaacataagaggagaaagtcctctgaagaaaggcccatggactgcagcagaggatgcaattttggtagaatatgccaaaaaacacggacaaggcaattggaatgcagtacataaatattcaggacttgcccgttgtgggaaaagctgccgtctacgatgggcaaatcatttgagaccagatctaaaaaaaggtgaatttactgcagaagaagagaatcgaatccttgaactacatgctaagatgggaaacaaatgggctcgaatggctgcagagttgcctggacgtacggataatgagatcaagaactactggaacacaagaatcaaaagaatgcaacgagcaggcttaccaatctaccctgaagaattgtgccaacggatacttaattgcaatcaagaaagtcaaaatattagcatcctgtcaaatgaagcctcccagcatggtgatctgtcacaaacagactttgatataccagacgtggaattcaaaattttcaaatttcgtcatggtctatcacatggacagtcaatatttgatatgcctgaaagtagcttgtttgatcaaagttcagactcatcccatagttataacttgttcccaactatgcgtcctacaaaacgccctcgggagtcagaaatgctatatgatagttttgaaagttgtacaattaatgctgccccactatttgatcagtatgacaattatacttctgaaaaaatttctgaccatcctaggttgtctcttccacgtgatcccgttcttaacaccaatgatcagtttaatggtgataaccttaccggcagccatgccgcattaaatggcaatgcctcttcttctgtgcccatgtttagggccatgaagttggagctcccttcactccaatatcctgaaactcaacatggtagctggggcacgcctacgtccccgcttccttcactcgagtctgttgatacattgattcagtctcctgttgttgagcctattctattagatcccatttctccgcagagcagtggtttgctggaagcgatagtccacaactcgaaaagcttgaaaggctcaaacaatgatttattattacaagaaacaattggtacaaccaatgaagtagctaagagttcaaccttgaatcattcctttcagacaaaatggtatgaactaggggagccaaattccccctttggtcaatctgctgcttcagttctaattgagtatactcctgtaagcatgtgctcagtggatggcccccaatcaattgaaaccactcaggatcatgatgataagcatgaagcactcaccacccaatttccagacagttccaggaagaaaaaaaatatattgaaacagatggattatacacagccagatgctttacttgacttaggttggtttgggaatagcaccgagtatggaagtgatcaatctgttctgcaagatgctttaagtgcacttcttggtgaagatt

SEQ ID NO: 27102 - DNA, 321 bp, Glycine max
  Peptide Sequence Number=SeqID_143880
atgcagggtgcagagggagaggaagatgctggttttggttgggatttctgttgggttcacactttatgtggttggtgtctactggtggagtcgttgggtcttatggcgctttctccggctttgacaattatgctgggttttgtgatttatgaaaatagaacaagtgggttgtatattgaaaagaagcaggtaaagttcaaaggtgacacggaagaactcactcttgatggaagtgttgattggcatggtcgccctataattagagccaaatctagcagaagggttattggaaccatcgttctatgtatgttccaaaaataa

SEQ ID NO: 27103 - DNA, 351 bp, Glycine max
  Peptide Sequence Number=SeqID_143881
atggaggttccttctgcagttccaagttgtttggagtgtagcatatcatgttttgtttatggtttcatgttcgaacaatgtgaagtgaagggatttgtggcgatgaccacggcggtgatgattgtcgtgataggaggcacaagctttgtggatcaatttgttcgcttcctagatattgtcgacgacgaagtaaccgcaggagatagggaggatgcaagattggtggaggaaggaaaggtcaatgaagtggaagggctcgtcatgacaggagggatatggagtggaaaggagggattgggaggaggcagaggttctagagagggaatgaggttgagggagaagaggagataa

SEQ ID NO: 27104 - DNA, 699 bp, Glycine max
  Peptide Sequence Number=SeqID_143882
atggaagaaggagaaatttctggagacctgggaataatggaagttgatgaggttcagaagcctgaaaatgtaactggaaacatgatatatctttctaagattgagaatcaagaaaaggaaaaaggctacgactctaaatcctctatggtaaatgcacttcaagatgccaataatagtgaaaaagtggagcctagaactagtggcaagaaagggattgtatgcggagttgaagtagcaatgtctaaagaaactattgaatgtcagaaggaagataaaacgaagttggataatgccagtaaaaagaataagtgtggtgggaataaaggaaaaaagaagagcagagttgtctccacttctgtccggaaatgcaaattccagcacacaccacttaacaacaatcatgtctctagttctgtcaagcaaaaccacttgactaagtctgcaggaattcattcttgcaccagtgttgaacataaggtgacaaacactgtacagaaacagcctataccacctaaaggaattagtttcatcaatcttgcaaaattatcacccagctttagttcactgaaacaagacacagtaacaaccaaggaaagtcctgtacaaattgggacccgtgaagatcaaagtgcatttcacaaaactcaaaataaggtggacattcctaagaaattaccggctgtgacacctaaggaataa

SEQ ID NO: 27105 - DNA, 852 bp, Glycine max
  Peptide Sequence Number=SeqID_143883
atggcgaaaaggagcaatatctcacacacactattgagtagtatgtatgtttttttgtgcgtggttgggttttcggagtgttcgagcataagcacgttcctctacagcgggtgcacgcagcaacggtacactcccaactcgccctacgagtggaatatcaactcgttactcacctcgctggtgaactcggcgacgtactctgcttataacaacttcacggtcgtggggtccactcagcaggacgcggtgtacgggctctaccagtgccgcggcgacctcgccatgccggactgcgccgcctgcgtggcccgagccgtcacgcgcgccggcgacatctgccgcggcacgtgcggcggcgcggtgcagctcgacggctgcttcgtgaagtacgacaacgccacgttcctcggcgcggcggacaagacggtggtgctgaagaagtgcgggccgtcggtcgggtacaaccccgacgccatggggagccgcgacgccgtgctcgccggactcgccgccgccggtgggaactttcgcgtcggtgggtccggtggggtacacggcgtggcgcagtgcaccggcgacctgagctacggggagtgccaggactgcgtggcggaggcgatctcgcgcctgaagagcgattgcggcacagcggattacggtgacatgtttctcgggaagtgttacgcgaggtactccgttggtggggcccacgatgagtccaaggcccacgacaaatcgaatcatggaggtgtaaagacattttctataattattggatcattagcgggagtggccatacttattattttctttgctttcatgagcaagatttgtgggcgacagggtaaataa

SEQ ID NO: 27106 - DNA, 726 bp, Glycine max
  Peptide Sequence Number=SeqID_143884
atggatagcgatggaggctccaaattgaatgggattaggcagattgtgaagctaaaggaaatgctccagaagtggcaaagtgtgacattaggcaccaaaccttccaattccctttctgatcatgtgactaatgatgatgggagcatatcaccattgatcaacaaaagtgtattgaatgtgatgaattgcgaatcagacaatgaggacagttgccaaagccctgcagaaccgcttccaccacctgatgttccgaaagggtacttggcagtgtatgttggacctgagcttaggaggttcatcatccccaccagttaccttagccaccctctcttcaaagttttgctggaaaaggctgcagacgaattcgggtttgatcagagtggtggcctcaccatcccatgtgagattgagaccttcaagtaccttctcaagtgcatggagaatgagcagaaagagcaactcggtgacagcgcccaaagagaagtgacaaagagagatgtgagtaagaatagtgagattgatttcatttgtttgggagaagaaagacatggaagaggtaggacagaattattgaggtggaacacgatttatggtgaaactgcagctggaagctcagggtctgtcgaagaaatagtacctagagtggtggtagcagtaagtagtaaccttgatgatgacaggaatgataaaaagcgtgaatctttccaaagaaaggaaagtggatag

SEQ ID NO: 27107 - DNA, 132 bp, Glycine max
  Peptide Sequence Number=SeqID_143885
atgaggcataatgtacataagagggcattagctatgagcgagatgagaaaaagccatgcagcttcgaaggaagtggaagcggaagtagcaaactctccaaagagagaggaaatgaaacgaaacgaaagataa

SEQ ID NO: 27108 - DNA, 1462 bp, Glycine max
  Peptide Sequence Number=SeqID_143886
gtaacaacaatttcagcggcgagatctcgccaaagttcaatagcctcactcgtttggccactctttatctcgaacgcaacaatttcactggttcgatccctgacctcgatgctccgccgctcgatcagtttaatgtgtcgtttaattcgctaaccggatccattccgaaccggttttcgcgtctggaccgaaccgcttttctcggaaactcgctgctctgcgggaagcctttgcagctttgccccggaactgaggagaagaagggtaaactatccggtggcgccattgcgggcattgtgattggttccgtggttggtgtgttgttgattctgttgcttttgttctttttgtgtagaaaaaataataggaaaaatgagaatgaaactttgccacctgagaagcgtgttgtggaaggtgaagtggtgtctcgtgagagtggcgggaattcaggttcggcagtggcgggttcggtggagaagagtgagattcggagtagtagtggtggtggtgccggagataataagagtttggtgttttttgggaatgtgagtagagtgtttagtttggatgagctgttgagggcttcagctgaagttttagggaaaggcacgtttgggacgacttataaggcgacgatggagatgggggcgagtgtggcagtgaagaggttgaaggatgttactgcaacagagaaggaattcagggagaagattgagcaagtggggaagatggttcatcacaacttggtctcactaaggggctattactttagcagggatgagaagctggttgtgtatgactacatgcctatgggaagcttatctgctctcttacatgcaaatggtggagtagggaggactccactgaattgggaaacaaggtctgccattgcccttggtgctgctcgtgggattgcatacattcattcgcatggcccaacatcctcccatggaaacatcaagtcatcgaatatccttctcaccaaaacttttgaagctcgtgtctctgactttggccttgcttaccttgctctcccaacctctacaccaaaccgtgtgtctggttaccgtgcgccagaggtcactgatgcacgcaagatatcccaaaaggccgatgtctatagctttggtatcatgcttttggagctgcttacagggaaggctcctactcattcttcactaactgaggaaggggtggacctcccaagatgggtccaatctgtggttcaagatgagtggaacactgaggtatttgacatggagcttctaaggtaccaaaatgttgaggaggaaatggtcaagcttttgcagcttgcccttgaatgtaccgctcaatatcctgacaagagaccttcaatggatgtggtggcaagcaagattgaggaaatttgtcatcctagtttagagaaagaggaagggaagaaccatgattttaaagatgctgataatggattttcccaaca

SEQ ID NO: 27109 - DNA, 249 bp, Glycine max
  Peptide Sequence Number=SeqID_143887
atgtattcgtatgtggcgatcactcccgattgtcatcctcataataatgtaagaccatcaagacctgggaagattggtggcagatgttgggctctaataagagcggagaactcaccatacaaccaacaacttttaggtactgatgatgctgagtacctgagacatctacgagcttggcgtagctcacaaagagaacgggtatggccttatgttgtaacatggactatgcactacatctgccatacttga

SEQ ID NO: 27110 - DNA, 2298 bp, Glycine max
  Peptide Sequence Number=SeqID_143888
atggcgttccccaacacttgcaagctctctgaattgtctttcaattcatcattcgcatcactgaaccatcctcatagctctttccgcaaattcccatttcgcactctcaccttcgcttctctcccaacccctaaacccaacccctccgccccctggctcaccaaatccccctcccccaaaagggccgtcgaaccactccccgccggcgaccctactcccgacagaaaaccgcagaacgccgtcgatagaatcgtcctccggttacgcaacctcggcttgccctccgaagaagaagaacaagagcaagaacatgaagaagaaattccggcgactaatccggcgccggtaaccggagaggagaggctgggggagttgctccagcgggagtgggtgcgcccggacgccgtgttggtgggtgaggacgatgatgaggaggaagagatgatgctgccgtgggagagggatgaggaggagaaggaggtggtggtggtgagtgaagaggggttgttgaagaagaggagggttagggctccgagtttggctgatttgacacttgaggatgaactgttgaggaggttgaggagagaggggatgcgtgtgagggagagggtgagtgtccccaaagctggactcactgaggaggtgatggagaagattcataagaggtggaggaaggaggagttggtgaggctcaagtttcatgaggaacttgcaaaggacatgaggaaggctcatgagattgttgagcaaatattgctctcactagttacttcacttcattgtggacttgtggttcttgtcttcggctgggtttggaggaatttctcaatcaacattgtgcagcgtcgaactggaggattggttacgtggaggtcaggcagtgttatgatggtgtatcgtggtattgattaccaagggcctgactcgcggaaggaacttaatgagaagaaaggtgatggtttttttgtgccggatgtctcgaaaagggaagacagtactgcaacctcaacctcagagaagagtgaggtggttgtgagggagcgagaacatccggagaatatgtcagaggcagaagcagagtacaatgccctccttgatggtttaggtcctcggttttttggatggtggggtacagggattcttcctgttgatgctgatttgcttccccggacagttccaggttacaaaacaccttttaggcttcttcctactgggatgcgttctcggctaacaaatgcagagatgaccaatttaaggaagcttgcaaaatcacttccttgtcattttgctgtagggagaaatagaaatcaccaaggtctggcatgtgctattcttaagctttgggagaaaagtttagtttccaagattgctgtcaaacgtgggatccagaacacaaacaatgaactgatggctgaggagctgaagatgttaacaggagggaccttgctgctaaggaataaatatttcattgttatatatcgtgggaaagactttgttccaacaagtgtcgctgcagttttagctgaaagagaggaattaacaaaacaggtacaggacgttgaagacaaggtgcgttgcagagcagttgatgcaattccatcagggcaaggtgaagcaacggcacaggctgggactttagcagagttctatgaggcccaagctcgatggggaagggaaatatctcctgatgaacgtgagaagatgatggaagaagctgccaaagccaagactgctaagcttgtcagacaaattgaacataaaatatttatagcccagactaaaaagcttagagcagaaaagctcttagccaaaatagaagcatctatggttccagctggtcctgattatgatcaggaaacaatcacagatgaagaacgtgttatgttccgtaaagttggtttaagaatgaagccatacttaccacttggtatacgtggtgtttttgatggtgttgttgagaatatgcatttgcattggaaacaccgagaacttgtaaaattgatgacgaaacaaaagactcttgcttttgttgaagacacagcaagattacttgaatatgagagtggtggaatactggtggcaatagagaaagtttccaaagaatttgctcttatttactatcgtggaaagaattataagcggccaattactcttaggcctaggaaccttctaacgaagggaaaggcattaaagcgtcatgtagccatgcaacgtcatgaggctctgagtcagcatattactgaattggaaaaaactatagaacaaatgaaaaaagaacttaggagaggtcactcctaa

SEQ ID NO: 27111 - DNA, 444 bp, Glycine max
  Peptide Sequence Number=SeqID_143889
atggctgcaataaccacaaaagaacaacaagtagtagtaaactatatgagtgaagagttgcaaacgatttttctgtccaacttggatgaggcacccgctagacggcgtgctcgtgaggcttttaaggatattcaacttgccattgatcattgcttgtttcggttatcatcagatggggtgaagacgaaagaggtttatgaagtgaactccagaggattaaaaatattctctaaaagttggcttccagaaagttctcatttgaaagcaatcatttgttactgtcatggagttgcaaggaagttagcatcatctggatatggagtatttgcattggattaccctggatttggcctttctgatggtcttcatggttatattcctagctttgaaagtctagtgaatgatgtcatcgagcatttctcaaaaattaagggtgagatctaa

SEQ ID NO: 27112 - DNA, 1578 bp, Glycine max
  Peptide Sequence Number=SeqID_143890
atgtcatgttccaaagaagaagctcttgttagactcttctacaatgcctctagctcctttcaccttctcttcctcttcctcttctcctcttcagttcttcttttcaagttcataaacttcattggcagcttcaccatattccaaagagatcatcactatgaatatgtgtcttctgagtatgatgatgaagaagaagaaattcaagaaagttactcttatgtccatgattctattgagtcagatcatctagtagcagacatcatttgtggtggagagacccttttgtttgtgcacaagaaccagcctcagaggactcattcttcttctgatgaattcacaagcccccgggatagccttgttgaagacttagaagaaaactattcaacagaaaccttgtcttttcacaagtcacctttggtttcagactttgaaaatgaacaagatgcagaagaatttccagcagaagatgctgattctgttccaaattctgtcccagctgaaagcaggcccacatcgcccatcacactgaacctctacaaaagcgacttagtagacagtgacaaaaactatgacgaagatcatgttgaaattggagttattgaaaataagaaggtgcaagaggaaagtctcacacgagatgagagattctttgcctatgctcctaccctattggaggctaagaagctcattgttgaggaaaaagatgatgaagaaatatatggtgactcatgcactgttgggtccacttctaagagctcctctgagtggaggagctccattaattgcagggattctggaactgaagaccctttttcttcttcatcaagaagaagttgccccaaatgggaatcatatacagttttccaaaaatatgatgaagagatgacattcctagacaggattagcgcacagaaacttcatgaaactgagcgtattgtgttcaagttttcaagtatgaataaaaaaccaggtgacatgcgtcacaacccatatcgtgaactagaggctgcatatgttgcacaaatttgcttaacatgggaagcccttaactggaactacaagaattttcaaaccaaacgagcttctcgaggccaggatgttgatgtgggttgtccagccaccgttgcacagagattccaacaatttcaagtgttgttgcaaagatacgtagagaatgaaccttatgagcatggtagaagacctgagatatatgctagagtgaggcatttggctccaaagttgctcctcgtaccagaatatcgagaaaaagatgaaagtgaaagatcttcggcgttcccgcaaatgcttgaggaagagaaagttgaagggagaagaagagatggagattttgatggcactcatagacctcaaagtgtgtcaagggttttgagaatgagtgagttaagtgaggaacagttgcattggtgtgaagagaagatgagcaaagtgaggcctgaaatgagaggaaagttgggtaaagatgaatgcttaggtcatttgatgaatattgaaagtgaaagaccaaagacaaagcaaggaatgaagatagagacaaggatagctttagtttgcctttag

SEQ ID NO: 27113 - DNA, 198 bp, Glycine max
  Peptide Sequence Number=SeqID_143891
atgctattcgaacaatatcggatcaaggcttcaaggaacagaagtcatgataaaagtcttggccccacccacttaaaagtgctagctggttatggctcattggctgatgaagatggacttacttggtcgctggggctggcgtcaggtgtagggcagcaaattaaagcaatgaaagggcttcatgattcagtttattag

SEQ ID NO: 27114 - DNA, 411 bp, Glycine max
  Peptide Sequence Number=SeqID_143892
atggcggaatactccctgctagcctgtctcgcaggcaccactggcggcattgctgcctacgtggaggagtatcccgccatttctgttggcgggttcaggagctctcgcttttgttcatgggggcacgcctatgtcgctaattccactggtggcaccaccccaagaagagaccccctccgtaaaatgttaaagaagagacccctttacgaaggtatgggagctacctatggcacaacgaagagtggcgtgggcgtggcttcaataggtgtgatgagatcggagttggtgatgaagtctattgtccctgttgttatggtcggagttttgggtatttatggccttattattgttgttattatcactattggcattaattccaaggccaaatcttattacctctttgatggttag

SEQ ID NO: 27115 - DNA, 246 bp, Glycine max
  Peptide Sequence Number=SeqID_143893
atgaatgtaaagagaagagaagatatagttgctatgcttccaaggaaaagaatactgatgcggcatgggaattctacgtgtcccctacgctcacacccgatcgatgttccacgagttcagacggtgtttcttgaagaagaggattattggcgtgagggaagagtcgcaagttcgagaacgggacttcggaaactttcacgtgaaagagaggatgaaggttataaaggaaatatgcaaacgttttag

SEQ ID NO: 27116 - DNA, 273 bp, Glycine max
  Peptide Sequence Number=SeqID_143894
atggaggattcgaaggaatttgcagtgtgtatattcgacgcattggttcgaaggaaggaaaggagagtgagcagcataaacagagaagagttgcatgagttctggttgcaaatttcagatcagagttttgatgctcggcttcagattttctttgacatggcagacagtaatgaagacggaagaattactagggaagaagtacaagaggtcagatttaagattttaaagaacatgcgtatatccaccaaactctttactactatcatttattga

SEQ ID NO: 27117 - DNA, 1413 bp, Glycine max
  Peptide Sequence Number=SeqID_143895
atgttgttactagaaaaggataggtacatgaactacagcagacaactcagcaccgcaagtgtaaactggagtcaaaatatgcccgatttgaggcccaaaaatgaggtacaaagattgtgcaggacacttcaatgtcttgcattagagtattggagaaggggctggattttgttactatggttggttaccactgcttgcctatttgcctggaaattttaccagtatagaaacagatcaactttccaagtcatgagttattgcataccaatagctaagggtgctgcagagacactgaagctcaacatggctctcattctcttgccagtttgtaggaacacattgacatggcttcgttccacaggagccaggaaatttgtcccttttgatgacaacattaatttccacaagatcattgcattcgccatagccgttggaatcgccgttcatgcaggcaatcatcttgcatgtgacttccccctccttgtgaactcatctccagaaaaattttcactcatatcttcagatttccataacaaaagacccacatacaaatcccttctgaccggagtcgaaggcgtaaccggaatctcaatggtggttttgatggctatctctttcactttggccactcaccacttccggagaaacgcagtcaggcttccttcaccctttaacagattgacaggcttcaatgcgttttggtactctcaccacctctttggtctggtctatgttctgcttctcgtccatggaacgttcttgtatttgacccatcggtggtaccagaaaacaacatggatgtatatttctgttccactgttgctgtacatagcggagcgtactctacgcactcgtagatcagcacattatacagtaaaaattctgaaggtgtcaggactaccaggaaatgtgttcagcttactcatgtccaagcctaatggatttaagtacaaaagtggacaatacatatttttacaatgcccaaaagtctctccctttgaatggcacccattctccattacctctgccccaggagatgagtacctaagtgttcacattcgcacagtgggagactggacccaagaacttaagcatcttctcactaaagaagatgacaaattaccttcagttaattgtcaggcaacgtttggtgaactgatgcaactggatcaaagaggacagccgagactacttgttgatggcccttatggagctccagcacaagactaccagaattttgatgtactactcctcataggattaggaattggagcaactcctttcatcagcattctcagagatcttctcaataacaccagagcaatggatgaactagtggtgcaggagtcaaacacagaaacaagtcaaacaaccagatcagacgagagctccaatagctttacatcttcaaat

SEQ ID NO: 27118 - DNA, 354 bp, Glycine max
  Peptide Sequence Number=SeqID_143896
atgagccagggtcaaattgagcttcataactatcttacaagcgtttatgaagagggggatgcgagatcaaccttaatcaccatgatccaagcactgaaccatgccaaacatggcgttgacatcctatcaggaactcgagtaaggacacactttgctaggcctaattggaaagaagttttcaccaagattgccgctaaacatccgtttgctacagtagagatgggcggtagtagccggtggaaattatggataatacagagtaaagcatgcactggtcaaaacaacccaacttacaaggaactatggatctatttgtgttcaatagatcacgatgaagaaatgaatatcttctaa

SEQ ID NO: 27119 - DNA, 387 bp, Glycine max
  Peptide Sequence Number=SeqID_143897
atgtgctgtcgctgccatcgttgtgaccttgtgacggcctcgcaccggcaagtcctgcacccggtggtgtcaggggctgcacctcctttgtggagaattgaattcgaggacaactctaaacttgaggctgatgttgtggttcttgcaacaggttttgatgggaagaagaagctcaaaagcatcttaccacatcctttacgcagcttgggaactgtctatccgttgattccaagtatggcctttgtgggctcccggcctggtgttgagaagatgctttcacaaacacttgaggagatggatgtcatgaaaagatcaactaggaagaagaactggattacagaggcattcagtccttacagtagtgaagactataggaaaaaagattga

SEQ ID NO: 27120 - DNA, 340 bp, Glycine max
  Peptide Sequence Number=SeqID_143898
atggccactgttagagttgttcttgctctagcatctattaatcgatggcacctccatcaattagatgttagcaacactttcttacactgggacctcagggaggacgtttacatggagacccctcctagcttgcttggttacacatcaagtcagagttgcaaattgaagaaatcactttatggattaaagcaatccagcagacaatggtatgaaaaattatctaatctattgctgatttgtggttattcacatgcccatgctgatcatagcctattcatcatgcctcataattctgaatttactgctttaattgtatatgttgatgacattgtgctaaccg

SEQ ID NO: 27121 - DNA, 208 bp, Glycine max
  Peptide Sequence Number=SeqID_143899
atggctacttccggctcatctagtgaggacaatcttactccaccaccaccaccaccttccttgtctcacatcacaatggtccaataccaacaattgatgaatcttctcagcaaatcctctggacctggtggtgcaagctcagagactactcttacacaagccaacctcattcattctaacccaaatcaaattcacaattctgattttg

SEQ ID NO: 27122 - DNA, 951 bp, Glycine max
  Peptide Sequence Number=SeqID_143900
atgacaaagcaaaattttcctttgggttgctctgttgtttgcataagcataatcttaatccagttcattgcttcaatgaatttcagcacatcccagagcttcaaaaacgaaactagtagtatcagtacaactaccaccactactaaggcctttttcatatttggcgactctactgtagactctggcaacaacaactacctaaatactatccctgagaacaaggcagattacaaaccatatggacaaaacggcttttttcaagaacccacgggaagattctcagatggtcgtgtcattgtagattttatagctgaatatgctaagctgccactacttcctccatttttacaaccaaatgctgattacagtaacggtgccaactttgcttctggtggggccggtgttcttgctgaaacccatcagggactggtgattgaccttcaaacacaattaagtcactttgaagaagtgacgaaattattatcagaaaatctaggagagaagaaggcaaaggaattgatctcagaagcaatttatttcattagcataggaagcaacgattacatgggtggatatcttggtaacccaaaaatgcaagaaagctacaatcctgaacaatatgttggaatggtcattggaaacttgacacatgcagtccaaagcctatatgagaaaggggctagaaggtttgggttcttaagtttgtctcctttgggttgcttgccagctcttagagctctaaaccaagaagccaacaaaggtggttgttttgaagcagcttctgctcttgctctagcacataataatgctttgagtaatgttctcccaagcctcgagcatgtccttgaaggattcaagtactctaactctaatttctatgattggcttcgagatagaatagacaaccctgcaaattatggtatgtattgcaatatgcgaccaattaattaa

SEQ ID NO: 27123 - DNA, 378 bp, Glycine max
  Peptide Sequence Number=SeqID_143901
atggccgaatggtactcgtcacttgtatatgttgaagatcgagacgtgttgtacgaaacatgtgaacctatggtcgaaagggtactcgacttcatagggtatgttgtagtaggtgtccgcataggcatcttctcgtcctgtccaaatacttatccagtatactggcgccctaagcccttttttggcctcaggccaaaagaagggttttatgttaagtacctacttctccaaatcttcctctcaaccaaacaccagggccacacgatgcaccaactgatgtggtgcctcatcccagccaggatccctaaggaaagcacgagcacaagaagaggaatcaccgtgacatcgaagtggctcgaggaaccttctgggcactaa

SEQ ID NO: 27124 - DNA, 750 bp, Glycine max
  Peptide Sequence Number=SeqID_143902
atggtctccccacatagtgcacttaacatgcctcctataacctttacgttggatgacttcaaggggattgaaccagtgcaagatgatcgcatggctattagcatagagatagtcaactgcataatcaagaagacctttgtcgaccaagggagcttagctgacattttgtttcagcatactttcaaacaaatggaaatacctgaatccaaaatcctatcacatgatgacccactgttcggttttgctggagaacaagtagggacaaacaggtgcatttggttgtacattaagttcgaacataaagggccattacaaaaaaggctaaagataacatatgtgataatgctctctcatacatcatataatatgttcctcggtcgtccctcactaaatgccttggacacaattttttcaatcccctaccttgatatgaaattttggtcggatagtggaaccatcataactgtgcatgtcaaccagaggatggctagagaatgttatatgaccagccttaggttacattctcatgcaaaggaggaagccccaaaatttttccattacatagaggccaagacaaaaatagaagaggtggaggagctagaactcaatttaagaactaatgatgacaactggatgaagccggtagaagagacatccaccttccaacttaatcttaaggaaggacaagtcgctcaactaagaaaccaactttttagtgacaaccgaagccgcatccaaagaactatctag

SEQ ID NO: 27125 - DNA, 402 bp, Glycine max
  Peptide Sequence Number=SeqID_143903
atggggtaccaaatgatggaaaaggtagccctcacacttgtcaatgctgctcatctccgtcaatattttcaaagccataggatcactattcaggctgattgtcccatagccaaaatattgcgcaagcttgagctgacagggcgggtgatggcatggtctattgaactcatagagtatgagattgttaacaagccaaaaagggatatccgagcccaggtgttggctaatttcttcctccacaaccacgtttggagcaggaatggtggacggtgcgtgtggatggctcctccaatcgacatggaagccgagtatgaggccttcttggcaagactaaggcatgccagagaagtcggcacccaaagagtcaggcgtcgaagtaattccaaggatgaagctgagtag

SEQ ID NO: 27126 - DNA, 312 bp, Glycine max
  Peptide Sequence Number=SeqID_143904
atggaaggctttaaggatggagttcatgcttgccgtggaagtggcccttatgggggtgtcttcagttgtggaggaacaaagaaagtcatagagtacttcagcttatgcgacaatgttggtgagtatgtatggtgggattcttttcacccaacagagaagatccatgaacaattgtctaaggcattatggaatggaccaccttcctcggtagggccatacaatttagaaaacttcttcaacaaagagatcaagctcactattgctgatgtagttgatgctccacaaattcagaatggagaatttcactactga

SEQ ID NO: 27127 - DNA, 498 bp, Glycine max
  Peptide Sequence Number=SeqID_143905
atgtggctaccttttatgagaaagcttgtgacattttcaattctgcatatatccctcttgctctctccaaatgggtcgacgctaagcctgaaaaacctaattgagaatgaatatggggaacagagtaagttgcaaggagctgctagtcaaaactatgtgaattggactgcaaaaatggctgtggaaatgggaactggggtctcttgggtgatgtgcaaggaagacgatgccccagatctagtgaatctcgtaggtgtgcttagattgactaaatccaacttccgagagccagtaaatattggaagcgatgagatggttagcatgaatgagatggctgagattattcttggctttgagaacaagaatattcctattcaccacattcctggccctgagggtgttcgaggtcgtaattcagacaatacactaataaaagaaaaacttggttgggctccaactatgaggttgaaggatgggttgagaatcacatacttctag

SEQ ID NO: 27128 - DNA, 177 bp, Glycine max
  Peptide Sequence Number=SeqID_143906
atgggtgtttgtgcgctattatatatgggttcatggaagaggttagtggcgcaacaatgtttgtgttcttggtggaggttagctgcacggttggattcgggcggcaatggcggtttgtggcacaacgatatgcattatatgatggtggcttgtggtcgtggtgcttgtttggactga

SEQ ID NO: 27129 - DNA, 495 bp, Glycine max
  Peptide Sequence Number=SeqID_143907
atggctcttatagctctatacttgaaagccaacaaaagtgattcttttgaagcagcttttgctcttgatctagcacacaataatgctttgaataatgttctcacaagcctcaagcatttccttgaaggattcatgcactccaactctaatttctatgattggcttcttgatagaatagataaccccacaaattatggttttaaagataaaattaatgcttgttgtggaagtggaccatttggaggcatcttcacttgtggtggaacaatgaaagttacaaagtacaacttatgtgacaatgttgaagagtatgtatggtgggattctatccacggaactgagaagatcaatgagcaattctctaaggcgttatggaatggaccaccttcctttgtagggccttacaatttaaaaaacttcttcaacaatgagatgatcaaactcactattgttgatgtaggttatgttcggcaagacatttcagttagcttctaa

SEQ ID NO: 27130 - DNA, 159 bp, Glycine max
  Peptide Sequence Number=SeqID_143908
atggttggagcattcttgcaaaacagagtgaccttgactgatcaccttatgattttacttagtgagagtgacctgacatacccattgtgtggtgagctagcatatgatgagtttcatgctggagatggaggcttatcctgtgacaggggaatgctttga

SEQ ID NO: 27131 - DNA, 360 bp, Glycine max
  Peptide Sequence Number=SeqID_143909
atggacccgaagaagtccaacagggccctggggtttccagctctggttgcgggcctctgtcagtcctacagggtgcccgttccccaagcgaggtcatgtcatcgtgacataggaatcgcacccgcaaagacacccagtggacccggagcagtccaacagggccctgggttctacggagtacctgtcacctccggcaagggcatcaggccccctactaatcgagctttcatcaagaagtacagcatccccaggcaggcgcagggcgaaacaccacagcagcctggggatggccagcagcgggcaacagacgcaccgccatcacctctagagttcacctcagctcatccacaaaaaggttag

SEQ ID NO: 27132 - DNA, 738 bp, Glycine max
  Peptide Sequence Number=SeqID_143910
atgggggaagggaaggagcaaaaactggaggatgcaccggacatactttcattctacttcacaaggagtgctcgtagatacgggtttgtgagattcaaacaggtggataatgcaaagaaactagatagacaactggataatctggttcttggaggattgaagctacacgtgaacctcccaaagcacggaaggaaacaaaatccgacagagacaatcaacaagaaacacaaagaaaaggaggagatagcaatagagaaggtggaagagagagacaaaggtaaaggaaaggggacagcagaacatatgacaatgactaaaggattacagcagcagaatccccaacgagcaacaggtttcagatcgtatgtgaatgtggttgcaacaggcagtaagcatctgacaaaacgatggacaccgaagtatgtgcaggcatcaaatatgaccgctcactcatctatccaactaacaatatcaatggataagacatggctaaccaaagcttgggtaggtagactgaggaacctaatggcatttgataggcttgaagaagaacttatgtgggacgaaggtgaagagattaaaccaaagtacattggcggcaacatggtgcttctcataggactcgctgacataagaacagaagagttgtgtagagaaggagttgaaagtggcttatctatgttccatactctggagaaatggagcccaagcttgaggcttggtttcaggttggtgtag

SEQ ID NO: 27133 - DNA, 133 bp, Glycine max
  Peptide Sequence Number=SeqID_143911
agcattggtgttcataaggttcggagatcctttcgctgcacacgatcggaaccaatgggttgtcgtatcttgggagaggagcgcaatcaaattttcttaccagagcagtggggcgttttctcttttgggatag

SEQ ID NO: 27134 - DNA, 686 bp, Glycine max
  Peptide Sequence Number=SeqID_143912
gatataattattgggactacatcgacgcctggaccaatgtgttctggcatcaaaatagtaaatttaagcattcatggctaatttacttcaagaataacactgtgtataattttccaaattggctcctccaatggtggaactacttcggactaattccgcagatatttccagaagaagtccaacagggattccaacaattcaccaagctcttcaatagcaaggaatcgagaattccggcagatttaaagtacttttccagttttgccttgtcatggattttttcatggcaatacagatatggaaaaaccgaaaacatcaaacaatatccaccattgcagagacatgcctttgtaaagtggtggtcacaatttgatacctcaaaggctgctccagaacaagtcaagaactggtttcaaagcaaccctgagtttctcaagcctactgatccagagacatcattgtttctaaatcaaaagtctcaacttgcagcattcttagcaagctcaaaatctaaagagagtcttgcccagaatcttaaggaagttctccagctacttcaacaggaagaagaagaagaaccccccaagaaggaagccgaatcatccgaaaaaaatgatgaccaagaagatgatccattctaccagaatgaggatgactgttttggtatatcgttagacgatgattag

SEQ ID NO: 27135 - DNA, 702 bp, Glycine max
  Peptide Sequence Number=SeqID_143913
atggtggtgctggagtgtatcgttcttacaatggcaatggctgtggatacgaacgtaattatctacgaaagaaccaaagaagaactatttgccggaaaaagtatcttggaggcctacaaagatggtttcaaacatgcattaaatgccattattgatggtcactcgacaacattcctaacggcagtggtgttattcttcttcggaacgggacctattaaaggatttgctttaacactaatgattggtattgcaatgactttatttacttctgtattgctttcaagagtaatgatcttcaacagattaaataaaggaaaacacctttctgtatggacagctccgacgaaaaatctgttcagaaatacgtggattgattttattgggaaaagaaaatatgcgtatatcatttctgctatattaactgttatctgcatcggatctattgcaactcaaggatttaagtatggaattgacttcactggtggtagaaactacgtagtaaggtttgataaagatgttaatgctgaagatatcgaacagaatctggtaaaaatgtttaaaacagaagatggtaagaactcttctgttgaggctaaaacctttggtaactctaaacaattgaaaatctctacagattaccttattgatgatgaatcgcttaaggctgaccagactgttgagcaaaaattatatgaaggataa

SEQ ID NO: 27136 - DNA, 291 bp, Glycine max
  Peptide Sequence Number=SeqID_143914
atgggggataagcttcatcgtcgagagggaaacagcccggatcaccagctaaggcccctaaatgaccgctcagtgataaaggaggtaggggtgcagagacaaccaggaggggagcgttccgccttagagggaaggacccgcgcgagcagtgctggacgaagcggaagcgagaatgtcggcttgagtaacgcaacgttggtgagaatccaatgcctcgaaaacccaagggttcctccgcaaggttcgtcacggagggtgagtcagggcctaagatcaggccgaagggcgtag

SEQ ID NO: 27137 - DNA, 522 bp, Glycine max
  Peptide Sequence Number=SeqID_143915
atgtctatttcaccgagtctctctccgagacagtgcccagatcgttacgcctttcgtgcgggtcggaacttacccgacaaggaatttcgctaccttaggaccgttatagttacggccgccgttcaccggggcttcggcgtcagcccccatacatggtcttacgactttgcggagacctgtgtttttggtaaacagtcgcccgggcctggtcactgcgaccccctttgtgaggaggcaccccttctcccgaagttacggggctattttgccgagttccttagagagagttgtctcgcgcctctaggtattctctacctacccacctgtgtcggtttcgggtacaggtacccatttgttgaaggtcgttcgagcttttcctgggagtatggcatggattacttcagcgctgtagcgcctggtactcgaactttggctcgaggcattttctctaccccttattaccctgaaaaagcaggggcaccttgcgtccttgaaccgataaccatctttcggctaacctag

SEQ ID NO: 27138 - DNA, 385 bp, Glycine max
  Peptide Sequence Number=SeqID_143916
atgagtaaaacggacaccctgcccgggattaccgccagcccggccctgatgcacagtgctgatgaagatattgctgaacgcctgatagaatttgtcagtgataaagaggcgttttctgataacacgtggcgacagttgctgagcgttatgcggatcggcagccgctgggcgactgaacatggccggcaatttttaccgatggatcctgccgatctgcgtgattacctgctgtggcttctggcatcgggacgcgcctcttctaacatcgcgactcatgcggcattaatttccatgttacaccgtaacgccggtctggtgccgcccaatgtttcgccgctggtgttccgcgcggtgaaaataatcaatcgcagcgcggtgatagccg

SEQ ID NO: 27139 - DNA, 216 bp, Glycine max
  Peptide Sequence Number=SeqID_143917
atgtggatgttggtctcgctggtgctgctggcggaatgcccagtcagcacctgtcttgttggtgctactggcgggttgcctagtcagcacctgtctcgctggtgctactggcgggttgcttgtatcgctcttggtgctggcggcacccagccacgtctcgccagagctagtggcggcatccatggagtcgctgatgcagctggcggcatcaaatga

SEQ ID NO: 27140 - DNA, 381 bp, Glycine max
  Peptide Sequence Number=SeqID_143918
gattttgcacaagtgcagaaaaatactaggcatttgctggttgtggaaagagcagtgcagaatgagttctggatgtttgctatgagaaaagctgtgattttggttggtgttttgggcagagttttctgcctttgccctgttttcttggctgtgatgcttgggaggattgatggggacccggtgttgagagaaacgaggatatgggctacgtgggagtacgtgagctcagttggaggtgggcaacaggggatgagtggtacctggagatatgtcgcgggggtcaggagaccttggggacgtcaggcgagctcctggcagtcaacagataaaaggaacaaagaccacaaagcaaggaggcttgtggtggctggccagctgtga

SEQ ID NO: 27141 - DNA, 312 bp, Glycine max
  Peptide Sequence Number=SeqID_143919
atgtctcctccacctctagaacctaacaatcactcacaaactcatctcaagctctcaggatggcttcctcttctcgctcagttctctgccagtggccttgttggtgcttgcacgcttagcgcaactctggatcgcttagcgcgcattagtgaattccaacttagcacgcgtcttcttgctcagcagatggactcaagcggtgcgcttagcgggatggtccctcactcaacgaacatgcataactcatcctttttccagattcttcctcgcgctcaaccaaaggggtggtgcgctcagggaatggctagctaa

SEQ ID NO: 27142 - DNA, 895 bp, Glycine max
  Peptide Sequence Number=SeqID_143920
cagcccgattacctcgctgagcaaggcagaagatatagccggcctgcgcatcatagtcggatccggcaccaatcaggaggccatcctgctggcctgggataaagagaatcaggctaagggactgaagcctttcacaccggtttataccaaagatgacgctgcgcagacgctggcgttacaggccgggcgcgccgacgcttacttcggccctaacgtgattggcgcgtggaaagcggcgctgaccaaaaagacccggctggtgggtagcgtggacggcggctggccgaaggcggcgcacatcgcggtgacggtgaagaaagacaacgggctggtgcagccaatcaacaccgcgctcaacggcgtgatcaaaaacggtgactacgacaaggtgctgaaccgctggggcggcatgagccagcaatttttccgcgaagtgtcaccggaagcgccggagctgcagccgattcttgacggtctgtttggtgaatatgcagcacgctacggcgatttcttcaggaagcacaatgaagttgagctgaccgagtggtatctgccgccgcgcgggctgttcatcgtgctggagcgcgacggtgagatcatcgccatgggcgcctataaaccgtgggatgctaccaccgccgaactgaagcgcatctggacgcggcgtgacctgcgccgtcagggactggcactgctgatcctgcaggagctggagcgccgggcgctgcgcgcaggctatcagcgcgtgtttctcaccaccggtttccgtcagccggaagcggtacagctgtatatcggccacggttatcagccgcagtttgagctgcgcgaagatatggagatttacggccagccgccgcacgatggccggctgcgttttctcaaagtgattgat

SEQ ID NO: 27143 - DNA, 660 bp, Glycine max
  Peptide Sequence Number=SeqID_143921
atggttaaagaattctatgccaacttatatagcccaaaagaccaaagccctaagcaagtgagggtaagaggacatttaatcaggattgatgctgacagcctgaataccttcttagagaccacaatagttttggaggagggtgagacactacctacctattatagatttacgaggatgaggattgatcctcaagagtttgctgcccgtctctacatccctggtagggatctcaccactcatgcacagacatggagtgtcctctcctacaacaacctgactcccacttcccacacctctgatcttaatatggacagagccaggctggtttatggcctagtcacaggcatggacatgaatatcggagccctaatctcaggtcatatttctaccattgcccagagtaattcctctaggctcggattcccagccttgatcactgctctatgtagagctagaggagttacctctgacactctgacctatgagagcctgagcccaaccattaacttgacctacattaacaaaaactgttggaatgtggatgatctgatagttaacttcagaggggctagaaaggtaagggctcgaccagcagatattccttcttcttccgcaccaccagctcctcccacttctgccactcctacactagctgcctag

SEQ ID NO: 27144 - DNA, 488 bp, Glycine max
  Peptide Sequence Number=SeqID_143922
gtcatccggaagaacctttcttccggaaaaactacttcttccgaaaactttccggaagaggtgttccgggaggttcttccggaagacctttggtttcttccggaatatttccgaaacagcttctttcagaagttccggaaaaacccttaacggatcttccgaaagtcgccgccataagccccctttccccattttttccggcgtcttctactctcgtcttctaccctaacattactatcctaaggttccattgctacaacaatgttggatattacaatcaaaggagagttagggagactaacctcgaagcctcattcgtggagaagaagaagcagcttggtgcttggctcacggagaagaagaagcagcttgacggagtagaggatgcaagaaccggaagaacgaaaatagcaataggaagtgcttctttgggaggaggaggcacttttcataattttttgttaaaaggtaaaatggcccattcataa

SEQ ID NO: 27145 - DNA, 318 bp, Glycine max
  Peptide Sequence Number=SeqID_143923
atgaagacgccgcaatcccacttcctctctctccctcctcccccagccataccccaaccataccctgcatcaacggagctttccaggaaggagcacaccaattcgactcagatgctcttggagaactcggtgtgcttcacggtagggttcatggcggcgaatctcgtgattctagaagccgcatttgaggagaaaacggagacgagtaggggaagcaatatttgcaccctcaacgcgctatcgacgtgtgaacagaacgtagcggtgaagatcgcggccgtagcagcgaacggaggggaggagagactgcgggcttag

SEQ ID NO: 27146 - DNA, 561 bp, Glycine max
  Peptide Sequence Number=SeqID_143924
attcagcgcgtgctgcactgggcgaaagagcacgtcacttctaccctgttcgtttgctgggcggtgcaggcggcgcttaacatcctgtatggcattcctaaacagacgcgacagaacaagctgtcaggcgtctatgagcatcagattcttcatccgcacgcgctgttgacgcgcggatttgatgacaacttcctggcgccgcattcacgttatgctgattttcccagccagctgattcgtgactacaccgatctcgagctgtttgccgaatcagaaagcaccggcgcctatctgatggcgagtaaagacaaacgcctggcgtttgtcaccggccatccggaatatgacgctctcacgctgtcgggtgagtaccatcgggactacgaggccggcctgcaccctgaggtgccgttcaactacttcccgcaggacaacccggaattgccgccacgcgccacctggcgtagccacggcaacctgctgttctccaactggctcaactactacgtctaccagattacgccattcgatctgcgccacatgaatccaacgctcgagtaa

SEQ ID NO: 27147 - DNA, 531 bp, Glycine max
  Peptide Sequence Number=SeqID_143925
atggaaagtagtatagttgatgctttggctgcttcaagaaaacgtagaagagatgaagaagaggaagaagaacttgaacaagcatttttcattattgttagtgttgtcactatgcttttgggtgcactgacttggtatcatgacaagtactttgttaaggaacctgctcgaaatttggaattagagttatgcactttagttcctatagctgaagctatgacaatgtttttgcatatccttgctcacaacctaaagtatagagttgtgaactttagttattgtagatccatggaaataataacacttgatgggatacatattccagtaacagttgctgcagaagatagacctagatatcgtaataaaaaaggtgatatctctacaaatgttttaggagtttgcggtccagatttaaagtttatatatgtgttgcctgggtgggaaggatcagcaggagattctggagtattgcgagatgttttgcatcgtcaaaactgtctttatattccaaatgataatattatgaaatga

SEQ ID NO: 27148 - DNA, 222 bp, Glycine max
  Peptide Sequence Number=SeqID_143926
atgatactagacctggcagattccacaagcaaccgtcaacacctacacaaattgacattctgccccccaggcaaacctctaagcattccaagatgtagaccagccagaaagaatgaggttgaaagcttcaacaaagaggatattatggagatgaggcgcaggtacttgaatcagaaaacaatgagaagaagcctaagtgatcttgaatttgaagaagtttag

SEQ ID NO: 27149 - DNA, 351 bp, Glycine max
  Peptide Sequence Number=SeqID_143927
atggcatttgctaaggctttaacaattatgagtgaaacttctgaaaggaaaattgatattttggaaaagatcaacctaagtcaggttgtagggtcatcctttaaagctacggtgtgggaagtagttggacaaaacaatgaggataacaacaaattgatggcttgtttagcatccttgaaaaacttgaaggaattggaggattgtcatgtaaacattattagaagcttagtaaatgattcagatgaagagattgagagtgttatgcaactttatattatgtttgaatatactaatttgttgaatccaaaacctcaaccacaaaggacatcaatattgaaggggcatgaatag

SEQ ID NO: 27150 - DNA, 432 bp, Glycine max
  Peptide Sequence Number=SeqID_143928
atggctgtgtgggctgagacaaaaggcccaggtgtttcactaggcgttcttgcaccaaattatggcggatcatctgattttagtgaagggatctctattttagggtctgcgtcttctgcttctcgttcctcatctacgatgagaagaaagaatcgagaagcacacttatggcctctggtgaactttgcgtcgcagttgaaacagaggcccctttctctccaactggccatctcctcaagggtgagccttcttaaaggtaagggtggtggtttggcgggtgaaggtaaaaggggtagtgttgggggtaagggtgagcttgaagggtctgaaccatcaaatctcggaacctcgagtttcatgtggggtggatgggttaaaggagtggttgatgtgggaatggctgatgaagaagagggtgatggaagttgttga

SEQ ID NO: 27151 - DNA, 824 bp, Glycine max
  Peptide Sequence Number=SeqID_143929
atgcagaaggggcatatttggctaccaaaaaggctcccggccattcaaatcatcctcgcggaatttcatttcacacctaccggagggcatataggagttgcaaagactttggctcgtgagctatttaaactcagtggaacgaagttgcacatgagtttcgcgtaccaccctcagtctgatggtcagaccaagtggtcttacaatacatccactcacacgactacagggatgtctccatatgaagttatgttcggcaagaaacctcctagcatccctcaatatttgaccggaatgacgaacgttgaagttgttgacgattggttgagtcaacgggatgtcatactcactagagaatggctgctagtgaaattaagacctcgtcgacaaacttcagtaacggagggtctttactccaagttagccaagagattctatgggccattccaagttacgaagaagatagggccagtcgcttaccaacttaacctgccggcaacttcgcgcatccatccaatattccactattctttactcaaaccatatctcccacccactaatctggttgatgttccaattttactgcaaaactctgctgaagacaatcagcccattataacaccactcactatactcgatactaaatgggagaacattgacaatggaaggcaattactcgtgcttgtgcaatggaaggggctgtttctagaagacacttcgtgggaaaagtgtgaggaccttaaactagaatacaaccttgaggacaaggttgttttggaagcccatagggatgttatgactaatagcattgagcaacaagacacata

SEQ ID NO: 27152 - DNA, 366 bp, Glycine max
  Peptide Sequence Number=SeqID_143930
atggacccttcaaatcttaagattcccatgccaagctgtggtcaaaagcctgttccttccaaggcgtgttgtgttattgctgagtttcttcctggtggaacattgaaacaatatttgtttaaaaataggcagaacaaacttccatataaggttttgattcagctggctttggacctctctagaggtcttagttatctacattcaaagaaaattgttcaccgcgatgtaaaaactgacaatatgttgtcagatgccaatcaaaatgtgaaaatggctgattttgatgttgctcgtgttgaagctataaatcaaagtgagatgacaggtgaaactggaacctatgaattatggcaccggaggttttaa

SEQ ID NO: 27153 - DNA, 219 bp, Glycine max
  Peptide Sequence Number=SeqID_143931
atgggtgttactaaaagcaaatcaacatacacacattctgcatacactgccaccttagtgaaatcaagtggggcagcagaggatgattttatctcctacataggcaagtggcgtgatgctggggcttccctgtttggtggctgcagcaagactactcctaatactatgagaggcacagctgaggcaacatatgggaaacttaaagacaaatgtatataa

SEQ ID NO: 27154 - DNA, 634 bp, Glycine max
  Peptide Sequence Number=SeqID_143932
gtgacccgctagttttggaggaaggccaacactgtgagtttggccagaggaggaacagggccgacgggttcgacgaggaggccattgcccagctattatgcacaccggggcaggatttcacgcggaccactgcagggaggcgggtgcggatcatgcgcaccagcatgaccactttgacccagatgtggatgacactgctgctcagcaatgtcttgcctagcgatcataactccgatctccctttgcctgagtgccagttggtgtacgccattctgacacggatgagcgtccacgtggcccaggtgattgctgacgccatctatttgtttgcaggtatgccacccaccaggcaccctctggacccggataagtctagcagggccctggggtttccggcgttgatcacgggcctctaccagtcattcggggttcctgtcacccccagtaaggtgatccggtcgccgatcactcgggccttcatcgagaagtactgcacgcctaggcaggcgcagggtgatgcacatcaggccacagacgcaccgccaccacctcggcaggccgaccccgctggatcactaggcatggagcattatctacagcacttggttcgccaacaggcggccaaccaccgtgg

SEQ ID NO: 27155 - DNA, 438 bp, Glycine max
  Peptide Sequence Number=SeqID_143933
atgggtgtccaaggtggaaagcaaggaggcataggcgcggttctccttgacgaattggaggtcatcgtcggaaacttcaacttcgtcgtcaggaatctccggcggaagctccggtggaagaacgattttatccttcttcttccccatcgatcagcttggtggttggatgagaatatgagaccaaaacaggtcgatccgatagcccgatacgacttttcgggtcgggtcgggaatgctgatcgattcgtgcatctgtgggtcgaaagtgaaaatcgaaggagtgacgtggcaaccgcaaagatgaacaaaggtgctaccatcaccaatgacaagacgacaactgacgtgaagacaatttcgccaatgaaaggagtgagacagaaactaactggtcatgagcagcatgagatatctcgcgattcacgcaaaaaagagtaa

SEQ ID NO: 27156 - DNA, 542 bp, Glycine max
  Peptide Sequence Number=SeqID_143934
ctacaaagacagtatcagaaaatgatccaagtgaagagggaactggagaggatgtcaataaagacaaaggtatggtcaagctaactaaggctgaaaagagagccaagcttaagaaaatgagaaaagaggcgaaacaacaagggaaagaggtggctaaagcagaagtggaagagacaccacaagcagcagtgctggctgaggtaaaggaagatcttacagttgaggaggcatttgaaagtaagaagcataaacttgcagaattggggaatgccttgcttacagatccagagtccaatattaaatttctgaaggagatggtgcagatatctaaagataatgatgataccattgttaaacttggacttctttccctcttggctgttttcaaagatattgtccctggctatcggatcaggcttcctactgaaaaggaactagaaatgaaggtttcaaagactgttagaaagatgcgttattatgagtcaactcttctctctgcatacaaggttcatattaatgctcaagtgttacgcttactataa

SEQ ID NO: 27157 - DNA, 756 bp, Glycine max
  Peptide Sequence Number=SeqID_143935
atggctaaaaggatagaagatgaacagaaatttaaaaacaacaaaagtaagaaaaggaaaaacttggaggcatcaaatcagttagagaatgagagaaagaaaagtagaaaagaaatgatctccaagacaagagaggaggttgaagctgattacaaggctgcatccttagccccggatgttatggagaagaaacatatgcaaactgaaacactctctgctgtctttgagacatactttcgcattttgaagcatactatgcagtccataagggccaggcctgaagcaaacactggggcattatcttctgcagtggaactcctccctttgcttgctccatgtctgaaaggactggcaaaattttcacatctgattgaccttgatttcatgggtgatctaatgaaccatctgagagtacttgcttctggaagtagcaactcaggcaacacttctgacaagtgttctaaatgtttgaccgtatcggaacgtctccagtgttgcattgttgcttttaaagtgatgaggaacaatcttgatgccttgaatgttgatttacaggacttctttctccatctttacaatcttgtacttgaatacaggccaggaagagatcaaggagaggtgttagcagaagctttgaagataatgttgtgtgatgataagcaacacgacatgcagaagactgctgcatttataaaacgattagcaacgctttcactgtgtgttggatcagcagattccatggctggtatgttttaa

SEQ ID NO: 27158 - DNA, 387 bp, Glycine max
  Peptide Sequence Number=SeqID_143936
atggatactggattaggttaccgcacaaagcaaaggatcactcagttttttgatcaagaatacaaaaggataccaaggaagggggcaaaatggtctttttatttttctagaccccagctcgctcggctagtatctggctcacctaggccatggaattacctcctggctaagcaatcagctcacctgggcgagttcattagttcagggctaaggcatgatggggggagttttaaggggttagaaggtacaacattgaagggagttgagagaattgagagaaaagaagaagaaagaagaggaaacgaagtcaagacgctaccgaatcgcgatcgtgatcaatccctacgtcgtttcttgttctgtgttcttcgtgcggcagtcagttag

SEQ ID NO: 27159 - DNA, 294 bp, Glycine max
  Peptide Sequence Number=SeqID_143937
atgaagaaaggagaagattcctccttagcccgaaaatgcaatgaatgcgatcaacctgagtacttgagatttgattgtcctgtccttaaaagaagaatggaaaaatccgacaagagaaatttcaaagaaaagaaagaaaagaaagcatacatcacttgggaagataatgacttggattcttcaagtgattcagaaaatgaaatcataaatctgggtctcatggcgaatgactatgaaagcggagaagagttggaaggtggaagttggaagttgaaattggaagttggaagttga

SEQ ID NO: 27160 - DNA, 189 bp, Glycine max
  Peptide Sequence Number=SeqID_143938
atgggtctctgggattccttcctcaattggctccgcagcttgttttttaaacaggagatggaactttctcttgtttgccttcaaaatgctggcaagacttctcttgtcaatgcaattgctactgggggctacagtgaggacatgattccaactgtgtgtatctatctttgctttttgattgcatcttga

SEQ ID NO: 27161 - DNA, 240 bp, Glycine max
  Peptide Sequence Number=SeqID_143939
atggttggacaccaaatactggcctggcaactatgcttaactactgtgacagagttgtgcatgacagcaaaaaatgaggacaattcttcagagtggcgatctaaaatagggaagttgctggaggatggttataatggtggaaccatagtgatgcctaccgtccccagaaaagttgcagaatacatgtgttctcaaagccctgacagtaacataagctgtagtagtcccatgtctgattag

SEQ ID NO: 27162 - DNA, 327 bp, Glycine max
  Peptide Sequence Number=SeqID_143940
atgagaacatcacaaattctgttggttttgctttggttcttctgcgtttatgccccttcttcgtttggagcaaatgtcacgtatgaccacagagcattggccattgatggcaagcgccgagtcttgatgtggccagacctcattcagaaatccaaagatggaggacttgatgtgattgagacttatgttttctggaacttacgcgaaccagttcgaggccagtataattttgaaggtagatgcgatttgatcaaatttgtgaaggtagtagcagcagcaggtccatatgtgcatctccagatcggtccatacgcatgtgctgaatga

SEQ ID NO: 27163 - DNA, 882 bp, Glycine max
  Peptide Sequence Number=SeqID_143941
atgttgaagaagcaatctctcttgtccttctcactagcactgctagtttcctttatgtattgcaccaccactttagcccaattatcaccagcttctgcccctctcaaaccaacccaacctacacctaccccaccggctgcagctcctcaacaaccattggttccttcattgccacagtcaccaagtgattccactcctgacagtactccagctgttgacattgttggaatcctgaggaaggcaaagtcattcaacatcctaatccgcctcatgaaaactacccaattgatcaaccaactcaatgcacagctcctcactactaaatccggaggcatcaccattcttgccccagatgacagttccttctctgaactcaaagcaggcttcctcaactctgtttctgatggccaaaagctcgagctcttacaattccacgttatttcagactatgtctctagctccaactttgatactctgaccaaccctgtgagaacgctagcaggagctaaacctggaaaggtggaactgaatgtgataagttacggagggagtgtgaacatctcgacgggtgaggttaacaccaccattactggcattatatatacggataaacatcttgctatttataaggtgggtaaggtgcttcttcctatggacttctttgctgtgtctaaggcacctgcaaaggcaccctctttggcaccagaaccatccgcaaaggctcctaaagcggataaggagaagtcactgtctccagattcctcagaatcatctgagattaattccacaaacgagaattctggcactgtgaatatcaatgtgcatgcaaagtgggtgccccttgttcttggactggttctcatgactgtattcttatcataa

SEQ ID NO: 27164 - DNA, 234 bp, Glycine max
  Peptide Sequence Number=SeqID_143942
atgtcaacagcagcagtggtgactgtggcaatgagggaaccaatggttgttgaggagcctcagctgtggacacttgatgcattgaagatatggtggagatggtgtttatatagcaagtctgggaatccttacctatcacggaaaggtggtatcaataatgattggtggggggaagaggcagaaccaaagtattggcaggttatcttcccacatccagtggaagcatgtatctag

SEQ ID NO: 27165 - DNA, 1716 bp, Glycine max
  Peptide Sequence Number=SeqID_143943
atggtgaggaagttctttaatatcaaaagcaagactgaggattcccaagcaaatggtgttgcttatggaggaggtgacatggaatatagaggtaggaatagcttctctgagagagaaccatgcacaatcaaaaagagcaaaacagaaaagtttagcaggagcacagatcaggtgaggcgagcaaaaatgaatcttgaccatcctcgaattatagatgtgcagaattatagcatttttgtggctacatggaatgtagctggaagatccccacctagtactttgaatttagatgattggcttcattcttcatcaccggctgatatttatgttcttggatttcaagagatagttcccttgaatgctggtaatatcttgggagcagaagacaatggccctgccaaaaaatggttggctctcatcagaaaggctttaaacaatcttcctggcaccagtggaagtagtggatgctatacaccatctcccatacctcatccactcgtagagctgaatgcagattttgagggatcagctaggcagaagaactcatctttcttccataggcgatcgttccagacaacttctagtggttggggaatggacaatgatccttcagttgtgcagccacggcttgatcgaagatacagtgtctgtgatagagtaatttttggtcacaggccaagtgactttgatcccagttttagatggggttataggcctagtgactattccagggcaagtgactactcaagaccaagtgactactcaagatggggttcatctgatgatgataatggccttggggattcaccaagtacagtcttattttcaccaatgtcttgtggtggtggtggtggtgctggacccgcctttaatgaagatggatatgccatgccaggacactcaaggtactgccttgttgcaagtaagcaaatggtggggatatatcttaccatatgggtgagaagtgaactcaaggatcatgttcaaaatatgaaagtgtcttgtgttggcagaggattgatgggctatcttggaaataagggatccatctcaattagtatgtctgtgcacgaaactagcttttgctttatctgtagccatttaacctcaggacagaaagaaggtgatgaactaagaagaaattctgatgtgatggagattcttaagaagacaaggtttcctcgtgttcaaggtgtggacaatgagaagtctccacagacaatccttgagcatgatcgaatcatatggcttggagatttgaattaccggattgcactctcctaccgatctgctaaggcactcgttgagatgcaaaactggagagcattgttagagaatgatcaattgagaatagagcagaaaagaggccgtgcgtttgtgggatggaatgaagggaagatatattttcctccaacatacaagtattcaactaattcagatagatatgctggagatgatatgcaccccaaagaaaaaaggagaactcctgcttggtgtgaccgaattttgtggtatggagaaggtctccatcagttatcatatgtccgcggagaatcgaagttttcagaccacagacctgtttatggcatattttgggctgaggttgagtcagctcatggcagattgaagaaaactatgagttgttctcgttccagaattgaggtggaggaacttctgccatattctggtggatacactgagctgagctttttctga

SEQ ID NO: 27166 - DNA, 1230 bp, Glycine max
  Peptide Sequence Number=SeqID_143944
atgttctcttccacatatgactccaactttttccctaacttccctttgtctacttacccaatccttccttttctcattgaatctgaaaatgattttgcaagccacactcttctggttgaggaccctcttgttgttcccctcacacatgatcctcctccattccctgaagaaaccgttgccaattttgcagttgctgatcatcactgcactgccatgcttgataatcaacacgatgcagcagcaaacactaactatggttcccactatggtagcagcatttccaatttcctcacccatcagaaacctgcagcagccacagccaaaaaagacaggcacagtaagattcacacatctcagggtttgagggaccggagggtgagattatcaagcgaaatagcccggaagttctttgatcttcaggacatgttagagtttgacaaaccaagtaacacccttgagtggctcttcacaaagtctgagaatgcaatcaaagaactagcccgaagtaagcatagcggtagtgttagtactgggggtgacaagtcttcacgcgacccttctggggattcaaataacaacttcaacaacaacaaatcaatggtgggtggtggtgttggtgatggttctaaagggaggaagctgaaatgggcacagaggggtgatgcttgtattcagaacaaaaaagagtcaagggaaagggcaagggcaagggcaagagaaaggacttgtttcaagaagtgtagcagtataagggtgcagcagcagaaagactttgatgaaaggtgccctgcaacaacaaacactactcaaatgctgcaccaattgtggtcttccattcagcctgaacctgaagaacctcgtgcaagatgggttcagccttattataacccttatttcgttgatgataatgaagctccaagagatcatggctttaacgtcattgaagaatctattatgataaaaaggaacatgaagccgttatctcaaccaaaccttgtgatccctagggaagcaagtttcaacaacaatgagttccccctattaccctattccactactccaaactgggagagtactaatggggccgttaactattgtggaataagcaccatgaatctatctacgtgtttcatgaacccgtgccaatggcatgtgaaagttctcataaagtcttcaatggtgaaaagcactgatgtacttttggtgcaaggtttacaaggatcaggataa

SEQ ID NO: 27167 - DNA, 634 bp, Glycine max
  Peptide Sequence Number=SeqID_143945
gaaatggccacgagaaagctcgccacaaagagatccaggaaggacaccattggagaaggctctagcgctgcccagccagcaaacacggattacgacagccgccgattctagagcgccgagcattagcagcgcttcgagaccatcaagggatggtcattactcagagagaggaatgatgagttccctgacccccatggctaaattcgatccggagatagtcatggaattctatgccaatgcctggcctaccgaggagggagctcgggatatgcgctcatgggtgcggggccaatggatccccttcgatgcagatgccctcagccaattcttaggccgcccgctgatcttggaggaaggtcagcattgtgaatacaaacaaaggaggagccaggtttccggctttaacgaggatgccatcgctcagcttttgtgcataccggggcaagatttcgcctggaccgctgcagggagacgggtgcagatcatgcgcagtagcatgaccaccctgacccagatatggatgatgttgctactcaataacatcctgcccagtgaccacaactccgatctccctctaccaaagtgtcagttggtgtatgccatcctggcacagatgagtattcacgtggcttag

SEQ ID NO: 27168 - DNA, 228 bp, Glycine max
  Peptide Sequence Number=SeqID_143946
atggtgggagctaagtcattagttggaaacccatatgttgatcgtctggctaaggaagagaagattactattggtgatatgacaaagtcaatggtgaaaccaagaaatattcttctaacattgaaggagcataatgccaacaattatagaacaatgaagcaagtatacaatgcaagatatggatatcgttcttccataagaggcaataatacgaaatacaacaactaa

SEQ ID NO: 27169 - DNA, 348 bp, Glycine max
  Peptide Sequence Number=SeqID_143947
atggtcattcctccgaagttcaaggtatcggacttcgataaatacaaggggactacctgccccaagaatcacctaaaggtgtactgcaggaaaatgagagcatatgcaaaagatgaaaaattgttgatgcatttcttccaagaaattcttactggggcaatcatcacctggatgcaactacagaacatgtgcaaaaaggagcacgaatctttcaaaggatacgcccaaaggtggagggatatggtagctcaagtagtgcccccaatgacagagaaagagatgataagaatgatagtagacatcttaccagtgttctactatgaaaagatggtgagttacaaaccttaa

SEQ ID NO: 27170 - DNA, 435 bp, Glycine max
  Peptide Sequence Number=SeqID_143948
atggaaactatatccaagcgatttgaagagcttgatgtttgtgataaagttactttaaagagtaaactccgggaaattgtttatcctaagctaaactctatgtgtcctcctccagaaaaggtcaagaccaaagtcaaacgtagtgcatcatcatctgaccagacaattctaagaaagactatgccgatgttggatcaatttcatctgtgcattcatgattcaattaaaaatattgtcgatgtcaaagctaatagtaacggtggatatcatgcaattgttgtcttattaagtatgagtgaagattcatgggcgttggtgtgcaatcatttgcttaaagaacttgccaaatggtctgataagtatatcaacctctttggtggcatagataaatttgaggaattaaagaggtccctacttgttgatagattatccata

SEQ ID NO: 27171 - DNA, 375 bp, Glycine max
  Peptide Sequence Number=SeqID_143949
atgccccgtggtcacggtagctccaatggtgttaaccatgctccacgtctggctcctattcaaggtggcgattgtggatctctatttaggatcgtagctgaaggaataacttttggtattggaagtgcagtggcacataggattgtggatttggtattcgatcctcgaagtattcaacatgaaacaatagttaatgggcctgttgttgttgtcactacacctatgactaatagtctaagcggtgatacatgcaatgctcccacaaaggctttccaagattcttttaggcctattttgatgattttagcttctaccataggtggtcaagccttggttattattggttcacaaagtgtttgtgaaaagtcctcatag

SEQ ID NO: 27172 - DNA, 423 bp, Glycine max
  Peptide Sequence Number=SeqID_143950
atgagtgagaatgttgggaaatatctggccaacatcaatggagaatttctcgagtatgatcccaacaacaactctgggggctggagatcgtacatgagggtgggagtaataggggatgttcatgttcctctgaaaaaggtcaagaaggtgaagaagccaagtagggattggaagggaacaagtggcttagggatgacaacgacaaaaaggttggcttcaatgaatgtggtaacagaaacagtggagtttgatgagaatcccaaagctgtccaaatacagggacctaggactaggggtaggacaaaacagtcagaggatacccttcaacaaatggtagcagtcctacttgacaaggctcaagtggagaaggacgaaggcccagaagcactcccaagaatcttggttgttgaaggtccaaactaa

SEQ ID NO: 27173 - DNA, 276 bp, Glycine max
  Peptide Sequence Number=SeqID_143951
atggcgagtttagtggaggataagatgaagagtttggcaatggtggaggaggaggaagatgggtttgttttctgtactcaagccatgaaagctcatatggcagcgatttggaagccatgggaaggtgtgacgatcaaggatgtagaaagggtcaacttcctatttcaatttttccccaagttggacatgcaaagtatcaccaatggagtaccttggtatttcgataatcaactattgattctagataaacttaaacctaatgatgttcctgatcaa

SEQ ID NO: 27174 - DNA, 264 bp, Glycine max
  Peptide Sequence Number=SeqID_143952
atgggagcaaagaggtcttctacttgctcctttgggagtgtgttcaaggcatgtttctcaagcgggggtagctatgatgagtactgggaaggaagtggcagtgggagaaggatgtttgcaagtgatgaagacagagggcgttgggttgctgagcctggcattgacagaaaagcctctgatttcattgctagatactacgcctcacgaaccaccggttgtgttcttggttggttcctaccggctgtactcatttggttgtattga

SEQ ID NO: 27175 - DNA, 234 bp, Glycine max
  Peptide Sequence Number=SeqID_143953
atgggaacaaatcacactggaaaaagattctatcaagtcaagattaagggcctagatgtcaccagccttaaggagttggggcggttgatgggacctctccagatgcaagccttccgcaaggcgtacggaaagattttagatttgaccatagcagagatatccacggaagtcgttgtatcactcacccaatactatgaccagcctttgagatgcttcacgtttggagacttctaa

SEQ ID NO: 27176 - DNA, 156 bp, Glycine max
  Peptide Sequence Number=SeqID_143954
atggccctctacgggttggcgctcgcttattcgaacccactcaaggatactaggctgccttgcagcggcgttttccgcttgcccagagctgggaagggacgacaatctgtcggtcgtaaccctagcctctatttgcatccattcctaagtatctaa

SEQ ID NO: 27177 - DNA, 285 bp, Glycine max
  Peptide Sequence Number=SeqID_143955
atggagctacatcaccggggcaagactttgcgaatcaagcgcactagcatgaccaccctgacacagatttggatgacattgttgctcagcaacatcctccccagcacagcagtagggtcaggcacagtagcagtaagaggaggaccagcaacagccagccgcagatgcgccgccaccacctctacggcagccaccatccctggagtctatctccgctcacctgtagaggatggaactccagatacacgcgtatatgcagcatgtgactggccagcaggcggctaa

SEQ ID NO: 27178 - DNA, 730 bp, Glycine max
  Peptide Sequence Number=SeqID_143956
tgcatcaagcggacagggctgtttggagtccaatcgagtccagggcttgccactaccggaccaatgcaaaagactcacaggcccagcgtgcaggtcccggcaactccccttcacgttatcgccacccaacccatgctggttccacctgtgctcaattggcgccacgtgtcccgcgaacaccaacagaaacgggggcagagaacccagctcgtagatccgatcgttcttctgaatctccatccacctctctatcctcttgctgtacccgattctccgccaccgcaccagatctatcaccatcacgcccgtgttgaagtagcatggcctccgcccggcgaacgccctcgcgaagcgcgtgtccgaccagaacgctgcggtgaagtacttggtgaagttggcgtggcagtattcaggggcgccgatgggttcgaggaggtcagcgagataatttctggcgtagttgaggggttgttcgagggcttgtctgacagaggtggagatcaggttgcggacgatctcgggatcaaagtaatagaccttgaagttcaattgagggaaggtggatttgacgagggattcgaggttggtttcggagacgaggaagtggaagaagatgttctccgggcactgggagtgttggaggatggagtggacggcggcgatggagccgcggaggtactcgacgtcgagggtgatggcgacgtggacgagggaggggtcgcagacggag

SEQ ID NO: 27179 - DNA, 108 bp, Glycine max
  Peptide Sequence Number=SeqID_143957
atgggtctagttccgtgtttccttccaaggaaacaggtgcaagggacaggcactaggttcatgaggcataaaaaggagcaagatgataataagtcagcaactgaataa

SEQ ID NO: 27180 - DNA, 393 bp, Glycine max
  Peptide Sequence Number=SeqID_143958
atgaagggacgcaagactggtgaatctatcactggttcatactatgtgcaagaggatctccgggaaacttacagagaatggagcgcctatggtgtagatgtggtagttagcccaaatggagagggggacataaaaatgtactacgtcccttttctctctgcaattcagctatatgttgtgaggaataagcttgtactagatgaagaagaagaagaagaagatgaacatgatggtggtgaagaacttgcagctgccaatgctctaatgactttaatattacctgggactgggaattttctcaataccccaaaccctgttgaacctcaagttcacactcttcaacttcgcaatgacacaaatcctgaatttgccaccaataggtctctgttctga

SEQ ID NO: 27181 - DNA, 249 bp, Glycine max
  Peptide Sequence Number=SeqID_143959
atgggcttaggaacaaaggtcaagattgaaattgatgcattggcaggaaagacctttgaaggtgaggtagccgctatatccgaagctaccggctccaaatattctgctgtaccagtggacaactccacgggaaactttgtcaaagtacaacagcgaatcccggtcagaattaattttacggcatccaatacgcctaaagacctcgccatgcttcgcgtcggtatgaatgccatcattcgtgttcaataa

SEQ ID NO: 27182 - DNA, 438 bp, Glycine max
  Peptide Sequence Number=SeqID_143960
atgtggggtgctaataccttccgcgtgcgtaaatacaactaccgaacctttcacttaaaagttcgtagatcgcgtcttttctggtttttccgacgttttcctcaaataaacgttggtggcgactccgcgccggccaacaagcccgttcacacgcagagatttacgtcgtcttccgtgcagacaacctctgcagtactaactcgtgaagttaggggccagcggaaatacccaagtggttatccgtataaacattcttttgctatctctaagactcaacgcatgataccatgtagagacaaacgtcattttctgcaccctttttcaatcgcggtcaacaagtccgttgacatgtggagatttacgtcgtcttccgcgcagacaacctctgcggtacaaactcgcgaagttagcgggccggcggaaatacccaagtggtga

SEQ ID NO: 27183 - DNA, 273 bp, Glycine max
  Peptide Sequence Number=SeqID_143961
atgtcggctattgtgttttcaattcaatccgtgaacgaagtttgcatgatgtcggttaggaaatgttcgatcggcgctgatgaggacatgaccaagagcaagggcaaggatccacttgaaggacttggaggacctatgacaagggctagagcaaggaaagccaaggaagctcttcaacaagtgctgtccatactgtttgaatacaagcccaagtttcaaggagaaaagtccaaggttgtgagttgtatcatggcccaaatggaggaggactaa

SEQ ID NO: 27184 - DNA, 297 bp, Glycine max
  Peptide Sequence Number=SeqID_143962
atgaagaacgaacgaagaacgatgaagaacagtgaaaaatcttcgcgaaatcacccacgaaaacatctcggaagcgttacggaagcgcctcggcttagattttcttcacggaaacaatttttctcactaattttaagtgattctcagataccaggaggaggaaaagagggaggtggttgccgcccagctcgcccgagcgagctgggttgcttccaccagaaggcatcgccttctgttggaagatcctgggagagccaagtggggtctggttgctatttgtacacccctgtttactaa

SEQ ID NO: 27185 - DNA, 567 bp, Glycine max
  Peptide Sequence Number=SeqID_143963
gctaagcgcgagtctgccgcgatggcatctaagaaaaggaaggctccttctacaccttcccaagtcagatatgatcagtctaggttcacatctcaagaagcttgggagagatatactgatataattgtgcctaggaaactattaccagagagaaatgtagtagtatattacactgagtttgatgagttcaaggaggaactcaagagaagacactgggatgaggagttgactgattttgctgactgcagcatagatgttgccattgtgaaggaattttatgcgaacctctatgaccccgaggataaatcacctaagggattcgagctaaacgctgatggtcagcctttgaagatattaaggaagaacataaccaatttagctcagacatggagcattctttccttctctaacttgattcctacctcccacacatttgatgtcacattagatagagccaagttaatttatggcatcattatgaagatgcatatgaatgtgggctctatgcaaggccagaggaatccaatcagattcaagatccctgaagagcctgagccttgccattaa

SEQ ID NO: 27186 - DNA, 961 bp, Glycine max
  Peptide Sequence Number=SeqID_143964
aggactatacgtcctcgccttcggaaacctacacgtcctcaccttcagagggcaacatgccctaagctttagagggctacacgccctcaccgtcagaggactacacgtcctcgccatcagagggttgcacgccctcgcaatcagaggactacacgtccaccccatcaaagggctgcacgcccccaccttcagaggactacacgtcgtcacctttagagggctgcacgccctcacctttagaggactacacgtcctcgccttcagaaggctacacgtcctcaccttcagaggactacacgtcctcgccatcaaagggctccacgtcatcgccatcacaggactacacgtcctccccatcagagggctgcaccccctaacctttagaggactacacatcctcgccttcagaggacagcacgacctaaccttcggaggactacaagtcctcaccttcaaagggcttcacgtcctcgctattagaaggttgcacgcccacgccatcagaggactacacgtcctcgccatcaaagggctgcacgccttcagcatcagaggactacacatcctcgccatcagaggactacacgccctcgccatcagagggctacacgccctcgcctttagaggactacacgtcatggccttcagagggctgcatgccctcgccattagaggactgcacgtcctcgccatcaaagatctgcaagccctcaccttcagagggctgcacgccctaaccttcagaggactacacgtcctaacctttagaggactacacgtgctcggcatcacagggctgcacgtcctccccaacacaagcttttcatgccctcgccatcagaggactacacgtcctcgccatcaaaggggtgcacgccttcaccgtcagagggctacacatcctcgccatcagaggactacacgtcctcgccatcagagggctgcacaccttcacctatag

SEQ ID NO: 27187 - DNA, 279 bp, Glycine max
  Peptide Sequence Number=SeqID_143965
atggtgcagcccaaaccaagtgctggccttaaggggaaacctcaccaacatgctctcactttcatgctttcttgtgtttcaacaaacaaaggcttgggcccccttggcctaagtcatgttttggcatttatcctaatcctcgcaagctgtccgcatccaaaaatggcaaaaataccgttgaggcatttcaccgagcacttggtgggcacacttttgggtaccaaaaacaagggaatgggggcaatgtggcttgtcccatcatttcagaacacaacctag

SEQ ID NO: 27188 - DNA, 375 bp, Glycine max
  Peptide Sequence Number=SeqID_143966
atggaaaaattcaatcatatagaggaaaggctgagggccattgaaggaggcggagatcatgcttttgctgacatgacagagttgtgcctaatgcctgacatcgtcatccctccgaagttcaaggtgccggacttcaataagtacaaggggactacttgccccaagaatcacctgaaggtgtactgcaggaaaatgagagcatatgcgaaagatgaaaaattattgatgcatttcttccaagaaagtcttactcgggcagccatcacctggtatactaatttggaaccttctcgagtccattcttggaaggacctaatggttgccttcattaggcagtatcagtacaattctgatatggctccggatagaatgtag

SEQ ID NO: 27189 - DNA, 384 bp, Glycine max
  Peptide Sequence Number=SeqID_143967
atgagtgaaatagaggaggtgcaagagcagatgaaggtcaatgcggctatagttgtttccgcaagtaccaccacagaagtggacccgactcacccatctggccttaatcaagtaaatcctccagtcttagatatagtagggcagcgaggtgaagtgttaggaagtacgagcgacccatattttgtgcaggttcagaacaagcattccttcccaccatatggcttgcctcctaactatattccgcccaatgttgcaaacactcccaatgagaatgtcaacaactctgcacccatacccattgagagccaacaaccccaatctgatcatgcacatgtctctcaacctatggggggacacatgaagcgcctcgagagtgcactctag

SEQ ID NO: 27190 - DNA, 206 bp, Glycine max
  Peptide Sequence Number=SeqID_143968
actcttccaatggcctatggcatgccttaaattttggggaggatgtgattgtgggtgttattgatattggtgtgtggctagagagtgaaggcttcaaagatcatcgaatgaccaacaaaattctaaacaaatggaaagggagctatgaggaagtacaggacttcaacactcatgtaggctgctcctgctgcagccatgatgagtaa

SEQ ID NO: 27191 - DNA, 207 bp, Glycine max
  Peptide Sequence Number=SeqID_143969
atgatattgcacgagattagaaggcctaactctctaaaagcagtccccagtagagtcgccaactatcgcaacctacccttccacgcgagggcaatgcggggctcgtgggtgcgtcttccaaggaaggaaaatgcacggagtcaccaccaacgtttattcgaggaaaacgtcgaaaaaaccggaaaaagtgtggtctatgaactttaa

SEQ ID NO: 27192 - DNA, 189 bp, Glycine max
  Peptide Sequence Number=SeqID_143970
atggatgaactgaaggatttgatcaaacaagttacacctcctgggattcccctttatggtattgatgaaacacaaatggtgttgattgagtctaactactggaagaagattgggccaatagaaattttagttgttttcagcaaacttataccgaaaatggaagacgagttgtccttgtcgcaaaattag

SEQ ID NO: 27193 - DNA, 944 bp, Glycine max
  Peptide Sequence Number=SeqID_143971
gatagaccctggggtactagtacccacacaatcagagggctacacgccctcaccttcacaggcctacacgtcctcgccttcggaggactacacgtcctcgcctttagagggctacacgccctcgccttcagaggactacacgtcctcgccttcaaaggactacgcgtcctagccttcagagggctacacgccttcaccttcagaggactacacgtcctcgcctatagagggctgcacgccctcgctttcagaggactacatgtcctcgccttccgaggactccacgtcctcgcctttagaggactacacgtccttgccttcaaaatgttgctcgctctcaccatcagaggactacacgtcctagcctttagacgaggactacacgtcctcacctttagagggctacacaccttcgccttcagaggacaacatgtcctcgccttcagaggactacatgtcctcgccttcagagggctacacgccctcgccttcaaagggctgcacaccctcaccttcagaggactacatgtcttcgccttcaagggacaacacgtccttacctttagaggatgcacgttctcgccttccgagggctacacgccctcgccttcagagggctgcacaccctcaacttcagaggcctacacaggactacacgtcctcgcctttagagggttgcatgccctcgccttcagaggactacatgtccttgccttcagaggactacacgttcttgtctttagaggactacatgtcctcgccttcagaggactacacgctctcgccttcagaggactacacgtcctcgccttcagagggctactcacccacacgttcagaggactacatgtccttgccttcagaggactacacgttcttgtcttcaaaggactatatgtcctcgcctttagaggactacacgtcctcacctttggaggacacac

SEQ ID NO: 27194 - DNA, 536 bp, Glycine max
  Peptide Sequence Number=SeqID_143972
atgggtaaagcagaggaggtgcaagagcagatgaaggctgacatggaggcccatgaaagagcaaatggccacaatgatggaggccatgatgagcatgaagaagataatggaagccaatgcgattgcagttatcgtagcgttgttgctaagtgcaaaaacaaacatgccttcccaccatatgacttgcctccctactatacaccacccaatgtggcgtacactcccaatgagaatgtcaataactccactcctatactcattgagagccaacaacctcaatctgatcatgcacatgtctctcgacccatgggggagacacatgaaattccccaccacaatctagccgacttcaagccttgcctcggatatgcgactgaagggcaagcagttggctctgggccattgaaggaggcgaagattgtgcctttgctaaaagagttgttcctagtacccaatatcatcacccctcccaagttcaaggtgtcggactttgacaagtacaaggggactacttgccccatgaaccatctaaagat

SEQ ID NO: 27195 - DNA, 369 bp, Glycine max
  Peptide Sequence Number=SeqID_143973
atggcgtattccgagttatggccctcattattggaaaaccatttggtggtggccatacctgggaaggtcttccagtcaccataccccaagtggtacaacttaaatgccacgtgcgcataccatagtggagcccccagacacaacattgattcctgcctgccattcaagtataaggtgcaacacctaataaatgccggttggctatcatttcaagaagagggccccaatgttaagaccaatccgctagccagtcatgggggagctagcgtaaatgccatcgaaaaggataggccgtcagggtcaaagagattagaagatgtggctacatccagaagattcatctaccagtcgctgcaggaagcatgcatg

SEQ ID NO: 27196 - DNA, 269 bp, Glycine max
  Peptide Sequence Number=SeqID_143974
aacgtgatagctcttgggtcaaaaagggcactcaacccgctgatgaagaaggcaacctaccagttgaagataattccactcttcttcgaaggcttatggacaagtttgacggacttcagacttttgttggtgataagtttgatgctatggaattgcaagacgacatacggttcgatgccgtggaatcgaggatcaccaaagtggaagaagatgtcgcattcatccgtacttgctttgatccaccaccaccgcctccatcatcatcttag

SEQ ID NO: 27197 - DNA, 351 bp, Glycine max
  Peptide Sequence Number=SeqID_143975
atgggtcagattctacaggaccaaaccttgtgggagttaaggaatgatggaaagaaaagaaataaaaaaaaaagtggcagtaagggtgacttatctgtcaacttttccactattacacccaaaaaaccaaactctgctttacgtaaagttgccagagtacgcttaacctctggatttgaaattactgcttatatacccggtattggccataatttacaagaacattctgtagtcttagtaagaggggggagggttaaagatttacccggtgtgagatatcacattgttcgaggaaccctagatgctgtcggagtaaaggatcgtcaacaagggcgttctagtgcgttgtag

SEQ ID NO: 27198 - DNA, 845 bp, Glycine max
  Peptide Sequence Number=SeqID_143976
ggctgcacgcgctcaccttcagaggactagacatcctcgcctttataggactacacgtccttgccatcagaggcctgcacgccctcacctttaaaggactacacgtcttcacaatcaaagggttgcacgccctcaccttcagaggactacacgtccttgccatcagagggctgcacgctctcacctttagaggactagacatcctcgcctttagaagaccacatgacctcgcgatcagagggccgcacgtcctagccatcagagggctgcacgccctcaccttcagaggactacaggtcctcggcatcagagggctgcacgtcctcaccttcagagaactacacgtccatgccatcaccttgagaggactagacatcctgccctttagaggactacacgtcctcgccatcagagggctgcacgccctcaccttcagaggactacacgccttcgccatcaaagggttgcatgccctcactttcagaggactacacgtccttgccatcagagggctccacgccctcatcttcagaggactccacgtccttgccatcagagggctgcacgccctcactttcagaggactagacatcctcgcctttagaggactacacgtcctcgccatgagagggctgcacgccctcacctttagtggaatacaggtccttgccagtagagggctggacgccctcagcttcagaggactacacgtcttcaccatcaaagggttgcacgccctcaccttaagaggactacacgtcctcgccattagatggctgcacacccccaccttcagaggactacaagtccttgccatcatagggctacacgcggtcaccttctga

SEQ ID NO: 27199 - DNA, 470 bp, Glycine max
  Peptide Sequence Number=SeqID_143977
atgggtgaaatagaggaggtgcaagaacaaataaaggccgacatggaggtcatgaaagaccaaatggccaccatgatggaggccatgttgagcatgaagataataatggaaagcaatgcggctgcagttaccactacgagtgccgccactgaggaaggaaaagcattgggaagcataggcggtccccatgttgtgcagagcaagaataatttcccaccatatggcttgcctcccaactatacaccacccaatgttgcacacgctcccgatgagaatgggcaagcagttggtggtgtacccctgctagacactttggggggccctcaattttgcccacaagcacaagccttgcattttatggtggaaagagtccctcctgctatggtggaaaagggaaaatttgatcatatagaggaaagactgagggccattgaaaggggcggaaattatgcctttgctgacatggccca

SEQ ID NO: 27200 - DNA, 315 bp, Glycine max
  Peptide Sequence Number=SeqID_143978
atggtgtgtccgaagaagcagaaggttgcttatattacatacactttggtagaagaagctgagtattggtgggagaacactagccaatgctttgaggctaaaggaagagatgttgaaagtttaaaatgtgtgaagtttctgaacggcttgcgacctgaggtgaaacaagctgtgaacaatcaaggtgtccgatcttcttcattaatggattcctttgcttcttggaagatgaatggcagtggaatggagaaggaagagagagaggagacaccacttcaaggagaagatgagtctagaataagctcaccaccatag

SEQ ID NO: 27201 - DNA, 342 bp, Glycine max
  Peptide Sequence Number=SeqID_143979
atgtttgaaggtgatccaacggttaacgagtctgggatcatggctgttacaaaagaccttttcttgggtatcaacaccaaagtattcaagaatcttggagatcagaactgcatagggacacctgaaaaaaacaatcctcttggtcatcaatatgatatcaacaataatgtttacccaattgatcttcagcttcccttgcataagactgataaggagaagatcctcccgagtcaactaagcatgattgttccccctcaaagtaataatccaagcaactacataggccaaaagcctatgctcaagcatcaacggttcagtaccaaaacacttatttccatttga

SEQ ID NO: 27202 - DNA, 276 bp, Glycine max
  Peptide Sequence Number=SeqID_143980
atgatcgaaagttttcaacaacaacaacaaatgtcagttctagaattgtacgtagaaaaggatgttgctggtggttctatgtttcatgctgcaaattctgttacgtcaggtggacgtaatgtatctcatcatgagttagaactgccaagaaatataagcaatttacatgatgatgaagatgatgatgatgatgattatcttgcatctaacttatacgttgaagagtctttcgatgaagatgatagtgatgatggaatatctgatacagatgatgaa

SEQ ID NO: 27203 - DNA, 288 bp, Glycine max
  Peptide Sequence Number=SeqID_143981
atgaaaagagaaaaacatgcctcatatagtagtcatgactcttgcaagagtttaagtgaagaacttagcgactattatagagggcgccataggccacatactaaacatcactcccatagaagagaaaaggataaaaggcctcaagaggttaacattagcctcccatatttccatggaaaagataatgttgaggtctacctagattgggaaatgaaggttgaacaactctttgcttgccatcatattggtgatgagagaacagttccattgtctactattagtcggtga

SEQ ID NO: 27204 - DNA, 228 bp, Glycine max
  Peptide Sequence Number=SeqID_143982
atgcaacagggacaggcagatatcctcattgctaggttccctgaccctaactatggtgttaaaacgatcaaatttagagaagatccaacggttaaagaaggctgggcagtatttttaccgaggcagctccatgtagctttctctagaagcttcattaagaggcttcctccagaagcttcctcgtggcttctcagggtgttacaagctcagcttgcccatgcgagctag

SEQ ID NO: 27205 - DNA, 1042 bp, Glycine max
  Peptide Sequence Number=SeqID_143983
gtcgactctagaggatcccccctttattggtgctgatgaaacagaaggaacctctttccaaggactgactgtagaaggtaaaaagccagagaagaatgaagtgtcttttgctacttggaagagcgcacagaaagtggtgcaggagggaacaggtgtaggatggggaaaagttgtgcagttaatagagagtaaaaaccgtgaaggactaggttttgcttcctctgcaggatccgcaatgaacagtgttggatcaagctccattactagcaccttttgtagcgccgggttcatcaacaactcgccagaagccaatgctgtcttggaagatgttcctgaaaagatagtgcttacatttgtcacacctggaaaacttgtccgcaactgggacgcggttgacatcccttcagtagttcatgcatcaaaactaggcatttatgagcccgttgaacataataaccctgcactctctcccaacttcgaatctcctgtctacgaggctgaagaggaggaggatgatgaaatcccggaggaacttgctcggttattggaatatgaaaagaaaaccattcggcctcatgaggaggtagtagaggtgattaacttgggaaccgaggaagataagaaggaagtcaagattggggcatcgcttgaggcaactgtcaaacgaagggtgattgaattactcaaagaatatgccgatgtgttcgcatggtcgtaccaggatatgcccggcttggatccccgtattgtggagcaccgtttgcctttgaagcccgaatgcccaccggtcaagcagaaattgagaagaactcgccctgacatggctctcaagatcaaagaggaagtacagaagcagatcgatgcaggttttcttgtcacatcagagtatcctcaatggttagccaacatagtgcctgttccaaagagggacggcaaggtcaggatgtgcgttgactaccgggatttgaacaaggctagtccaaaagatgactttcctctacctcacgtcgacgtattggttgacagcgctgcaaagtccaag

SEQ ID NO: 27206 - DNA, 1056 bp, Glycine max
  Peptide Sequence Number=SeqID_143984
atggcttcccgtaaaacaaaagccccagcttcagtgtcccaggctagaaaaattaagaggaggaattggcataaggagctcactaacttctctgaagggatcattgacatggcattagtgaaggaattctatgccaacctttatgaccttgaagataaatcaccaaagcaggtgaaggtgagagggcacctaattaaatttgatgatgacgccctcgacacctttttgaagacaccagcggtcatcgaggaaggggagagcctgctctcttactccaagttctgcaagttgaggccagatcctcaagagcttgaaacccacctatgtatccctaggaggggatttgagctgaatgcagacgggatgcctctgaagattttgaggaagaatcttactactctggcccagacctggagtgttctatctttttctaacttagccccgacatctcatactttagatattactttggatagggctaagttaatctacgggcttgtaatgcagatgaatatggacttgggatccctcatcttaggtcagatttctctcatcgcacaacatgactcctcgaggctaggttttccagccattattactgctttatgcaaggcccgaggagtcacatctaattctctgacctttgaatccctgagcccagcaccatctacttcagctccccctacctcagctccttctacctctcctctctctccagcaccagcagctccagttcttctagatccttcttctcagagcttcgagccttccttgtctatgctgcagagcctgcatcagggccaactcctgatcatgtggcctggccaggagtccagccttcacctttgggaggaggaggacattccaaaggctacagagcctacacctcctaagccattcactttagagtctgatccagttgttgtacaggctaatccaactatatctcctcagcctgagccatctgcactagtgtcagacctgcccctttctcaggatccatcatttgcaccagcattagacctgaatgagcatgccatgaatcgggatcattaa

SEQ ID NO: 27207 - DNA, 514 bp, Glycine max
  Peptide Sequence Number=SeqID_143985
caatcaaagagagtacgaggagagtttataccctctcgggcatcatgttcctccctatgagatacacacccttctccctcatgtttcgaataccgaatttcgtgatccagatcagattctctgtgatcgtgaagtggaatcaaacagtggcgccggaggaacgatagcggtagagcttgccgaacacgtggagcgcggtgacgaagccgatgaagcagaggctcatgacgagcaccaccgtcggcgagatcttgaggccgggggcgtcgtcggtgtagaaccgcagcatattgcttccgccggcgccggagccgccgctgaccgaggcggagctggttcctccgccgaggcggcgacggcgcatgccggcagtggcggcagcggtgccgcgaggagccatcacgcccggtcgcgtggtggcgtgggacgctgtggattgagattgagaggcgcctctcgccatgtcgatgatcacgagggaaaaggtggtggtggtgtgggagaaagaaacagt

SEQ ID NO: 27208 - DNA, 333 bp, Glycine max
  Peptide Sequence Number=SeqID_143986
atggttttttccttgtttttcctaggcctcaactcgcccaagccagcatttggctcacctgggccaccaaataacttcaaggctaaggggctaggtcgcttgggtgagctcactgcttcagggttaagtttcagctcgcctgggcgtgctccaaccgccccaagaaaaggcttagaggtggaaagaattgagagaagaaagaaagaagaagaagaaagaagaggaaacgaagtcgaggcgctaccgaatcgccactgcgatcattccctacgtcattttcttgttccgtgttcttcatgcaatagtcagttggttttgttcttcaagagttga

SEQ ID NO: 27209 - DNA, 298 bp, Glycine max
  Peptide Sequence Number=SeqID_143987
catcagtgagagtcaaagtgagagtgagagcgagagcgacactgacaaggagagcgagagagagagagagagagagagagagagagctagactaacagtgagagcgagaggaagcaccgccacagagagtgagagcatgaagtgtgagagtgggtgcgagaagaaggatcctgcatttgagaatctgcacggcaaagaatatgaccttgaagatggcaaggagggggaagcgacaaccgacgctaatgatggtgatggcggtgtgtgtttgctagaactggacaagcagatcaacaat

SEQ ID NO: 27210 - DNA, 241 bp, Glycine max
  Peptide Sequence Number=SeqID_143988
aaaaccctacactgctcttggaacagtcgtgggtgctcaaagctcaaagctttctatgctgccagttaacaagttgattgtgctttacgtggttttcaagcttgacgagagttacacgccgagcaaagtttccatccgtgccggtgatggttttcacaacttgaaggagattaagaccgtggaactcgtgaagccaactgggtgggtttatctatccttgtctggagctgatcctaggtaa

SEQ ID NO: 27211 - DNA, 547 bp, Glycine max
  Peptide Sequence Number=SeqID_143989
agagaagttggaaaaattagtgagaaggaagattttggagctctcccttgatggtggtggtgttgggcacgagcttgaaggagaagagggaggagattttcaacttcattcaagcttacgagaaatttgcatgagtgatatggttgaacctaatgatggggttgtgccatcgtctgctatcgagccacccatcggagaaggggggcaacctactaataaggttgaccataatgataatgaagttgttgaggtcacccctaacatgccttcctctgtcttgactaagaggaaacgtgatgatgaaactatgcatgttatcaagttgatgttcggttcgggtctcccatctgttgctgtttcacagggttcgcctttggcttcattggtcattcaagatgctattgttgctccccctccttcttctttgcccactcaatatgtttatgtctctcctcctagtatggttattgtgccagtccttttagtcgccactatcatcgctccacctttccccattgtttctcccttgttgagcacgctaatgtga

SEQ ID NO: 27212 - DNA, 847 bp, Glycine max
  Peptide Sequence Number=SeqID_143990
ggacattgctcaaactttttggagagtgaagcatgccaaggtggccaacaccattgtcgcctttgctgaggccatcaggtccaaccaacatatgtcatccaagattggtgatgcccttgccaagttactacacaccaaactggatggtgataagatgtttgagcgatgcaaggtcttgcagagaaagaaaaatgacttggccgacaaggtggatagcgctattgatgaaaaggatgagctcgccaatgtgtccgagcttggggcgttagaggatatggtgaacaacaaagagctagaggagaagctgttggccaggttcttcaccaaggaacatgacttaggtctttgtaacccattcaaagacatgaaagatgatgaactatttgatgaagaagaaataattgcaatagaggagtatgctgatgaggagaaagccaatatggccattgtcttgttaatcatcttggtgatgcttccttttggtttatggagcttctcccctgatgcttgtgaggagagagagcttaccaagggtgtaccttgggtttttgtaggagcgcttaccaaggctggaccttcggtttcttgtattccaaggccggaccttgggtttaacaagctttggacaaaggaagtgttcatccttgagatacgagactcacgaaaggttgaccctaggtttgacaagcctttgaagaagcgagactcaccaagggcaaaccttgggtttgacgcgcctttggagaagcaagactcaccaagggtggaccttgcgtttgacgagcctttggagatgcaaaactcaccaaggccggaccttggatttgacgagcctttagaaaagtga

SEQ ID NO: 27213 - DNA, 875 bp, Glycine max
  Peptide Sequence Number=SeqID_143991
atgtatacatgcattcacaacatcatctcggctcaaggcattgccccagacccagagaatatctcagctatgcttgcttggcccattccgatttctccgacggctctccgtgggtttttgggtttaacaggcttctatcggaagtttattaagggttatgcggccattgcatttccccttacttccctcttacgcaaggacaagttcagttggtccccggaggcccaaacggccttcacggcccttcagcaggccatgattagtgcccccgtccttgccaatcccaacttctcactcccattcaccatcgaaactgacgcctcggcgacggcaatgggtgcggtgctgctccaagaggaccacccaattgcatattatagtaaggtcctgtgcccaaggttgcagaaggcctctgcgtatatacgcgagcttcacgcgattacctcttcggtccggaaatggcgacattacctcctcggtgccacattcaccattctcaccgaccaccgcagcttaaaagacttgatgacgcaggtcattcagaccccggagcaacagctctacttatcaaagctgttggggtatgattataccatccggtacaaaccaggggcggcaaacgtggtggctgacgccttgtcccgcatcactccgccggaggccacgtgtttggctttgacgatgccacatccccttttcctttccgaattacggcaggccctactccaggacccacgatatgtcactcttttgcaggacatccaatccacgccggcaaaccacccggagttctccctccatcacgatcttattctccggaagaagcgtatttggattcctttcccttgcgttattacgcagtcgttattggaaga

SEQ ID NO: 27214 - DNA, 237 bp, Glycine max
  Peptide Sequence Number=SeqID_143992
gtggcctggccaggagcccagccttctctttctggagggggtgtacacatggctcaggaggaggagacttccacagaccaaatcctagagccatccccaacacccataactaatgatgccataccatctgcaccagcatctgagttagagcagcctatctctcaggattcaccagttgctcaagtgttggatcttaatgagcatgcacaggagcaaccacaggagcaggacatttaa

SEQ ID NO: 27215 - DNA, 459 bp, Glycine max
  Peptide Sequence Number=SeqID_143993
atgctgacatcttcgaaaagggtgcagatgaccacattggcctctgcttgtcaatcgaacttggggtctccgaatgacgaggtgcggataaccgaaaggtgtctccgcatgctaccagactcttgggtcatgatagcaaaaggtggggtggtcgacaaaagcgaggcttttgctcctacgtatcctccatttgtgatgaagaactcagacctacgtagttctttctattcgttcattcctaaacgaccatttagaggaaacactgggcccgacagaatagaagaatatcactcgaagtgtaccaatctcacacagggcagggtttgtggtaagttgggattttggctcaaggcttgtagaacggctggacatgatatatgtcaggatgttggtttggccagcggctcagggaaaaaggagaagtcccacattatttccatgatacacatgcaacactga

SEQ ID NO: 27216 - DNA, 225 bp, Glycine max
  Peptide Sequence Number=SeqID_143994
atgaaaggaagaggacaggaggtcttcaaaccagataaatattcggcaaggtggaaaaaacccagtggaccattcggtcctgccaacaaatcttgttcggagccccatgaattgattgtcgttcatgcatcctccaccaacgagtttggagccccgcgaattgattgcctagtgctattcgccaattctccattctccacttttattcggagccccatgaattga

SEQ ID NO: 27217 - DNA, 638 bp, Glycine max
  Peptide Sequence Number=SeqID_143995
gagtggtggatattgctgtttctgagcatcaaattgccaaggaaatcactgccaaacaagtccagcattggccaaagaaagggaagctttctgcagggaagctaagtgtgaagtatgcaatcctgcacaggattggcgttgcaaactgggtacccaccaatcatacttccactgttgccacagaatcctttgctgtcaaattacccattgccttcccaactgtattgtgtggcattatgttgagtcaacatcccaatattttaaactacactgactctgtgaagaagagagaatctgctctatccctgcattacaaactgtttgaggggacacatgtcccagacattgtctcgacatcagggaaagctgctgcttcaggtgctgtgtccaaggatgctttgattgctgaactcaaggacacatgcaaggtgctggaagcaaccatcaaagccaccacagagaagaaaatggagctggaacgcctgatcaaaagactctcagacagtggcattgatgatggtgaagcagctgaggaagaagaagaagcagctgaggaagaagaagaagcagctgaggaagaggaagatgcagcagaggatacagaatcagatgatgatgattctgaagccaccccatga

SEQ ID NO: 27218 - DNA, 330 bp, Glycine max
  Peptide Sequence Number=SeqID_143996
gtggaaagacccgatgaatcgttcggtcctgccgaccaatcttttttggagcccatgaattgcgttttcgttcatgtgttctccaccttcgagtttagagctatgcgtagtgattgcttagtgcaattctccattctccaccctttttcggagcccatgaattgcgttttcgttcatgtgtcctccaccttcgagtttggagctatgcgtagtgattgcttagtgcaattctccattctcaacctttttcggagccccatgaattgcgttttcgttcatgtgtcctccaccttcgagtttggagctatgcgtagtgattgcttagtgtaa

SEQ ID NO: 27219 - DNA, 525 bp, Glycine max
  Peptide Sequence Number=SeqID_143997
atgaagatcttaaaagggtataccaagaatctacatcatccggaagcatctattgttgaaaggtacattgcagaagaggccattgaattttgttcagagtacattgaaaaagctaaacttgttgggcttcccgagtgtcgacatgacgaaagagtgggcggtaagggttcaagagcactgcatgttctcactccaagtgtagaagatttgcaacaagctcacttgtatgtgttgaacaacagtaatgaagtttttccatacatacatcagcatgaaggtttagtgaaaaaaggtgttttgatgataacaataatgacaacaaaagatgatgacaaaggtgatgaaaaaaaagctcaaagatcaaagaataactcaagtgaatcaagaacaagtcaagagttcaagaatcaagaagaattcaagactcaagaagaaagcctagaatcacgaatcatgattcaagattcaagatctcaagatctcaagaatcaagatcaagattcaagactcaagattcaagaatga

SEQ ID NO: 27220 - DNA, 165 bp, Glycine max
  Peptide Sequence Number=SeqID_143998
atggtgaccaaaggttggagctttgttgggcaacaatggtggaggaagaagaagagaacggcaacctatgccacatgtctccatttgagtggagcaaaagggcccgctttttctcttgatgtgactcatgctcagccacatgaagagaaaaatttgaccttttga

SEQ ID NO: 27221 - DNA, 675 bp, Glycine max
  Peptide Sequence Number=SeqID_143999
atgcagccaaatgcaaagcgagaaaagtcggatcgttattgtggattccataagcatagagggcatactacggaggaatgtgcacaactcaaagtggcgattgagaggctgatcaaacagggccatttaggcgaatacattgataagcctcgaaataagcgccgtgatgatcctccacgccgagataataatcgagatcaacagcaaaggcgagaggataagggtcatcgacgcgacctagataacaacgataaccaacctacccggggaatcatcttctttatctccggaggaccagcgggtggcgattcacaaaatgcaaaacgcaccctcgctcgatcagcacgtatgaatcaagaacgtgcttctccatccgcacgcatctatcaaatacgaagacctgatcatagcatagtcttcaactcctccgaccttgaagatccagacgaagatcatgtcgatgcgttggtagtaacaacaacagtggccaacttcttggttaagaagatattagtggacggtgggagctcagctgacatcatgtacctccacgctttaaagcagctgggcatagataatgccctgtttagtcgcatctccacacgcttgaaaggattcaaaggagaatcagagaaaaagaaaagagttgcaattaggaaaataaaatcaaattag

SEQ ID NO: 27222 - DNA, 138 bp, Glycine max
  Peptide Sequence Number=SeqID_144000
atgacccgagagctggtagcccgcggagacaccttacggttatccgcacctcgtcattcagtgaccccaagtgtgattggatacgtaggagcaagagccttgcttttgtcggccgccccacaatctctgtcatactga

SEQ ID NO: 27223 - DNA, 489 bp, Glycine max
  Peptide Sequence Number=SeqID_144001
atggcaaagttgagcgacatcataaggtctaagcgcaaggaaatgggcttaacgcagaaggcgttcggcaaccttttcggtgcgcagcagacaaccgtctccgattgggagaagggcaagatatctatgatgcgcaactggcagaagctcgccgggtcccttggtctgcgcgaatcggagtttctcgaccttatggctgaggcaaccaccgagtcggaaaagacagagcgcatgattcccgcgttgcgtcaggcaactgcccctgtcattaataccggtagtatcattgccgctcctaaaccgccgtccggggagcgtgacgtgcctgttctgggcaggtcgaagggagggtcggacggtgagtttgagtttaacgggcagatcatgggctgggaatggaggccgcctcacctggcgggcgtcgccgaggcatatgcatcttatgtagacggcgagagcatgtatccgcgttacaaaccaggcgagacg

SEQ ID NO: 27224 - DNA, 271 bp, Glycine max
  Peptide Sequence Number=SeqID_144002
atggcggccagtgaccgggccgccctaaacgccagcaaccaactggcgataacaaaaccaataatgccagaaggggagatgaatatgagaaagaccgcagccaatgacttcgaaaatttagcgccggtggagcatgaaagctctgccggcgttgtcgtacatgcagcgaaaaacgaaaaggggcgtaatgagccggcaccacccgtaactccgccccttctccgtactaacacgccgaggagaccttcgccgaaaggcgggatcaaagcgc

SEQ ID NO: 27225 - DNA, 357 bp, Glycine max
  Peptide Sequence Number=SeqID_144003
atggcggcgcagctaatccgtgatcgagtagagatggagttcctagagggagcttgggagaccctcgaaggcaacacgagcgcactgtggagtggatactaccccacgcctacaccatatcgtctagtggagcccgtccaagtgatcgaggtaacgtcatccgaggaagaccccgaggaggatctggaagagctacctcctgagcctgctgtggatgcccttgactttctagagggtgatgaggatccacttcttgaggtggattctcccgaggaagtcatgtcggcatctgaggcagactctacggaggatagtggcccgggggagatgacgatcagcggaggctcttcatcctag

SEQ ID NO: 27226 - DNA, 537 bp, Glycine max
  Peptide Sequence Number=SeqID_144004
atgcaaaaatcttcattcagatttatgtctagaagctcatccaaagctatcaacactgatacatcttatgatgatgagttcgatgacgatagctcagacgaagatgatcagttagcctttatctcaagaaagataaggaacatgtggaagaaaaggagtggatcagacaggaaaagatccaagaaaccatatagagaaagaaaggacaaggataaaagttccatcatatgttataagtgtaagaaaccaggatacttcaagttacaatgtccataccttgatgtattcaaccacaacaaaaatataccaatcatgatacctagacagtggctgctcacatcacatgataggagaaaaattggacttgatgtttcctttagcaaagatgggtgtgttgtcaaacacaaaaatatgaaccaacttttcactgccaagaggcaaggttttgatgatgccaagacaaaagcaacacaagttttatttcaagtccaaatcaagacaaaaaaaacaaagatcaagaagaaagctgagtcttag

SEQ ID NO: 27227 - DNA, 321 bp, Glycine max
  Peptide Sequence Number=SeqID_144005
atgaaaccgataaaagaggaagtcatgatattgcacgagattagaaggcctaactctctaaaaaaaatccctagtggagtcgccaattgtcgcaacctacccttcggcgggagggcgacgcagggctcacgggtgcgtcttccaagggaggaaggcgcgcggagtcgccaccaatgtttattcgaggaaaacgtcgaaaaaaccggaaaggtgcgtgtatggtctgcgaactttgagtgtgaaaggttcgggagttgtatttacgcacggggaaggtattggcaccccacgcgtccatcacaagggacaacagccttttaa

SEQ ID NO: 27228 - DNA, 246 bp, Glycine max
  Peptide Sequence Number=SeqID_144006
atgactaatgcaaactgtccgcaagaatcattgcattcagtctcaaacggaaatctaagattaggcagcaagctcaaaaatctctttgttttgtttgtcaaaccactgacaacctgtggatatgtgttatatgtgggtatgttggctgtggaagacaatggatgtggaagttgcaatagtgaagataatgccatgaatgaggttatacttaatagcaaacttgaagctgtaatgttgcaagattaa

SEQ ID NO: 27229 - DNA, 614 bp, Glycine max
  Peptide Sequence Number=SeqID_144007
atgggtgacctagaggaagtacaggaacagatgaaagtcgacatgtcggctttgaaagaacaaatggattctatgatggatgccatgctgggaatgaaacaacttatggagagtaacgcggcccccgccgccgttgttagttcggctgccgaggcagacctgactctttcgactgctgcgcaccaccctattccaaataaggtgggacgagagaaaagcacgccagggcacgtcggcaacccgcatctggggtacaaccgaggagcttacccctacggtttaccacctaattacacaccaccagtcatacgtgacgatgcgggtcatgttcctccccccatacttgaaggggagcctcctcgacatccggacgtggtccacgaggatcatcgagagcatgctcagggagacatcgactcctactccccgttttccactgaggggctagcgcccaacgcactacctcaacccaacatcacgggagaacctcgaagccacccaacgcagccaatatttctgtctgtgggaggaccacccctggcagcagaaggaacggggaaactcgatctcatcgaagaaagattgagggttgtcgaaggatttggcgattatct

SEQ ID NO: 27230 - DNA, 642 bp, Glycine max
  Peptide Sequence Number=SeqID_144008
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctttctctggcgccccctttccaggggacttgggcccggtccgcccactga

SEQ ID NO: 27231 - DNA, 233 bp, Glycine max
  Peptide Sequence Number=SeqID_144009
cttcaactgatactgcttatagccaacatcggctatggatcacgcccatcatcataagggcttctcgaagacttaatctcgctctacctccattctcggagaggggagtcttacccgcggatactcttattcgagagatggaattgggaatctgtttcgagacttcgtcattgagagctactaactgccattattccgaggcttatggagaccctcctaagcttaaaggctga

SEQ ID NO: 27232 - DNA, 267 bp, Glycine max
  Peptide Sequence Number=SeqID_144010
atgggagttactaagtgtttggaaatgggaaaatacttaggagtcccatctatggttggtaggagtaaacagagatgtttaaatacgtcttggtggaactctaaaggagataggtgcaaaggtatcaatcaattgaggtgggagaagttgtcgcaaaggaaagagaatggtgggatgggatttcaggaccttaaggcttcaaatatggctttgttgggaaaacaaggatggaaaattataagcaaaccatgggagtcttatagctag

SEQ ID NO: 27233 - DNA, 355 bp, Glycine max
  Peptide Sequence Number=SeqID_144011
atgggtacctcaaagccttacactagggcaatgaggggcatcacgcatgagcctcaagcgagcataggggcagatcaaaatcctctcaatgagtcaatcttatgctttctcatatgggtggacccttgggtactagaacctattgccttgagaggactacatgtcctcgccatcagagggctacacgccctcaccttcagaggactacacgtcctcaccttcagagggctgcacgccctcaccttcaaagggctacacgtcctcaccttcagagggctacacgccctcgccttcataggactccacgtcctcgccatcataggtgctgcatgccctcaccttcagaggactacac

SEQ ID NO: 27234 - DNA, 354 bp, Glycine max
  Peptide Sequence Number=SeqID_144012
atgaattcattgcctagcgttgttcatgtatcctcaacaatcgagtctggagccccgcgaattcattgcctagcgctgttcgccaattctccattctccacttttattcggagacccatgaattcattgcctagcgctgttcatgcatcctccaccatcgagtctggagccccgcgaatccattgcctagcactgttcgccaattctccattctccacttttattcggagacccatgaatttattgcctagcgctgttcatgcatcctccaccaacgagtctggagccccgcgaatttattgcctagcgctgttcgccaattctccattctccacttttttcgaagccccatga

SEQ ID NO: 27235 - DNA, 246 bp, Glycine max
  Peptide Sequence Number=SeqID_144013
atgaggacacgtagccctctaaaggtgagggcgtgcagccctctcaaggcgaggatgtgtagtcctctggaggtgagggcgtgcagccctctgatggcgagggcgtgtagccctctgaaggtgagggcgtgcagccctctgatggcgaggatgtgtagtcctctcaaggtgaggacgcgtagtcctctgacagtgagggtaactagtacccaagtcctctcaaggcaaggacgtgtagtcctctga

SEQ ID NO: 27236 - DNA, 271 bp, Glycine max
  Peptide Sequence Number=SeqID_144014
atggatttggacgaggtttcttttgaaggaaatgctgggaagtcttctgaaagacgtgattatggtggaccacgaggtccttaccgtggtggtggtggtcgtcatggaggtttcagcaatggtgaaactggtgaagctgaaaaaggacgacctcgaagagcatttgatcgtcacagtgggactggacgaagggtaactgatgaggttgcgaatgaaactgaaaagaatttgggtgacgagaagcctacagttgaagaagatgtagctgatg

SEQ ID NO: 27237 - DNA, 528 bp, Glycine max
  Peptide Sequence Number=SeqID_144015
atggagagcacaatgtggtggtggtggtggtgcaatatggtgtgtgttggtggtgatgaaaatgagaagtggtatttggtggtagctgaaggggcaggagctagaggtgcatccagaataataggcgttgacatcaactcagacaaattcatcaaagcccgagaaatgggtatcaccgactttataaatcaaagggatgatgagagaccagtatatgagagaatcggggaaatgactggtgggggcgtgcactacagttttgaatgtgctggaaatttgaacgttctaagggatgccttcctgtctgctcatgagggttggggattgactgtgctagtagggattcatctatcaccaaaaatgcttcccatccacccaatggagttgttccatggtcgcagaatagtaggatcaaattttggaggcatcaaagggaagactcaattgccacattttgcaaaagaatgcatgaatggagtaacgactaccattctctctgagtttgcatttgttcttttcaaaaaatga

SEQ ID NO: 27238 - DNA, 483 bp, Glycine max
  Peptide Sequence Number=SeqID_144016
atgaatgtttatacggataaccactcgggtattttcgcccgtcagcgtgactcaaatgtcagtatgacagatcttgtgagcgcggaagatgacgtaaatctccgcgtgtcaacgggcttgtcggccgcgattgacgaagggcgcagaagacaacacagcaaaaagaatgtttatacggataaccactcgggtatttccgcccgtcagcgtgactcaaatgtcagtatgacagatcttgtgagcgcggaagatgacgtaaatctccgcgggtcaacaggcttgtcggccgcgattgacgaagggcgcagaagacgacacagcaaaaagaatgtttatacggataaccactcgggtatttccgcccgtcagcgtgactcaaatgtcagtatgacagatcttgtgagcgcggaagatgacgtaaatctccgcgtgtcaacgggcttgtcggccgcgattgacgaagggcgcaggagacgacgttag

SEQ ID NO: 27239 - DNA, 273 bp, Glycine max
  Peptide Sequence Number=SeqID_144017
atggttttgcaacgtcacccgcgaggaagtatccagcatactgacattgactcatatttctgcacatcagcaaagagagggagcaaccatacctccagaaggtttagaagggtgcaagcgaaacacagagactggattgtgcagtatgatccacctgatgaaccaaatgaatatattcacagggttggtagaatagctcgtggtgaaggtgggaaaggaaatgctttgcttttcctgatccctgaagaattgcaatttcttcgctatctgaag

SEQ ID NO: 27240 - DNA, 1425 bp, Glycine max
  Peptide Sequence Number=SeqID_144018
atgctaaagtgcagagagcatgagctagcatctatatatgccataatagacttaaggaaagtgtgtctggtcattgtgttgtacatgcatacagatagtatgaggagcgcactggtatggatttttaccttgaacgtttgccttcaaattttatttattcctggtggtgactcaaagccgcatccacgtttcagagagaaaatcactgaggagtacaatcccggatttataagcattgactgtggagcaagtaacgattacttggacgaggaaacaagtaccttttataagacagacacagatttcatagaaacgggagaaaacttgttgacgtcttcccaatttattaacacaaatatccctgattatggaagacagctacgcacattgagaagcttccctgagggaaataggaactgttatactctgaagcccgagtataagcaaggtgagcagcaaagttatatgattcgggctatgttcggatatggaaactacgatggaaaaaatcatgcccctacgttcgatctctatctcggggtcaactactggaaaaatgttaacacggcaaacagatcctatatttggaccgagattattcatgctcccacaacagacaccatacaagtgtgtctggttaatattgacactggaatactatggatagacacccaaaatctagagttaacatttagtgctagagactttgttgcattgtggagatataagttgatcagtgattggaaagggagaatgaagagggaaaaagttcggatcgacaatgtttcctataggtacaaggacgatatctatgatcgcaggtggtactggcgcgatgttaaagattggtataagatcaatacaaccatagatgttaataaatctggcaatgatatttataaagtaccagctgaagtcttgaaaaccgcagtgcagtccttcaatcgctcatatgacttgcactatgactttgaaattgaatggaatcttcaattgaacaagtattccggatattatgtctactttcactttgctgaaattcaacagcttgctccagggctcagaaggataatcaacatcactctcaatgatgaaaacatactctctgagcctataactctcgaatatatgaagcctgtcactattagtaacaaaaatgcaactcaaggtttcgttcgcttttcaattagagcaactgcagaatcggatgctcccccaattctcaatgcttttgaggtttataaattagtaacagatctaaattcaccaacagatattaaagatgttgatgccatcgtgaacatcaaacgctactatgggatatccagaatagattggcaaggggacccatgtgttccagaaatattcagatggagtggcctggactgcagctacggcatcaatcctagaatcatatcattgtga

SEQ ID NO: 27241 - DNA, 339 bp, Glycine max
  Peptide Sequence Number=SeqID_144019
atggaatatgtagactcgaagaaacaagagttcagctactcagaggttcaaatgattacgaataattttgagagggttgtgggtaaaggaggatttggaactgtctactatggttgcataggtgaaacacgagtagccgtgaagatgctctctcattcaactcaaggtgttcggcaatttcagacagaggcaaatattctcacaagagtacaccatagatgctttactccacttattggatattgcaatgaaggcaccagaacagcactcatctatgaatacatgaccaacggagacctagctgagaagctatcagggattggtgcatatttaaattaa

SEQ ID NO: 27242 - DNA, 378 bp, Glycine max
  Peptide Sequence Number=SeqID_144020
atgtatcaacagcaattgcaggcaccccaggataccttgacccagaagataatcacggggaggacagtcatactaaaaacccaggtgagaactcacataatcaaatgggtaagttccatgctggctgatgatggtgaaattgatggtgttgtggatacaaggttacaaggagaatatgacagtgaggctgcaaggaaagtaatagatgttgcaatggcctgtgttgctccgagttctgttaataggccaacaatgaatcaagtggtcatggaattaaaacaatgtttccccatggggaaacttgggactacgtccactggatccagtgaaattttctctgcgggtgaaattagtggacttagttctctagccaggtaa

SEQ ID NO: 27243 - DNA, 606 bp, Glycine max
  Peptide Sequence Number=SeqID_144021
atggaaggtctgtcagtgatcgatatgggttgtggcacaggggatttcctgcggtatgccgcccgaaacggcgccggtcgcctcgtcggactggacagctctgagcgcatgatcagggaagcactgaaacgtagcgaggactatgagattgactatatatgcggagacttcgcgacagcctcagaaacagaagcattcgacctctgcttttcatcgctggcatttcattatgtcagtgatatcagtgcactgtttaatcgaatcagccggttgttaagacaggatggcacactcattttttcagttgaacatcctgtcgccagcgctcagttagcacgctggcatgctgatgaaaaagccaatgaaacctggggagttgaaggatacctggctgaaggggaaagaaaatcacgctggttcggtcaggaggccatcaaatttcaccgaccattctcatcctggtttaatgctcttcagacggcaggttttcgtttaaccaatatatcagaaccctgtcccagtcagaatacactggatattcgccggaaggcaggccttgcctcagaccgaccagccttcatcgtttttaaagccataaaagcctag

SEQ ID NO: 27244 - DNA, 966 bp, Glycine max
  Peptide Sequence Number=SeqID_144022
atggtggaaagcgggttgccatggccagttcttaggtggtggtgcttgtcagagtcgcacgcgaggaagcccaatccgcagaagacagtgcgggacgggcccctgtccggaacggtggaaaacgggggccgcctgtcatacccagtcttccagtgtcagacccggtacccgctcaaactcccgcacattgttcgtcaccagcacggtgccggcagcgatggcgtgtccggcgatcgccgtgtcgttcgggccgatcggcgtgccggccaggcgcagcgccaccttaatctccgtggtggcgtccaccgcggcgcggtcccagggcaggacggcatcgagccgggcgcagaattcctcgaccagctgtacgtgacgcggcgaggccttcgggccggtggcgccgaagcgcatctcggcgtaggtcacggccgataccacgatgcggtgaccgcgcagcaccgcctgctccaggcgctcaatgacggcggtcggctgctcgcgcatgatgaacgagcagatacaggtgtccagcatataagttttgttcacaggtcaaaccgtccttcgtcgctgacaacgtccccgcgctccgccataaagtccggatcggctttttcaagctgcaggaatgagccccagttcggccggacgggacggaggatgatgctgtctccttcccggacgatctccagctcacttaccccctcaaaatccagatcgcggggcagacggatggcacggttattgccgtttctaaatatcgatacggttctcatggtgaggcagatgcagatgattaacatatgcgtatgcaacacctatgcagatgccggggatatggatatgccagacctatcctctgttctgtctttttccgctgagatccgaaaaaaggcagaaccggatctctgccgcagaactttgatggcaggcagagattcggatcggctggatgaggtcagataa

SEQ ID NO: 27245 - DNA, 859 bp, Glycine max
  Peptide Sequence Number=SeqID_144023
atgcgtcagggaggttccggcagtgaagcggcgcctgatccgccgcagcgggcgcgccacacttccgggaaagtgctatattggccggaaagcggatccggcgccgagaaaggagatcaaatgggacgttcaataccggtgaagattggtcagaaggaatttaaatccaaaaaagccaccgtgggctatttcatggatcagcgtgaagctgtcaaagcagggggcccgttgaaagatggagagttctttgatgaattgcgggacctttatctgcgttactgcgaaatcacagaccatcgcttgggcaaccgggaggttcattcattcagcgtaaactatgaaactcgtcataccgaccagaactacggaaatggagtaaaaatgatgatgaaggcagatggtatagtccgcggcattacgggtccggttgctcacccgctgaccgtccgggtgagcagtccgcgggcagggatccggggacgcctggctgccggtctgattgccggagtcattgcgtctgcaggtgtcgtgcctgccacgcctgccgcgacgcgggatgaagtcatacacctgaacgccgcctatccgtccggctccgttatggtatgcagtaagaatctgccgggcgacggaaaaatgatacagccgaccgtactgcagatgcggggaaccgtggttaacaggaagcaggacagcgcagtgtatgaggtctcatcgacatggaccattccgggtaaaagcagcagttctgacctgacgctgaagctcagaatgctggagcggatggatgataaaggcagctattcccgcatcgttcctgacagcatgtcggtatcgatgccgtccgtcggccctgcgg

SEQ ID NO: 27246 - DNA, 231 bp, Glycine max
  Peptide Sequence Number=SeqID_144024
gcgaatttcagcaggatttcagacagggcacgggttaatgatgttgaaggtgatgaggatgcagaggcggccggaatatgctttttcacagcgcggggtaaagcagaccggaagcaatacccgccgtcgctgataaactgcggtgtcatgagcaccttatactcagttgttcagaacggttcagtcattacgctgcatcgtgcggaggcaggcggctatgagtcaggctga

SEQ ID NO: 27247 - DNA, 954 bp, Glycine max
  Peptide Sequence Number=SeqID_144025
gccgccagtgcgaccgagtacccgctgccgccgccggacagccgtctgatcggtgaaaacaccacgtataccgtgccaaacgacggccgtccgctggaggcgatcgccgccgactacaagatcggcctgctgggcatgctggaagccaaccctggcactgacccgttcctgcctaagccgggttcggtgctgaccattccgacccaaatgctgctgcctgacaccaagcgtgaagggatcatcgtcaacctggccgagctgcgcctttactactacccgaaaggcgagaacaaagtgatcgtctatccgatcggtatcggccagaccgggatgcacacgccgctggaggtgacctccgtcagccagaagatccctaacccgacctggacgccaaccgccaatatccgtaaacgctatcagtcccagggcgtgacgctgccagcggtggtgccggccggccctgagaacccgatggggttgttcgccctgcgtctggcgatggggcgcggtgaatacctgatccacggcaccaacgccaacttcggtatcggcatgcgcgtcagctccggctgcattcgtctgcgtccgacggatatcgaagcgctgttcaatcaggtgccgcgcggtacgcgggtgcaggtgatcaacgatccggtgaagatttcggttgagccggacggcaaacgctatgtggaagtgcatcagccgctgtcgcgggtagaaagcgacgatccgcagaccatgccgattgcgttgtctaaagcggagaaagccttcgctgcggatgctcagaccgatcgcgccgtgttcgatagcgcggttgtacgccgttctggcatgccggtgctggtcaacgtaggggagagcccgtcggcggtgagtttgactcctgcagcgacgcctgaggcgaataagagcccattcaaggcagcgccaatcagttccgtgaactaa

SEQ ID NO: 27248 - DNA, 792 bp, Glycine max
  Peptide Sequence Number=SeqID_144026
atggcatcatcgtccaaagaacaagtctcgagaagctcgtccaaaacccttaaagttaataattcatttgatgatgaatctaaagaagactctaatgaaaatcagctagccttcattttacgaaagatttacaaaatatggagagacaaatgtggctccagatggaaaaattcctcaagaaggatgcctaaagaaaagaaagataaaggcaaaagctccattatttgctatgaatgcaacaagtctggacacttcaaatctgagtgcccaaaattggagaagggtgatgaagaagccaatatatgcccaatggcagatacaggctctgaagaatctgaatcagatcaagaagataaggataacttgggaaagtttgactcgagaagtgatagtgaaacatttcttagatactctgaaatttctaaggcattcatagtttacaactcaagaaccttaatagctgaagaagttattcatgtgagttttgacaaaaataagcctgataaagatttattagagctagatgagtcttttgtagatctcagattggacgatggctcaatagaaactagcttgtcgagacagaacccagaaacagaagcgttgaccaaacaagtagtccaagaagagattacactaatttctgaagtggaaccccaatacattgacgatgcaatgcaagatgataattggatcaaggtcatgcaagaggaacttgatcagtttcaaaagaatgatgtttggaagttagttgaactaccgaaagaaaataaggatactcataacaagaag

SEQ ID NO: 27249 - DNA, 387 bp, Glycine max
  Peptide Sequence Number=SeqID_144027
atggacagaagagcaaaaactcatattgctactcaactccaaggctcgaaatgtgatgttgtgtgctctatcagaagaggagtacaccaaggtacacaacttaagaagtgcaaaacaaatgtaggacactctcgctataacatacaaaggaacgtcacaggggaaaacatacaacgtatgtttggatgctttcgagccattctcaatggactaaggtctttaggcaaaacttatgataacaatgatcatattgacaaaatttcaagaagtttgactagaaagtggagatcgtgggtaatgacgctaagagctttgaagaatcttgattccttatcccttaaggaacttgttagtaccctcaaggttcatgaacaagaacttcagtag

SEQ ID NO: 27250 - DNA, 387 bp, Glycine max
  Peptide Sequence Number=SeqID_144028
atgctccgaggtcacagttccaatgatgtagagcatccaccgtggcttatgcctagtgatgtggcttggctaggagtccagtcttcttctttggggggagttgaggcttccgcaacccaggagcctcagccagagccagaggttgcacgcgagcccactccagagactactccacaggcttcaccagctacttcaccagttttagaggtctctgaagaggaggatggcgttgttgatgcggattatgcagctaatatgactgcagcacagagcacctgggatccttggcctgttacagatcaggagacacctcagccatcccaagatactccttcctcacctcatggcgagcctgcatcagcccaggatgagcccacaccggcatag

SEQ ID NO: 27251 - DNA, 177 bp, Glycine max
  Peptide Sequence Number=SeqID_144029
gaggcttgccaagcaatcacagaaaggttggagcatttcctcaacctaaggatagtcactgcaggcatagaaatacacgaggtcatggaagactgcttaaggatcactaggggtgtcacaacagagggcaatgtttatgtcaggtcgcgacaaaggcggcgcacggatcaacgatag

SEQ ID NO: 27252 - DNA, 273 bp, Glycine max
  Peptide Sequence Number=SeqID_144030
atgtggatggaccgatttgctcttaccttgaacgggagtcaagaacttccccgattgctagccaaggccaaagcaatggcggacacctactccgcccccgaggagatccacggacttcttggctatttgcgaatcaagtcactcccgcaatttatctctagcaggcattgtatgttggtctcgtcctttgtcacgggaagccggaaggtccacgtcaccccaaatgtgcaatattggcgatcagaattgccattccctggattacggggttga

SEQ ID NO: 27253 - DNA, 327 bp, Glycine max
  Peptide Sequence Number=SeqID_144031
atgtcaaatgaagaattgaagctgcaggattcacgatgtcggatacaatgtccaggacatcctgcccgagaatactggagttgctgtataatgcaagataaaagtcaagtagtgaagctgcaggatccacgatgtcggatacgatgtcctgacatccggcccgataatactggacatataattctattttcaggaaagaagatagatctcatccagcatcaagaagttgtagcccagaaacgcacactgctatataaacatggaggctgcacgagttctgtaccaagtccgggattgaagagttattttgtgagttttgggacttga

SEQ ID NO: 27254 - DNA, 360 bp, Glycine max
  Peptide Sequence Number=SeqID_144032
atgccgatctccccctgcggaagtatcagttggtctgtgccgtcccgacatagggatcacgcccgcaagacacccagtggactcgaagaaatccaacaaggtcctggggtttccagctttggttatgggcctctggatcgcgttcgcaagacacccagcggacccagagaagtccaacagggtcctggggttccaactctgattacaggcctctatcagttctacggagtgtccatcgcccccagcagggtcatcaggcccctattaacagggctttcatcgagaagtattgcgcccccaggcaggcgcagggcgaggcatcatagtagcaggcaacaggcgcaccgccaccacccctag

SEQ ID NO: 27255 - DNA, 171 bp, Glycine max
  Peptide Sequence Number=SeqID_144033
atggataccttagagccctacactagggcaatgaaaggcaccatgcataaacttcaagtcatgacgaaagacaacgattggtacctcaaagccttacactggggcaatgaaaggcaccatgccaaaacctcaagcgaacctaggggtagattagaagttctcacccaatag

SEQ ID NO: 27256 - DNA, 201 bp, Glycine max
  Peptide Sequence Number=SeqID_144034
atgtcaacatggaaggctgatattggtggcgaatcagcagatggtttattgagagatgacatatcagaggactgggttgcagaacttcgacaagccattcagaaagtaaaaaattaccagcgtttgaattctcagtctcaaaatggtcatttgaattctcagtctcaagatggtcatccgaattccgaatctcaaagttga

SEQ ID NO: 27257 - DNA, 1986 bp, Glycine max
  Peptide Sequence Number=SeqID_144035
atgaagttggtgcccaggatccggtattggggtaactatgtggaagttgttcagctaagtaccaactcattgggaggaatgctaccaaatgaaacttctcaatttttaaggttaactgcacttaaggtatccaataactcattggagggatttctcccaccaattttgggaacatatccagaactagaagagattgatcttagcctcaaccagctttctgggtttgtcctaccaagctttttcacctcaaccaaattgattaatcttaatctctccaacaataaattttctggatcaattcctattctatttcaacctccaaataatccattagtttctgctgaaaattttagtctggtgtttcttgatctttcacacaacaacttgagtgggactcttccttcaaatatgagtaggcttcacaatttggcatatctcaatctatgcaacaaccaattggaaggtactattcccgatgaccttccagatgagttgagagtattgaatgtgtcctttaataatctttctggtgttgtgccagaaagcttaaagcagtttcctgactcagcatttcatccaggaaatactatgctggtatttccacattcgcaatcatcaccaaaagatacttccaacctaggtttgagggaacatcggttacataaaaagtctgcaactaggattgccctgattgcatgtttggttgctggtggttttgtgatggcttttgtggctataataatttattataaggcccatcatgaaaaagaaaggacttctaaacaaaatgaagcaatgagcatcacccaagagagtactttcacctcaaatacagaggcacctgatagaaatttgggagcattaccgcctgctcaaagggggtcttctgatgatgcaaggaacattcatccagtgggaaagaagccaatagatcctggcccttttgaattaggtaagaatgaggaaggaacatctaccccaatgtctattttgtcaccttcaaatccttcatcttcaaaaagctatcagtttgagaatcctggttccctcaaagtctcctctccagataaattagttggagacttgcatatatttgatggatccttggtgctaactgtggaagaactttcatgtgctccagcagaagttattggcaggagctgtcatggaacactctacaaagctacacttgactcaggtcacgaattggctatcaaatggttaagagaaggaataactaaaggaaaaaaggagttggcaagggaaataaagaaacttgggactatcaagcatccaaatctggtttctgttcaaggttactacttggggccaaaggaacatgagaaactgattatatcaaattacatgaatgcacaatctttggacatttatctccaggagacagataaaagaaatctccatcctttgtctcttgatgaaaggctcagggtggctgtagaggtggcgcgatgtctgcatttcttacacgatgagaaagccatacctcatggaaatctcaaatccacaaacattttgctagaaactcccaacagaaatgtcctcctcactgactacagcctgcacagaatactcactgctgctggtactgctgagcaacttctgaatgccggcgcactcggttatcggcctcctgagttttctagatcaagcaagccatgcccttccctgacaagtgatgtctatgcatttggagtggtcttgttagagctcctaacaggaagaaattctggagaaatagtttctgggattccaggggtggttgacctcactgactgggtgaggttcttagccgaacaagaccgttcaaaccagtgctttgataggtctataatggacaggcacaatggggaaagacaatctaaaattcttgatgaaatgctaaaggtggctcttagatgcatccttccagcatctgatagacctgacatgaaaactgtctttggtgatctctcaacaataaggtag

SEQ ID NO: 27258 - DNA, 606 bp, Glycine max
  Peptide Sequence Number=SeqID_144036
gatcccacaagtttatacggataaccactcgggtatttccgcccgtcagcgtgactcaaaagtcagtatgacagatcttttgagcaccgaagatgaccaaaaagtttatacggataaccactcgggtattttcgcccgtctgcgtgactcaaaagtcagtatgacagatcttgtgagcgcggaagataacggcgcagaagacgacgttagtctctgcgtgctaccaggcttttcgtcttacagactacaaaaagtttatacggataaccactcgggtatttccgcccgtcagcgtgactcaaaactcagtatgacagatcttgtaagcgcggaagatgacgccgcaaaagacgacgttagtctctgcgtgttatcaagcttttcgtcttacagaatgcaaaaagtttatacggataaccactcgggtatttccgcccgtcagcgtgactcaaaagtcagtatgacagatcttgtgagcactgaagatgacgcttttcgtcttacaaacaacaaaaattttatacggataaccactcggggtatttccgcccgtcagcgtgactcaaaagtcaatatgacagatcttgtggagcgcggaaagatgac

SEQ ID NO: 27259 - DNA, 285 bp, Glycine max
  Peptide Sequence Number=SeqID_144037
atggagaattggcgtacaacgctactcaataacttcgcggggctccagagtcgtaggtggaggatgcatgaacagcgccaggcaatgacattcatggggctccgtaaaaaagtggagaatggagaattgtggagaatggagaattggcgaacagcgctacgcaataacttcgcggggctccagactcgttggtggaggatgcatgaacagcgtcaggcaatgacattcatggggctccgtaaaaaactggagaatggagaattggcgaacagcgctacgcaataa

SEQ ID NO: 27260 - DNA, 237 bp, Glycine max
  Peptide Sequence Number=SeqID_144038
atgctcccacgaacgaaagttcaagatcatcacaggcaccaatcacacgatacaaaaatcgcaaagcctaagcgtgtccacatgacactctcacttaggaaaactaggcagcaagtgtcgaggtcactctgtcgtgcacatgcaactcccccccagggtgatcaacctaagtctcaaggaagttcaccaagagacatgcccccaagtacaagtatttttccttatgaaaaactatga

SEQ ID NO: 27261 - DNA, 978 bp, Glycine max
  Peptide Sequence Number=SeqID_144039
atgtttatggcttcggcgttgtctattgtggcttataccggtgccatgggtccgctggcccagtctttttcgacttttatctccctgttcaccgccatgctgctgtcgcctttgattgcatggtataccaaaggtaaatattacctggccaggcagcgccccaaatatttgcaacccaatgcaaccaagcagtgcgttatttgcgagcgtgaatatgaggtcagcgacatggcgcactgcccggcttatggcggggcaatttgttccctttgctgctgcctggatgcccgctgccatgatacttgcaagccgcatggccggctgagtgcgcaatgggaggcgttgaataaaaggattttgcccaaacagctatggccgcacctgaatggtggtgtggcgcactttttgttgttgatggtgattgcggtcattttatttggggcgacgatcagcctgatttacctgcatgatgccttgaccattggtcgagagtccccggagttgatgcatcgtttcagactgggctatctgaaggtatttgtggccatgttgtttttgggcgggatcgtcgcctggtggctggtgttgacctcagccagccggcgtgtggcacaagaagagtccaaccggcaaacgggcttgctgcttgaagaaatcgagtcgcacaagaaaaccgatgcgcaactgcaaaaggcgcgccgcctggcggaagaggccaaccaggccaagagtcgctatattactggcattagtcatgagttgcgtacccctttgaatagtattcttggttatgcgcaattgctgactaacgatgacagtattcccgagcaccgcaggcaggcgattagaaccattagccgtggtggcgaacatttgttatcgctgattgaaagtacgctggatattgcacgtattgagagcggcaagatggcgtttgatgtcaagcctctgcactttcccgagtttattagccagata

SEQ ID NO: 27262 - DNA, 243 bp, Glycine max
  Peptide Sequence Number=SeqID_144040
atggctaccattgcattattgagtagatatgggagtaagttagcatacggcactggaattagggtgaattgtacatgcttcttttctggaaaattccttccttggtcggtgttttggttcgtgttaagggtggtgtttggtatcggatgtgcagcaggagattttgtggctgatttaggggtggcttttgtggatgattgggtgttcttggctgataaggtggtgggtaatgagaagggctga

SEQ ID NO: 27263 - DNA, 777 bp, Glycine max
  Peptide Sequence Number=SeqID_144041
atggctgtggtgaaggaattttatgctaatctatacagcccagaggaaccagcccctaaacaagctagagtaagaggacatctgattaagatcgatgcagacaacctgaatgaatttcttcagactctagtgggccagccatggaaacttctcagaaaagatctgacgacactggcccagacatggagtgtattctcttactccaacctagctcccacatcccacacctcagatttgaacatggacaaagctacgttggtctatggcttggtgtgtaacatggacatgaacatcggagcccttatctcaggagttacctctgatagtctgacctatgagagccttagcccgaccattaacttggcctacattaagaaaaactattggaatgtggaagatttgacagttaactttagaggggcaaggaaggcaagggctcgactagctgatgttccctcttcttctgctcctccagctccttccacttctactactcctacaccagctcctccaggcctatctgcccaggactctcagtgctttgaagccatgcttcagagtcttcatcaaggacagattttgttaatgcagagcttgcaggtggtatctcctccaggatccactctgttactggaacagttcatggagaaggatgcatcttctgaagccaccatccctggagcttttgattttttaggtggaggattagagatgagacccgataaggctgcttctcctgagccaatactagtaccagctgatccaccatctccagtg

SEQ ID NO: 27264 - DNA, 1050 bp, Glycine max
  Peptide Sequence Number=SeqID_144042
atgagaagagaacaaaccccagtatcgttacgcatgttccctttacgggtaatatgggaaaacaaagaaggtctttcagacgagttgcctcacttaatctacgtatctagagaaaagaagcaggaacatccacatcaatataaagctggtgctatgaatgtgttgacaagagtctctggagtgatgacaaatgcaccctttatcctaaacttagattgtgacatgcacgtgaataatccaaagattgttctacacgccctgtgcattttattagattcaaagggagaaaaagaagttgcatttgcccaatgtatccagcaattctatgatggattaaaggatgatcctctcggaaatcagcttgtggcagcgtttcggtacttggggggtggattagcagggctccaagggatattttacttaggaacaaattgcatgcacagaagaaaagtaatttatggcctttctccttatcatggcattcaaaatggaaagaaggatcatggcgtctccaatgggaaattctcagaaaagaaaacaatatttggtacatcaaaggggtttgtggaatcagctactcatgctttggaagggaagacatttactcccaataacaatatttgcaaatctcttgaggctgcgagtgaagtttctagttgtgaatatgaatacggcactgcttggggaaaacaggtgggttggatgtatggatcaacatctgaagatttacttaccggactgaaaatccacacaaaaggttggagatctgaagtgtgctcaccagaactttcgccttttatgggatgctcacctcaagatattttagttgtaattggtcaacaaaagagatggatctcagggttgcttgatatcctcctaagcaagcattgtccaatttttggaaccctatttggtaagctccaattcagacaatgcttggggtatctttggatcactacttggagcttacgacccgttcctgaaatatgttatgctgctctccctgcctattgcatcattaataactccagtttcttgcccaaggtatga

SEQ ID NO: 27265 - DNA, 210 bp, Glycine max
  Peptide Sequence Number=SeqID_144043
gaagagaagggcttcagttctagggttacagtgataggggtagaagctccatcagcctatcatatggcaccaaggagtgaagctccatgtcaggttcctcctgttcctgaagcaatagctggagctattggtgtctcacctgtgagtgtgggattggatggaacaacagctaagaagaaatctgattctattttagcaagggagtgttga

SEQ ID NO: 27266 - DNA, 246 bp, Glycine max
  Peptide Sequence Number=SeqID_144044
atggctatgaattgcggtggcgttgtggttcggtttggctacatagtgggtccccctctctactggcacttcattgaacacgtcaaccactcttcttcatcttcttcttgcgctccttgcgtctgcgattgctcttctcaacccatcattacgattccccaagtaattcatgaatgttgtaccacgtcgggactaactggcataagcaataaggcaatatgcaataggcatggtattatgatatag

SEQ ID NO: 27267 - DNA, 1323 bp, Glycine max
  Peptide Sequence Number=SeqID_144045
gaactcggacaatggatccccgccactttgcttgtgatttacaacgtgtctactcttttagagaacttgaaaataggattgtcaattcgaacatggtgtaacaatcaacgaatggcaaggataaccaccatgaattcttggttttttggatttttggccatcctacttaagcgattaaggatatctaacattggctttgaaataacaaggaaagacgaaacattttccaatgagggtgcaaatgaaaatgatggtagattcatttttaacaagtctccagtttttatacctggcacaactattttgcttattcaactcacagcactggttaccatgtggttgggatggcaaccacctgttagaaacaatggacatggatctggtgttggggaagtgttctgtagtacatatttggttgtgtgctattggccatttttgaaagggttatttgagaaaggaaagatacctgaacttccatggatggatctatttgtgacaacggcagatccgattcttgagccacccatcatcacagtcaacactttattgtctcttttggccctagattaccctgcaaacaagttagcttgttatgtttccgatgatggtgaagagagtgatacaatccatcccgcaaggacattggatagaagactccaagtagattgggccaaagatgcaagagaaggccctagggttcttatgagccttagggccaatgaagattcgctagaatttagacaagaatggttaagagtgaaggacgagtatggagaacttacccttaaaattgaaaatacagctacaaaaccgaatctgtttcagcctgttggagagcatgcagagttctccaaagcacagccaacaaatcatcctaccatacttaagctgttctatgatggattaaaagatgatcctttcggaagtcagctcatggctatgtctgtggtgcgtcaaatttctaacattattgggaaaaatccaattaggagaaagctagcaaaagaatacgtagcaagtggatttgcaggacttcaaggaattatgtactcggggacaaattgttttcttagaagaaaagttatttatggcctttctcctggtcacgatattcaaattggaaaggagggtcttggtttcaccaatgggaagacatttgctagcattgataaccttggcaatgttgatcttgaggcagcgaaccaagttgctagttgtgcattcgaacgcaacactgcctggggtcaaaaggtggcaaaattaggtggggtggatgtatggatcaacatcagaggatgtgctcacggggctaagtatacatag

SEQ ID NO: 27268 - DNA, 456 bp, Glycine max
  Peptide Sequence Number=SeqID_144046
atggtgactcaatttggaacaattcctaaaacatttatgtatcttttagtgattggatacatgcatgtttttttaaccagtgctatgaaagaattagagagatttcatgaatgtgcaaagcacaatccaaaggtggatggagacactgaaaacaattttgcggagttactgtcggaagaactaaatcttcgggaaactgaagctttgaaaaatcagcatcgtgctgacatggctctgctggagtctaagaagattgcatctcagtatcaaaaagaagcagacaagtgtaattcaggaatggaaacatgcgaggaagccagggaaaaagccgagatggcgttagtggctcagaagaagctctctgcattgtgggaacagagagctcgtcagaaaggatggaatgaagggcttgccaaatctaagaaacagtctaaagggaaagtacacactgcttag

SEQ ID NO: 27269 - DNA, 2949 bp, Glycine max
  Peptide Sequence Number=SeqID_144047
atggattccctcatcttcctcctccttctcatccttctctcttaccgtgtttactccattagccactattctttcccttggtttcttgcaaccctgtgcgagtcatggttcaccctcacttggctcaccaccattagcaccaaatggactcctgcacgaaccaccacccacctagaccgtctctttctccgggtaggtgagcttccacaagtggatgtgtttgtgacaacggcagaccctgtgcttgaaccacccatcatcacaatcaacactgtgttgtctcttttggctcttgattaccctgcaaacaagttagcttgctatgtttctgatgatggctgttctcctcttaccttctatgctcttgttgaagccaccaaatttgccaaactttgggtacctttctgtaagaagtacaatgtacaagttagagcaccgtttagatacttctctgaggatgccacggttgacaaaaacactgatttgcaagaatttgaacaagaatggtcactgatgaagaaagagtatgaacaactttgccgtaaaattcagaatgctagccaaaaatcgaatccgtgtccactcgttggagagtatgcagtcttctcaaaaacagagctgaaaaatcacccatccatcattaaggtaatatgggagaacaaagaagggcttagagatggagtacctcacttaatctacatatctcgagaaaaaaggccacaacatccacatcattacaaagccggtgctatgaatgtgttgacaagagtctccgcgttgatgacaaatgctccctatatcctaaacgtggattgtgatatgtatgtgaacaatcccaagattgcacaacatgccctctgcattttcttggattcaaagggagaaaaagaagttgcatttgttcaatgtccccaaagattctatgatacagtaaaggatgatgcttatggaaatcagcttgtagctttgcctatgtacataggtggtggatttgcaggacttcaggggattatatacgcaggaacaaattgcttccacagaagaaaagttatttacggtctttctcctgattatgacattcaaaatatgaagaaggattttggtttcattaatggaacaaagtctcaaaagaaaacaatgcaaatatttggagcttcaagagggtttgttgaatcagctaaacatgctttagaagagatgacatttactcccaatgataagcttttcaaatctcttgagcttaaagcagcgaaccaagttgctagttgtgattatgaatacagcaccgcctggggtaaacaggtgggatggttatatggatcaacatcagaggatgtactcacaggtctggtaatgcacacaaaaggttggagatcagaagtttgttcaccagatccaatggccttcatgggctgttcacctcaagataacctaggtcaaatgggccaacataagagatggtcctcaggcttgtttgacattttccttagcagccactgtcctatttttggcactctatttggtaagctccaattcagagagtgcttggcgtacgtttggatcactaattgggccttaagatccgtgcctgaaatatgttatgcccttctccctgcctactgcatcatcaccaattccagtttcttgcctaataaggaacccggcatgtggatccctacgagtgtgtttgtgatgtacaacgtagctactttattggagcacttgatatcaggcttgtcagcaagaacatggtggaacaaccagagaatgggaagaataacaaccatgacttcatgcttttttggatttttggatatcgtccttaagcgattgaggatatctgacactgtctttgaaataacaaagaaagaccaaccatcttccaatgatgaaaatgtgggaaggttcattttcaacaagtctcccatttttgtaccaggcacagccattttgctcattcaactcacagcactagttatcagctggtggaggtggcaacaatctcttcttaagaatgagcgtacatatgggctaggtgaggtgttttgcagtgcatatctggttctatgctacttgcctttgttgaagggattgtttgcgaaaggaaagtatggaattcccttatccacaatatgcaaggcaatgggcagtgatggaactgccatccccttggatggaatcatacctgcgaaaaaggtacgccacaatcaaagccgcggtgagtgtgacaacgtccttacccgcgcactgtttattggacacactgggcgacccggtctgaggcccattggaccaatacaagtagttcaacaactgggcccctttctcttgggtgaaccggtccggcttgaaccggtccggttcgtcgaatataacggagtccctcatgacgagcttctgaaagccgcacagcaactcgcccttcttgacgtggaagaccgagtcgtgcgaactcaaccggaagtcctttcgggctcgaccgtactggagtggaaccggagggttcatgcgcagcgtttcgtagaccacggattggatcaggtccatctctttgaccgagtcgaagttgctggctatggcatcgatcagagaggggagaaaaatggagaatccgccgtaggagttgaagcccagcacgaagagcaaattgtggatggcttcttcttcgttgtagaggttgttgtagtttccaccgacgaggaagaaagggtaggcaaaggagtggaggaagatttcttccaggggttgaaggatgcccacgctgactggtctgcaccggcaaggactttgcagaggaacgtgaagagaaactgttgtaacgggaaaaggtacgaaactgatgaggatttcgagagtgatgcttcgatgttgtcccacagtgtgtctaggtttgattctagttctgatacccatatgcctgagcttcttttcagaatatccatgatgtag

SEQ ID NO: 27270 - DNA, 918 bp, Glycine max
  Peptide Sequence Number=SeqID_144048
atggatgacatatttgaaaatgttgatgggtatttgtttaagagtctgggttttaggtcaaagaaaaatgcatgggcaggcactgatcattggaagtttcaaaaagctaaaggctcagaatcagaggttcatcgtgcttctgaggatgtgttggtccagaaaaccaggcagccagggacaaagagacaagtcgaagttgatttagatttcacaagttttgtcgagaaaaaaatatccgatatcttttctcctcccaggaatcccaaatcattacagctacctgaaaatataccacctagcattacaaaacttccagaggactgccactatgaaccagaggatcttgtcaatttatttcttttgccttatgtaaagtgcattgggaggaaggcaagaaagctctcaggtgaatttgcagatgtatcaggagaacaatgcaataactatgaatcattcccttcctgggacaatggaagtgtttgtgatgatgatgttactgatgtacatagtgaaatggatgactctacctcacttatttctcagccacgtcagttagagcataagtatgattatttccaaataacacagatcaataaagttgaagtccagtatgacaaaacattcaaacaagtcaatgttcaggctctgaaaataacactttgggaccatattcaagaatccgttcaagttccgattcagggtaaaaaagaagtggtatctttcaagcacatgttgaccaactttcctagtaaatgcaatgctgctgcaactattagtgacatatctccacatttgtgtttcatatgcctattgcatttggctaatgagaaaggattgaacatccaaagctgccccaacttggatgatcttggcatatgcctacctgatgatggtgccactattactggaacagtttag

SEQ ID NO: 27271 - DNA, 327 bp, Glycine max
  Peptide Sequence Number=SeqID_144049
atgtcaactagccgtaactgggctctgttatgtgaaacttggatgttggagctacaatatgcagctgaaacaagtgctctggagcctcctcacaagtatgttccttgggtagttgtggatggagaaccactctatgaggattatgagaacttcttaagctatctttgtaaggcttataaaggcactgttacaccccaaagttgcacccaagcatcatacctaagagaagtgaatgcaaagcctaagcattcggtttgctacaaggacagtgggattatgctaacatgggaaaaagtgaggtcaaccattgcatcatggatgcactag

SEQ ID NO: 27272 - DNA, 516 bp, Glycine max
  Peptide Sequence Number=SeqID_144050
atggtatctgtttctctgctcttattcctatctttctttgccttctttgcaccctctgaatctcacgacaaagtctcgttggaattgtactacgaaagcttatgcccctacagcgccaacttcatcgtgaatcacctcccaaaaatcttcaccccagatcttgccccaatcgttcacctcaaactcgttccttggggcaatgccaaactccgtgccaacgccacctttgactgccagcatgggccatatgagtgcttgctgaacacagttgaagcctgtgcaattcacatctggcctcaactcgagatgaagtctggtgccacctggacgaatgagttgttggtgaacttagaaagcaaacattttcctttcatctactgtgttgaggatctggtgtttcagagtaagcgtgaggaatgggaatcttgttttgagaaactggatcttgattcggaacctattaatcagtgttataatagtgaacatggaaaacaggtgaagaaaataagaagataa

SEQ ID NO: 27273 - DNA, 921 bp, Glycine max
  Peptide Sequence Number=SeqID_144051
atgcaaaacagcggggtcaccctaagggctgaatctcaacactttgcaactgtacatgatgacaatccctttgtagcttcaatcccttactttggcttcattgatgaaatatgggagcttaactatgtcaaatttactgtttgtgttttcaaatgtaagtgggttgacagcaacaccggtgtgcggactgatgatataggatttacgttggtagacttaaagaaactagcttaccagaatgaccctttcatcatggcagaacaagctaagcaagtattttatgtgcaagacccttgtgatgaaaggtggtctgtggttctaaacgggaaaacaattggtgttaatgtagaagatgatgattcatacatggacacttatgttagtcctttgtctacacaaatgacttctaacaacgttggagaagaagaagctgacgatgcggaatttcaaatccctgaagcttctgacaataggacaaagaagaaaattcttcagattgtcggcgagcgctggaggcaatttaaatctgacttgactaggaaatgggcacttgcagtcgacaaggacggtgcggacgacattgtctgtgaaaaatatggcattagcaaggagaaatggactcagttttgtcagacccgtagagacccctcatgggaggatgtacgaaaaaaggcacaggcctcccagaagcaaaacactgccccccacgtattgtctcgtgggggttatgaatatttagaagaaaagctcatggctgagaaggcaaagaaaagactggaagaagctgcccagtctggaagcactgagggcatcattgaccctccatctcccatcagacgccacgtgaaatggaagatggcccacacgaagaaaactggacagatgacgtctgaggcagcaaaagaaatagctgacaggatt

SEQ ID NO: 27274 - DNA, 249 bp, Glycine max
  Peptide Sequence Number=SeqID_144052
atggggatcatggaggtagaaattgtggcggacgtgtgggactttgacattgtgaagcacacgatgcacgatgtgggccccatagacgtcctgcttttgaattacaacatgttcatgttgcttcttcctaacataaatctaatggcaacattgaatctcctcaagttcgcattaccaaaaagtgtgagaacgacgacacatgtatctagcgttaacattgataactccaatttggatggaatgacctaa

SEQ ID NO: 27275 - DNA, 426 bp, Glycine max
  Peptide Sequence Number=SeqID_144053
atgggaattctgttttcagcatggaaaagttgtgctaagatgccagggaaacctgacactgatgattggcgtgtagagcgtggggagcagattcagtttcagtcttccatttactctcatcatcagccttggtggcgcggagtgggggaaaatgcctccaaatcatcttcagatgatcagttaaatggttcaatcgtgaatggtatcacgcggtctgagaccaatgataagtcaggcggaggtgttgccaaagaataccaaaacatcaaacatgccatgttgtcaaccccatttaccatggagaaacatcttgctccaaatccccagatggaacttgttggtcattcagttgttttaacatctccttattcagatgcacagtatggtcaaatcttgactacttacgggcaacaagttatggtatga

SEQ ID NO: 27276 - DNA, 165 bp, Glycine max
  Peptide Sequence Number=SeqID_144054
atgcctttgccacttgaaatggaagaggagcctgtttatgtcaatgcgaagcagtatcatggtattttgaggcgaagacagtcacgtgctaaggctgagattgaaaagaaaggaggggattacacagctaattgggaggggtccactatcctgaaaaaagattag

SEQ ID NO: 27277 - DNA, 1428 bp, Glycine max
  Peptide Sequence Number=SeqID_144055
atgtatatttgcttaacaactaaagcttgtggagagttggttcgtgacaattgcattcaaggtactcattgggttggtattaacttcttttcatctcatgggagaatgattcatggcttgcgcatcaaagatggaaaagctacatatgtttcccgttttgtgagaacttctcgtcttaaacaagaagaatactttggaggctccaaatttatgaagattggagatctcaaaggtctattcggactcttaatggttaacatacatatgctgagaactaaatggaaagtgctggatgtttcttatggaactggaacagctaatactgctctcgtatatcaccatgggaaacttctagcactctcagaagcagataaaccctatgctattaaagtttttgaagatggtgatttgcagacacttggcatgctagattatgacaagagattgggccactccttcactgctcatccaaaagttgacccatttactgttattccaacgaataaatatcctgtatgcaggggagatgtttacacatacagagtaatttcaaaggatggttatatgcatgatccggtacccataacagtatcagatcccatcatgatgcacgactttgccatcacagagaactacgcaatatttttggatcttcctttgatttttaggccaaaggaaatggtgaagaataagacactgatattctcatttgattcaaccaagaaagctcgttttggtgtgctacctcggtatgctaaggatgaaaagcttattagatggtttgagttacccaactgcttcatattccacaatgccaatgcttgggaggaggaagatgaagttgttctgatcacatgccgccttcagaatccaaatttggatttggttggcgggactgccaaggaaaagcttgaaaatttctcaaatgagctgtatgaaatgagatttaacatgaaaaccggtgaagcttctcaaaagaaactatcagcatctgctgtagattttcctagggtgaatgagagctacactggaaggaagcaacgatatgtatatggaaccacattagacagcattgcaaaagttactggcattattaaatttgatctgcacgccgaaccagatcatggaaaaacaaaacttgaagttggaggaaatgttcagggtctctatgacttgggaccagggaagtatggttcggaagctgtatatgtccctcgtgtccctggtacggattctgaagaagatgatggatacttgattttttttgcacatgatgaaaataccagaaaatcttttgtgcatgtcatcaatgcaaaaacaatgtcagcagatcctgttgcagtggtcgaattgccacatagagttccatatggtttccatgccttctttgtgacagaggaacaactgcaagagcaggggaaactgtga

SEQ ID NO: 27278 - DNA, 3639 bp, Glycine max
  Peptide Sequence Number=SeqID_144056
atgtatatcaaggagatttgcctggaagggttcaagtcctacgcgacccgcaccgtggttccgggctttgaccctttcttcaacgccatcaccggcttgaacggttccggcaagtccaacatcctcgattccatctgcttcgtcctcggcatcaccaacttgcagcaggtcagggcttccaacctccaggaactcgtatacaagcagggccaggccggcatcaccaaggccaccgtctccgtcgtcttcgacaactcccacagctccagaagccctctcggatacgaaggacactccgagatcacagtaacaagacagctttgtttgcctccgatgcttcaacttttcggttttaggattgtggttgggggcaggaacaagtatttgatcaatgggaagcttgcacagcctagtcaagttcagaacctttttcattcagtgcagctaaatgttaataatccacatttccttataatgcaagggcgcatcactaaggttttaaatatgaaaccgcaagagatattgtctatgcttgaggaagctgcggggacgagaatgtatgagacaaagaaagaggctgctcttaaaacacttgagaagaagcagagtaaggttgatgagattaacaagcttcttgaccaggagatactgcctgctctggagaagttaaggaaagaaaagacacagtacatgcaatgggctaatggcaatgcagagttagataggttgagaagattttgtattgcttatgagtatgttcaagcgaagaggattaaagacaatgctgcttctgaggtggaagaagtgaaagccaggatagccgagattgatgacgttgctaagataaataaggtggaaataaaggaaatggagaccaaaataactcagttgactgctgaaaaggaagcaaacatgggtggagaaatgaaatctctgtccgagaaggtagatgcactttcccagaatcttgtgagggagacatctgtactaaataataaagaagacactttgaggagtgaagaagccaacaaagcaaatcttgttaaaaatattgaagaattgaagcattctgtacaagagaaggcctctgctgttaaaaaggctgaagagggggtggcagatctgaaaaataaagttgatgagctcacaaagagtctagaggagcatgaaaaagaataccagggtgttttagctggcaagagcagtggtaatgaagagaaatgcttagaggatcaattaagggatgcaaaggtagcagttgggagtactgaaacagaattgaaacagctgaaagccaaaattagccattgtgaaaaggaactgaaggagaaaacaagtcaattaaggtcaaaatgtgaagaagctaatgctgttgaaaatgagctcagcactagaaaaaaagatgtggggaatgttagaatggagttggagtctctttcttataaagagggtgagatggaagatttacaaaaggagcgtatgactgagatggactgtgtgcaaaagttgaaggatgaaatacgcaatctttcagcaaacctggcaaatgttgaatttacatactgtgatcctgttaagaattttgataggtcgaaggtgaaaggtgttgttgcaaaactcatcaaagtaaaggataggtccacaatgactgccctagaggttacagccgctggaaagttgtataatgttgttgtcgacacagaaaatactggaaaacaactactacagaatggcaatcttagaagaagagtgacaattatacctctgaacaagatacaatcctacagtgtttcctccagagttcaacaagctgctgttagattggtgggcaagggaaatgctgaagtagctctttctttggttggttatgaagaagaattgcggagtgcaatggaatatgtatttggttcaacctttgtctgcaaaaccattgacgctgcaaaggagatctgcattgttcttttcatatgcataactttggagcttgatggtcttttctataagtatttggctactgtggcatttaatcgggagattcacaccacaagtgtcactcttgaaggagatatatttcagccaagtggtcttctgacgggtggaagccgcaagggaggtggtgatcttttggggcaacttcatgctttgtctgaggctgagtcaaaactttcagtgcatcaaagaaggttgtcagagattgaggcaaagatctcaaagctcctcccacttcagaaaaaatttatagatctcaaagcacaattagaactgaagttgtacgacctttcattgtttcagagcagagctgagcaaaatgagcatcataagctcggagaattagtgaagaagattgagcaagagcttaatgaagtaaaatctacagtgaaggacaagcaacttttatataaggactgtgttaaaactgtttcatctcttgagaaatcaatcaaagatcatgacaataacagagaaagtaggctaaaaggcttggagaaaaagataaagacaatcaaatctcaaatgcagtcatcattaaaagatctgaagggacatgatagtgaaaaggagagacttgtaatggaaatggaagctgttatacaggagcaagcatctttggagaatcagttagcatcattgggaacactgatcagtaatcttgcctctgaagtagaagaacaaagatccagtgttgttgctgcacgggataatcttgatcaagttcagtcacagctgaaatcagttcgcctaaaaatgaaggaatgtgatcaggaaatcagtgctattattaaagagcagcaaaagcttgaacataaaattagtgagagtaatcttgaaaggaagaggatggaaaatgaggtaaaacgaatggagatggaacagaaagactgctctgtgagagtagataaattaatagagaagcatgcatggattgcttctgaaaaacagttgtttggtagaagtggaactgattatgatttttcttctcgtgatcctactaaagctagggaagaacttgagaagcttcaggctgaacaatctgggcttgagaaaagggtgaacaagaaagtgatggcaatgtttgagaaggctgaagatgagtacaatgatttgatgtccaaaaaaaacataattgagaatgacaagtctaaaatcaagatggtgattgaagagctagatgagaagaagaaggagacactaaatgttacctggatcaaagtgaataatgactttggatccatcttttctatgctactaccgggaacaatggccaagttagaacctccagaaggatgcagcttccttgatggtcttgaggttcgtgttgcatttggaagtgtgtggaagcaatcattgtctgaattaagtggaggtcagcgatcactgcttgcactttctctgattctggcactgcttctgttcaaacctgctccactttacatccttgatgaggttgatgcagctcttgatttgagccacacacaaaacatagggagaatgataaaggctcactttccgcactctcagtttattgtggtttccttgaaggaaggcatgttcaataatgcaaatgttcttttccggacaaaatttgtggatggtgtttcaactgttcagcgaactgttgcagctaaacaaagcaaataa

SEQ ID NO: 27279 - DNA, 834 bp, Glycine max
  Peptide Sequence Number=SeqID_144057
atggcactaaaattttatggggaaagacttcgtctagcccgcctaataaagggtgttacgcttcaaaagattggagatgctgtcgctgtaactcgtcagagcatacatcaatatgaaagtgacgttcgggctccagctacggacgttcttaatgcgctagcagagtatcttgaagtttctcctggcttctttagcgtgcctctttcaggagaggttaagccggaacaatgtcattttcgtaaaagactcacgactccagcaggagtgaaggacagagtacaggcgtatagtacaatacttgagcaaaataacagcgagattccagagttaactccgcccattattgagaaaattgccgaagttgctcgtcttcgttggggcttaacgtcggatgctccaatagataacatgataaatgtcttggaaaatcagggagcgatagtcacttgttttgatggtgtatttgataaagtagatgcattatcagttagtagaaaatttcctattatgatacgtaataaagccagggaaagtgcttgccgaatgcgatttgatctggtgcatgagtgtggtcatctcattatgcatgacggtatcgaaactgggtgtacaaaaacagtgagagaggctgatatatttgctagcgctttcttgtttccacgagaatctttcgcgaaagaatttccgacctgtttaagcaaagtagggagcattgtttggaaaaaaatttatgaattaatgttacgttggaaggtaagtgctaaagcgataatttttagagtaaactttctaggattcataaatgctcaacaatacaggaatgcaaatgtttag

SEQ ID NO: 27280 - DNA, 2206 bp, Glycine max
  Peptide Sequence Number=SeqID_144058
atgggtcgacctagaggtgatgaaaagtactggaatgaagtaacgagttttgaagagaacgggaagcagaagtggaagtgcaagcattgtgaaaaaacgtatggtggaggttattcaagaattaaactgcatttagataaagaacaaaaaggacaaggcattactaaatgccccgtttattgtagcaatgaagaagttctcaacatcattgcttccacttcaatccatccacaagaaactgtaaatacactgaatccattacaagtggttgaagatgttgttgctggcgaaatgattgtccctgttggtgctccaattaaccatcaaacaaataatgaatcaacaagtttattcgaaggttgggcaccagagcatgctattgtcggaagcaacaattcgaatggtattttccaaagtaagattagtgtgataaatgagttggtttccgatctatcaagagaggaagatgacatcaaggaacaattagaatggctagaatctcgcggcaagaagcgcaagggtgatgttgatgactggatggatgaactacgagacctgaagaaacatgttgctgatgtggattggttagggttcactaacttttatgcatcggatttggttgataaattgcgaaagcataagattgataagcctctggtgttgtcaaatgaatttgttggtgaacaatttgagttaaatgttggaaagatgtggaagcttctggtggatgaccaagttttcgttattggcataaatggaatggggggagtggggaaaacattcctagcaacttatatggagaatgagataaaaagaaagggaagtttcaggcatgtcttctgggtcactgtttctcatgatttcaccactttcaaattgcaacatcagattgcaaaaaaaataggggtaaaacttgatggagatgatgagagatgtagagcaacaattttgtcatcggagttggagaaaatagaaaattcagtacttattttggatgatgtttggagatatattgatctacaaaaggtgggaattcctcttaaagtaaatggcaaagtaaatggcattaagttgatcatgacaagtcgtttgaaacatgtgtgtcgacagatggattgcctaccagataatacaatacaaatataccctttgaaaaaagaagaagaagaagaagaagcttgggagttatttttgctaaaacttggacaccgtggaacacccgcaagacttccccctcatgtactagagattgcaagatctgttgtaatgaaatgtgatggtttaccacttggaatcagtgcgatggctcgaaccatgaaagggaaaaatgagatccattggtggagacatgcattgaataaacttgacagattggaaatgggagaagaggtcttaagcgtactaaaacgtagctatgacaatttaattgaaaaggacatccaaaaatgtttcttacagtctgcactgtttcctaatcatatttttaaagaggaatgggttatgatgcttgttgagagtgggttgttagatggaaagaggagtttggaggaaacatttgatgagggacgtgtcataatggataaactcattaaccattctttgttgttaggttgtttgatgttacgaatgaatggtctggtgaggaagatggcgtgccatatcttgaacgacaatcacacttacttgataaaatgtaatgaaaaattgagaaagatgcctcagatgcgggaatggacagctgatctggaggcagtttctttggcgggtaatgagatagaagaaatagcagagggcacatcacctaattgtccacgcttgtccaccttcatcttatctcgtaattccatcagtcatattcccaagtgttttttcagacgcatgaacgctctaacacaacttgatttatcatttaatcttagattaacatctttgccaaagtcgctgtctaagttgaggtctcttacttctttagtgctccgtcaatgttcaaaattgaaagatatacctccactgggagatctacaagcattgtcaagattggacatttcaggttgtgattcgctcctcagggtaccggaaggcttgcaaaatctaaaaaagttgcaatgccttaatctttcccgcgatttgtatttatcattgttacccggatgcgcactgcccggtttgagcaatatgcaatatctggatctccggggttcgtcag

SEQ ID NO: 27281 - DNA, 378 bp, Glycine max
  Peptide Sequence Number=SeqID_144059
atgagaagggcaagaggcaacggtggtcgctttctcaacacaaagaagcttgaaaataacaattctaattccacttcagacaaaggcaacaatactcgtgcaaacgcctcaacaaactcgcctaacactcaacttttgttcaccaacaatttgaatctaggctcatcaaatgtttcacaagccacagttcagcacatgcacacagagcagagtttcactataggttaccataatggaaatggtcttacagcactataccgttcacaagcaaatgggaaaaaggagggaaactgctttggtgaagatgaagggctttatctcatccaacttgtgatgctgtatagaaggcaattcattcttggcttagttaagtggtga

SEQ ID NO: 27282 - DNA, 1185 bp, Glycine max
  Peptide Sequence Number=SeqID_144060
atgcagctttctcatttatgtggccgatggtttccatctccaactccacacgggacccgttggtctgaggtggacagcttgagttctgggcgggatctgcaaaatgcaaatccagtatataatcatagaacaagttttggctcaagtgtaagtgattctgatcgtcctagacatcgtggggttgaggctgcctattcttttgttggaatgcattgcatctttgatcagtgcaaagcctctgttacggtgttgaagtttgggcacatgagttctgatctacttgcttatggggcatcagatggaaccttgactgtgtgcagtgtatctgagaatccttcagtcatcaaacaattaaacgggcattccaaagatgtaacagattttgattttacatcaaacaatcaatacattgcatcgtcttcattggataaaaccgtgagagtatgggagatagcaaaaggtatttgcatacgggtgatatatggagtctcttcacaattgtgtatccgttttcaccctgtaaataacaacttcctttcagtaggcaatgcaaacaaagaaatcaatgtgttcaattttagcactggaagggtaattaatagatcaatatttgacagtgaagttacctctatggaccatgatcatacaggacatcttttattttgtggagatgcacagggatgtatatactcagtaaatatgaactcccacacaggtgtactatctcgctctcatcgttaccgaagtagcagcagacacaaatccgctgtcacaacagtgcaatatcggagtttctctctactggctcggggacctgtgttgttgacttgtacccaggatggaaacctgtctttcttcagtgtggctttggagataaaaggttatttaactcttagatgctcgctcaaattagctccacgtatacacaaaattcaagcttctttctgtcctcttctttcccttgaaaaaggagaattcatagttgctggaagtgaggactcaaatgtctatttctatgatttaacgaagccaaagaatacatgtgtgaacaagctacagggtcatcggtttcctgtaatgggtattgcctggaaccatggagaaaacttgttggcttcatctgatttttatggcatagtaattgtgtggaagagagaaagatcacatcaaaagcgaaatacgtaa

SEQ ID NO: 27283 - DNA, 1803 bp, Glycine max
  Peptide Sequence Number=SeqID_144061
atgctaaaacttggacaccatggaacacccgcaacacttccccctcaagtagtggagattgcaagatctgttgtaaggaagtgtgatggtttaccacttgcaatcaatgtgatggctagaaccatgaaaggttgttatgacactattatgtggaaacatgaattgaataaacttgaaaatttggagatgggagaagaggtgaaggaagaagtcttcacagtactaaaacgtagctatgataatttaattgaaaaggacctgcaaaagtatttgttatattttgcacagataccaaacaattctggtttccagtcaaaaagctacttagttaaaaagcttgttgagagtggtttgttaaaaaatgtaaagaggagtttgagggaagtatttgatgaggcgtgtgccatggcgaataaactcgtagaccattctttgtttgtgggttatgattaccatacaaaaatgcatggtctggtgaggaacatggcatgccgtatcttgaatgagagtaacaattacatggtgaaatgtgaaggaaatttgagtgagatacctgacgtgaaggagtggatagttgatttggaggtagtttcattggggggaaacagaataaaagaaatcccagaaggcatatcacctaattgtccacgcttgtccaccttgattttatctggtaattgtatcggccacattccggagggttttttcatacacatgaatgctctaacagtacttaatatatcatataatgatttcttgacatctttgccgcattcgctgtccaacttgaggtctcttgtttctttagtgctccaaaattgttcaaatttggaatatatacctccattgggagagctacaagcattgtcaagattggacatttcaggttgttcgattcgccaagtaccagaaggcttgaaaaatctaataaacttgaaatggcttgatatgtccataaatgagcatttaacgctggcaccaagatgtgtactgcccggtttgaccaatttgcaatatctggatctccgttgtgattcagctataatagcagaagatgtacaagggatgagtatgcttgaatgttttggaggaatctttctcggcaaagataattacaatagttacgtgcaagaaattctggacagaggtcatggacctaaaacttatgatatccatgtagaagatgttagggatctgatatttgcatttgatattgatgatccagtttctctatacgaagatcatcaaaatgtacggttttggcaatgcgaaggattgctgtatttactacccagagaccttaagaaattgagtatggaacgcaatgatcaatgggtgtgcttatgtggtgctctgtcatcaagtggtcctctttcttctttgaatcaaattgatattattggcggctatagtttcactgcaatctgtgaggaagatgctgttgatttaacacgatctttgtctccaaggggtgtgttctcaaatctcaagaaatttcagctcagccaatgccatgaaatagagacgttgctgacaccattgttagtgccacaacttcaaaacctagaggttttatcggtcgagagctgtaggtccatgagagagatatttgcagtgagtaatagtggcaatgatgataatttcaacattatactccccaaattgatcagattgcggttgtggaatttaccagaattgacgaccgtgtgcagagaaattttagtatgtggatctgcggatatattgttcattaatcattgtcccaaattagaaaggctaccaagaatcgtcgtgtatgattga

SEQ ID NO: 27284 - DNA, 705 bp, Glycine max
  Peptide Sequence Number=SeqID_144062
atggatcgctcaacctatcctttgttatctgaaaaagaatttgttgagattgccagacggatactggccgggaaatataataatgcaaaaggattttataacgatctcgcggatttcctcctgaccggaggagataccgcgcagacgccacaacaattacgcgccaggggcatcattttattatcagagcatcacttaattaacagcatcgcgacgtggccggtactgaaagagtatggcgatacgcgaaagaaatctggccagcgccaaatgctttcactgctggcgcaaatcctgcaggcaaatgagctcaatttgctcgcgattgccgtagtgatattattagtgattgatacactagccgatcgcggcttcggtaacgcacttattcgctatcaaagtttaaataacagcgaactctcgaagctttactggggtaatgggcagcactatcgcgccatcctgcaacgggaaaaacaatttacgcgcattgcctttacggaaacgtcttccgtgctggcagggctggcggtcacgctgtttaccgtgtggctgacgccgtcagtgctgtgcgccatctggggttacctggcgatggtttccatcagaatgctgatctactgctactacggacgtccctggttccagccggagtaccgttttagcctgaaagctttcgccgcagtgcgagcaagaaacggataa

SEQ ID NO: 27285 - DNA, 219 bp, Glycine max
  Peptide Sequence Number=SeqID_144063
atgtcctccaaattagaaggaaaaggtaaaagagagatgttcgatggaatggaataccgtttcaatcaaatgggtaacatcaattggggacataaattggggatccctgtagaaccatgcaagtttacgtggactcacattgatcgaaccattacttcgtgtgctacttctaagaaacaaattggaaattccgttgctagatgggagcctagttcatga

SEQ ID NO: 27286 - DNA, 1228 bp, Glycine max
  Peptide Sequence Number=SeqID_144064
ggttgctagaactgttatatttggtggtctcataaattccgatatggctgaagaagttcacggcaaagctagagagattggcactgtgtgttcaattaagtaccctctttcaaggaaagatctcgagcaacatggtctcctgcaagatggatgcactttagatgcttcagctgtgctttatacaagtgtaaaatcagcccgagcttctgttgcaacgttacatagaaaagagataggagggggaaacatttgggtgcgccaactgggtggagagggctccaagactcagaaatggaagcttattgtcagaaaccttcctttcaaggccattcaaaagctcaatggatcaaagtttgcaaaacgactcatagctgttgattgggctgtttcaaaaaagatatttagcagtgatacaaataatgctcttgcctcagagaaaggacaacaaaacatgagtgatgaggatagtaccgatgaagattttgagcttgttgataaaagatctggtcaaggagatagtgatacagactactctagtgccatggaggaagaaggcacccctcctgaagataattttgataaggaagcagacattgcaaaaaaggttcttaacaacttgcttacatcctcgagtaaaggaacatctgtaaacaatgattctatgttgatcaaagaaaacaagggatcaagatctgatgaaattgttaaggatgcagatgaaaaagcatctaatgagtctgaaaaggtttcaggtgtttctaagcctgaaatttccagcagaaacaacttattaaatcctaagggaacagaagatgatttgcagagaacagtttttataagtaatcttccctttgaatgtgataatgaagaagtgaaacaacgattttctggatttggggaaatagaatattttgttcctgttctccaccaagttaccaagcgacccagagggactggttttctaaaatttaaaactgtagaagcagctaatactgtaatttcaactgccagggctgcttctgggatgggtattttattgaagggtagaccattaaaagttttgaaggctttggataagaaatcagcacatgacaaggaactggagaaagcaaaaaatgaggttcatgaccaccgcaatctttacttggcaaaggagggacttattcttgagggaactacagctgctgaaggggtttcagccagcgatatgttaaaacgcctagagtga

SEQ ID NO: 27287 - DNA, 354 bp, Glycine max
  Peptide Sequence Number=SeqID_144065
atggcctatgttggatccacatttatgactctcttacttattcctccatacttcagtatccagagtcttgctaagaaacttcccatcaattttatacgtgttcctctacactcacatccggtctatgttccacgagctcagacgggagagatcctctttgatgaggacatgaccaagagtaagggtaaggatccacttgaaggacttggaggaccaatgacaagggctagagcaaggaaagccaatgaagttcttcaacaagtgttgttcatactatttgaatacaagcccaagtttcaaggagaaaagtccaaggttgtgagttgtatcatgacccaaatggaggaagactaa

SEQ ID NO: 27288 - DNA, 546 bp, Glycine max
  Peptide Sequence Number=SeqID_144066
atgaatgatcagtatgggagaatccctctccattatacagctatgagaggacgaatggagatagcaagagagttgattggagcaaagcctgaatcacttatgatgcttgatggatcagataactttgaaaaagcaagtactgtaaggtacttgctttcgatatccaaaataagagaagaagcaaatattaagaagatgggttatactgctttggacatgctagagcacggtccaaaggacacgagaagtcttcaaatacaaatcatgttgatggatgttggcttcaagaacaatgaaaggaaccaactagatcacccaccatcgacaacaaccttagccattgttgtcccgtcgtcgatgacaattgatccaaatgaaaagtattggagcaagtttttgaagcgtgtgaataagttcttacaacttaagagtaatagattggaagaaatgagagggatgttgagtttgatatccacaatgatctcaactgtgacctttggtgttgtaatgaacctgccaggtggtaataacacatatcaatgttga

SEQ ID NO: 27289 - DNA, 282 bp, Glycine max
  Peptide Sequence Number=SeqID_144067
atggaacaagtcgagaatctggtgtttgttgagacagggatgagaatgggatggttgggggtggaagttggcggcgaggggcttgcggcggattgcggcggcgcgggcttcacgggtctgggcccgttcaagctggtcgttgttggagcccacgaagaaagggctcgtcggagattggatacgagcggacatgggaaccgtctttttgtgagagagggcactgggcagcaacgttacttgccgagaaaggaaactgatgttgccgtattgtggcctaagtag

SEQ ID NO: 27290 - DNA, 111 bp, Glycine max
  Peptide Sequence Number=SeqID_144068
atggtggattttttgccaaccgctgtagacaatttgcgaaggaaggcctgccatggcagcgccataaggcaagctgtacacttgaagctggagtcaaaatatactccttaa

SEQ ID NO: 27291 - DNA, 447 bp, Glycine max
  Peptide Sequence Number=SeqID_144069
atggcggacgtcacggcgaacttgcaagcagcaaccaccgcatccaccccttacgcgctccccaccaatctccctctcctctccgctttcctctccttcgctctcgcacagttcctcaagatcttcacctcctggtataaggaaaagagatgggattctaaaaggctgcttgattcgggtggaatgccttcgtcacattctgcaacagtctcggctctggctgttgctataggtctccaagaaggggcaggatcaactgcttttgcagttgccgtggtcttggcgtgtattcttcatgtacaatatttatttagtgaggatctctgccttttgaatcctttgatgccacaattccaaattattccttatcctctgaaaaacaactccaatagcaaatttaacatttccattatgattgtcatgatgcttccattgatggagtattaa

SEQ ID NO: 27292 - DNA, 150 bp, Glycine max
  Peptide Sequence Number=SeqID_144070
atgcacaagtgctacattgttgcaacatgtgatcgggacttgaagaggagaattcggaagattcccggtgttccaataatgtacatcaccaaacgcaagtactcaattgagcgattgcctgaagcaacaattggtggagctgctccgtaa

SEQ ID NO: 27293 - DNA, 1730 bp, Glycine max
  Peptide Sequence Number=SeqID_144071
atgaccgcgatttggattgctattgctgttctggcggcgctggcactggtgtttggtgccctgctgggctacgcctcgcgccgctttgaagtagaagaagacccgattgttgagcagatcgatgcgattctgccgcagagccagtgcggccagtgtggctatcccggctgccgtccgtacgccgatgcggtgggcaataacggtgaagccattaataaatgtgcgccgggcggcgaacagaccatgctgaagctggccgaactgctcaacgttgaaccgcagccgctggacggcggcgcggaagtgctgacgccggttcgcaccgtggcgtggattgacgaagccaactgcattggctgcaccaaatgtattcaggcctgcccggttgacgccatcgtcggtgcgacgcgcgccatgcacaccgtgctgagcgatgtctgcaccggctgtaatctctgcgttgccccctgcccgactcagtgtattgacctgcgtccagtcgctcagaccaccgaaacctggaaatgggacctgcaggccatcccgttattttccgctttccgaaaagacaagatctgggacttcaacggcggtattcatccgccggaaatgaaaactcagtccaacggcacgccgctgcgtcaggttcctctgccgcagcgttttgtcattccgctgaagcagcatatcggtgctgaaggcgaactgtgcgtccaaccgggcgacaaagttttgcgcggtcagccgttaacccgcggctttggcaggatgctgccggttcatgccccgacttccggaacggtgacggctatttccccccactccaccgccccccctttttcgctggcggaactcagcgtgatcatcgacgccgatggcgaagactgctggatcgaacgtgacggctggagcgactatcgcagccagtgccgtgaagcgcttatcgagcgcattcaccagttcggcgtcgccgggctgggcggcgccggcttccctaccggcgtcaagctgcgcggcggtagcgataaaatccagacgctgattatcaatgccgcagagtgcgagccgtatatcaccgccgacgatcgtctgatgcaggattgcgccgctcaggtagtggaaggcatccgtatcctcgcgcatattttgcagccgcgagaagtgctgattggcatcgaagacaataaaccgcaggctatctccatgctgcgcgccgtgctggcgggtagccatgatatcgccctgcgcgtcattccgaccaagtacccgtctggcggcgcaaaacagctgacgcaaatcctcaccgggaagcaagtgccgcacggcggacgttcttcggatatcggcgtgctgatgcaaaacgtcggcacagcttatgccgtgaaacgtgcggtaattgacggcgagccgttaaccgaacgagtcgtgacgctgactggcgaatcggtctcccgtccgggtaacgtctgggcgcgcctcggtacgccggtgcgtcatttgctggagcaggctgaattctgcccgggtaccgatcagatggtgatcatgggtggccctctgatgggctttaccctgccatggctggatgtcccggtagtcaaaatcacgaactgcctgcttgctccctcttccaccgagatgggcgaagtgcaggaagagaaaggctgcatccgctgtagcgcctgtgccgatgcctgtccggcggatctgctcccgcagcagctttactg

SEQ ID NO: 27294 - DNA, 177 bp, Glycine max
  Peptide Sequence Number=SeqID_144072
atgcgtgagacaattactaaattgaatgttgaacttttggcaaaggtaaataaggagaggacacttgagtctatcatgtcagctcctggtccatcgactaccacagtgcatgaaactgaccaccatgttgactatgctcaggttgatcgtcctcatgatatgtcaatggatcattga

SEQ ID NO: 27295 - DNA, 1845 bp, Glycine max
  Peptide Sequence Number=SeqID_144073
atggcgttcctatctgaggctgcgagtgcgattaagagcaggttcgggttccacgaccatccctccgaatcgctttcgctggttcagaacactccggatcttttcaaatccgccgtcaaagacactctctcgcaaagctccatagtccgaaacctaagcgattgggacgacgaaagtgtggtcggaccgagtagcgccgccgtttcctcatctcagagctttgaattcggcgaggacccttccttctggaaagatcacaatgtacaggttataattagaatgcgtcctcttagcaactctgaaatatcggtgcaagggtatggaaaatgcgttaggcaagagagtagtcaggcgattacttggactgggcatcccgagtcgcggtttacttttgatcttgttgctgacgagaatgttagccaggagaatctctttaaagtagctggtttgccaatggtagaaaattgcatgggaggctacaacagctgcatgtttgcttatggtcaaactggaagtgggaagacacataccatgcttggtgacattgaggggggaactagaagacacagtgtcaactgtgggatgacaccaagaatttttgagcacttatttactagaattcaaaaggaaaaagaggctcgaagagatgaaaagttaaaattcacatgcaaatgttctttcttggagatatacaatgaacagatccttgatcttttggacccatcatctaacaatttgcagataagagaagacagtaagaaaggagtttatgtggaaaatcttaaggaaacagaagttacttatgctcgagaagtcattcaactacttattcagggagctgcaaacagaaaggttgctgccactaacatgaatcgtgctagcagtcgttctcatagtgtatttacttgcatcattgagagtcagtgggaatctcaaggagtgactcacttccggtatgctcgacttaatcttgttgatttggctggatctgagaggcagaagagttctggtgctgaaggggaacgcctcaaggaagccactaatatcaacaaatctctttcaaccttagggcttgtgattatgaacctagtaagcatatctaatgggaagtcgcaccatgttccataccgtgattcaaagcttacatttttacttcaggattctcttggagggaattcaaaaacaatcataattgcaaatataagcccctccatttgttgttcacttgagacattaagcacattgaagtttgcacaacgcgccaaatttattaagaacaatgcaattgtaaacgaggatgcatctggagatgtcattgccatgagaattcaaattcaacaacttaagaaaatgtttggcggcactttttctgtacattttctagggaagaaagaagtatcccgtttgcgtggtctagttggtggaggagaaattcaggataatgacatttcagttgtcagcttcccaggttctcctggatccttcaagtgggagggtgtgcaaggatcattcagtccattaacctctgttaaaaggatatctcagaaaaaagactatgacattgcccttgttggggcctttagaagggaaaaggacaaagagatggaattacaggcactaagagatgaaattcaagcgtccatgaagctggtgaaacaaagagaagatgagatacaaagtttgaagatgagactacgttttcgagaagctggaataaaaagattagaaacagttgcttctgagaagatctcagctgagacacacttgctaaaagaaaaagaggagcacttgaaggaaattgaggtcttgcgggcccaggttaaagtcattttgtatggaaggtga

SEQ ID NO: 27296 - DNA, 2295 bp, Glycine max
  Peptide Sequence Number=SeqID_144074
atgataatgttctgccacaatacacccagtaaagcaaaagcatgcaatcagcatataatgttaaagtcattttgtatggaaggtgaacgagaatggatgagtgaacaaatcatggtattggaaaacaagttgttggaagcactagattggaaatttatgcatgaaacagatctgaaaacaaattctgatttgatgatggaagatgtacataatgatggtaatctcatctccaaacaggagtcaagtccaaaatcacgatggcagtctttgcttagggaggaaaatgagtttctcaagattcaggctatacaaaaccaggcagaaatggatacaatttgcaaaaagctagaggtttgccttgaagagaaagaaaaattaaaaagccatgttgatgatttgatggcaaaattagaacaagagaaatgccaaacaattaatgaaggaaaggaacgaatggatcttccatcaacaactgatatgcctgtcattaacagcaatgaccaactggagttgaaagcaatggttgatgctatagcttcagctagtcaaagagaagcagaggctcatgagacagcaattatgctggcaaaggagaatgatgaactcaagatgaaacttaaagccttgattgaggataatagtaaactaattgaattgtatgaacaagctgctgctgagaacaataatagaaatgttaataaaggggaggatgctcaagaaattggttccaagattgacaatggttgctattctcttgaaacaacaaaagaggagactgagttgaaaggagtggttgagaatctccagcatcagttaatggaaatgaatgaagaaaatgaaaagctgttgagtttgtttgaaagagccatgcaggagagggatgaaataaaaaaaactctttcatgttttggacatgaaagagttgaaaccaaaggagatatggacttcccagagaagcttgttgaagttgatggtggggaaagagactcaagagtacaaactgtttcccaggaagtgcagggtagagatgaaagtgaatgtgaaccttctacatctggatctgatatggacatcgagtgtggtgctcatgaacaggaacagattttaaaggatgacaatggggctgatatactggtcaactctgagaagaaatatgaggtatctgatctcagcgaagcaaagttaacagaggaattaaattgtgctacaaagaagcttgaaagagttgatgaacatatctcagatgcggtcaagactatagcttcacttggttgtgctgaaaaagcaatggcccaggttgatgagctctctagagaaattgaggtcacagaacaagatattcaggtcaagcgtcagcagtttgaatccttgaaacttcagctttctgaagcacaggaaagaagaacaatagtcaataaaaagttctctgcactcaaatattcattatcaaacttctcctcaacatattcttactttgagcaacgggaagcaagggcaagagcagtggtgaacgacttgacatctcatcttgaccaaaagaaaggtgaattggctgctcttcaagcttccaaacagggactggagaatgctcaaaagaagaaccaagaatgtgaagttgaaatagtgaaaaatattgcatgcatcaaatcgaaattggaggaagagaatcgcaagcgtgaaggtgaaaaggttctatttgcagttgaaaacacacagaatattggttccgcactgaaaaatttgcatcttaattgtaaagctaccgagttacttaagttagaggaagagaaaacaaaactgcaagcagagatgaagatctctctagaaaaactcggggttataagaaaggaactggggaatctaaacaagaaggaggcaaatgtagagagccagatacaagctgttcaactggaaataaagcaatgtttgaggaacacagaggagaaggagcttgcacttcaacgtgtgatgaaagaaaaagggatgctcttggagtttagagataatggtatgtctgaaatagagcatatgatcattgaactccagcaatatgtgtttgactatgatctaaaggaggctgaaataaagattctaggagaagaattgcaaatagatttgataagagccgaagagttacagacagccaggatcattgctgccaacaacaagaacaatgtcctttcttctatttcttattcgggcatgtttgagaagctgaaggaggagatgcaaaacctgcgggcaacaattttcgatacaaaattgttgctggaaggcatttcccatgctacctaa

SEQ ID NO: 27297 - DNA, 315 bp, Glycine max
  Peptide Sequence Number=SeqID_144075
atgcgtctaccgggaaaggagagtctgctgatgaaatctcctataaccataaatgagattttggatgttagcatttcgtttctaaatgaccatttagaggaaacaccgggttcgacaaaaatagaagaaatccactcaaagtgtatcaatctcgcacagtgcggggcgaaaaagtcgctagcgcacgggattttgggtaaggtttatggtgagtcaggattttggctcaaggcttgtagaatggctagacatgatacatgtcagggtttggtttggttcaaggataaaaagggatgccccacattatttccatga

SEQ ID NO: 27298 - DNA, 522 bp, Glycine max
  Peptide Sequence Number=SeqID_144076
atgacgcagatggtccttctgcgctcgccgccggtcacccgccgcagggggaggcgcggcgtgggcgaggttgccggcagcgcgacggcggagtgcgcggcggtgtgctgctgcgtgcccctcaccgtcatggacatggtcgtactcgccacctacaagctccccgcgtgcctcctcaagaaggcaatgcacaaacgcaagcgacgccttctgcagaaaaaaaagaagaaaaccgaggcgctcttggatcacgggcccgtcaccgcagacaatgctgggcctgggcccaaactggaagatcatcttgcgaaggaggtcgcggaggagaagctggaggcgtcgaggttggaagcggagatgtgggcccagttcaacgggaccgggttctggagaagcgcttctcagcgctaccaacaacaacaaactggtcaaatcaaaccaattattaatctaccaattgaaccattaacctattacatcgaccaagtcactgatcgggttgggtttcccaactatggatga

SEQ ID NO: 27299 - DNA, 1080 bp, Glycine max
  Peptide Sequence Number=SeqID_144077
atgcccgcatggtctgaggttcctacggaccgagacaaagacaactcgttgctgaaatcggagctcttgtttgtgaaccaagtgcaaggaccagagagcattgcctttgatcctcttggtcgtgacccttacactggtgttgcagatggaaggattttgttttggaatggacagtcttggactgattttgcatacacctcccccaataggtcacacttctcttcattcctcctcactttgccaactcaactgctaaatattacaattctcacttctcagactaaaaagctaggcttcaactcttctaaacacgtgtcagaacaatataatcctaaggcatctgcatctccaatgagttatgtcaaaactgagcacatctgtggaaggcctttgggactcagatttgacaagaaaagtggtgatttatacattgcagatgcatattttgggttgatgaaggtggggcctcagggtggtttagcaacatctcttgcaactgaggctgaaggggtgccgctgagatttactattgatgtagacattgatacagaggggaacctttattttacagatagcagcacaaactttcagaggagcaatttcattcagctggtactatctggtgaggctagtggcagggttttgaaatacaaactgccactaagaaaccactgttctcatgaggaacgttcaatttccaaacggcatctccttaagcaaggatggttacgtaagtactggctaaaaggagataaagctggaacttcagagatcttagcaatcctccctgttttcctgacaacaaggtatatgtacagttacctgaatagtctatacccaaaaatgagaaaagtcatactcaagctacctattccaacaagaattcaatacatgtttcatattggaggcaggttccatgcagtagctgtcaagtatagccctgaaggtaaacttctgcggatattggaggacagtgaggggaaagttgtgagagctgtgagtgcagtggaggagaaagacggtaaactttgggtgggaagtgttcttatgccttttatggcagttcacaacttgacatga

SEQ ID NO: 27300 - DNA, 1338 bp, Glycine max
  Peptide Sequence Number=SeqID_144078
atggatcgccgcatctacggcgtctccggccaccgcatcttcctctcccttctcttccttgtctctgttttcccacaagcgttaacgctgtcgccgtcaccgacggctcagattaactcaaactcaatcctcgtcgctcttctggactcgcattacacggaactcgcggagcttgtcgaaaaagccatgttgttacagaaactagaagacactgtcgccactcacaacataacaatcttcgctccgaccaacgaagccttagaccgcaacctcgaccccgatttcaagcgctttcttctcgaacccgccaatcttcactccctccagacgctcctcctctctcacatcacccccgcgcaaataggatccaaaaccctaacccgccacgtcacctctctttccgaccacaacctcaagctctccgaaaatctcaccaccgtcgacgaagccaaggttacccacccggatgtggtgacccgacccgacggcgtcatccacggcatcgaccgcctcctcctcccccgctccgtcgaggacgacttcaaccgccgccgcagcctccgctccatcaccgccgtcaaacccgaaccctcgccggaaatcgacccgagaacccaccgtctaaagaaacctcccccgccggtgaaacccggttcctccccggaacttccgatttacgacgcgatggctccgggacccgccctggccccggcgccggcgccggggccaggcggcccgcaccaccacttcaacggagaaagacaagtcgaggacttcatccacacgctcctccactacggcgggtacaacgagatggcggacattctcgtaaacctaacgtcgttggccgttgaaatgggtcgtttagtttcggagggttacgtgctcaccgttttggccccaaacgacgaagcgatggcgaagttgacaacggagcaattaagcgaaccgggggcgccggagcagataatgtactatcacataataccggagtaccagaccgaagagagcatgtacaatgcggttagaaggttcgggaaggttcgctacgataccctacggttgccgcataaggtggtggcgcaagaagctgatgggtccgttaaattcgggcacggggacgggtcggcttatttgttcgacccggatatttacaccgatggacggatctcggttcaggggattgatggggttttgtttccgacggtggaggtggagggggcggagcgggttagaccggttacccggaccggtcagaacggtgcgaaagttgttgtcaagcacaggagaggggcttatgatatccccacaagcttttgtgtttatgaccgactatga

SEQ ID NO: 27301 - DNA, 1269 bp, Glycine max
  Peptide Sequence Number=SeqID_144079
atggagggtgctgggatggaagagaataatattattaatgatgatgataataataacaagtctgaggcgcatttgacttctgccgctgcttttgtggagggtggaattcaggacgcttgtgatgatgcttgcagtatatgccttgaagctttctgtgatagtgatccttccacggtgacgagctgcaagcatgagtttcatcttcagtgcattctcgaatggtgtcaaagaagctcccagtgccccatgtgttggcagcctatcagtctcaaagatccaacaagccaagaattacttgaggcagtggaaagagagcgaaactttaggttcaatccatctagaaatgccacaatatttcatcatccaacactgggggattttgagttacaacatttgccagttggagctagtgacgctgatcttgaagagcgtataatccaacacttagcggctgcagcagcgatgggaagagcacgccacattgctagaagagaaggccagagaaacaggtcatcagctcaaggtcgcccacattttttggttttttcaactaatcctaattcacctcccatggctcctgcttcttcctctccatctcagaggggggatgatgaaccaattcctacaattgctgttgccaatctgtctccaactcctgcaactggagaagaatcatcacagctgactttagttccgcctattcaagcagaacaggtgtctgcttcaggatctggatctactgctcttgctacagatcatcagggatcatcttacaacaataggagatctcctaatcagtcatctccaagtagtcaagacagagcagggccatcagaattacaatcattttcagaatctctgaaatctaaactgaatgctgtatcaacaagatacaaggagtcaatttccaagagcacaagagggtggaaggagagatggttctctcggaacaacactatgtctgaccttggatctgaagttaggcgagaagttaatgcagggattgcaactgtgtcacgcatgatggaacgcctggagaccagcgacaataatagaagcaatagcaattctgcccccagtaatatagaggatggttcagttcaggaatataatggtcaaactttaacaccaggcaatgaaggggacgattttgcatcggaactaaatatttgtatgcttgtgctcgtagaaatagaattgcccattggggatgtgaaattccatggatgtgatgcattgcctattggctggcgcagaccaggcaagtga

SEQ ID NO: 27302 - DNA, 1733 bp, Glycine max
  Peptide Sequence Number=SeqID_144080
gttaaacggagcacaagaacttatgcatctgattcatggaattccaaaggaaaagcagatgtatttggaattaatgttgctgaagatgacctcgtagtaactgatatcgcagcgcatcccagacacatgaaacagatgaaaccccatcaagttgaaggattcaattttcttgttagaaatcttgcgggtgaccatcctggtgggtgcatcttagcccatgctcctggatctgggaaaacattcatgataatcagtttcatgcaaagttttctaggcaagtatcctaatgcaagacctttagtggtgcttcctaagggaatattgtcaacatggaaaaaggagtttcaaacatggcaagtggaggacatacctttatatgacctttacacagtgaaggcagacagtagaagtcagcaactagaagtgttgaagcaatggatggagcagaagagtatccttttcttaggatacaaacagttctcctctattgtttgtgataacgggaccaacaacacatctttatcttgccaggagattttactcaagattcctacgattcttatcttagatgagggacacaatcctaggaatgaaaatactgatatggtacagtcacttgccaaagttcaaacggctagaaaagttgtactatcaggaaccctttatcaaaatcatgtcagggaggtattcaacattttaaatctcgttcgaccaaaatttttgaagatggaaacatcaaggccgattgtgaggcgcattcatagtagagttcacatacctggggtgagaagcttctatgatttagtagaaaacactttgcagaaggacactgattttaaaaggaaaatagctgttatacaagatttgcgggagatgacgagcaaggtacttcactattataaaggagattttcttgatgagcttcctggtcttgttgattttactgtggtgctcactcttagccctagacagaagcctgaaattcagaaattaaaaaagctatctagaagaaagttcaagataaattctgtaggcagtgctgtctatcttcaccccaaacttaaaccactagcagaaaattgtggtgaaaattctacatctgataatataatggatgatttgatagagaaactagacatgagagatggtgtgaagtcaaaattctattacaacatgctaaatctgtgtgaatcagcaggggagaagcttctagttttcagtcagtatctgttacctttgaaatatttagaaaggttgactatgaaatggaaaggctggagtcttggaagagaaatttttgtaatctcaggagaatcaagctctgagcaacgagaatggtccatggaaaaatttaacaattctcctgatgccagagtcttctttggctcaatcaaggcatgtggagagggtatatcattggttggggcttctcgaataattattttggacgttcatctcaatccatcagttacacgtcaagctataggtcgtgcattcagacctggccagatgaagaaggtgtttgtgtatcgtttggtatctgctgattctccggaagaggaagatcacaatacttgtttcaagaaggaattaatttcaaaaatgtggtttgaatggaatgagtactgcggtgatcgagcttttgaagttgaggcagttgaggtgaaagagtgtggtgatctatttcttgaaagtccacttttaggggaggatgtaaaagctttgtataaaag

SEQ ID NO: 27303 - DNA, 849 bp, Glycine max
  Peptide Sequence Number=SeqID_144081
atggagtccgctgatgatgtatctgcttctaaacgccccctaccaaccggattttcccctggccctgatggaccaaaaagactgaggttatctagtgatagcctgccatacccagcatgtgaccaaattgaaccaaagacacctaagaatccaaatgttgttgactacagcaatccatttgcaataactgatattttagatcgtttagagaatggaaagtttggaagtgttacaaaggacatagaggcccttatagccctaaaaatgcaaataatgggcccttactttgcaaaatatcccatacttgttaatcaattattgaaagtggtaacgcatcacgatgaagaaactcccaagttggaaaatcaacaagttactggtttgacacatcaaagtgtcatagatttggagggggaatacactgaaaaggatgttcctgcagtaccaaatactgttgtgattattgattcagatgaggaagatgatagagataaaaaatctgtcattccatttcatgaagttgtgttgccaagaaaagttgcaccatctcctgcattgaaggtgattgggtatcacacttacctgggagaaagcaacgatctaaaaattgagataaatatggctgataaaggtaataacactaggagcaataaaggtgtttatgttggtgcacagggagaggaagaagataaggctgatactgaggatgatggtctacaagatatttggaaggagatgtcaatggcaatagaatgttccaaacatacagttattgttattggcatccagtatattgctctctggcttaatctttctatgctataccttctgtatgcatataacatgtaa

SEQ ID NO: 27304 - DNA, 162 bp, Glycine max
  Peptide Sequence Number=SeqID_144082
ccccagctcttccagcttcgccacctggcggctgacggtggtgtaatcgcgcccggcgcgatcggccagctcgaccacgccgaggggaccaaagcggccaatctggatcagcaacggaaacagggcgcgatccagctggataccggactcttttatcagtaa

SEQ ID NO: 27305 - DNA, 936 bp, Glycine max
  Peptide Sequence Number=SeqID_144083
atgaaagcagctattgtcagtgccgcaggtgagaaaccggtatggggcgatttcccgccaccgcaggccgatgaacagcatgtggtggtgacggtgaaggccgccgccatcagccagctggcgaaagcgcgggccgccggcgcccattacagcgccggtagccactatccgtttatcgccggtattgatggcaccggcacgctgagcaacggcgatccggtctattttctcgcctttagcgcaccgtggggcagtatggcgcagcagacccgggtgccagctgcagcggtggttgcgctgccgccgacgcttgatccgctgctggctgcggcaatcgccaatcccggcatgtcctcgtgggccgcactgacgcgtcgcgcgcagtttcaggcaggtgaaaccgtgctgatcaacggcgcaaccggcacctccggcgggctggcggtgcgcattgcgcgtcacctcggtgccgggaaaatcatcgccaccggccgtaaccgcgcggtgctggagcagctgcgcacgcagggcgcggatatcatcctgacgctggatgaactgcccggcgcgctgccagcgctgatgcagcagggcattgatgtggtgctggattatctgtggggccagagtgcgctcgacatcatgcatgcggccgtggccggcggtgagaaaacggtgcgcttcgtgcagattgggtcgctcagcgggcaggagatcgcactgcacagtaaactgctgcgctcatccgggctgacgctgatgggcagcggactgggcagcgtctctgacagcgaactgatcgcctgtattggtgagatgctgaacgccgccgctgaaagtgacttctccatcgcttttcagcagcgtccgctgagtgaggtagagcaggcgtggcagcaggatgacagccgctgccgcaccgtgtttacgctctag

SEQ ID NO: 27306 - DNA, 1773 bp, Glycine max
  Peptide Sequence Number=SeqID_144084
atggcttattcttctccctccgttattaaggatgccaaggtgcttatggttggcgctggcggaattggctgcgagcttctcaagaccctcgctctctccggtttccctgacattcacatcgttagttctcttctctattcgggtctttccaacttcgagctgtgtgtgtttggtgacataggaggtgtttgtgagagtgaggaggggagccatgttggtgcttatagtctgttggcttcaattgcttttgtgctaatcgaagtccgtgatgatggaagtagggtgtttgttagtggggtttcagttttccatcaatctgatgaagtcttcaaccaggttgctagggatgctgtgttaaaatttaggccccacataaacattacaccataccatgcaaatgtcaaagatcctgaattcaatgtggacttctttaagcaatttaatgttgttctaaatggacttgacaatctagatgcacgccggcatgtgaatcgcttgtgcttggcagctaatgttcctttggttgaaagtggaactactgggttccttggacaggacttactttttgccaagctatttggggacaagaatcaagacaatgatttaaatgttcgatcaagtgatgctgccagctcgtccaaaaatgtagaggatgtatttgaacgtaggaaagatgaagacattgatcaatatggaaggaaaatttttgatcatgtttttgggtataacattgaattagctttgtctaatgaagagacatggaaaaatcgtaataggccaaaacctatatacagcaaggatatcctgtccgatgaaccggctcaacaaaatggaaatttggagaaaaaatatgaatctgatgaattatcagtttccgccatggcatccttgggcatgaagaacccacaggatatttggagtctcaaagaaaattctagaatatttcttgaagcatttagacttttttttacaaaaagggaaaaggagattggcaatctaagctttgataaagatgatcagttggctgtagaatttgttactgcagctgcaaacataagggctgcttcatttggcatccctctccaaaacctttttgaagctaaaggtattgctggtaatattgtgcatgctgttgcgactacaaatgctgtgattgctgggttgattgtcattgaagcaatcaaagtgctgaaaaatgacattaaaaattataggtatgatgtgatttctcctcctgcaaagcttgggatgaaccttcctcttattatgtgtgcttcaaacctgctttatgaagctggtgatgttgaggatgacatgattgctatttatgaggccaaccttgaaaaggctctggctgagcttccttccccagtaactggtggcacaatgcttacagtagaggatatgcagcaggaattcgtttgcaatattaacatcaagcacagagaggagtttgatgaagagaaagaacctgatgggatggttctctcaggatggactcaaccagtgtcagcagcagaaaacaaagacaaatctgttggaaatggtgcaagcacctctgatgcattaataacagctgtggaatctgaaaaggatgatgagataactatagtttcagccttgaagaaacgaaaacttcccgacgaatctgatatttcaaatagtgcagctgaagcaaagaatcagaagcaattggaagtaattgacgatgaggatgatcttgtcatgcttgatggggatttaaacagcgttaaaaagagaagattgtcatag

SEQ ID NO: 27307 - DNA, 2051 bp, Glycine max
  Peptide Sequence Number=SeqID_144085
atgaccacgcaggccggtaatctggcctacgtgtcactgctggcgctggtgccgctgattgccgtggtcttcgcgctgtttgccgccttcccggtgttctccgacatcagcgtgcagctgaagaacttcatcttcactaacttcatgccggccgccggggatgtgattcagcgctatctcgatcagtttgtcgccaacgtcaacaaaatgacggcggtgggggcgcgcgctcaacgccatctggcgcagcgacaagccgcgcccgatggtttactcctttgcggtctactggatgatcctgacgctgggaccgctgctggccggtgccagtctggccatcagctcctatctgctgtcgctgcgctgggtgaacgtgaccggcgtcaccagcctgatcgatcaggcgctgcgcatcttcccgctggttttgtcgattctcgccttctggctgctgtacagcattgtgccgacgcggcgcgtgccgggacgcgatgcgttgataggtgcggtggtcgcgggtctgctgttcgagctgggcaaaaaaggcttcgcgctctatgttacgatgtttccttcgtatcagttaatttacggcgtgctggcggtgatccccatcctgtttctgtgggtttactggacctgcgtgtgacgcgcgccagcgtcagcgtggataacgccacggtgggtgaaattggcgccggtctgctggtgctgctgggggtggaaaagggcgatgacgagcagaaatcacagcgcctggcggagaaagtgctgggctaccgcatctttggcgatgagaacgacaaaatgaatctcagcgtacagcagacaggcggtagcgtgctggtggtttcgcaattcaccctggcggccgacacgcaaaaaggcatgcgtccctctttctctggcggcgcgcatccggcggaagccgagcgcctctatcacgacttcagcgatcgctgccgggcgctgggcgtcaccaccgccaacgggcgcttcgccgccaatatgcaggtttcgctgattaacgatggtccggtgaccttctggttacagggctcagaacgtgatgcctgggatgcgctggcgcatcaccagatggtggtggatgagcacggcaaaccggtagcggtaggccggctgtatatcaatgcggaaaatgaagcggcgatccgctttctggcggtgcatccgtcggtgcagggcaaagggctgggtacgctggtggcgatgacgctggagtcggtggcgcgccaggaaggggccaaacgcgtcacctgtagcgcgcgcgaggatgcggtggagttctttgccaagctcggctttgtcaatcagggcgaaattaccgcaccgcaaaccacgccggtgcgccacttcctgatgattaaaccggtggtgacgctggatgatattctgcatcgcgccgactggtgtggacagctgcagcaggcgtggtacgaacacatcccgctgagcgaaaagatgggcgtgcgcattctgcagtataccgggcagaagtttgttaccaccatgccggaagccggcaaccagaacccgcaccacacgctgtttgccggcagcctgttttcactcgccacgcttaccggctggggattgatctggctgctgctgcgcgaacgccatctcggtggcaccatcattctggccgatgcacatatacgctatagcaaacccatcagcggacggcccggcgccatcgccgatctcggctcgctgagcggcgatctcgaccggctggcgcgcggacgaaaagcacgcgtacagatggaggtggagctgtttggggatgatgagctgggcgcggtgtttgaaggtgtctacatcgtgttacccgccgatcccgacggaccgctggaagagggcggttcaggcgcgcggtcgccattaatggcgaccaaaaaagcgcaactgacccgcatcgcgcttttcagcgcgatcggtcatgcaatcatcactgcacctgcccgccacgcatcgtctgctgcaccgactgcgtatccgtcgttaacgacaaactgccttctgcgctg

SEQ ID NO: 27308 - DNA, 1026 bp, Glycine max
  Peptide Sequence Number=SeqID_144086
atggataggttaataaatttctatcttgttcatcacagtccactgtccaatcaaactatttcaaggaatgtctccataaaggtgagcatagaacaggtgaaggaattggctgaatcatcaactttatcatgtccatatcccgcaaaacttccacattcattgccttctacttctttgtcagtatctcctctgcaatcccaaagtcacccacttccatccagctcaacaccatcaaggtggccctgccattccccaggactgcaattatcacggcaagtttctgatagcctaatattgggatttaagacacctagcaacttttatgtatctgaagagaggccagtgtttccttcatggagcaatgaatctggtacacattcccagggtggatcttcggataattggtctaggcctggcttttctgagctgacaagcacttccctaaaagaaagatggtcatttgacagtgagtcgtttggttttaattgtgaaaggccggttagatccagtagtcggttttcaaattctccagttgatttgcaaacatgtggtgtttgctcaaaacttttaactgagaaatcttcttggggaacccaaaagataattgcaagtaatgacctttctgtagtttctgtccttatctgtggacacgtttatcatgctgaatgcttggagagtttgacatctgaagtcaacaagtatgatccatcttgcccagtttgcacttttggtgagaaatatacacttaagttgtctgaaaaagctctgaaagctgaaatggatttgaaagctaaaaataagaaatcaagtgatattgatgattctgttttatacgaacattttagagaaaaagggcatcatggtaaaggtcctagaatcaattcttgttccagtgggagaaaatctaatgggaaaccttttctgaggaggcacttctcatttggctcaaggagtaccaaatccatgctggataatcagccaacccggaagaagggcttcttttgggcaaaatctcacaaggaataa

SEQ ID NO: 27309 - DNA, 399 bp, Glycine max
  Peptide Sequence Number=SeqID_144087
atggcaactggcacgctgcccgacgcggggcagattctcaactccctgatcaacagtattttgctggtcgataacgatctggttatccactacgccaacccggcggcccagcaattactggcgcaaagctcacgaaaattgttcggcacgcccttaccggaacttaccggctatttttcgctgaacattgaggtaatgagcgagagtttaggggcaggccagggctttaccgatagcgaagtcacgttagtggtggatggccgcgcgcacattatgtcgctcacggcacagcgtctacccgacggatttattctgctggaaatggcgccgatggataatcagcgccgtctcagccaggagcagattcagcacgctcagcaggttgccgcgcgcgatctg

SEQ ID NO: 27310 - DNA, 210 bp, Glycine max
  Peptide Sequence Number=SeqID_144088
atgggtggaggatcaggtagggtgaaaaagaaggctaagagatactttggaaatagattcatggaagaagaatatgataggccaaaatttgatggatccaatcaaaacgactttatgcttctagaagattttgaggaggaagaagtcaagatggccatttgggattgtgaaagttctaagtgtcccaaaactttcatttcttattcatga

SEQ ID NO: 27311 - DNA, 570 bp, Glycine max
  Peptide Sequence Number=SeqID_144089
atgttttactcaaagcaagaacactggttgagtgatgattgtgatttccttttttttccgattatttgttcgactgtcaccttatggatcattgcaattggtgatacagttttttcttctgttgttatagggatagagctgtgttctccagtcctggttgatgagggtgctattggtgtggttttgttgataatgggtgctgtttgttgtgttgctgccaaagataaaaccatacaaagtgcatctcccagtgaaatcttgcatcggaatattcgacattctccgacatggaacttccggtgggatcatcgagggcgtgtagctggtgaagatactgctgtaacttggttttctaacgatattagtgggaataatggattggagaataaaaatgaatcctcatatgtatcagaggatggagacccgttgcagaattatcaaattcaaaggaatagattgcaaaaatctccaatctctgaaggaactgctagaaatgtgataaattcatcttctggtaattttcatcaaatcaactctctggttttaatcataattcatgcacccacttga

SEQ ID NO: 27312 - DNA, 1008 bp, Glycine max
  Peptide Sequence Number=SeqID_144090
gctagaattgttcaccccgataaaaatcctgaggatcctaaggccgcagaaaactttcagaaacttggtgaggcttaccaggttttaagtgatcctgggaagcgtgcggcatatgatgagcatggaaaggagggagtaccacaagattccatgatggaccctacaactgtatttggaatgatttttggaagtgaattttttgaagaatatattggacaacttgcactggcttctttagcatctatagaaattgaggaagactcacaggatcctgaagttttgaggcagagaattcaagaaaagatgaaagcttggcagaaggaaagggagcaaaagctttcaacatttctgaaagatcgcctgcaaccatttgttgatggtcgagaagatgaatttacagcatgggcaaaatcagaagcacgtagtctttctaaagctgtcctggccccaatgtggtttctgaatcaagaacaaggcaaagacaatgaaatgaacactcctggactttcgggagcttttggagaagccatgctacatacaattggttacatctacacacgaaaagctgcaagagaacttgggaaggatatacggtatatgaacgttccctttttggcagagtgggtgcgaggcaaaggacactgtataaaatcacaagtaacagcagcctcaggagctgtctccctaattcaaatacaagaagaactcaagaagctaaatcaaggagaaaacaaagaagaaagcatagtcaaagctattgaagataagaaggatgccatgattaattctctatggcaaatcaatgtgattgatattgaatcaactctgtcacatgtttgccaaactgttcttaaagatcctagtgcctccaaagatgttctgaagtctcgggccaaagcattgaaaaagttaggaactatctttcaaggtgctaagattgcttataacagagaaaacagcctacgcagagaaagtggcaaaacaccagatgctgcttcctcatcatag

SEQ ID NO: 27313 - DNA, 1287 bp, Glycine max
  Peptide Sequence Number=SeqID_144091
atggcaaagatgccacattcttcatctcttgctattgttttactgtgtctttacattaacatctctttcttgaatgcccttgacggtggtggctttagtgtggaaataatccaccgtgactcgtcaagatcaccatattatcgtcccacagaaactcaattccaacgagttgctaatgcattgcgtcgttccatcaaccgtgccaatcatttcaacaaacctaatttagttgcctccacaaacacagcagagtccactgtaatagcaagtcaaggtgaatacctaatgagctattcagttggaaccccaccattccaaatcttgggtattgttgacacgggtagtgacattatctggctgcaatgccaaccctgtgaagactgttacaaccaaaccactccaatattcgatccttcacaatccaaaacctacaaaaccctaccttgctcttctaatatctgtcaatcagtgcaaagtgctgcatcttgctcttccaacaatgatgagtgtgaatacactattacatatggtgataattcacactcacaaggcgatcttagcgtggaaaccctaactttagggtccaccgatggttcttctgtccaatttcctaaaaccgttataggatgcggacacaacaataaaggaacctttcaacgggaaggttccggcatagttggccttggaggaggacccgtatctcttatatctcaattgagttcttcaataggtggaaaattttcctattgtttggcaccgttgttttcacaatctaactcgtctagcaaactcaattttggagatgaagctgtggtttcggggcgtggcactgtctcaacccctatagtcccaaaaaatggactagggttttacttcctaaccttggaagcattcagtgttggagataatagaatagagtttggaagctcttcctttgaatctagtggcggagagggaaacatcataattgactcaggtacaacactcactattttgccagaagatgattacttaaatttggaatcagcagtagcagatgcaattgaattagagcgtgttgaggatccaagtaaatttttgaggctatgctaccgaactacatcatctgatgaactaaatgtaccagtgatcacagcacattttaaaggagcagatgttgagttgaatcctatcagcacctttattgaggtggatgagggagtagtatgttttgctttccgttcaagtaaaattggtcccatctttgggaacttggcacaacaaaacctcttggttggctatgatctt

SEQ ID NO: 27314 - DNA, 984 bp, Glycine max
  Peptide Sequence Number=SeqID_144092
atggaagagatcaacacgaaaccattggccacttctcttctggtgccatcagtgcaagagttggctaaacagaatttctctagcgttccacaaagatacattcaacatcaacatgaagacatggtgctcatctgtgaagaaactaacagtacgagtagccttgagattccagtaattgacatgcacaacttgctttctatagaagctgagaattcagaattggacaagcttcaccttgcttgcaaagaatggggattcttccagcttataaaccatggagtaagcccttccttgctgaagaaactgaagttggagattcaggacttcttcaaccttccaatgtcagagaagaaaaagttttggcagactccacaacatattgagggatttggacaagcatatgtagtgagtgaagaccagaaacttgattggggcgatatgttctatatgacaacccttccaactcactcgagaattccccacttatttccacaactccctcttcctttcagagacactctagagctttactcatgcaacatgaaaaatatagccatggctattattggccagatgggaaaagctttgaagatagaagaaatggaaataagagaattatttgaagatgagatacaaaagatgaggatgaactattaccctccgtgtccacaaccagagaaggttattggcctcacaaaccattcagatggagtaggtctcactatcctcctacatgtcaacgaagtagaagggctccagataaagaaagatggtgtgtgggttcctattaagcccctacctaatgccttcgttgtcaacattggagaaatacttgagaaaagaggctatctactcgccatatcaatgttattaaatggctgcgatatggctaccatgacgaaatggcatgacgatttttttgccaaccaccacaagcattttgtgaagggaggcccgctattgagacaccgtaggctgcaatag

SEQ ID NO: 27315 - DNA, 525 bp, Glycine max
  Peptide Sequence Number=SeqID_144093
atggaaaagttcttcaacccatcagggacttcacttttggtaccatcagttcaagagttggctacaagaaatttgtccactgttccacaaagatacattcagcatcaacatgaagacatggtgctcctctctgaagaagctaatattagtcttgagatattccagttattgacatgcagagcttgctttctgcagaatctgggacttcagaattggctaagcttcaccttgcttgcaaggaatggggattcttccagaacaataataaaagaagtgaagctaataaaccatggagtaagctcagccttgctagacaaagtaaagttgaagactcaagacttcttcaaccttgctagacaaactgcacaaaatgggttgcctcctgtggaagagtggagggaaaatctcttacaatattgctttaggaaattaattgaattccctgacaaatacaaagaccaatgggacgatgcttattgggatgccataattcaaactacatctgcttcccaaaatcaaagataa

SEQ ID NO: 27316 - DNA, 371 bp, Glycine max
  Peptide Sequence Number=SeqID_144094
cgatgctaatgatccctgaagaagctcatagtactcttgagattccagttattgacatgcacaggttgctttcggtagaatctggtacttcagaattggaaaagcttcaccaatcaccatgcttgcaaggaatggggattcttccagatgggatacaactgatgaggatgaactattattatccaccatgccctgaaccagagaaggttattggcctcactccccattcagatggaattggactcgctattctcctacaatccaatgaagttgaaggtcttcagataaggaaagatggagtggcggacctacgttggcttcaaggagatgcagtttgtgtgaaagagtttacagagaatctgattgagtga

SEQ ID NO: 27317 - DNA, 870 bp, Glycine max
  Peptide Sequence Number=SeqID_144095
atggaagagatcaccaagaacctatcagggacttctcttttggtaccatcagttcaagaattggctaaagaaaagatatctaatgttccacaaagatacattcaacctcaacatgaagaggacattgtgatcctctctgaagaagctaatagtagccttgagattccagttattgacatgcagagcttgctttctgaagaatctgggagctcagaattggataaacttcaccttgcttgcaaagaatggggattcttccagctgataaaccatggtgttagctcatccttggtggagaaagtaaagttggagattcaggatttcttcaagcttccaatgtcagagaagaaaaagttttggcagagtccacaacatatggagggttttggacaagcatttgttgtgagtgaagaccaaaaacttgattgggctgaccttttctttatgactactcttccaaaacatttaagaataccccacttatttccacagctccctcttcctttcagggacgccttagaaatttactcacaggaacttaaaaaactagccatggttgttgttgaacaaatgggaaaagctctgaagatggaagaaacagaaatgagagagttttttgaagatggtatgcagtctatgaggatgaactattacccaccatgtcctcaaccagagaaggtaattggcctcacaccccattcagatggagttggtctcactatcctcttacaagccactgaagtagaagggctccagataacaaaagatggcatgtgggttcctatcaaacccttgcctaatgctttcattataaacattggggacatgctcgaggatagtaaaacggatcagcctgttagccccttatga

SEQ ID NO: 27318 - DNA, 99 bp, Glycine max
  Peptide Sequence Number=SeqID_144096
atgtcgctggattctcttctcctgtcattgaagctaatgggtggtttggtaccaatgaagaggagagaagaggctaggattggagacgatttccgatga

SEQ ID NO: 27319 - DNA, 1196 bp, Glycine max
  Peptide Sequence Number=SeqID_144097
ttctgcagcccctacaggtggacagacagcttctgcttttggacagaatacatccccctttggacagactactacaccttctttcagtcaaccaagtttgttcaattcaccttcttctgggcttgttggaagtattttctcatcaagtgcaccactcacttctaataatcttacaggttttggtcaaacagcgctgtccatttcaacaccttttcaatctgcacaacctgctcagtcgagtggtgcttttggctttggcaactttggccagacacaacctgttggtgcaagcagcttcggtggcactccaggaatgtcttctacccccctgagttctgtggctgtacaagcagttccgaatacaaatccatttggaacacttcctgcattgcctcagatgtcaattggtcgagttggaactactccttcaattcaatatggaatctctagcatgcctgttgcattctttagtgatgatgaggatactccaacaacacccaaggctgatgctctgttcattcctagggaaaatccaagggcgttgataatttgtcccgtggagcagtggccaggaaaggcttctgagaaggcatcaacatttaaggatagatccatcccagtgaatgagaatgagagtgctgtagaaaatggttttgtcaaggagcaagctcagcctatatcgacaaagccaacatccaatgggagcaatgaagatcattctccacaaaaggcggacgtgtacaagacactcagaggtcacagagctggtgaggctgccattgtatatgaacatggagctgacgttgaggcactaatgccaaaactgcggcgatctgattactacacactgcctcggatacatgaactggcagccaaagaaagagctgaacctggattctgcagtcatgttaaggacttcgtggttggaaggcaaggttatggcagcatcagattcttgggtgagacggacatacgagggctcgatctcgagtccctcattcagtttaacaaccgggaggtgattgtatacatggatgattcaaagaaaccccctgtgggacaagggctgaataagcctgctgaggttacactactcaacataaaatgtttcgacaaaaaaactggacatcagtatacagaagggccaaagatcgagaaatacaaggagatgctcaagagcaagactgaggaccaag

SEQ ID NO: 27320 - DNA, 261 bp, Glycine max
  Peptide Sequence Number=SeqID_144098
atggagggaatatttgtgcaccctgttggaaggatgaccctcattaattctatcccttatgctatcccttcttaccacacgtcttttgatcttcttccaaagagaataaaaacttcccccacaagagagcaaacgattcccataaactttcctaggggagggcttggggttaatcaagccactacttgccatttgtcaagattggatagaatgtgtcctaacaaagagaggtgccttagggtagaagctcacactaggtaa

SEQ ID NO: 27321 - DNA, 408 bp, Glycine max
  Peptide Sequence Number=SeqID_144099
atgtctatctttttttcatctttgccttgcagtaccagccaaaaagtgaatggaaacattgtgagagtgctaacttttaaattttgccatgttagtgttccatgcagcagtttgctcaccatagttacggttagatgtggacactgtgccaatttgctgacagttaacatgggagcatcacttcaaacttttccttctcaagacactactcagcgattttctaccgttggtaagttacagagacagcatctaagtgttcaagaagcatgcagcaaggaactaggatcatcatcaaagtgcaaatcatttgagactgtagaccatgagcagcaacctaggattcctcccattcgtcctcctgagaagagacaacgtgttccttctgcttataaccggttcattaagtaa

SEQ ID NO: 27322 - DNA, 141 bp, Glycine max
  Peptide Sequence Number=SeqID_144100
atgaaagggatccagaagctgtacaagtataaagtctgtataattgaaggattagtcattgttcttgaaagcatgtggagcaaattttcaagatctcgaaaaagactatctgtggagggttctaaccaacaaagatgttga

SEQ ID NO: 27323 - DNA, 888 bp, Glycine max
  Peptide Sequence Number=SeqID_144101
atggaactgggcatatttcaggtttctttacccaggaccatgtcaaggtttgagatttggttgtttatgaccaggattttattgaggcaactagatgttggatttcaagagatatctgttgggaatgctgctccaatctggtataacatgcttaatcaacattttctcacacagccagtattttcattctggttaaaccgtaatactaatgaggaacaaggcggccagattgtatttggtggaattgattcagatcattacaagggtgagcacacatatgttccagttactcagaaaggctatttggcaggattatgtgctgccaagtgcttggcaattgttgattctggaacctctttgttagctggcccaacgggggtcattgctcaaatcaatcatgcaattggagcggttggtattgttagccaagaatgcaaggcattggtagctcaatatggaaaaaccatattggataagctgataaatgaggctttgccacaacagatctgctctcaaattggtttatgtacttttgatggtactcaaggtgtaagagaacatcttgtagttggaatgatgccggatgcacagcttctctgtgatttggtccccagcccaaagggagagtcagttgttgaatgcaatactttatctgaaatgcctaatgtttcattcaccatagggggagaagtgtttgagctttccccagagcagtatattcttaaagtgggaaaaggagccacagcacaatgcattagtggatttatagctttagacattgctcctcctcgtggacctttatggattttgggggacattttcatgggtagctatcatacagtgttcgattatggcaatatgaaagttggatttgctgaatcagcataa

SEQ ID NO: 27324 - DNA, 1191 bp, Glycine max
  Peptide Sequence Number=SeqID_144102
atggagtggactagaggcttcatcataggacgtgggtcatcggccaccgtttacaccgccacctcatcccactcctccaccgtggcggccgtcaagtcggcggagctaacactatcaaattcagagcagctgcagagagaacagaggattctgtcttctctgttttctcctcacatagttacctacaaaggctgcaacataacagaggacaacaacaccctttggttcaacctcttcatggagtacatgccctttggtactctctctcaggaaagtcaccggcacggtggccgcctcagcgaaccggccaccgtttactacacgcgacaagtcctgcaggggctacagtacttgcacaataagggtgttgtgcattgcgatattaaaggtggcaacattttgattggtgaagatggggccaagattggggactttggatgtgccaagtttgccaatgattcctcggcggtgatcggtggcacgccgatgttcatggcgccggaggtggcgcgtggggaggagcaggggtaccctgctgatgtgtgggcacttgggtgcactgtgcttgaaatggccactggttttgcaccatggcctaatgtggaagaccctgtcacagtgttgtaccgtgttgcatattccgatgatgttccagagattccttgttttctgtctgaggaagcaaaggatttcttggggaagtgtttcaggaggaatcctaaggagaggtggagttgtggtcagcttctgaagcatccgcttcttggggaattcagttccaatgataagaaaattcaggaatctaattcgtgttctccaacaagtattcttgagcagggcttttggaattctatggaagaggcagaggtagagtgtgtctctgcctctgccaatgtggttcaggttaaaagttttgaggattctcccaggggtaggatcagaaggcttgcttcgtgttcaggggatccaattggggaattggacgatgaaaattggatcacagcaagaggcagtgaaatgggtgcttcttcaagttgtgatgggttggatttggatgttaatagtagaattagtggttatttttgtgatgattattataaatgtagggatgttagtgttgtagttgatagtttcaattttgagagaggcaattctgagaagcttctcccattaacattggattttttataa

SEQ ID NO: 27325 - DNA, 276 bp, Glycine max
  Peptide Sequence Number=SeqID_144103
atgactgcactttgtattctttcatcacccttatttctactgaatgcttgcaccccaaaacagcacatagatggggcgattctccaaatggcatacacaatgcaaaagcataaatcctctgcaggaacctatgatttcaacaaagtgataatacggtttggggccaggaaactccactgttactgcaacagaggcagagtcattgaagtctatggaccggagttcaggagcagaagatgcaatgaacaaaagtctatccacacgtgctgcagctag

SEQ ID NO: 27326 - DNA, 2202 bp, Glycine max
  Peptide Sequence Number=SeqID_144104
atggctctgctttccaattccaagcttctccgatggacacccactctccatccaaaccctctctccgccttctccaccgccgaagctctctccgaaaccgaccacccctctccgccctccccgcagccccaacccccacccatcattccccctcgcgagaacaatctcgaactcaccatctgcaagatgatgtccaaccgcgcgtggaccacgcgcctccaaaactccatccgctccctcgtccctgaatttgacccttcccttgtctacaacgtcctccacggcgccgcctcgccggagcacgcgcttcagttctatcgctgggtcgagcgcgccggcctcttcacccacaccccggaaaccaccctcaagatcgtccaaatcctcggccgatactccaagctcaaccacgcgcgctgtatcctcttcaacgacacgcgcggcggcgtctcacgcgccgccgtcaccgaggacgccttcgtctccctcattgacagctacggccgcgccgggatcgtccaggagtccgtaaaactttttaagaaaatgaaggagctcggcctggaccgcaccgtgaaatcctacgacgcgcttttcaaggtcattctccgccgcggacgctacatgatggcgaagaggtactacaacgcgatgctcctcgagggcgtggatcccacgcgccatacctttaatattctgctttggggtatgtttttgtcgttgagattagacactgctgttaggttttacgaggatatgaagagtaggggtattttgcctgatgttgtgacttataacactttgattaatgggtattttcggtttaagaaagtggatgaggctgagaagttgtttgtggagatgaaagggagggatattgttcctaatgtgattagtttcaccaccatgttgaaggggtatgttgcggctgggcggattgatgatgctttgaaggtttttgaggagatgaagggctgtggggttaagccgaatgtggtgactttctccacactgttgccggggctgtgtgacgctgagaagatggcagaggcaagggatgtgttgggggagatggtggagaggtacattgcaccaaaggataatgctttgtttatgaagatgatgagttgccagtgtaaggctggggacttggatgcggctgcagatgtgctgaaggcgatggtcaggctgagcattccgactgaggctgggcattatggtgtgttgattgagagtttttgcaaggcaaatgtgtatgacaaggcggagaagttgttggacaagttgattgagaaggagattgtgttgcggccgcagaatgattctgagatggagcctagtgcttataatttgatgatcgggtatttgtgtgagcatgggcggactggtaaggcggaaacttttttccgccagttgttgaaaaagggggtgcaggattcagttgcttttaataatttgattcgagggcattcgaaggaaggcaaccctgattctgcttttgagattatgaagatcatggggaggagaggggttgctagagatgtggattcctacaggttgcttattgagagttacttgagaaaaggggagccggctgatgctaaaacagctttggatggcatgcttgagagtgggcatctaccggaatcgtcactttataggtcggttatggagagtttgtttgatgatggcagggtccaaactgctagcagagtaatgaagagtatggtggagaagggggcgaaggagaatatggacttggttttgaagatattggaggcccttctcctgaggggtcatgtggaagaagctctgggacgaattgatttgcttatgcataatgggtgtgagcctgattttgaccatcttttatctgttctttgtgagaaagaaaagacaattgctgctctcaaactgttagattttgttcttgaaagagactgtatcatagatttttcaatctatgataaggttttagatgctctcttagcagcagggaagacactcaatgcttattccattttatgtaaaattctggagaaaggaggatcaacagattggagcagccgtgatgagctgatcaagagccttaatcaggaggggaacacaaaacaagcagatgttttgtcaagaatgatcaagggaacagatggacgtaccttaaggagaggaggaaagagaaaagctactgtatccacgtag

SEQ ID NO: 27327 - DNA, 2409 bp, Glycine max
  Peptide Sequence Number=SeqID_144105
atgggcttcctttcgaaggtgcaagatcaagtatacttactgccacatgaagaaaggcatagtgattcaaaaaatgtaatgaaggatgacaaaggcttttcagctactgacagtgatatggcagatgtatatcctttacaactcaggctttctgttcagagggaaacaaattcatttggagtaagaataagcaaaaaggacaatgcagttgagctctttaaaagagcctgcaaaatgttcagtgtggattcagagatgttatgcatttgggactattcagatcagataacatttttaatgaatgacaacaatcaggtcccagttgactgtcaaaggcagtctgatcaggagattcttttggagttgcaagtttatgggttgtcagactcaattagatgtagggaaggtaaaaaagacgagatggcaaatttttctggcagtgcttcactgaagatgaatggcacttatgatggtgcaaattctgattgtatgaatgccaattctttgaccttctcttcaggccctggtgaagctggttccttgggattaactgggttacaaaacctaggaaacacttgcttcatgaacagttccctacagtgtttagcacatacaccaaagcttgttgattattttctggaagattatattagagaaatcaatcatgataacccattgggcatgaatggtgagatagctttggcatttggagatctgctcaggaagttatgggcccctggagcaagtcctgtgtcaccaagaatattcaaatcaaaacttgctagatttgcacctcagttcagtggatttaatcagcatgattcccaagaacttcttgcttttttgttggatggtcttcatgaagatctgaatcgtgttaaatgtaagccttatattgaagtcaaggatggagatggtcgacgagatgaagaggttgctgatgaatattggcataatcatttggctcgcaatgattctgtcattgttgatgtgtgccaaagattatatcatgccattgaattgcttcggaaaaaaataattagcttctttgtggggaggggggaaaggggtgtgggtgacatttctgctgaaggtaatggtttcatgaaggtctctgtgacatttgatccattcatgtacttatcattacctctaccttcaacaacagtgcggacaatgactataactgttgttagtggcaatggtggtgaaatgtctcaattatcaccatacactattactgttccaaaaaatggaagatttgaagatctgacccgtgctcttggcattgcatgctctttgggggctgatgagaccttattagtagctgaggtatacaacaattgcatcatacgttttcttgaagatccaactgattcattatccttaatcagagatgctgacaaactagttgcttaccgatttttgaaatgtaatgtggatgcccctttggttgtcttcataaaccagcggatggaggagcagtatgtctatgggaagcagactctgaattggaaagcctttggaattcctgttgtagataggctttatagtgttacaaatggatctgatctccgcaatttgtatctaaagtggttctatccatttcaaaatccaattgaagaggccttagaaaattgtctcgtgtctaaggaaactgaagaagatgcagaaacggaggtcacaactcctagtttaggttcaaatgtgaatgagttagacactccttcagatggaggaatggagttttatgttactgatgaaaagggaactataaaaaattccaagatattaatgaatgagcctctagcaataaatggagacttaaggctgctgcacgtgcttgtgtgttggtcagaagaacagcttaagatatatgacacgcaactttgtagttcattgcctgaggttttcaagtctggctttttagcaaagagacctcaagaatcagtttctctatacaagtgccttgaagcatttttgcaagaagaacctcttggaccagaagacatgtggtactgtcctggctgtaaagaacatcgtcaagctagtaagaagttagatctttggagacttcctgaaattttggtcattcatcttaagaggtttcaatacagtcgttacttgaaaaacaagctggagacatatgttgacttccctgtagataatctcgatttgtcagcttatattacctatgggaatgatgagtcttaccattacacactttatgctgtcagtaaccattatggaagcatgggaggtggtcattataccgcatttgtccatcgaggcggtgatcagtggtatgacttcgatgatagccatgttaatcccatcagcaaggagaagataaagtcttcagctgcctatgttcttttctacagaagaaatttcgaagtatcaacatag

SEQ ID NO: 27328 - DNA, 387 bp, Glycine max
  Peptide Sequence Number=SeqID_144106
atggaggcaacgagagtgaacacaacaggatgggatggaggcaaagttattgtctatcacaagcggaggcaacgacgacaggatgggattctcgacggcattagggtgtctggaattgaaattacaccagaccctgttgtgcgtgctaggcctgccacctttaagatttcagctgctactggtgaagctatttatggaggaaagtgggtaactgcagttgcatacttcggttttgttgtcctcaaagaaatccatgatttttgtgaggaaatatcatgtcctgttgctactggcagttttgtggctgctcacacccaaaaattgcctgcatttgccccaccacttctgaatcttttagaatttatggaatttcatgaagctggttga

SEQ ID NO: 27329 - DNA, 366 bp, Glycine max
  Peptide Sequence Number=SeqID_144107
atggactgtgcctccgaagattgctccgataactctcagcgaccggactcacacaaggaccagcgagtctatttcgttcctcacaggtggtggaaggatgctcaggattcaatgccggaggcagattcggataagaagaagggaattgcgtttgcctcttttccaggttcgtcctatgctggtcctatgaagattatcaataacattttcaactcagatcttgtgttcagtcttcggagggaggaggattcaccacgcattcgtgaaaatggcgaggttggtgtgtctggccgggactttgctttggtgtctggggatatgtggttgcaggcactcaagtgctttgtgcagtgccttcgtgcttaa

SEQ ID NO: 27330 - DNA, 225 bp, Glycine max
  Peptide Sequence Number=SeqID_144108
atggatggacactatgaacattgtgatagggatgaggatgacgagcggataaggcttgcacttgggctcaagcgtagtgagggtgtgccttcattgagaaagctcccaagaccaatagtgatgcagtggttggcttcagagagtagggcacgaagatcttggttttgtgtttattgtcgcgatgccaatgatgatgtcggtggcagcacttttgcagcaacatga

SEQ ID NO: 27331 - DNA, 357 bp, Glycine max
  Peptide Sequence Number=SeqID_144109
atgacgcttcgagctttgcttctgcaaagcgaacaaaatagcggaaagtcgacatcaaaaaataaaaaagtagcgaccagtgaagaaggcaccgtagcagtggtagcggcggcggaggtatcgcgggctctgaagcaagcgaagaagcaccccatggcagtggttcgggagcaggatcggagaacgaacctcagtgtcgaagctagctgcagctctggcccgagcgtgtcatggaagaggctcggagcaggtaaggtgtataggacgcgctacgaagtggggacacgtggagcgtgtggcgcatgggagtgtggtgatggaggcggcgagtgggagcggtgtagaatgagagtatga

SEQ ID NO: 27332 - DNA, 420 bp, Glycine max
  Peptide Sequence Number=SeqID_144110
atgccaccaccaacctccccttcaccaaattggttcgtccaaaccaccacttacctccccttcatcaaatccgcctgcctaaacgaccattgcaccaccactagcctcccccttcaagttcccatacacgttttgtggcaggctatgaattacgatctgtgtggtgttggcggtgaaggaggtgctggtagtggtggtggtggtgacaatgacgagggtggtggtagctgtagtggagatagtaatggtggttgtgatgatggtgttggtggtggtatcagtaattgtgatggtggtgatgctggtggtggttgcggtaatgtcactagtgatggtagaagaaacaatagttattgtggaggcgatattgtcaatgatagtggtcgtggtggtggtatttatgatagttgtagtttataa

SEQ ID NO: 27333 - DNA, 1134 bp, Glycine max
  Peptide Sequence Number=SeqID_144111
atggcactctggcaagccttggtgttgcattgtgaatttctacctcaagcttctgtcagcaaggccaagtttctcaaagctggtggtaccttagcaaggacccctcttgagaaatcccaccttgatggtcaacctttcaatccctcaactcctgtaaaatgttgcgaggaagggggggagagaactgattccttggagcaaacaccaagcagctgtatctccaatgcgcaaagtactcaatgtgaccctattgattctacggaaggaattaggacagggagtcttcacagtttggacaagaatacagcttctgtttcaccttggccatcgaccacatacactaagaggaggaacaagtttgtacgttttgaatgtggcagtgatttatcatcctgtgattcatctgattatggcggacgacatatgaagaaaacagattcaccaaataatgagagtgcatataaaccatcgcctaatcctaccccgatgaagctatctgacgagatgcaaactcctggaacagtttaccctgcaacaaaagacttgccaaatggtaagcctcgacttaagtcccagtttgtgtatccaattaacaaccctggtgatgatgtctctctgaagaaatttgaggagagtgaatcagttgagctgtctcaaattacaacttcaactcctgaaaaagggttaaagaaaatgtcttgtgaaaatgtatgtaaggtggaggaaagcttgtcttcctggttgaagcctgcggctgtcattctggaggagagaaacaagagaatgcagaccgcttataatcaggtccgcaaaacacctgctgataggcctatcattgggatggttgcagctcactggaatgaggatgaggattctcaagctcctcctcctaagtggtgggatggtaatggcataccaaattcaaccaataagtataaagaagatcagaaagtgaaatggcatgcaacaccatttgaagagaggctggaaaaggcattatctgaggagactgtcatctctcaaaggaaggatgcatgtggaaaatcaattccttttgatgacaacgaagaaagtgatactgcactatctcagctgcaatcttcaactcatccacagtcagtggtgtcattctga

SEQ ID NO: 27334 - DNA, 357 bp, Glycine max
  Peptide Sequence Number=SeqID_144112
atgactccttttctgacagcaacacttgctggtaaatatgtagcagtggacgcgtctggcttattgatttcaacactgcaagttgtgctttttcctgtgttggctggtgcatttctgaaccagtttttcaaaccttttgttaaacttgtctctccattgatgccacccattgcagtaacaactgtggcaattttgtgtggaaactctattgcccagagttcttcagcaatccttgtgtgtggtggacaagtgattttagctacctttcttctccatgcttctgggtttttctttggttacatatttggaagattgcttgggttagatgtgtcatcatcgcgaaccatatccactcag

SEQ ID NO: 27335 - DNA, 312 bp, Glycine max
  Peptide Sequence Number=SeqID_144113
atggcaagagccccacgaagatcatcaagagttaaggtcatacccattccaagcatgatgatgttgaggcccctaattgtcacttttggagtgacccaattgaagcaatttggtttcatcaaccccaatacgcacccaattgagacccacaatggaaatgccattgagagaaactcaccagccagcacaagccactctcggacactcctaacctcgtttccaccatacatgttggaagaaatgccacaccgaacgttggaactgaagattcttgttggtggttttggtgtgcaaaggtttagcagtggttga

SEQ ID NO: 27336 - DNA, 528 bp, Glycine max
  Peptide Sequence Number=SeqID_144114
atggcagtggaatggagaaggaagagagagaggagatgccacttcaaggagaagatgagtctagaagaagctcaccaccataggaggccatggataagagcttggaggaagaaggagatgaatgaagggagaggaagaaaagagcatgaaattttgtgctctaaaagggctctgaaatctgaaatatggttcagcccactaatccaagatcaagtccaagattctccactaagtgtgcttaggtgtcatgagcccatgagcccgaaatctaacctaaggctcatgagaaccctagggccttctcttgcatctttggcccaatcttcttggagtcttctatccaattccgttaggggtcctttcgctaagtgcaagcctcgcgctaagcgcatctttggtcatacgctaagtcgagagtctctagagcttagcgctcaacccttgcatctcaggctaacttggtccgctaagctgcccaaggatgagctaagcacatttcaattcgatctgaattgggctaagcgatag

SEQ ID NO: 27337 - DNA, 942 bp, Glycine max
  Peptide Sequence Number=SeqID_144115
ggtttcaatggaaccttaactgagccaattgagagagaaggtgatcggtttaaagaaagggaactcacagtgcatccagaactgaaacagcccttggccgaactttgcagtgacccaaagaccacagttgttgtgcttagtggaagttgtagaacagttctagatgaaaactttaaagaatatgacatctggctggcagcagagaatgggatgtttctaaacccttcaaagggagaatggatgacaacaatgcctgagcaactgaatatggaatgggttgacagtgtgaagcatgtttttgattacttcacggacagaacacctcgatcgtattttgaagaaagggaagcttcacttgtttggagttacagacatgcagatgttgagttcggaagactgcaagcaagggacatgctgcagcatctctggacaggtccaatttctaatgcatctgttgaagttgttcaagggagccgatctgttgaggtgcgagctgctaatgttacaaagggagcagctattgaccgcattctaggtgagatagtccacagtaaatccatgacaacaccaattgattacgttctgtgtataggacattttctgacaaagcaggatgaagatatatacgcgttttttgagccagagctaccacgaagcaaggtaacagaaggagtcaagtttcctgttgagagggtatcgtcatcccaaaataagggacaacggcctgtgtcaaactctgagaagaaaacaaataatcatgtctgccgcctgccacggcggccggctcctgaaaagatctcttggaatgtgcttgacctcaagaaggagaattacttctcgtgcgctgttggacgaacacagaccaatgctcggtatacgcttgcttcaccagatgaagttgttgcatttctcaaggaactccatactttgtctcagagctaa

SEQ ID NO: 27338 - DNA, 132 bp, Glycine max
  Peptide Sequence Number=SeqID_144116
atggaaaaggtattcaagatttttgtgtatgaagaaggggagccaccgttgttccacaatggtctaaacaaagacatatatgccactgagggaagattcatacatgaaatggaaaaggggagtatttactaa

SEQ ID NO: 27339 - DNA, 142 bp, Glycine max
  Peptide Sequence Number=SeqID_144117
atgctcaaaagaaatactgattcagaaggagcaacattgacagaggccagaccttttggtggctatgaaaattctgatgacacaagtattattcgattaaagaactacatgaatgctcagtattttggagagattggtatag

SEQ ID NO: 27340 - DNA, 267 bp, Glycine max
  Peptide Sequence Number=SeqID_144118
atggaagtgaaggttgttgccaaagctgcagtgaagttggggtcagctgcaatggcaacactaactgtgtcagcaagggtctgcatcgagacatttgaaggccagaaaacttggattggttatacagtgcttggccaaatatctgaggcaacaatgaggcttgtgaattgggaaagttataagggacaacaaggaaggagatttggaattggcttggttgctttgggaactgtaatgggtttggagactaattcaagtccaatgtaa

SEQ ID NO: 27341 - DNA, 213 bp, Glycine max
  Peptide Sequence Number=SeqID_144119
atgaatgtcatccaaatagaggttgatggaatgcttgagttactttctcaaggtctaaaccagttaattgatttacctgcattacgtatgttagaggattttttgtataatacacctaagaagactattggtgttcttgaatactattttgaggtaccatatgaatcagattcaaccacttttgtgatttttgatctgagaggtcttgggtga

SEQ ID NO: 27342 - DNA, 291 bp, Glycine max
  Peptide Sequence Number=SeqID_144120
atggggtggttgaatggatcaatctcagaagatgtgccaaccgggttgaatattcaaagaagaggttggagaccagagtgctgtacaccagatccaattgccttcacaggaagttctcctggaggattactcactacaatggtacaacaaaagagatgggcctcaggcctcactattgtcttttttggaaagcattctcctcttataggcatgctcttttggcatgacaattttgttggtgcatttgacaacaatgttgataaagttttgtgggttgcaacaaactcgtag

SEQ ID NO: 27343 - DNA, 2007 bp, Glycine max
  Peptide Sequence Number=SeqID_144121
atggccaaccaaggacatgttctccctctctctgaaaaaatttggttcaagcgcacatttcaaagagtaatagacaccttgattttagtccttctcctcttgaatctcagttatcgtgttttctcatccaataatttcactttcccatggttccttgctttcatatgcgaatcctggttcaccttcatttggattgtgattcttaacaccaagtggagtcctgcagtaaccataacccacccaaatcgtctccttcaacgggtacctgagcttccacctgtagacatgtttgtgacaacagcagatcctgtacttgagccacccatcatcacaatcaatactgtgttgtctctgttggcacttgattatccagctaacaagttagcttgctatgtttctgatgatggctgttccccacttactttctatgcccttgtagaagcctctaaattcgccaagttttgggtacctttctgtaagaagtacaacgtgcaggtcagagcacccttcagatacttctctaatgttgccattagcaaaagtgaagagtcccttgaattcaaacaagaatggttacaaatgaaggatatgtatcacaatcttagccaaaatcttgaagaggtgacaagcaaaacaattccattccaacttgatggagaatatgcagttttctcaaatacagagcaaagaaatcatccaaccataattaaggttatatttgagaacatggatggcctttctgatcagttgcctcacctaatatacatatcaagagagaagaggccacagtatccacataattacaaagccggagctatgaatgtgttgaccagggtgtctgggttgatgactaatgccccctttatgttgaacgtggactgtgacatgtttgtgaacaatcccaagattgttcaacacgctatgtgcattttgatggattcaaaaagtggaaaagaagttgctttcgttcaatgtttccaacaattctatgacggaataaaagatgaccctttcggaaatcagtgggtggctgtatttgagtacatagtgcggggcatggcaggacttcaagggcctttctattgcggaacaaacaccttccatagaagaaaagctatttatggtgtttatcctgatgaaactggaagcaggagaaatggaaaattagaagaaaagatattgatacaacaatttggaagtttagaggagtttgtcaaatcagcagctcatgctatggaagggagtgcatattctgcaaatgatattactccttccagctttattgaggcagcaatccaagtcgctgattgtggatatgaagatggcacttggtggggtaaacagatggggtggttgtatggatcactcacagaagatgtgctaactgggttgagtatgaaaagaagaggttggagatcagagtgttgtacaccagatccaattgccttcacaggatgcgctcccggaggattactctctacaatgttacaacaaaagagatggttcactggccacactgtaatcttttttggaaagcattctcctcttatgtgcatgctctttggtaaaatccagttcagagcaggcttgtcttatttctgggtttccactttgagcttaagagagtacgttaaaattggattgtcaatgcgacaatggtggaacaatcagagaatgtgcatagttagaacaacgactgcatcgtttcttggatttttgaatggcatggttcagctatcagggttatcggacattgcttttgacataacggagaaggaatacccaacttctagtgctgatgaaaacagtacagatgctggaaggttcacattcaacgaatctccagtttttgttataggcacgaccattttgctggtttatttgacagcaatattgatcaagttttgggggttgcaaccaactcatagtgggaatgggagtggactaggggagttcatctgtaaagtaatggtctcagttgatgacttgacttttgcagaagaatag

SEQ ID NO: 27344 - DNA, 2247 bp, Glycine max
  Peptide Sequence Number=SeqID_144122
atggccaaccaaggatttgatctccctttctacgaaaaaatttggttcaagcgaacatttcaaagagtgatggacaccttcattttagttctcctcctattgcttcttagttaccgaattttctcatccaacaacttcactttcccatggttccttgctttcttatgtgaatcttggttcaccttcacttggattgtgattctcaacgccaagtggagtcctgcagtaaccataacccacccagatcgtctcttgcaacgggtacctgagcttccacgagtagacttgtttgtgacaacagcagatcctgtacttgaaccacccatcatcacagccaacactgtcttgtctcttctagcacttgactatccagctaacaagttagcttgctatgtttccgatgatggttgttctccttttactttctatgcccttgttgaagcctccaaattcgctaagctttggatacctttctgtaaaaagtacaatgtacaagtgagagcacccttcagatacttctctaatgttgccactaccaagagtgatgactccccagatttcaagcaagaatggtcacaaatgaaggatatgtatgacaaccttcgacaaaatattgaagatgtgacccgaaaacaaattccattagaacttgatggagaattcgcagttttctcaaatacagagcaaataaatcatccaagcataattaaggttatattggagaataaggatgttctttcggatgggttgccttacctgatatacatatccagagagaagaagccaaatcattcacataattacaaagcaggagctatgaatgtgttgacaagagtctctgggttgatgaccaatgctcccttcatgttgaatgtagactgtgacatggttgtgaacaatcccaagtttgtcctgcatgctatgtgcattttgatggattccaagagtgggaaagaagttgcttttgttcaatgtttccagcaattctacgatggaataaaagatgacccttttggaaatcagtgggtggctgcctatgagtacataatacggggcatggcaggacttcagggaccatactatggaggaacaaacaccttccatagaagaaatgctatttacggtctttatcctcatgaaatggaaaatggaagagaagatgaaaaattaggagaaaagatattgatacaacaatttggaagttcaaaggagtttgtcaaatcagcagctgttgcgttggatgggaaagcataccttcccaaagatatcagtccttcgaattttattgaggcagcaatccaagttgctagatgtgggtatgaatgtggtacattctggggtaaaaagattggctggttgtatggatcaatctcagaagatgtaccaaccgggttgaatattcatagaagaggttggagatcagagtgttgtacaccagatccaattcccttcacagggtgtgctcctagaggatttatctctacaatggtacaacaaaaaagatgggcctcaggcctcactgttgtcttctttggaaagcattctcctgttatgggaatgctctttggtaagatccaattcagggctggcttgtcttatttttggcttaccaattggggctcaagaggtccattccaagtttgctatgctgctctaccagcatattgcataattaccaacaccaatatctttcccaagggacctggcttatggattccaattgctcttttagtgatttacaatctacatactcttttagagtaccttagaattgggttgtcaattcgatattggtggaacaatcagagaatgagcttagtaacaaccacaactgcatggtttattggatttttgagtgctatgcttaagctatcagggatatcagatactgtctttgaaataacagagaaggaacaatcaacttctggttctgatggaaacaatgcagatgctggaaggttcacgttcgatgagtctccagtttttgtggtaggcacgaccattttgttggtgcatttgacagcaatgttgatcaagttttgggggttgcaaccaactcatagtgagaatgggagtggactaggggagttcatctgtagtacgtatttggtaatgtgctactggccatattttaaagggctgtttggcagaggaaaatatgggattcccttttccaccatgtgcaagtcagtggtctttgcattagtctttgtgcacttttgtagaagtaatgccatcagtggatga

SEQ ID NO: 27345 - DNA, 510 bp, Glycine max
  Peptide Sequence Number=SeqID_144123
atgcaaagacgcatttttacgtctttcctcgccctctcgccgaagggtggggttgtgaagggtttgttgggattttggccacgtgggacaattattttcaacctcccgacgacttcgcgcattcacccagtattccactgttctttattcaaaccatacctcgcacccactaatcaggctgatgttccactagaattgccaaactctgtcgaggataatcaacccattataacaccacttaccatccttgatgctaaatgggaaaaaacaaacataggaaaagaattactcgtgctggtacaatggcgggggctgttccctgaagacacttcgtgggaggaccttaaactcaaatacaaccttaaggacaaggttactttggaagcccatggggatgttatgaataagaatatggagcaacagaacacagagcaagaaccagagaaagaagaaaaccgaaggctaagaagggaaattaacaagcctcattacctcagagatttcgtgtag

SEQ ID NO: 27346 - DNA, 645 bp, Glycine max
  Peptide Sequence Number=SeqID_144124
atggagtggtttgtgggtcgagacagaggtagtgttatcggtgcctggaatagtgcttcgaattgggtggttccgacggacagactcgaaggtgaaagtattcacttgcactatttgtttgaagcaggcgacagagctgtgggcacccctattttagggtctgcgtcttttgcttcctgttcctcatctgcgatgagaaggaaaaatcaagaggcacacttatggcctctagtgaacttctcgtcgcagttgaaacaaaggtctctttccctccagctagccatctcctctggtgtgagcctttttaagggtaaaggtggtggtttggcgggtgaaggcaagaggggtagtcatgctaaccccgccgcctggaccaaggtccaacctagatatgaagcagctaaggaggagtggtggcggcaaccctacaatgcgattggcaagcgccttagatttcgacagcctgaagggtctgacccatcaaatctcggtatctccaatttcattcgtggcggattggttacaagggggatgggtgtgggaatgactaatgaagatgagggtgaaggagatggttgggagttgttttcgagattggtaaccctattaataagcgcatcaagcttctttgtgacatggagatga

SEQ ID NO: 27347 - DNA, 252 bp, Glycine max
  Peptide Sequence Number=SeqID_144125
atgcagcttaactctgttgggttaagaggaaaccataagttttcctccatccataatgacaaggaaaaagggtacaatctaattaagagggaggggcatatatatgtaatagattgtaattctattatggctgttgaggtaccatgtgatggtgagggtttgaagcagacgaatcagaagaggtttgatggtggtataagttgtgacatcctggaaatttctacccggaattttgtaaacgatgcattttga

SEQ ID NO: 27348 - DNA, 462 bp, Glycine max
  Peptide Sequence Number=SeqID_144126
atggtatcaagggaacctcttctttcccaacctgtaattcaagacatattcgtggatgaggatcgtgggatagagacactaaatgaagatccaatgcatataatgataaatgatgcatttggattgtctagattgtgtgccaatgaagagtcatttccatcatcacctgaacatagtggtggggtgaaggaggaatttgatttacttaaagatggagagcaaccgctttatgatggatgcactgagtattcaaaattgtcattcttggtgaaattatatcacatgaaagtgttgtgtcgagttagtgacaaagcaatgaccatgatcattgaattgttgcatgatgccttcaaacatgcaaacatccctacatctaattatgatgcaaataaactcctcaacaagtttggtcttcattacactaagatacatgcatgtcctaagggttgcatgttatattag

SEQ ID NO: 27349 - DNA, 117 bp, Glycine max
  Peptide Sequence Number=SeqID_144127
atgattcaccaacctcttagtggagctcaaggaggacaaactgacataggtatacagaaaatggaccaaattggtcctcagcagtatttaagttctgatgttttcaatcagaaatga

SEQ ID NO: 27350 - DNA, 351 bp, Glycine max
  Peptide Sequence Number=SeqID_144128
atgacctttggatccatggtggggactctaaaaaaagccttagcacgagctctaatctcttattatgtatttgcaggagaagttgtgcctaacaatatgggtgaacccgaagtgctttgtaataatcgtggggttgattttgttgaagctgtggcagatgttgagctaaagtgcctcaacttttacaacccggatgacaccattgagggcaggtttgttccaaagaagaagaatggtgtgcttgctgtccagctgtttgaaattttttggacctcctttgatcatgagtcctgggtagtcgcatcgcaaaacaacccctcaagccctgataagaaggaaaatcctaattag

SEQ ID NO: 27351 - DNA, 747 bp, Glycine max
  Peptide Sequence Number=SeqID_144129
atgtacacccccatttccgagttccctcctcctccggccagcgccgccaccgctctcctcagccgcatatactacgtcaaggcggagcagctccaccgcatgcagtttctcgccgccacgcgcacaaagctcgagtgtttctccgcattcttatggaagatggttgcacttgcggcttcaaaagaggaaaatggtaagagggttgtggccaaaatgggcattgtggttgatggaaggaaaaggcttggcaacggtgacaaagagagtgaagcaatgatggagtgttattttgggaacgtgctttccataccctttgacgggaaaccggtgcaggagttggtggagaagccactaggctttgtggcggaggcggttcacgagtttttgatggcggcggccaccgaggagcacttcttagggctaattgattgggtggaggatcaccgaccggtccctggagttgctaaaatttattatagcaacaccaaagagggaccagcctttgtggtgtcttccggacagagatttccggaggacaaagtggattttgggtgggggaaagttgtgtttgcatcatatcattttccttgggctggtgaagctggctatgttatgccaatgccaagtcctttggagaatggtgattgggttgtgtacatgcatcttgcaaagaagcagttggagatcatagaatctgaggctgctcatgtcttcaagcccttaacgtgggactaccttaaccagtaa

SEQ ID NO: 27352 - DNA, 531 bp, Glycine max
  Peptide Sequence Number=SeqID_144130
atggaagctatcttccttacaaactcaagtcccacatacaccacatttacaaccaaaaatatgcttcaactgtttcactggccactattttctgctaatgacgtgtacattctccctgtttcttacccagatgtagcacttgtcacatctttgagggatggaatgaatctttttgctggtgctgcacagtcacttggtgctggggctattcttgttaacccttggaacatcacagaagttgctactgcaatttccaaggctctgaatatgccatcggcagaacgcgagaagagacataagcataactatgaacatgtaaaaactcacactgctcaggaatgggcagaaacttttgtaagtgaactaaatgatactgttgtcgaggcacagataaggacaaatcaagttccaccacggctcccaacagagactgcagttgaatgttatttgcagtcaaataatcggttgcttattttgatggtctcagatgacagatctgttgaaagtgaaacagactcagttcttatatga

SEQ ID NO: 27353 - DNA, 897 bp, Glycine max
  Peptide Sequence Number=SeqID_144131
atggttggattccagagtgaccatatgcctgggaacaagtgcaatggtaattctaatagttttccggttccggatcgtcatgaacgacttatgagaggaagagagctaagaaaaagcagcagggcatctcctgatagtaatagtattagtaatgtgggtagtgaaatttttgagcatgacctgcgcttaagagaagataataactctgctgctcccattgttgaacgatacctggaagaagtggcagcagctgcagcagcagcgcggggagaaaggaaagatgggagacctttcagacaacggcttttggtggtggccaacaggctgccagtctcagcaattaggaaaggcgaggattcgtggtctttggagataagtgctggtggcctggtcagcgctctcttaggtgtgaaggagtttgaggcgagatggataggttgggctggtgtcaatgtgcccgatgagattggacaaaaggcacttacaaaagctttggctgaaaagaggtgtatcccagtatttcttgatgaagagattgtgcatcaatattacaatggctattgcaataacattctgtggcccctttttcattaccttggacttccacaagaagaccgccttgctaccacacggagtttccaatctcagtttgaagcttatcagaaagcaaatcaaatgtttgctgatgttgtaaataagcactatgaagagggtgatgttgtttggtgccatgattaccatcttatgtttcttccacaatgcttaaagaattataaccacaaaatgaaagttggctggtttctgcataccccatttccatcttctgaaattcacaggacattgccatctcgctcagaactcttgcatgctgttcttgcagctgatttggttgggtaa

SEQ ID NO: 27354 - DNA, 221 bp, Glycine max
  Peptide Sequence Number=SeqID_144132
agcggcagtcgaagaaatgggatgctcctaagaagatcggaggagtgtcgtgccgctgtggggttgccagcagagaaggacgcaggggaaggttggagttcttttcgaagaaagaaaaccaagaaacacaacaaccactcgctggagaaggggacgttccagagaagaaccctcaccatgccaccgtggtgttgccggagaagaagcacgcggtagagtga

SEQ ID NO: 27355 - DNA, 105 bp, Glycine max
  Peptide Sequence Number=SeqID_144133
atggacatgatggtgaaccatactgctggagagaataaaaatcttgagtcaattatctatggatcttttagatctgtgctgagagcagagacacgagcaagttga

SEQ ID NO: 27356 - DNA, 249 bp, Glycine max
  Peptide Sequence Number=SeqID_144134
atgacgcgaagttctagaaagtacgaatgcttgtgcgttggagtgaggacgggagaggttcagcaatttgcgggtagagagagaaagatgagaggtttgtgttttgaggtttcttctaaaagaggaagagagaaacggaaggacttatatagaaaaggagagagagagtgcacatttagtagcagacatttatgcatcgtcacgaacgcattccttttgacgggggcagagatgggttggggggagtag

SEQ ID NO: 27357 - DNA, 288 bp, Glycine max
  Peptide Sequence Number=SeqID_144135
atgtcttttgtcaagactatcaaagtctactttgcatttcaaagactatcaatgtcttttgttgagactatcaaagtctcctttacacttcaaagacttcaatgtcttttgataagtaaagaggggcaactttcataccctaatttcatccggggactctcattcgccaatgttttgattcttccttgccgaattgagctgttcgacaccagttgctgcgcaagacaaaagattattcgacatttcggtaaagaatgcggaaaatgttggaccttgtggcctcaataa

SEQ ID NO: 27358 - DNA, 114 bp, Glycine max
  Peptide Sequence Number=SeqID_144136
atgggattgcatataaaatccaccaaaccggatacacagttcccggttatactatatttcagaagccatgattccaacacactatataaccggtactacaaaggtcccctgtga

SEQ ID NO: 27359 - DNA, 351 bp, Glycine max
  Peptide Sequence Number=SeqID_144137
atgtgcaaaattgtcggaaagaaaaaaataataaaagaaaagagcgatagtaacttggttaaacccggggaatgtgtaaagcgatcgtttgccttagttacaaaccaaatctttatgtccgctcccctttcccacacaaaacaaaaggagaaagggaaacaaaaaggggaaaaggccaaaagaagagaaggtctaacatctggtgtctcactaagcgaggcatatgcgcttagcaaggcactcagctcgtttagcgggttgggaaaccctagaagaggatcagtctcagatgcatgcgcccaatgcaccgccagctcacccagcgagtcgtttgtcccttctcgcgcctag

SEQ ID NO: 27360 - DNA, 915 bp, Glycine max
  Peptide Sequence Number=SeqID_144138
atggaaagatggagaaatattgaattcaaagaagaagaaaaggtgattttcgaagctctgaatgagagtgaagatgcgacagatgcagaaataggagaagcatggtttgtagggaaggttcacactcaaggttcattcaatagtaaagcgtttatgacaactatggcacatattttgaaggtgaagggtggagttgaaatcaaagaagtaggggggaatcttttcaccttcaaattcccttcaaaatcagatacgaagaaagtactaggaagagaaccttggttttttgatcccaaattgattgtgatgaacgacatgaaaccactcaagaggagcatccgaattcagacagagaaaaatcgaagtagaaggatatttcttgggtatgagagattaggaaatttatgctttgtatgtggatgtttgaacaatacattgagaggttgtgataaaagggatgttgatgctaaagatgaggatgttgataattttccttatggtgtatggttgaaagcatccccaatggagatgaatgttgtggtaggggtgaaaactgaggtatcctttagtagtgctagaaggaaattatcatgtgatgccatggataagggctctccaggtgatcatttggcaaggaatgagggggaattaaagaatggaaaacatagtgaaagggaacctcaattgataaaggtttctgaagttttgaaaagtttggtggaatgccatattgaaaaggaggagcaactaagtataattagagtggatgaaaggatattaggcctaaaagaagcagagaagatagtgcctaaggttgtgatatgtagtggggaattaatgattaattatgtagaaaagactaaggtagtgcaggggaagaaagatgacgaaactgtctttaaaagaaaaaactag

SEQ ID NO: 27361 - DNA, 285 bp, Glycine max
  Peptide Sequence Number=SeqID_144139
atgtcgcagaacttcacggattgcctaacgatgggtgttaagttcctcaaagcgatcaagcgaaggttgcatcccaccaaacaaatgttatctaggtctgtttggggcaatgcacaagtatcgaataaccttcttgggttcctccttgttcttgcagttcaaatagctacacgtcttccatggtggcattgccgaatgaaactaccaaaaaatgtgcaacaattgccacttgcagacatggagaaatcaactgaacaacaacaagcaaagggtagatacagatga

SEQ ID NO: 27362 - DNA, 1269 bp, Glycine max
  Peptide Sequence Number=SeqID_144140
atgtctggtgttcttctttgggtgagttgtggacccaaggagaaccccatctccattgttggtcttgctggaagaggtggcagaagccagaggaggtttggactgtgcaatgggatcagttttgcaagcttttcaccagcagtggcagacccttcaagatcctcagaggagagggtatatgaggtggtgttgaagcaagcagcactggtcaaggagaagaataagggcaccaagagagcactgaatttagacaaaccaacagttgaaggtgatttaacccatggggatctgttgagtgctgcttatgataggtgtggtgaagtctgtgctgaatatgccaagacattttatcttggcacacaattgatgacccaagagcgcagaaaagccatctgggccatatacgtgtggtgcagaagaaccgatgaactagtggatggacctaatgcttctcacatcacaccaaaggccttggacaggtgggagcaaagactatacgatgtttttgaaggccggccttatgatatgtatgatgctgccctctcagatacagtttcaaagtacccagttgatatacagttggtaatgagtaaggaacttgtgttctacaagataagtgttgaattgtataatttagagtatctagtgttcagttatccatttaaggacatgattgaagggatgaggctggatctgagaaagtcaagatacaataactttgatgaactctacctttactgctactatgtagctgggacagtgggactcatgagtgttccagtaatggggatagcaccagaatcaaaggcttcgacagagagtgtctataatgctgcattggcacttggcattgctaatcaacttaccaacattctcagagacgttggagaagatgcaagaagaggaagagtatatcttccacaagatgaattggcacaagctggcctatcagatgatgacatttttagagggaaagttaccgacaagtggcgcaatttcatgaagggccaaatacagagagcaaggatgttttttgatgaggcagagaagggagtttcagagctcaactctgcaagcaggtggccagtatgggcatctttgttgttgtataggcaaatcttagattctattgaagccaatgactacaataacttcactaaaagagcttatgtaggtaaagttaagaagctgctatcactacctgctgcatatggaagagcacttctaggtccccaaaagttgaccaaaatggttacgagaagtatgtaa

SEQ ID NO: 27363 - DNA, 606 bp, Glycine max
  Peptide Sequence Number=SeqID_144141
atggatgatatggacatggatattcccctccccgaagaactcgaatttctcgaatcaaattctcattttgccgaacaagaacaagaagaagaagaccatcactattacttcccagacctagaccccgccgccgaatttcttgaatcaaattctcaacaatcgccgtcgccgcaagatctcgcggttccttcggcggagcccgaattcaacggccacaagcgatcgcgtccgccttctccagaagagaagagagcgaaggttagggttgccgtcgaggaggatttcgccgtggccgacgaggactggccccggtactctcctccgccggctcctccggagcaggcgatggaggaaatgatgttcgagaaggagaagacactgtcgagattcgcctcggagattgacggcgagtgcatgccgatcaccgcgcccagcggcaacagggtttacgcgaagctgaaccggttccaaggagaggagcgcgtcacgaagcttgattacaatggatattctgctgggaccgaggttattctgctggtactttttcttcttgaattattactccctgtgctagtagctcctagagaaatgaaactatttaactaa

SEQ ID NO: 27364 - DNA, 1087 bp, Glycine max
  Peptide Sequence Number=SeqID_144142
ttcatccacttcaggaacctcttcagattatgaattagatggaaaccaacacaaaggtgacaactttaacgttccatacctcatcaactcatgtggggtgtccccaaaacttgctaggaaactctccaaaaaggtcaattcgaaaaccccaaatggcccaaattctgttcaggatcttctcaacaactacgggtttgacaaaacccatctagcaaagcttgtagagaaacatcccatggtgctagttgctaacgcagagaacacccttttgcctaaactcaagtttttccgttctattggggtttccaacactgacatgcctaagatcctactttgtaaccatgtattattggtgagtagcttggaaaattacctcatcccacgttacgagatcctaaggagtgtacttcgtgacgatcaggaagttgttagagctttgaaaaacgccccatttggttttacgtatggtagctttataaacagcttggttccaaacatcaaggttttgaggcaatctggtgtgccccaagcttccgtgtcttacctgatgatccactctggggctgtagtctactccaaacattcaagatttgtggaggctgtcaacactgctaaggaaattgggtttaatcctttgagaataagttttattaatgctattgaaatgcatctaagtaggagcaaagcagtgcgagaatcaaggtttgaggtttatgagaagtggggttggaatggcgaaatggctcttcaagtatttcgaaagtttccctatgttatgaagttgcccgaggagacatttaccaaaaaaatgagtttcctagtgaaagatatgggttggttatcagaagatattgctgaatatcctcaggtgttagcgtacaacttggagaagaggattatccctagattctcggtaatcaaaatattgaaatcaaaaggtctgcttgagaaaaatgtgcatttcagtaaaattatttgcgtaactgagaaattatttttggagaaatttgtcatcaattatcagaaagatttgcctttcttgccagatttctacaacagtttgactaatcaacagaatgtagtatag

SEQ ID NO: 27365 - DNA, 1038 bp, Glycine max
  Peptide Sequence Number=SeqID_144143
tatgaaaagttgggaagaactaacaagaggcgtaagcgtaaacttgtccgaagaataacaccgggaaagaaagagagtgaagaagggtataagcgtccttgtgaaggcactaggccagccatcatcactatgtcatccccaaactccgtccctcagtcccacgcgccgctccttctcccgcgccccgatgccgccgcccgcctccccatcctagcgctcctcctcggccgccgcggccactccgccgtggtccgggagacggcggcgcgtgagctggaggagcgccgcgccgactggacctactcgaagccggtggtggcgctcgacataacgtggaacatggcattcgtgctggtctcggcggtgatgctcgcctgcaccgtcaaggagaaccccaacacgccgatccgctggtggatctgcggctacgcgctgcagtgcctcgtccacgtggccctcgtgtggctcgagtaccgcaggaggaacgacgctcccagggacgaggaatctgctgccagcctccaatacgacgacgtcaacgatagcgacgaggacgatgttggaacctccgggagttcctcttcctccgggttgtctgttgtctttttggcatttgatgtcttctttgctatcttttgtgttgttttggcatgcttgattggaattgccctctgttgttgtttgccctgtattattgctattctctatgctgttgcaggacaggagggtgcatcagaatcagatctcagtatacttccaaaatacagatttcaattgttaagcaatgaggaaacacctggtgagggaggaggatcaatgattcctatggagaccagcaacggttattcggtgaatgaacgaacactttcaccagaggatgcagaatgctgtatatgcatctcttcttatgaggatggagctgaacttcatgttcttccttgtaaccatcatttccattctacatgcatagtgaaatggttaaagatgaatgcaacttgtcctctttgcaagtataatattctcaagggaaatgaacag

SEQ ID NO: 27366 - DNA, 1212 bp, Glycine max
  Peptide Sequence Number=SeqID_144144
atgtctaattttctcctcattgcaagattaactgcgtcatcatcattcacacgctacaagagcacccatatcccattgggttctctgttgcaacacaaacacacagcttcactttttttcttcaattcattcacttcagctacctcttctgattctgaatcagatggaaaccaccataaaggtgacacctttactgtgtcgtacctcatcaactcatgtggggtgtccccaacactggctagggaactctccaacagggtcaatttaaaaaaccctaatggcccaaatgctgttcttgatcttctcaacaactatgggttctccaaaacacagcttgcaaaacttgtggtgagacatcctttagtgcttgttgcaaaagcaaagaaaacccttttgcctaaactcaagttctttcgttctattggggtctccgacactgacatgccaaaaatcctgattgctaatcattgtatcttggagaggagcttggaaaaatgcctcatcccacgttatgagttcctaaagagtgtactttgtgatgatcgggaagttgttagagctttgaaaagttcccctcttggttttgtatatggtgacttagtgaatgccttggttccaaacattaaaattttgaggcaatctggtgtgtctcaggcatccatctctttcctactgaccattgctctgcctgcagcatatgtggagcattccagatttgtggaagctgtgaagacagttaaggaaattgggtttagtcctttgaaaacaaattttgtcgtggctatttccgtgcttacaactatgaggaaaacagtctggaattcaaggtttgaggtttatgagagttggggctggaaccgtgaaatggctcttcgagcatttagaaagtttcctggttttatgaagttttcaggggagacgtttaccaaaaaaatgagtttcctggtgaaggatatgggttggccatctgaagctattgctgaatatcctcaagttgtagcatacagcttggagaagagaattatccctagattctctgttatcaaaatcttgaaatcaaaaggtctgcttgagaaaaacatgcactttagttccattatttgcacagctgaggaaaagtttttggagaaatttgtcgtcaattttcagaaaattttgcctttcttaccagatgtttacagaggtttgatcaatccttcaaatgtattgtag

SEQ ID NO: 27367 - DNA, 4353 bp, Glycine max
  Peptide Sequence Number=SeqID_144145
atggcgctgccatttaacaacattgcggttgcggaccgtttcttaaaaccatggtggccccctttagttgaggtggtgaatacctgggagttgcctcccgtgctcattgaaagatacaatgcagctggtggggaaggaactgctttttgtggaatatttcctgaaatacgaagggcgtgggcgtctgtggacaattcattgtttctttggcgttttgataagtgggatggccaatgtcctgaatttagtggggaagagcaagctatttgtgcagttggtcttgcaaaatcaaaacctggagtttttgttgaagctattcaatatcttttagttttagcgacacctgttgagttaattttagtaggagtatgctgctctggaggagcagatggttcagatccatttgcagaagttacattgcagccattgccagagcatacaataccatctgatggggttacaatgacttgtgtggcatgtactaataagggccgcattttccttgctggtcgggatggccacatatatgagattctttattcaactggttctggatggcaaaaacggtgcagaaaaatctgcatcactgctggtttgggaagtgtaatttcaagatgggttataccaaatgtattcagttttggagctgttgaccccattgttgaaatggtttttgacaacgagagacaaatattgtatgcacgaacggaagagatgaagcttcaagtttatgttctaggaccaaacggtgatggccccttaaagaaagtagctgaagaaaggaatcttgtcaatcagagggatgcacattatggagctagacaatcgacagggtcaagagtctctagtcgatctccaaagccatctattgtttgcatctcacctttatctacacttgaatccaagtggctacatcttgttgctgttttatcagatggcagaaggatgtacctatctacctctccttctagtggaagcttgactgggttcaacaccaaccaccacaagcctagctgtttaaaggttgtcactacaaggcctgctcctccttggggtgttagtggtggtctcacctttggagccatggctcttgctggtagacctccgaatgaggatctctccctgaaagttgaggcagcttattattctgctggaactcttatcctttctgatgcatcaccttcgaccatgtcttcactccttgttttgaacagggattcaagctcacaatcatcaccgtcgggtaatctaggaacaagtacgagaagttcccgggcattaagggagtcggtatcttctttaccagttgaaggacgaatgctttctgtggcagatgttttacctttgccagataccgcagctactgtgcagtctctatattcggaaattgagtttggtggttatgagagctctatggaatcatgtgaaagggtgtctggcaaactctgggcaagaggggatcttgcaacccaacatatactaccaagaagaaggattgtcgtcttcagcaccatgggcatgatggaaattgtttttaacaggccactggacattataaggcggctattggaatccaactctccacgatcagttttagaagatttcttcaatcgttttggtgcaggtgaggcagctgcaatgtgtctaatgttagctgcaagaatagtgcattctgaaaaccttatcagcaatgttattgctgagaaggcagctgaagcttttgaggacccaagagttgttggcatgccacaacttgaaggtagtaatgcattatcaaacacaagaagtgctgctggtggatttagcatgggccaggttgttcaggaggctgagcctgtattttcaggtgcacatgaagggctctgtttgtgttcatctagattactttttcctctgtgggaacttcctgtaatggttgtaaagggaagtttaggcccttcaggcactctatctgaaaatggagtagttgtgtgcagactctctgttggggctatgcaagtccttgaacagaaactccgatctttggagaaattcttaagatctagaaggaaccagaggaggggactttatggctgtgtagcaggtttaggagatctgagtggttccattctgtatggtaatggttcggcattaggagccggggatcgaaacatggtaagaaacttatttggtgcgtattccagaaatatggagtccaatggtggcagaacatctaataaacggcaaaggttgccatatagtcctgctgaattagctgccatggaggtgagggcaatggagtgcattaggcagttgctccttagatctggtgaagccctatttttgcttcaacttctttcacagcatcacgtgactcgattgattcagggatttgattctaaccttcaacaagcattagttcagttgacatttcatcaactagtttgttctgaggagggtgaccatcttgctacaagacttatatctgttctcatggagtattatactggtcctgatggcaggggcactgtagatgacattagtaggagattgagagatggttgtccaagctactataaggagtctgattacaaattctttttagccgtggaagccctagagagagctgctatgactatagatgctaaggacaaggagaatcttgcaagggaagcatttaattccttaagtaaagttccagagtctgtggacctacgaactgtttgcaaacgttttgaggatttaagattttatgaagctgttgtgcgcttaccactacaaaaggcacaggctattgaccctgcaggcgatgcttataatgatgaaattgatgcaactgtcagagagcaagcacttgctcagcgggggcagtgttatgaaataattatcggtgctttgcggtctctgaaaggtgacaccttacagagagaatttgggactcctattagatcaactgcttcacaatctgctcttgatccagcctctcggaaaaaatatatatgtcaaattgttcagctgggtgtccaatcacctgacagaattttccacgagtatctttaccaggctatgattgatttaggtctcgagaatgaattgctagagtatgggggtcctgacctgttgccatttttgcaaagtgccggtcgtaattctctacacgaggttcgtgctgtgacagccacaatttctccagtgggacaatcgggagcacctatgtcatctaatcaagtcaagtactatgaacttttggcacggtattatgttttgaaacgccaacatatgcttgcagctcatgcgttgcttagactagctgaaaggcgttctattgatggagttcctactcttgaactgaggtgtcaatacctaagtaatgcagttctacaggccaaaaatgcaactaatagtgatgggttagtaggttctggtcgaagttccattgacagtgggttcctagatttgcttgaagggaagcttgctgttcttcggttccagataaaaatcaaagaagaactagagtctgtggcttccaggtctgatgttttacctgccacaccagattctgctgaaaatggtgtagtgcctgagggaagttctactgctgatgctaattttgcaaatgcaacacgagagaaggctaaagagctagcttcagatgtaaagagcataacccagttatataatgaatatgctgttccctttgggctctgggagatatgcctggagatgctgtactttgccaatttttccagtgatactgacagcagcattgtcagagagacatgggctagacttatagatcaagctatatcaagagggggtattgctgaagcttgctcagtactaaagagggtcgggccccgcatttatcctggtgatggagctgttttaccactcgacattatttgtcttcacttagagaaggctggactggagaggttaaattctggggttgaagctgttggagatgaagatgttgcaagagcccttgtttctgcttgtaagggtgcagctgaacctgtattgaatgcatatgaccaattgttatcaaatggggctattttgccatccgcaagtgttagattacgtatgctgagatcggttctagtggtacttcgagagtgggcaatgtctgtatattcacaaagaatgggtagcagtgccgctgggcattccctaatactaggtggaggattctcatcggaacgtactattgctagccaaggaattcgggacaagatcacaagtgcagcaaacaggtatatgactgaattgcggaggttagcccttccacagaaccaaacagaacatgtctaccgaggttttagagaacttgaagaatcgtttataagccaacattcatttgatcgattttga

SEQ ID NO: 27368 - DNA, 528 bp, Glycine max
  Peptide Sequence Number=SeqID_144146
atggcaattctgttagtttttagaatgaccgcgagcgagcttggcaacttaaaccagcataccaacagtttggtccctgttgatcagaatctgaagcttatttctgattttattactgcttttggagtttgggattttcatatgtttcagaatatcatgactcctcaaattctaaatgttgttacagctatgtcacctcttagtacttgtggcactgccagatccaccagatctcattttgagatcctacaggagatcaccttagtctccagcatactcctcaaattgaaatatacaacaacgcatccagcttatgggattgttaagatgattccggatttcattgatgatggagtacatatcacgtggtctcgtgcccttagagaggctaatcaagttgttgattgttttgcaaattatgctcactctcttggtgttcaaataagaggtttagattttattcctatttttgcttctaatgtgcttttggcagatctaactgcaaccgcatttccgcgggatttttag

SEQ ID NO: 27369 - DNA, 312 bp, Glycine max
  Peptide Sequence Number=SeqID_144147
atgaaccacaaaggaatcccctcctttgtgtttaatgattacaaccaagaagctatgtccacttcttgcaatgaatccaaaagcgtgatcaaccaagaagcaaatcctgcttcttgcaatgaacccaaggaactcatcctcgaaggtcctgacaatatcactctagagcaagccttcaagctcaacttcaaagcctcaaacaaccaggaagagtatgagacgctcattgtaggtctaaagctagcaagagaagtcggagctaaaaaggtgcgatggcagaatcagacaagagaagtcggagctaaaaaactg

SEQ ID NO: 27370 - DNA, 141 bp, Glycine max
  Peptide Sequence Number=SeqID_144148
atgacgcaaccacctcaagggcacaagaaaagagttcttacatcgatagagaaagctgaaacaagaaggggaaaacaccggagagatttacaccaatgggtctcgagcaaccacataagtgaacttcacaccacactttaa

SEQ ID NO: 27371 - DNA, 270 bp, Glycine max
  Peptide Sequence Number=SeqID_144149
atggtgtggttatggttagataccttctatgagatggtgaggcctcaccctgctactcctgacgggctccgagactgtattttttggaattgggtgcttggggatctgtatacgttgtacttatatgcggcgatcactcctaactatcatccatgtggttgtgcaaggccaccaatacccgtgaggcttagtggcattgttaggcattattatgtgttgagtctgacaatttacatgttacacttacttttagacatttatgggttgtaa

SEQ ID NO: 27372 - DNA, 834 bp, Glycine max
  Peptide Sequence Number=SeqID_144150
atggcggcggttgccggtccggcggcgctgctgatcggctggctgatcaccggtgtcggtatcctctttctgtcgctggcgatgttgctgctgacgcgtctgcgcccggaactggatggcggcatcttcacctacgcgcgcgccggcttcggcgagctgaccggcttctgctcggcatggggttactggctgtgtgcggtgattgccaacgtctcgtatctggtaattgtgttttcagcgctgagcttctttaccgatacgccggatcgcatcgtttttggcgatggcaatacctggcaggcgatgcttggtgcttccgtgctgctgtggctggtgcactggctggtgctgcgcggtgtacagaccgccgccagcatcaacctgctggcgacgctgggcaaactggtgccgctgctgctgttcgtggtgctggcgctgctggcgtttaattacgatcgcttccgttttgactttgacggcgcggcgctcgaccagccgctgtggcagcaggttaaacagaccatgctgatcaccctatgtcgggcgcgccacgctgctagcggtgctggccgcgctgctggtctacctgctggtgacgttgctgtcgcttggcgtggtgccgcgtgcggaactggcgcagatgcgcaatccgtcgatggccggtctgatggaacgcctgctgggtcactggggcgatgcggtgattgcggttggcctgattatctcagtgtgcggggtctatctcagctggaccattatggcggcggacgtcccgttccttgccgcgcagcagggcgcgtttccgcgcagcattgcccggcagaaccgccataa

SEQ ID NO: 27373 - DNA, 231 bp, Glycine max
  Peptide Sequence Number=SeqID_144151
atggcctttatggataactgggcggtgggtaaggagaaggaatggcagtcacagcacgggcttctccttcatcctaccctcttcatttgccccagttttctcatttgtccaagcaggatgactaaatttgcctcttttcagacccacatcgatcctttcactagcaaagaccaaatccgcaaagctttgaaggtgcgtagcccaccattttccatagtagaatactggtaa

SEQ ID NO: 27374 - DNA, 462 bp, Glycine max
  Peptide Sequence Number=SeqID_144152
atgactcaaatcctggtacagagggcaggttctccggatgaatttactaggctaacagctatcacatggataaatgagtttgtcaagcttggtggagaccagcttgttccatattatgctgacattcttggagccattttgccttgtatagcagataaagaagagaaaattagagttgttgctcgtgaaaccaatgaagagctacgtgccctcaaggcagatccagctgaagcgtttgatgtaggagcaatcctctccattgccaggaggcaattatctagtgaattggaggctactcgaattgaagctttgcactggatatccacccttttaaacaattatcgtactgaggttttgcaatttctgaatgacatatttgacactctgctcaaggcactttcagatccatctgatgaggtctaccgtcccccagatgtaccttgccttcatttgttctattaa

SEQ ID NO: 27375 - DNA, 345 bp, Glycine max
  Peptide Sequence Number=SeqID_144153
atgtgcgcttctaaggaggtaggtgatctgggtgtgagagatttgagatgctttaattatgcgttattaaggaagtggcggagaagaaggatctatggaataaggtattggtctgtttatatgggtcgcggaatgggaaggctgtgggtgatgactctaaagacacctgtcaaatacatcaaacttaatccagacatgggcatcagtgtcgtgttggtgtcggtgtcgtgtcatgtcggacaccggacaccggacaccggacacgacaagagaccggggtgtctatgcttcctagctctaaaggatcctgtgtgtggaagcttgatgagggtgttaggggcgtga

SEQ ID NO: 27376 - DNA, 210 bp, Glycine max
  Peptide Sequence Number=SeqID_144154
atgtttccaaacaattatgatatttcatctgttcagcctattgttgctgcttctgaaggaaccacagtttttggtgatcagaggaatgttagggaagagccccgtacatatctgggagtacaaaaggtcacggataaaccaatctatataggtctagtacgtgagaatgatgcaaccaagagcgagcgaacaatatatcttggtgagtga

SEQ ID NO: 27377 - DNA, 240 bp, Glycine max
  Peptide Sequence Number=SeqID_144155
atgggtggaaccttggaagaacttgatccatggaagatatttttgagtgatatgctcaggcatcgaaggcttcttagtaaccaattaaagaggttgcctgagtatgttgaaatcattcaattaagggtcaatcactcacaatcggtaaattgtgatttttgtggaggagagcatttcaatgatagttgtcatctctattccatggaaaattattggtgggagcaagagttatacccttaa

SEQ ID NO: 27378 - DNA, 699 bp, Glycine max
  Peptide Sequence Number=SeqID_144156
atgtcgactgatatgacacaaacggatgttgtggattctgtcagaatgttaagttacagctttgtgaagttcatatccaagtatcgtggagtcatcagagattcatctactgcgaaatgggaagcaatttttgttacaagcagcgacgacaacaaatcccttggattattcggtgaagtcattaccccatatattctatgtaacacagaagaggaagcagcaagggcatatgatgttgaaagcataaggttgaaagggtacgacgccattaccaacttcaatatcaggttttacaacgttgaggccattttgaaaggagtaactgatcctgaaaaagtaatatatcagtcacaagacactgtccctgtggaagcaatgcagcctttggaagtgcttcagaacattattgaccaaggctcctcgaaaatgttgtatggtactactactgataccttcggaagcaatgtatttcaaaggccaatatcaggaaacacagaagaacaggaaaattatgtggcctttgcctcacaaggccgtgaaaatgaccctaatagaaatttgtccttagtgactgaggggcaacctttggtctatggaagaagtggtgaggacgatggtcagggaggctcatcagccagcagcatgtgttttgaggatgaactgaccaatgcttataaaaaattcataaagaggagttaa

SEQ ID NO: 27379 - DNA, 1275 bp, Glycine max
  Peptide Sequence Number=SeqID_144157
atggagaacttgtttcgcctagtagacaacgaagacttgttctctcgccgttgcatttgggtgaatggccctataatcgtaggggcaggaccctcagggctagccacagcagcatgccttagagaacaaggggtacccttcatggttctcgaacgtgcagattgcatagcctcactgtggcaaaaaagaacctacgacaggctcaaacttcaccttccaaaacaattctgccagctcccgaaactacccttccctgaagacttccccgaataccccacaaagaaacagttcatagagtacttagaatcctacgctaagcacttcgagatcaaccctcagttcaacgagtgtgtgcagtccgcgaggtacgacgagacaagcggcttgtggagggttaagaccgtttcatcctcgagtggcgcggctcgcggcgaggttgagtacatttgcaggtggctcgtggtggccaccggggagaatgcggagtgtgttatgcctgagattgaagggttgagtgagttcaaaggtgatgtgatccatgcttgtgattacaagtcaggggagagattcaggggaaagaaggttcttgttgttggatgtggcaattccggcatggaactctcacttgacctttgcaaccaccattcttctccgtccatggttgttcgtagctcggttcacgtgttgcctagagaagtgtttggaatatcaacttttgaattggcggttatgttgctgcaatggctgcccctttggcttgttgacaagattctcttgatcttggcatggtttgttttggggaacattgagaagttggggctcaaaaggccttcaaagggtcctttggagatgaagaacagaaaggggaagaccccagttttggatattggtgccttggagaggattagatccggtgacatagaagtggtgccaggaatcaagaggttcaataatggtgaagttgagtttattaatggtgaaaagcttgatattgatgcaatagtgcttgcaaccggttaccgcagcaatgtcccttcttggcttcaggaaggtgaatttttctcaaagaatggatacccaaagatgccattccctcatggttggaagggaaatgctggactttatgctgtggggttcacaaagagagggctctctggtgcttcttctgatgctgtgaaaattgctcaagatattggccaagtttggaaaaatgagactaagcaaaagaaacagcgcactactgcttgtcatagacgttgcatttcacagttctaa

SEQ ID NO: 27380 - DNA, 135 bp, Glycine max
  Peptide Sequence Number=SeqID_144158
atggaaggagaattaggaggcaatgatgatgacatgtcatcctcatctgattctttgggcgatgatgaggtggcaaggaaagagctgagtaaaatgggtggaagagaggacgaggcacgtggtgtggatgagtga

SEQ ID NO: 27381 - DNA, 378 bp, Glycine max
  Peptide Sequence Number=SeqID_144159
atggtgactgtaatggttacaaaagcaggggatactattatagagcgaagattgtcagcagaatctgcaagaagctttccctatgtggctgagcccgttgtgtatatggctccctcttctgctaatgtggcagagaaagttgcagaggctgcaggaaagtctcacttggcaagaaatgtatcagctgttcaaagaagaggatataccagtgatgaggagctagaggaactagattcccctcttacattcatcattgataagcttccttcatctccaactgtcactgaaaatggaaaaggtaataatcataaagagcaaggtggcaaccccaccacaaatgctagataccaactcctacgtgaagtttggtccatgtaa

SEQ ID NO: 27382 - DNA, 318 bp, Glycine max
  Peptide Sequence Number=SeqID_144160
atggttgaggtattcgggtttaatcctttgaaaacgacctttgtcatgggtatccaagctatgggtttgccatcagaagatattgctgaatatcccccggttctggcctacagcttggagaagaggattatctctagattccatgtaattaaaatcttgaaatcaaaaggtctgctcgataatagttttcacactggttcctttatgaccataactgaggaaaagtttttgaagaaatttgtcatcgactttcagaaagatttgcctcttttaccagatgtctacaaagatttgattgattatcagaaagtaatgtag

SEQ ID NO: 27383 - DNA, 267 bp, Glycine max
  Peptide Sequence Number=SeqID_144161
atggctttggttttgcattttcatttctcaattgcagctatcaatgatactgactcgaaaagtcagtgggaacctttagctcccacgaaagaagcacatgaatttcatctttcccaaacttatcatgaaggacttctcaagttacaagcaaaagagtatgagaaggctcgcgagctcttagaatctgtccttaaatatcctcttattgctaatgctcaggtggatagtagtgccagtgatggtcatctattgcaactcaggttttga

SEQ ID NO: 27384 - DNA, 1773 bp, Glycine max
  Peptide Sequence Number=SeqID_144162
atgaaagaaattgagaagagaaaagcttcaaggaatagtcagacaaagggttcaagaagaaccgaaaggagagagaataaattgcatcaagataattcttccaaaacattgaatgaaaaaggaactgaatctaagacaccccaggatagtagaccaactgcaaataattttctaagtgattcaaacacggccttagagaattcagaaacttatgaaaatgtggttatacattatgtggatgatgtcaacaggtctgaggaggcacttgccgagatgaaagttaatgaaaacaaaaatgaagtggctggtgatcgttccagtgatttggagaaagagcaaaaggaagggaatgaagaagtctcagatactgagacagtaaaggattcagtatcttcccaaggtgattctttcacaaatgaggatgagagaacagaaaaggcttcaaaagatcctaaaagtaaggttaaagtgaatccttcagaaagcaaccgtggatcaaaggagagatctgatagaaaaactaataaattgcaatcgaaggtatcgaatagcaatcaaaagaaacctatgaactcaaataaagggccctccaaagttacaaacaaaaatactccctcaaccaattccaagactgtgaaagttcctgtaaatgtatcatcagaatcttctgaaggtgtagatgaaaaacctgttcaagaggtcaaggaacctgatgttgtggatggatcctccaatggtgctcagagtgtaggaagtgaagatgaaattcatgaaacagttaatgctgaagaaaatggtgaacatgaggatgatacagctgcagaattaaaaattgaagaaatggaattacgaattgaaaagctcgaagaggagcttagagaagttgctgctcttgaagtgtcactttattccattgcaccagagcatggaagctcagcacacaaggtgcacacacctgctcgacgcctttctaggctctatatacatgcttgtaagcattggacccagaaaaggcgagcaacgattgccaagaatactgtttctggtcttattttggttgccaggtcttgtggtaatgatgtttcaaggttaactttctggctgtcaaataccattgtgctgagagagataatttctcaagcctttgggaattcctgtcaagctagtccccttaaaaggttggccgagtcaaatgctgctgggaagagaaacgatgggaagtctatggcgctgaaatggaaaggtagctccagtggtaaagcaggaaatggttttatgcctcttgttgaagattggcaagagacaggaacctttacatttgctttagaaagagtagaatcgtggatcttttctcggatagtggagtcagtgtggtggcaggctttgactccctacatgcagtctccagttgggaactcttcaaataaatccattgggaagctgatgggacctgctcttggtgatcacaatcaaggaaacttttccatcaatctctggagaaatgctttccaagatgcttttcaacgactctgtcctgttcgagcaggagggcatgagtgtggttgtttgcctgtattggctagaatggtcatggaacaatgcatagctagactagatgttgctatgttcaatgctcttcttcgggagtcggcccttgatatcccgactgatcctatatcagaccctattgtggattcaaaggttttgccaattccagctggagatttaagctttgggtctggtgcacagctaaaaaattctgtatgtatttaa

SEQ ID NO: 27385 - DNA, 425 bp, Glycine max
  Peptide Sequence Number=SeqID_144163
aggaactatgggcaatgaaactgggtttgaagcttctgcaagagagggcaaaagttggatctttctggtggccatatattaccaatctccccgaaacatacactgtgccgattttctttcctggggaggacataaagaacttgcactatgcttctcttcttcatcagagagaagtcaagcgtgctttggtaagtcttacaccagataagcatccttttggtggtcaagaagtagatgcatcttctcttggatgggcaatgtcagcagtatcatctagagcatttcgattgtatggtgaaaaggatcccaatgggatacgcattgacgtaccgatgatgctccccctaattgatatgtgcaatcatagtttcaatccaaatgctagaattgttcaagaacaagataccagtgactcgaagatgaaa

SEQ ID NO: 27386 - DNA, 369 bp, Glycine max
  Peptide Sequence Number=SeqID_144164
atggagaatgggacgagggaaggggcggtgcgtgttaggaaaatagggcccccacaaggatcacatcgcacccattcagataacgaaaaggttgactatgatgaccggctatacccagtgaacttcggtcaccgacaccctttcccggttaccctccacgactccctgttccgttttaaaatgcgtgcacgttcccgcactctcttcttcttctcccacaactctccagaacctctcatcgagcgtttgaatgtaacaaaaacaacacaaagaaaacaacagttgcaacgttgctattcccaaggattcttttgtctgccatcatttttgcgtacgtaccacttcaacaagacaaaaccgcgtgtttga

SEQ ID NO: 27387 - DNA, 282 bp, Glycine max
  Peptide Sequence Number=SeqID_144165
atgatgcaatctgtccaaagtagtacacgggccctgtttacaaccttacagtcaccgactgcaattaaactcggcagtgctagttggtttgatttcaagcattttgtgtttgacaatatcgctattgttgattctcatagagggattggattccagatccgtgatggagacctagccttaaaacatagatttgaagtgtttcaacttccttgtgcaggaaatgccaggatgccaagagttgataaaacacaggactgcagggatgatgatggagcacattga

SEQ ID NO: 27388 - DNA, 384 bp, Glycine max
  Peptide Sequence Number=SeqID_144166
atggataataacttacctagcatggtgacacctctcatgtggccagaaatcccactcaatggcaaccggcagcattatcaacagcagtggcaattggatgcattccaccaacctctctgggagagggaagaagtcaaccataatttcatgactccggaaaactcacttttgagttatgactcgtcggcaaactcagttagctgtgatttgagtggtctcaactctccagatttagcagggtttccatgtcttctatttgtcagaggcggttggaaacctggattttctttggcccggaacggcagtgcagccggtttatattgttgtcttaccctcggatcccctcagttctactatgagacattgctttcttcgttggactaa

SEQ ID NO: 27389 - DNA, 378 bp, Glycine max
  Peptide Sequence Number=SeqID_144167
atgtgggcgcatctaactccccatgaggtagaagtgtccatgttccaagatcttggttcatctttctggggcatggtattgatacttgcatcaacaaatcttcttaccgctagaatagctgctggctgttttattgctgctctacttattgtcctcttcattgccaaaaattggactcttcggggactttgcattggatttatcatttttcttggtgtaatatggattctgcaagagacaaccaaagttcgaatactacggtacattatcttgttcataggtgtttacttagttgagctgacaaggaaagccagggggttaatatcttttgtgtttctttgcggagctgtgtatctgggtgctgtgatcttgtcataa

SEQ ID NO: 27390 - DNA, 1158 bp, Glycine max
  Peptide Sequence Number=SeqID_144168
atggtgcgtaattttctcctcattgcaagattaactgcgtcatcatcattcacacgctacaagagcacccatatcccattgggttctctgttgcaactcaaacacactgcttcaatttttttcttcaattcattcacttcagccagctcttctgattctgaatcagatggaaaccgccacaaagccaaggaactctccaacagggtcaattttaaaaacccagatggcccagatgctgttattgatatgctcagcaactatgggtttgacaaaatccaggttgcaaaacttgcgaagaaacaacctttggtgcttcttgaggatgcagagaatacccttttgcctaaactcgagttcttccgttctattggggtttccaacactgacatgcctaagatcctaattgctaaccgtgatatcttgtttagaagcttggagaaatgtctcatccctcgttatcagatcctaaagagtgtagtttgtgatgatggggaagctgttactgctttgataaatgccccatttgattttacaaatggtgacatgatgaatcatttggttccaaacattaaggttcagaggcaatctaatgtgcctccagcttccatctctctcttgatggtccattttacaggtgtagcatatatgaagcattccaaatttgtggaagctgtcaacaaagccagggaaataggttgtgatccttcgaaaatggtttttatgcatgctgtccgtttgcttttaactactagtaaaaccttgtgggattcaaaatttgaggtttatgagaggtggggctggaaccacgaaatggctcttcgagcatttgtcaagtctcccaattttatgatgttgtcagaggagacatatacaaaaaagatgactttcctagtgaaggatatgggtttgccatcagaagatattgctcattatcctcaggttctaacctacagctttgagaagaggattatacctagattctcagtaattaaaatcttgtgttcaaaaggtctgcttaagaaagatttgcacttcagttcctttatgtgcttaactgagggaaactttttgaagaaatttgtcatcaaatttcaggatgatttgcctcttttatcagatgtttacaaaggtttgttcaatcatcagaatgtagtatag

SEQ ID NO: 27391 - DNA, 1956 bp, Glycine max
  Peptide Sequence Number=SeqID_144169
atggaagcaaaggtagcagcgctcgagagtgaagttgcgagcctttgtagtgtcctggtcacaatgcaatcgaaggctaaagagaatcaggcgaaactcctcaccttgcttgaggagcgattgtcattgaacgaaggggaaaaatcagtcatgaagacatctttgaatgtgattgttgatgaatttcaccaagcagtgaagaaagtagaattacccctgttcattggtgaagacccaacaagatggattgcacgagtcgagatctacttccagatccaggagacacatctagagattcgtgaatttggcccaactatgtatcgaaggctcgacgattcattttttcaagtcgttactggacgacaagacaaaattcacgtggaagaaactcaaagtagaattgctagagcggaattcaaacatttgattgctcaggtaccttgtcgccctgatgatcaatactttgggtatttcatgcatggattaaaggaaggaatcaggggtcgggacgaaggagcgttggatttcgaagcagaaccgggtcgggttggtccaatcaagcaaaccagaatcctttctccccttgcacaaatttgggccgtcaacatgggtattattggggaacgtcctatgtcaacaaggacactcgtaatggtgatgctattgggtctgggcttggtcctccaaaaggaccgttttgtgacaaagattgtaaccaacccagagataaagtgtcttgatcatcaattaagggtgatgctcattgacgatgatgatgaggaagagggggaattacaagtgttttccgcagaaggggaagtcgacacagagtcaaacaatgagtgtagtgtgatgcatttgggaagcttgcgtgtgcaaaaaaggtgggcaacctcaaatgctgaagattcgaggcaccataaaaggggttccaattctgattctggaacttgcaaaggagttgagctaaagttgggagaaatcaccattcccattgatacactcttgttcgatttagaagggatcaacattgtattagggatatcgtggctagcgtttcttggtcgcattctgtttggtaaaccttaccacatggtcgaggggttgctgctttgcacagagttacagattagtcattctaggcccttagggtttgatcgtgacgtgctgtctgatcaacccttttcagaaatcaccagccttttggatgggtattttaaaatttttagggaaccaaagggattaccgcctcaacgtggtaaaaagcatgtcattaccttgatggagggccagggggcagtgaatgggaggccataccggtacccacgctatcacaagaatgaaattgagaagcaagtcaagcaatttatggacaatggcatgattcgtcccaatcaaagtgcattttcaagcccagcaattttggtgaaaaagaaagacgagacatggcggtcatgcgtggattatcatgctttgaacaagttgaccgtaccggataagttttccattcctataattgttgagttattagatgaattgcatggggcacattatttctctaaactggacttgaaatctgggtctcacattctgcacttaactgctgttttggatgttttgaagagagagcagctggtggaaaactggaaaaaatgttacttcggtcaaacaaccgtagaatacttgggtcatatcaattccaaagatggtgtggccatggatcccaacaaagttaaaagtgggattgagaggccggttccaaaaaatgtgaagggggtgcgcaacttcttaggactaaccggctactaccgcaaattcatcaaggactatgggaaaatagctcaccctctaactgacttgactaagaaagatgagtttaaatggggagactcagaacaaacagcttctgaatttctatcaaggaatgtgatatttgtcaacatcaaaagtatttag

SEQ ID NO: 27392 - DNA, 1230 bp, Glycine max
  Peptide Sequence Number=SeqID_144170
atggatgaagaccttgtgagagtagttgaggaattaagagaaactccaaaaccaatttctttcaagtctcaaaaggggaagaacactccttatgtagatgagtatttcatgcctagaacaactcctggagctcaaccttgcttgaagagtgtcttgcaaaataagcaaattgtagaaaagtgtgacaaagccattgcaaaatggatgatagatgcttcaattccatttaatgcagttaactcaacatattatcaacccatgattaatgctattagtagcatgagtccagggtataaagccccaaatttttatagaatttgtggtcctttgttaaatatgtgggttgatgaagtgagaaagcttgttgaaagttacaaagaagtttggaaggaaactggatgtactctgatggctgatgggtggactgaccactctagaagaactctcattaatgttcttgtttattatcctaaagggactattttcttaaggttattggaaaaagagtttcttaaagtatattggtctccttgtgctgctcactgcattaatttaatgttgcaagactttgggaaatttgaggaaggactggataagcccaactttgccaaagactccaaggctaaaaaatttgtggagcaaatcttggactctggtttttggaaatggtacacacatggagatcttgagttgcaagataaattaaatgaaggcatgaggatatataaaatttttgaaggagattttgctatacaagctgcaatatgtaaacagaacaaagtcgtgctagatcaatggtgggattgttatggatgtaatgctccacaattgcaaaaattggctattcgtgttttaagccaaacttgtagtgcttcgggttgtgatagaaattggagtatatttgaacagatccattcaaaaaggaggaataggttagaacatcaaaagcttaatgaccttgtttatgtgttggaggagtcaccatcattcttaactcgtgaagaggtggagactttacgtaatgatcttacaaacatgttcattcaatcaacttcatatgatattgataaattaaatctggatgaatatgaggatgatgatgtgtcacaaccaccaaacaacaccatgaaagatgttaatccaaatgaaagtaatatcggtgaaaaatttcaatcttttgatgaagaaggattacttgaaattgacccaacattggctccttggatgtaa

SEQ ID NO: 27393 - DNA, 369 bp, Glycine max
  Peptide Sequence Number=SeqID_144171
atgtacactctcttgttctcagttacaacaacccaagtagatgtaccatctacttgtagcacaaaggatgtaccctccaatgtgttaagacaaagttctcaggcgacggtggatggtgataaagctccctcgacggtggacgacgtcgttgctcttcgcggaagcctcatcaatgcacctcgcaacctcttcacggaaacctcctattcatggcaacaatggtggcaagctcctcaacgaagaagaagaagaagaacctgttcccacaacctccttttaacgacaacaacaaatggaaacgtcggtgacgtgagcaacaacaatacaaaaatggctgaggtgagaaagaagaagaacaaaacgttgtga

SEQ ID NO: 27394 - DNA, 447 bp, Glycine max
  Peptide Sequence Number=SeqID_144172
atgtttgtggaggcggtgaaggtggtggttgggactagcaaggaggcttgggagaagagggtggaggtttatgagaggtggggttggtctaatgagatgtgtctttgtgccttcaggaggtaccctcagtgtatgttgatgtcggaggataaggtcatgaggaccatgaggtttttggttaaggatatggggtggcctgcagaggatatttttcggactccgggggttctcagccccaacttggagaagacaattatgccgcggtctcgcgttatgaaggtgttgaaggagagggggctggtgaagagtgactcacggcttagctcggctattttgatcaccgagaagttgtttttggagaagtttgtggggcggttccaggatcgtgtaccggggcttatggaggtgtataaagggcacgttgatcacctggattcggtgctgtag

SEQ ID NO: 27395 - DNA, 519 bp, Glycine max
  Peptide Sequence Number=SeqID_144173
atggggccctgcggcacccctacacctcttaggtgctccacgttggggatcaaatggttgatcaagccacggccggacagtgctgaggatgttgtagcgcggaacaaggcagtacttgaggctgccttccaagaggacggagtttccgatgaggagtttggggaggtcggaggtggagaggccgatggagaggaagaactggagcttgggcagaatggtcttttcgggtttgatcttgaggactatggggaagcgtttgacaaggagggacaactggagttcggagaatccgaaggttttgaggaggttaaggacggcgttaggctgatcgggggatttgaggtggacccttttagagagcttgagggcccacgcgggggacaggttgcaggtgttgatgaggtaggagagggtgaagttaggatttttggtttgggatttggatttggatttggaagaaaaggggttgaggaaaatggatggtttcagctttcagatgctgtgattgcaattgcatga

SEQ ID NO: 27396 - DNA, 342 bp, Glycine max
  Peptide Sequence Number=SeqID_144174
gctgccaactcagcgtttaggagcaaaggtggttatgaaatcctccaaatggtgcagtttgctcaatttccttttggccctaaggcagaaccagttagcggcatcggtgtgcaagatgacgctgccgtaaggaactgtgttgcaatggtcgtggcggtagtgggcagcatggatgagaactctggctccgatacgggtcgtgacgacaaccacaccgcttgcgccgcactgtgtattatcggcagaggggcacctatgatgacaacttcggcgtacccacaaggacaagttcctccaggcgttgctgggaacttcctcgccggcgtggtggctgttgattga

SEQ ID NO: 27397 - DNA, 753 bp, Glycine max
  Peptide Sequence Number=SeqID_144175
agtaagcctatgatcaatgtgaagagcacacctgagaaaaagaaacttttggctaagttggagaggtctaataggataagtataattgtcatcaagatgatagtctttgaacatcttttgagtgatttgccagagaaagtgacagccaaggagtttctttacgctctaggagagaggtatcgagtatcagataatgttgagtttagatgtttaatgaagcagttaatggacatgagatatgataatgttaatggtcttgaagtgacggaccccattgttctatctaacggagttgatactgagtcatccgagactgtctcttttccactacctattccaagtgttggtgtttccaatgttattccagttgagaatgtagttgcgactgaagatatagttggccctcgagccaatgatctgattgatcctcttactgtgaatgaaaatgaacaacctattgagcagcatgttgagttgcctgaaaaatataaggcaattggttgtaaatggttcttcaagacaaagaaagacttagatggtaacattgagagattcaaggctagactggtgccaaagggttttacacaaaaagaaggtagccttatgtatgcccaagtgtgcactaggcctgacattgcctttatggttggcattcttggtagataccaatcaaaccctgggaatgatcactgggtagctgctacaaagttgatgatacttacagaaaaccaaggagtatatgcttgtgtatag

SEQ ID NO: 27398 - DNA, 229 bp, Glycine max
  Peptide Sequence Number=SeqID_144176
atggcacgttctccagacaagacaaagagcatcgatggctcaaaagaaactcttaaacttagtgtgaggatcagtgatctatgggagtgtgttctaggggacatcccttttagaaaatacaggtttgctggatttgcagatgttgtggctggccagtttgaacgtggactattggttgatgttattggtgttgtggacgaggctgccttttggcaagtttcaggaaaag

SEQ ID NO: 27399 - DNA, 123 bp, Glycine max
  Peptide Sequence Number=SeqID_144177
atgactaatggatctactgtggctgcaaatcctgagactgttaaaggcatgctagaaagcctagccaccatggcaaatggtagcgtgctagatcttagccaaactgctactgaaaggacatag

SEQ ID NO: 27400 - DNA, 543 bp, Glycine max
  Peptide Sequence Number=SeqID_144178
atgagagcagtgtccctttggcttcggcgcaaacaccaattgccgttggcattggcatttcgcagattctcgacatctaattcgaaggtgaaaatctttgatcgcgagttgaagcgcacacaacgtgaccgagccgcatggttgactccctcacacgaccctcttcttcacaccgtcgctcaaaatctcttggaccgcttgcaggactgtaagaagacttttccaactgcgctatgcttaggaggctcattacaacctatcacgcgctctctttctgctcctcctgccccaggtggcgtggaaaagcttattgtcatggatgcctcctatgatatgcttcaagcctgtaaaaatgctcaccacaatgccaccgttgagacccactttcttgttgctgacgaagactctgtggatttggttgttagttgcttgggactacactggactaatgatctgcctggagcaatgatacagtctagattggcattgaagcctgatggcttatttttagcagctattcttggtggagaaacattaaagtga

SEQ ID NO: 27401 - DNA, 474 bp, Glycine max
  Peptide Sequence Number=SeqID_144179
atgacagacaaggcaaatgtagtacgtgaagctgtcaaatatgtgaaacaacttgaagaacgtgtgaacgagctagaaaatcaaaagagaaaggaaggtgtgaattcaataatactcaccaagaaaacgccactctccataaataatattgatcaagccatcactcatggatgtgtggatgtggaagaagaaatcctcgagctgaaagtaactgttttagataaggaattgctcattggaatttattctgagaaacaaaggcagacaatgctcaaaatattgtcattgcttgatgatctccatctttctataacccctctttctataacccctactagcgtattgccatttggaacttccactcttaaaattaccattatcgctcagatggatgacgaatataacatgataattcatgatctagtaaaagcactgcggcaacgcatattgaagtcacaggatatgcaaaagtga

SEQ ID NO: 27402 - DNA, 3282 bp, Glycine max
  Peptide Sequence Number=SeqID_144180
atggcgtcgccgttggacggaggaggagtggcggtgctcccgaattccgtcaacaaggttgactcctcctcggttctcaatggcggcttgaagtgctccaaaccggagtcgccaattttgattttcttgttctttcacaaagcgattcggaatgagcttgacgcgctgcaccgattggccgtcgcattcgccaccggcaaccgctccgacattaagccgctctccggccgctaccatttcctcagctccatgtacaggcaccactgcaatgctgaagacgaggtgctaatcttccttcacctttacgttttcggacttgttaaatcgtgtaacctaatttcccgttgtgagaaaaatggcgtagagagtggagatttcatagctgctctagatatacgtgtgaagaatgtagcacagacatattctctcgagcacaagggtgaaagcaacctttttgatcatctatttgagcttttaaattcttccatcaataatgttgaaagttttccaaaagagttggcatcctgcacaggagctttgcagacgtcagttagtcaacacatggcgaaggaagaggagcaggtatttcctctgcttattgagaagttttctcttgaggaacaggcatccttagtgtggcagtttctttgcagtattcctgtgaatatgatggctgaatttctaccgtggctttcagcatctatatcacctgatgaatctcaggatttgcgaaattgcttaatcaagatagtgccagaggaaaaactccttcaaaaggttgttttcacctggatggaaggaagaagtagcattaacacagttgaaacttgtgcagatcattctcaagttcaatgtagttctagggcattaacccatcagcttgagaaagtaaactgtgcttgtgaatccacaacaactggaaaaaggaaacattctggatctatgatagatgtttctgataccactggaacacatcctatagatgaaatattgctctggcatagtgcaataaaaaaagagttaagtgagatagcagtggagactagaaagatacagcactctgaagattttactaatctatctgcttttaacgaaagatttcaattcatagctgaagtttgcatatttcacagtattgctgaggacaaggttatttttccagcagtagatggagaattttctttctttcaggagcatgctgaagaagaaagccaatttaatgactttcggcgtttgattgaaagtattcaaagtgaaggagcatcgtctaattcagatgttgaattttattccaagttatgcatacatgctgatcatataatggaaaccatacagaggcatttccataatgaagaagttcagcgtgtcctgccatggttggtaggatctttaactgaagatgaagcaaagacgtttcagagaaatatgcagttggcagcaacagattctgctcttgtcacactcttctgtggatgggcttgcaaggctcgtaatgaaggtctgtgtttgtcttcaagtgcatcaggttgctgtcctgctcaaagactttctgatattgaagaaaatattgttcggccatcctgtgcttgtgcatctgcattatctaatagacattgctcggtattagctgaatcaggtgggaacaaaagatcagtcaagcgcaacatattggagtcgcacaaaaatgaagatctacctgaaacttcagagactgaaaatattcagaaacaatgttgtagtgcacggtcttgttgtgtgccaggtttaggagtaagtagtaacaatttagggctgagttctctttctacagccaagtccttacggtccttgtctttctgctcttctgccccatctcttaattccagtcttttcatatgggaaacagagagcagctcatgcaatgttggatctacacaaagaccaattgataccatatttaaattccataaagctatacgcaaagacttggagtatctagatgttgaatctggaaagctgagtgatggtgatgagacaattcttcggcaatttaatggaagatttcgtcttttgtggggtttgtatagagctcatagtaatgctgaagatgatatagtatttccagctttagaatccaaagaggcacttcataatgtgagtcattcgtacatgctggaccataagcaggaagaacaattgtttgaagatatttcctgtgttctttcagagttttctgtccttcatgaagccttgcagatgacgcatatgtccgacaatttaagtgaaagtaattttggaacctctgatgccaatactagtgatgatatcaaaaaatataatgaacttgctactaagcttcaggggatgtgcaaatctataagagtgaccctggatcagcatctttttagagaagaatgcgaactgtggccattgtttggcagacatttcactgtggaagaacaagacaagatagtgggtcggataattggaacaacaggtgctgaagttctccaatcaatgttaccatgggtaacgtctgcacttactcaggatgaacagaacaaaatgatggatatatggaagcaggcaactaagaacactatgttcaacgaatggcttagtgaatgctggaaagagagtcgagtgtctacagcacagacagaaacgtcagatcacagcacttctcggagaggtgctgaatatcaagaaagcttggaccacaatgatcagatgttcaagccaggttggaaagacatatttcggatgaatcagaatgaacttgagtcagagatccgcaaggtatatcgagactcaactcttgatccaaggagaaaagcatatcttgtgcagaatctactgacaagtcgatggatagctgcccagcagaaatcacctaaagctttatctgaaggatcatctaacagtgtagaaatagaaggactctcaccatcatttcaggacccagaggaacatgtttactttggtatgcttgatgccctattggctgctgaggagcttcctgaagagtacaaggaccgctgtcaggtgagtacttttgtctcttcacttcattcctttcgaaagctaatgacatactctgccatgactgtaatcggaagggcacttcacgcttccactggttgtatcacaaatgtggattttgtggctcttacaatacccgggttatcaagtgtgagacgtcaaactccagctgctcttagtgtgcttcttttgtcgggaggagattgtagttgtagcagtaaccttgagaagttcctctatggcatgttcctcaaggtttag

SEQ ID NO: 27403 - DNA, 135 bp, Glycine max
  Peptide Sequence Number=SeqID_144181
atggcgtcgttcgaagaagctcctcccggaaactccaagaacggcgagaagatcttcaagaccaagtgcgctcagtgccacaccgtggacaaaggtgccggtcacaaacaaggtttgaaagttactctgtattga

SEQ ID NO: 27404 - DNA, 1488 bp, Glycine max
  Peptide Sequence Number=SeqID_144182
atggcactccccactgcttcctttgccatggcaatggtggcggcggtggcggagcagagcccggaatctcccagtgcttcctctgtggcaaagggtggtgttagtgacatgtcggaaatattccagtgtttcctctgcgtcgcagccgcaccaaaagaacctgttcttaatccactaaatgttcctctttcggtttccggtgatgacaatagggcgggtgacaaaggcactgatgacaaacccgatgttagagaaaatgccgaagacgaagaagcattagatagtctccgtggcgctcgtggtggtgatgatgatgatgatgatgataatgcatcttcatttttctccaatgttccttcatgtaatgatgatgatgatgatgctgcatgtgcatgtgaacatgcacttaatgcttcatttgaattatgttcagtgaaaaccctatctggtgttgagcacaacgaaggagaagaaggagaagattgcacgtgcctttccggcgaggcggaagaagaggaagggcacgaactagagatcacgcttcttcctccggtggcgaaaattcgccgggaagccgatccggttccgccggagcctcccaacgatgagcctctcggagacttgtcgcgcaagcggcggaagcggtcggagctccggcgattccattttccggtcgccgccggcgtcggagacgtcggcgccatcttcaattatgtgcgagttaactacagttccgaggtaaagaaactcggagctggtggaagacgtgtgccggagcttgcgagtttccacggcggtttcggtattgcgcgggagcaggcggaggtcggtgtcggatcggataagtttgccgtcggcagcgaggggagggctccggcgacggcggtaacagacgacggcagagatgattatagcaaggaccgcggcggcgacggcggagagagcgacggggaggagtttgttggaggaagaattgggtttgggggagtgaggaagaatgagagaggaaatattggcagggaaggaggcaaagttggtgttggtattgttgtggtagtggtagaggttgtgggaatggtggatgatggatatttgggttttggtttttgtttatggcttgaaggagaaggttgtggttttggtgcttcagaaggtggaagagtggttaaaggaacaaagggttcatggagaatccttctattgaggaagaagggttgggatgaggctatgagagaaggaagtgatttagagagtgaaaaggttgatttttatgatgagatgaaaaatggtgagagtgtgaatttaggtggttttgtgttgcatacagctaagattctcttggtcgttctgtttcactacttgaaggaatcaaggttccacatttgcactgttccagggcctatgcaacttcttctctctgttggggtgtttgatttaatacatggaaacaacaatataataggcgacattgatgaagattttttatag

SEQ ID NO: 27405 - DNA, 2388 bp, Glycine max
  Peptide Sequence Number=SeqID_144183
atgcaaaccttcttcttgtaccttttccttttcttcttgttatgtgcacttcaccaactagcctcatcccaacccttcttcctcaatagaaggattctccatgaaccctttgttcctttaaccactcttccaccttctgaagcaccaaaaccacaaccttctccttcaagccataaacaaaaaccaaaacccaaatatccatcatccaccattcccacaacctctaccactaccacaacaataccaacaccaactacaactacaccacaatcaccatttttcccattatacccttcttccccaccacctccttctccaatcacctttgcctccttccctgccaatatttcctctctcattcttcctcactcccccaaacccaattcttcctccaacaaactcctccccgtcgctctctccgccgtcgccgccgcggtccttgctataatcatctctgccgtcgtctgttaccgccgtcgccggagccctcccctcgctgccgacggcaaacttatccgatccgacaccgacctccgcctgctcccgcgcaataccgaaaccgccgtggaaactcgcaagctccggcacacgtcttccaccagctccgagtttctttacctcggaactgtagttaactcgcacataattgaagatggcgccgacgtctccgacgccggcggcgaccggaaaatggaatcgccggagctccgaccgcttccgccgcttgcgcgacaagcttctttgccgctgccgacgtacgacgaggcggggttcaccaccgcggaggaggaggaggacgatgaggagttttactctccgagaggctcatcgttgggaggctccggcggaaccggatcggcttcccggcgaattttcgccaccggaggaagaagcgtgatctctagttcgtgcccttcctcttcttccgcctcgccggaaaggcctcattctatcgcgacggcgagttcgagttcccggagaacccagccaaagtcgccggaaaattacaaccaccaacacgtgcaatcttctccttcttctccttcgttgtgctcaacaccagatagggttttcactgaacataattcaaatgaagcattaagtgcatgttcacatgcacatgcagcatcatcatcatcatcattacatgaaggaacattggagaaaaatgaagatgcattatcatcatcatcatcatcatcaccaccacgagcgccacggagactatctaatgcttcttcgtcttcggcattttctctaacatcttcgctggagaaggtaacacgtaatcacactttcgatcagtctccaagaatgtcgagtgtctccgacggactaatgttaccgggtttgtcatcagtgcctttgtcacccgccctattgtcatcaccggaaaccgaaagaggaacatttagtggattaagaacaggttcttttggtgcggctgcgacgcagaggaaacactggaatatttccgacatgtcactaacaccaccctttgatgaaattggaacggttccggttccggctccggctcctccacctttgccacagaggaagcactgggagattccgggctctgctccgccaccgccgccaccattgccatggcaaaggaagcagtggggagtgccatcgccggcaatgaggccgtcgacaccggtgtcaaggccgccagaattggtgcctccttcgaggtcttttgtgttgcaaaaccaaggaaccaatgttgagttgccggcgagtttgggggaaattgaagagattagtaaaccaaaattgaagcccctgcattgggacaaagtgagaacgacctctgatcgtgaaatggtgtgggatcagatgaagtccagctcgtttaaattgaatgagaaaatgattgaaacattgtttgtagtgaacacatcaaacccaaaacccaaggacgcaactacgaactcagtttttcccctgccaaatcaggaggaaagaatacttgatcctaaaaagtctcagaatatttcaatcttgctgaaagcacttaatgtcactatagaagaagtgtgtgaagcacttttagaaggaagtactgatacacttggaacagaattacttgaaagcttattaagaatggcaccaagcaaggaagaagaacgtaagttgaaggaacataaagatgactcaccaaccaagcttggtctagctgaattttttttgaaggcagtgcttgatgtacctttcgcatttaaaagaattgaagcaatgctttacatagccaattttgagtctgaagtggagtatcttaggacatcctttcaaactctagaggctgcctgtgaagagctgcgacattgtagaatgttcttgaagcttttggaggctgtacttaaaactgggaaccgcatgaat

SEQ ID NO: 27406 - DNA, 2946 bp, Glycine max
  Peptide Sequence Number=SeqID_144184
atgctggaaaagaaaaaagaatacgaccaaaggccaaaacggaaaaacccgcctttcaaaatttcccgccaaaaaatgagaattgcagagatatcctcgccggagctccggtcgctccaccgagacacggagcctaacaaccgtagcctcttccaaattgaaacaatcgttaaacaactcgaaacccgctctgccgaaaaaccaccgccggagaccgtcgtctccgatctccggcagtgcctgactcagctgagtcaactcgcttcgtttccaaactcgttgaaacttcagatttggaagctcagctaccgcctctggaacgcgtgcgtcgacatctccaacaccaccgccatccgctcctcctcctccgcaaccaccgaaagccaggccgaactccggcacatcgccgcggacctcctctcaatcgccggcgacgtcgacggcatcccatctccggcgataaaatcggcgtcgttctaccacaagactggccagatatggcacagcctccggaaattcgatctcgccgcgaagtgcttcgagcgcgccacggatctggtctcgaagctcgaaatcaattcaatcaccgacgccggagagcggaaactgttgctggatctgaacctggctcggtcccgaaccgcgtgggaggttcgagacccgaacctggcggtggcgctgctgaaccggagcaagagcttcctcttcggcgcgtgcgagcactacacggatctagcaaagcagttcatggcgtttgggaagcgcgcgctgtcgagcggcggcggcgaggacgcgaaccgtgaggcgctgaagctgatgaacgaagcgttggagtgttgcgagaaggggttcggtgcggcgcgaacacgggaagagaaggtggagatccgagggttgaggtggaaggcgcttagattcatcgctgcgattcatttgcagaaagaggaatttgagagtgtgattaagtgtgtgaaggttttgagagatagtgctgatggcggtgatgagcatccgagtctttcggtgttggcgatgaaggcgtggttagggttggggaggcatggggaggcggagagggagttgagggggatggtgattgacaaagggattccggagggggtttgggtgtcagcggtggaggcgtattttgtggcagcagggacggcgggggcagagacggcgaagggggtgttcttggggctgttgggaaggtgtcatgttagtgccggctcggcagtgagggtggcgcatagggtggctgggggtggtggggaaggggggagactgagagctaaggtggttgctgagcttgtgtcggatgagagggtggtggccctctttgcaggacaggatgctgctaaggatagggtggcaatgcatgctgttctgtggaattggtattgcttcttgaaccatttatttcctaatctgctagctgtggtgccgataattttcaatcaaaagattatgagaccagtgcggaactctttgaaaaatcaatgctatatattccatatgatgcagagaacagaatacttcgagcaaagggctttagaagttttgaattcgttgcttgaattttcagtcaaatatgaaacattatccatgcttttccatgcctgcagcttgagcctaacattgtctgtgcttttcttaaggaatggcatgagaacttacgttgaaatttcatttgttttaactcagttcaaaatttatctccaaaagaatgaccaccaaggtgctattaatcaaattgaagcgatgacaacatgccttgactttcaaccagattttctctcactttcagcacatgaagctgttgcatgccatgctctacctattgctgttgcttctctatcaagtatgctaaagttctatgcttcaggaaagtccatgcccacagcagaagtaacagttgtgcgcaccttgctgacagtcctctctcaagagccgggtaacgaacagcaagtaataaaattcctcaaacacgcccatacacgagcatcggagattggtcctgattgcttctttggaaaagaggaagttggaagacgggaacggaattggtttgctgtgacttcatggaactttgggacaaaatcgggacaggataagaactatgaatcatctgccgtgttcttaaaactggcatcagatttttatgctctaattgaggggtctgataatgagaacaatgtcatggtttgcaaatcgttagtgctttctgtatcatcaatgatagcttcagaatttgaaaggaagacttcgatgtcagaaactgaagtcaagcaagctttatacttgttagatagagcaggggagatgctaaaatcaatttcagccaggaactctgttaacagtgaccaaattaataccattgagcctgaactttttttcatatacactttctgctattatgatatacaaggcaggctgaatgacttgggatctcaacttctcaatgtgaaaagctttgccagctcaaaggcttgcaaacctcaccacctccttcaaataggtctctctgcctcacagggaccacggttgaatcacgaagtagcctgctttgctttaaatgaatgcctctcatctttcctttcatcagcagctccagattatcaaaatgttgctcttgtaatgcgcaagcttatatccaatgccagcattcacaagggtgatgcagatgatgatcttgtatatagcatgtacaagcaagcctataggataatggttggtttgaaggaagatgagtatccgattgaagaaggaaagtggcttgccatgactgcatggaaccgagcagcagtgccagtcaggttgggtcagattgaagtggggaagaaatggatgactgtgggcttagacattgcaaagcatgtcccaggcatggaagcttacaaagaatgcatggaagaagtccttggcaatttgaagaaagaattttga

SEQ ID NO: 27407 - DNA, 471 bp, Glycine max
  Peptide Sequence Number=SeqID_144185
atggattctgaagttctcaacagtgatgtcttaaaactttcgaaaggaattgcaagcatagcagaagttgtgcaattaaaccaaaccatggcatcagatgaaagcagtcagaaattcacagaatcaatgaacaaattcatcagaatggctgaggaggaaattccaaaaattcaagcccaagaaagtgttacttccacccttgtgaaggagattacagagtattttcatggaaatttgacaaaggaagaagctcatccatttagaatcttcttggttgtaagagacttcctagcagttcttgaccgggtctgcaaagaagttggaatgataaatgagagaactatggttagttcagctcataaattccctgtgccagttaaccctatgcttccacaatcccttcctgggttacatgagaggcaacagtataataactcttcagatgatgatagttcttcttcatcaccatag

SEQ ID NO: 27408 - DNA, 1375 bp, Glycine max
  Peptide Sequence Number=SeqID_144186
catagccagtatggtgcactgtgtggtcttagcatatccagctcaaggccacattaaccctatgcataatttctgcaagctcttgcaacaacaaggtgtgaaagtaacactagtcaccaccctttcctacagcaagaacttgcagaacatacctgcttctattgcacttgaaaccatttctgatggttttgacaatcgtggttttgctgagtcaggaaactggaaggcctacttggaacgtttttggcaagtagggccaaagactcttgctgagcttcttgagaaacttggtagatcaggtgaccctgttgattgtgttgtttataattcattcttcccttgggctcttgaggttgcaaagagatttgggatagttggggctgttttcctcactcaaaatatgtccgtcaatagtatataccaccatgtccagcaaggaaatttgtgtgttcccctcacaaaaagtgagatttcccttcctttgttgcccaaacttcaacatgaggacatgcccacattcttcttccccacatgtgtggataattcacttttgcttgatttggtagtgggccagttctccaatatcgacaaggctgattggatcctttgcaattcattctctgagatggaaaaagaggtaaccgattggacgaagaagatatggcccaaatttaggactataggaccaagcataacatctatgattttgaacaagcgacttacagatgatgaagatgatggtgttacacaatttaagagtgaagaatgcataaaatggttagatgataaaccgaaacaatctgttgtttatgtttcttttgggtccgtggtagtactcaacgaagagcaaatagaggaaatagcttatggtttgagtgacagtgaaagttacttcttgtgggtactcagagaagaaactaagcttcccaaagattttgcaaagaagtcagagaagggtttagtaattgggtggtgctcacaactaaaagttttagctcatgaagctatagggtgttttgtaacacattgtggttggaactccacattggaagccttgagtttaggtgttccaatggtcgcaatgccaaattggtctgaccaatgtacaaatgctaagctaattgaagatgtctggaaaatgggaattagagctagagttgatgaaaaaaagattgtgagaggagaagtattgaagtattgcataatggaaataatgaacagtgagaaaggcaaagaggtgaaaagaaatattatgcaatggaaggctttggctgcacgagctgttagtgaggaaggaagttctcataaaaacattgcagaattcgtgaatagcttgttcaatttaaaacagggaattgcaaattatcctgattaa

SEQ ID NO: 27409 - DNA, 990 bp, Glycine max
  Peptide Sequence Number=SeqID_144187
atgttcgtcaatagtatatactaccatgtacagcaagggaagttgcgtgttcccctcacaaaaaatgagatttcccttcctttgttgcccaaacttcaacttgaagacatgccctcattcctctcctccactgatggggagaatttagttttgctcgatttggcagtggctcagttctccaatgtcgacaaggctgattggatcctttgcaattcattctacgagttggaaaaagaggtaaataattggacattgaagatttggcctaaatttaggactataggaccatgcataacatctatggttttaaacaagcgacttacagatgataatgatgaagatgatggtgttacacaatttaagagtgaagaatgcatgaaatggttagatgataaaccaaaacaatctgttgtttatgtttcttttgggtccatcgcagcactcaacgaagagcaaataaaggaaatagcttatagtttgagagatggtgaaaattactttttgtgggtggtgagggcctcagaagaaactaagcttcccaaagattttgaaaagatatcagagaagggtttagtgataaggtggtgctcgcaactaaaagtcctagaccatgaggctatagggtgttttgtaacacattgtggttggaactccacattggaagccttgagtttaggagttccagtggttgcaatgccatattggtctgaccaaagtacaaatgcaaagcaaattgtagatgtctggaaaatgggaatcagagccacagttgacgatgagaaaaaaattgtgagaagagaagtattaaagcgctgcataatggaaataatgaagagtgagagaggcaaagaggtgaaaagcaatatggtgcaatggaaggctttggctgcacgagctgttagtgaggaaggaagttctcataaaaacattgcagaattcgtgaatagcttgttcaatttacaacagagaattgcaaattatcctgattaa

SEQ ID NO: 27410 - DNA, 516 bp, Glycine max
  Peptide Sequence Number=SeqID_144188
atggctcagtccaactcctcgaggctcggatttccaaccctcatcactgccttatgcatggcccgaggagtcacctcagattccttgacttttgagtccctcagcccagccattaacttggcttacataaagaagaactgttggaacttggatgaccccacggccagctttccaaggacccgcaaggccagggctagaggatctgagggtccatcttctattactccccagacatctactgcaccagctcctattccttcagcaccagttcccgctacttctggtccctccgctcagagcacagacctcatgatggcgatgctgcagagcattcaccagggtcaatacctggtggcctggccaagagtctggccttcttctcatggaggaggtgaggcctctgcagctcaggagcctcagccagatccggagactacacctgctgctcaggaggatgattcaaaggccactcccccagagtcatttgtaccagaaactgatccagaagcagatcca

SEQ ID NO: 27411 - DNA, 153 bp, Glycine max
  Peptide Sequence Number=SeqID_144189
atggaggtttttgctgggattatggctaccattgcattattgagtagatatgggaatatgcagcaggcgggttttgtggttgatttaggggtggactttgtggataattgggtgttcttggctgatagggtggtgggtaatgagaagggatga

SEQ ID NO: 27412 - DNA, 1419 bp, Glycine max
  Peptide Sequence Number=SeqID_144190
atggacttgaataatttcaaggacaagcgagccaagtctgcatgggaagattgtttggagctctatgaggacacactttatcagctcaaacgctcaatgaactcaaacaaactaaatgataggttgacttggcaaagtgcatccattgccaaccatcaaacatgccaaaatggtttcactgaattcaaccttccctcacacctaaattacttcccctccatgctaagcaacttctccaaactgcttagcaattccttgtccattagcaaaactatgatgatgactttgacaacttcatcgaccaaacaaagtggtgggagaaggttgttgctttcagatggcttcccctattggttgtcacattcagatagaaggcttcttcaggaaacaacaccaaaagctgatgttgtggtggcacaagatgggagtgggaactataagaccatctcagagggcgtggctgcagctgctaagctcagtgggaaagggcgtgttgttgtgcacgtcaaagctggtgtctacaaagatagcattgatattaagaggacagtcaagaacttaatgatcattggagatgggatgggtgctactattgttactggtaatcttaacgcacaagatggttccactacttttcgttctgctacttttgcggtttctggtgacggcttcatcgctcgagacataacctttgagaacacagcgggaccacaacagcaccaagcggtggctctccgatccggtgcggaccactcagtgttctaccggtgcagctttatggggtaccaagacaccttatacgtctacgccaaccgccaattctaccgtgattgtgacatatacggaaccatagacttcatattcggggatgccgtgacggttcttcaaaactgcaacatctatgtgaggaaaccgatgagcaatcagcagaacacggtgacggcacaagcaagaaccgaccctaacgagaacacgggcatcatcatccataactgtcgtataactgcagctggggacttgatagcagtgcaaggctctttcaaaaccttcctaggtcgcccatggcaaaagtactcaaggactgtggtcatgaagagtgcccttgatggcttgattgaccctgcaggttggtctccgtggagtggaaactttggtctgagcagcctctactacgcagaatatgcgaatacaggagctggtgctagcactgcagggagggtcaaatggccagggtttcgtctgatctccagttctgaggctgtgaaattcaccgttggaaatttcttggctgggggctcgtggatttctgggagtggcgtgccctttgatgcagaggctacacaaaatgttgtagtgtgtttcttcttcccttacacagtctgttattttttgtccacggaaggaccgaattacggatga

SEQ ID NO: 27413 - DNA, 156 bp, Glycine max
  Peptide Sequence Number=SeqID_144191
atggcttgctccatggtaaccctaagggccagatcatggaaggaagaagatgaagcatctagggttgataatgtgttggtagtttcaatttatattatcaagcttgttaggaaagagatcgatctaggatattatcttagaaatgcttgtgaataa

SEQ ID NO: 27414 - DNA, 327 bp, Glycine max
  Peptide Sequence Number=SeqID_144192
atgaagaatcaagtgtggcataaccattggccgaaaagagttcaagttgtgaaagaggatctcaaggctctagtacggaaattggaaattggaagtccaatgtccaaaatgaagaaatcacttgaaccttcaagaagcatcaagaaggatatgcaagaaactgttcgctgcttgaaagattggtggagagctattgatgtaagctccattggagcttgtaggcctatgattttcttcatcaatggattcctttacttcttggaggatgaatggaagtggaaaggagaaggaagagagagaggagacaccacttcaaggagaagatga

SEQ ID NO: 27415 - DNA, 228 bp, Glycine max
  Peptide Sequence Number=SeqID_144193
atggaagaagtgggttggtttccgtggagtggaaactttgctctaagcaccctctattacgctgaatatgggaatacaggagcaggtgcaggcacaggagggagggtgaaatgggaagggtttcgcgtgatctccagtactgaggctgtgaaattcaccgttggaagtttcttggctgggggctcgtggattcctgggagtggcgtaccctttgatgcaggtttatga

SEQ ID NO: 27416 - DNA, 309 bp, Glycine max
  Peptide Sequence Number=SeqID_144194
atgttgtggccattcaaagttgttgctggtattaatgacaaaccaatgattgttgtcaagtacaaagggcaggagaagcatctttgtgctgaggaagtatcatctatgtgcctgcttatttcaatgattctcagcgaaaagctactattactgctattgcatatggccttgacaagaggactaattgcgttggagagaaaaacattttcatctttgaacttggtggtggtacttctcacgatcaaggataaggtattccaagataaggctacttctggaaacactcacttaaggtggagaggactttga

SEQ ID NO: 27417 - DNA, 858 bp, Glycine max
  Peptide Sequence Number=SeqID_144195
atgtctttgttccttaaagctttgcctttgatggccttccgcacgaggccatctctggtgtttctgggcagagtttccaacaccattccattgtcactttccagaaccagaaccgtgtattccgcttctgcttcaacacaaccacctccttctgcttgtgcttctgaaacactcacttccagtgctaaaccacctttgcccctcagtgaaccccttgagtgggtcaacaggactgcattttgtggcgaattgtcttcaaatgatgtgggaaaaagtgtccagctttgtgggtgggttgcccttcacagggtccatggtgggctcacatttcttaatctcagagaccacactggcattgttcaggttacaacccttcctaatgaatttccagatgcccattctgctatcaatgatctgagacttgagtacgtggttgccattgagggtgttgtcaggtctaggccagatgagtcgatcaacaagaagatgcaaacaggcttcatcgaggttgctgcaaataaagttcaattgctaaactctgtaaattcaaagttgccattcttggttactacagcagatgatgcaaaagactctcttaaagaggaaatccgtttgaggtatcgatgtcttgatctgaggcggcaacaaatgaatttcaacatattgctgcggcataaagtggttaaactcattcgaagatatctagaagacgttcatggttttgttgagattgaaactccaattctgtcaagatccacaccagaaggtgcccgggattatttagttccatcaagaatccagcttttgttgctcaagattatgatcatgaaatttatccaatatatttcaaaccattga

SEQ ID NO: 27418 - DNA, 1230 bp, Glycine max
  Peptide Sequence Number=SeqID_144196
atgaagccaggaacattctatgccttgccacaaagtcctcagctatttaagcaaatgctaatggtagctggttttgataaatactatcagattgcaagatgttttcgtgatgaagatttacgagctgatagacaacctgagttcacccagctagatatggaaatggcctttactccttatgaggatatgttgatgcttaatgaagaattgattagaaagaaaagtgaaggaaaagaaaatcttagggtttttcttgaaattaaaggtgtggagttacctaaccctttccccaggcttacatatgctgaagcaatgagtagatatggttcagaccggccagataccagatttgatcttgagttaaaagatgtatctgacattttctcagggtcttccttcaaggttttctctgattccttggagagtgggggagttatcaaagtgttatgtgtaccttctggtacaaaaaaatactcaaactcagctcttaagaaaggtgatatttacaatgaagcactcaaatctggtgcaaagggtttgccttttctcaaggtcttggatgatgggaatattgaaggaatttctgctttagtatcaagtatggatcctacaactagagggaatttgttaaggcgatgctcttcaggaccaagtgatctgattctatttgcagtgggtcatcatgcgtctgtaaataaaactttagaccgtcttagagtttatgtagcccatgatctaggtttaattgaccttggcaggcattcaattttgtggataactgattttccgatgtttgagtggaatgatccagagcagaggcttgaggctcttcatcatcctttcactgcaccaaatcctgaagacatgaatgaccttgcatctgctcgtgcgttggcttatgacatggtttacaatggggtggagattggtgggggaagtctgagaatttataaacgtgatatacaacaaaaggttttagagattgttggcatctcaatggagcaggctgaagcaaagtttggttatcttcttgaagcgcttgacatgggggctccaccacatggaggcatagcttatgggttggacagattggttatgctgttggcgggggctaattccatcagagatgtcattgcttttccaaaaacaaccactgcacagtgtgccctcacgagatcaccatctgaggtggatccccagcagctgaaagatctgtcaattacaacatag

SEQ ID NO: 27419 - DNA, 1584 bp, Glycine max
  Peptide Sequence Number=SeqID_144197
atggacaagctctttttcaactactgtttcgttggatactgccttctttattctctcttgcttgtgcatggcaaacaattgtcatgcaatgaaaccccttaccctcgtgtgtgcaagcattacattgaaactaccaacacattatcagccctagatgctcccccttcttattccttccatgatatggcccttaaggtcaccatggagcaagccacggaggcttataaactcgtctcaaacatggacttgaataatttcaaggacaagcgagccaagtctgcatgggaagattgtttggagctctatgaaaacacactttatcagctcaaacgctcaatgaactcaaacaatctaaacgataggttgacttggcaaagtgcatccattgccaaccatcaaacatgccaaaatggtttcactgatttcaaccttccttctcacctgaattactttccctccatgctaagcaacttctctgaattgcttagcaattccttgtccattagcaaggctatgacattgacatcattctcatcatcaccatcgaccaaacaaagtggtgggcgaaggttgctttcagatggcttcccctattggctgtcacgttcagatagaaggcttcttcaggaaacagcatcaaaagctgatgttgtcgtggcacaggatgggagtgggaactataagactatctcagaaggtgtgaatgcagcttctggtctcagtgggaaagggcgtgttgttgtgcatgtcaaagctggcgtatacaaagagaatattgatatcaagaggacagtgaagaacttaatgatcgttggtgatggaatgggtgctactattgttactggtaatcttaacgcacaagatggttccactacttttcgttctgctacttttgcggttgatggtgacgggttcatcgctcgggacataaccttcgagaacacagcgggaccgcaaaagcaccaagcggtggctgtccgttccggcgccgaccagtcggtgttctaccggtgcagctttaagggttaccaagacaccttatacgtttacgccaaccgtcaattctaccgtgactgtgacatatacggaaccatagacttcattttcggtgacgcagtgacggtgcttcaaaactgcaacatctatgtgaggaaaccgatgagcaaccagctgaacacggtgacggcacaaggaagaaccgaccctaacgagaacacagggataatcatccataactgtcgtataactgcagctggggatttgaaagcagtgcagggctctttcagaacctttctaggtcgcccatggcaaaagtactcaaggactgttttcatgaagagtgcccttgatggcttgattagccccgcaggttggtttccgtggagtggaaactttgctctaagcaccctctattacgcagaacatgcgaatacaggagcaggtgctagcacaggagggagggttgattgggcagggtttcgagtgatctccagtactgaggctgtgaaattcaccgttggaaatttcttggctgggggatcgtggattccggggagtggcgtgccctttgatgaaggtttatga

SEQ ID NO: 27420 - DNA, 1028 bp, Glycine max
  Peptide Sequence Number=SeqID_144198
atagcttattctggttatgctgtctagttgaacatgttccgaccattgcatcatgccctaccacaacttcatatttctggtctttcactccagataagtgcatatatcaaagaacttacagaacgccaagccatctttcaggagtttcctccttagcttctcgatcaggttttcttttaatgcagagatcaaatatctttggaagccatgatattctgggaagctggctccctgccagatacataagtaatgaatcagttgagctgaagactcacaatgatgtcatacggttctctctaggcaagtctgatgatattaataatgcaaagaagagccagctgaacaaaaaatttaaaatgtctagaaaggctaaactgaatgagctgaggttctatcgtttgaaggccaagaaaaagatgaattccccaaatccagaagttagaattagatataagcttgaaaaggccaagcgaaaggaaacttggttgattgagaagctacggaaatttgatgtacccaaaccccctccagaaacatatgatcctgaaattttaactgaggaggagaggcattacctgaagcgcactggtgagagaaaaaaacattatgttccagttgggagacgaggagtgtttggtggggtagttcttaatatgcatcttcactggaaaaatcatgaaacggtaaaggttatctgcaagccttgcaaaccagggcaagttcatgaatatgctgaagagcttgctcgactgagcaaaggcattgtgattgacatcaagcccaataatactatcattttttaccgtggaaagaactatgtaaaaccagaagtaatgtcacctccaaatacattatcaaaagcgaaggccttggagaaatataggtatgagcagtcccttgagcatactagccagttcattgaaaagttggagaaagagcttgaagagtatcatcaacaccttgcaaagtttaaaaaagggaaagaggatactgctaaagatgttagttttggagctttggcatattaa

SEQ ID NO: 27421 - DNA, 240 bp, Glycine max
  Peptide Sequence Number=SeqID_144199
atggtatttgatgaggatccaaattatgtcaagcttatatcacttttcaaaagcttgattgaaccatgcactatgttgagactaattagaatagatgaagctttaaaggttgctatggccaaagaagagaatgtgcaaaaagctgcaactgatgactcgcttagcgaggcatctagctcacttaacggatgggaaaccctagaagaggataagttagagatctgcacgccaagcacgtag

SEQ ID NO: 27422 - DNA, 1086 bp, Glycine max
  Peptide Sequence Number=SeqID_144200
atggcgttctcgacgacaatgctgtcgtggagcgtgatcgatttcgagaagagcatggggacggagctagggaacgcgctgaaggcggtgaggtgggggacagattatttgctgaaggccacggccaagattggctccggcgtggtgttcgtgcaggttggtgacccttactccgatcataactgctgggagagacccgaagacatggacacgctgcgcaccgttttcaagatcgatgggtcccaccctggctctgacgtggctggtgaaactgccgctgcacttgccgctgcctccatcgtcttcagatcacgtgacccctcctactctaccatgctcctcaatcgagccgttgcggtgttccagtttgctgacaagcatcgtggtgcatacagtaacagcctgcaccgtgcagtctgcccattttactgcgacgtcaatggttaccaggacgagctactgtgggcagcagcgtggttgcacaaggcctcacgtaggcgtcagtacagagaatacattgtgaggaacgaggtggtgttgagagctggggacaccattaatgagtttggttgggataacaagcatgctgggattaatgttctcatttctaaggaggtgctaatgggaagagcagaatattttgcgtccttcaaacaaaacgctgatggatttatctgttctacattgcctggaatttctcaccctcaagttcaatattccccaggtgggcttattttcaaggccggtggaagtaacatgcagcatgtaacgtccctgtctttcctgctgctagcttattctaactacctaagccacgccaataaggtcgtgccatgtggcgagactactgccaccccagctttactcaaacaccttgctaaacgccaggtggattacattcttggggacaacccattgggaatgtcgtacatggttggatatggtgcacgctacccgcagaggatacaccaccgggccagttcgcttccctcagtggcggcccacccggcccatattggctgtaaagctggatctcggtattactttagcccaaatcccaacccaaatgtgttgcttggggccgtg

SEQ ID NO: 27423 - DNA, 1101 bp, Glycine max
  Peptide Sequence Number=SeqID_144201
atgcctgtaggagaagcatttttgtcagctttccttcaagttttgtttgacaggctggcctcaaagaatgttatagaggttattcttgcaggagacaaaagcaaaatcctaaagaaatttcagaagactttgctgctcctcaaagcagtacttaatgatgcagaagacaaccatttaaagaatgaggctgtgagaatgtggctagttgagcttaaagatgttgcttttgatgcagaagatgttctagataggtttgctactgaagtattgaagaggaggttggaatcgatgtctcaatctcaggttcaaaccacctttgctcatgtatggaatcttttcccaacttctctcagctcaagtatggaatctaacatgaaggcgatcactgagagactggcgactcttgcaaatgaaaggcatgagcttggtttaagtgaggttgctgctggatgttcatacaaaatcaatgaaacaagttccatggtgaacgagtcctatattcatggcagagataatgacaaaaagaagattatccagttcctgatggagaataggccaagtcatggtgatgaagtcttggtcattcccattgtgggaatgccagggattgggaaaactacattggctcaggttgtgttcaatgatgacgaggtgaatacgcactttgaactcaaggcatgggtatctgtaccttatgattttgatgtcaaggttgtaactagaaaaattctagagtcagtcacttgcgtaacctgtgatttcaataacttacatcagcttcaagttaaactcagagcagtcttgagtggcaagaagtttctgattgttctggatgacgtttggaacaagaattacaatgaatggattaagctggtagctccattcagaggagctgcacggggaagctcagttattgtaacaacaaggagtgcagaagttgccaacatgatgggaactgttgaatctcaccatgtcaaccaattgtctgataaggactgttggtcagtgtttgtgcagcatgcttttaggagtaaaactattgatgcaaatcaagcttttgcagaaattggtaatgttagcaaagttgatagatgcatttaa

SEQ ID NO: 27424 - DNA, 3153 bp, Glycine max
  Peptide Sequence Number=SeqID_144202
atggcaacaacatttgggggtattttgtcctcacagaaagacgcaagagactgggaaaatgtaatggattttgaaatatgggatcttgcagaggaggaaagtaacatcctccaaacattaagattgagttataatcagcttccttcatacctgaagaggtgttttgcatactgctccatactaccaaaaggctttgaatttgaggagaaagagatagtgttgctatggatggctgaaggacttttagagcaaaaatcacagaagcaaatggaagatgttggccatgagtactttcaagagctactctctgcatcactttttcagaagtcaagtagcaacagatcattgtatgtaatgcatgaccttataaatgatctagctcaatgggtggctggagagtcctgtttcaaattggacaataattttcaatctcacaaacaaaagaaaaagaaaatttccaaaatgactcggtatgcatcatacgttggtggtgaatatgatggtattcaaatgtttcaggcctttaaagaagccaagtccttaagaacattcctccctctaaagcatcgaaggctagaagaatggtcctacataactaatcatgttccttttgaattgttacctgagttaagatgcttgagggcattatcattgagtggatatttcatcagtaagcttccaaattcggttagcaatttgaatcttctacgctacctgaatctttcttcgactgacctcagacagttgccagaatcaatctgcagtctatgcaatctgcaaacattactactgagagattgttttaatcttgaagaactgccatcaaacatgagtgatttgatcaacctacgtcatctagatatcaccagatctcattctttaacacgtatgccacatggtattggtaaattgacacatcttcaaactttgtcaaattttgttgtaggctcaagtgggataggagaattgatgaagctgtcaaatatccgaggagtactttctgtgtccaggttagagcatgtgactgacactcgagaggcaagtgaagctatgataaataaaaaggtaggcattgatgtgctgaaattgaagtggactagttgtatgaataatcagtcacatactgaaagagcaaaagaagtgcttcagatgctacaacctcacaaaaatcttgcaaagcttactattaagtgctatggtggtacgagtttcccaaaatggataggagatccatcctacaagagcctagtgttcttaaagttgaaagattgtgcacattgtacatctttgccggcacttggaaaccttcatgccctcaaagaactttacatcattggaatgaaagaagtatgttgtatcgatggtgagttctgtggtaatgcttgcttaagaccttttccttccttggagagactatactttatggacatggaaaaatgggaaaattggttcctctcagataacaatgagcagaatgacatgttttcttctttgcaacagcttttcattgtgaagtgtcccaaacttttaggtaaactaccagaaaatctcccttctctcaaacatgtaatagttaaagaatgtgaacaattgctggttaccatttcaagccttcctgtgctctacaaactagaaattgaaggatgcaaaggcttggtccttaattgcgcaaatgaattcaattcactgaattcaatgtctgtttccagaatcttggagttcacattcttaatggagaggttagtgcaggctttcaaaactgtagaagaactcaaaattgtcagttgtgctcttgatgaaacagttctgaatgatttatgggtaaatgaggtttggcttgagaagaatccacatggtttgtcatctattctcagattaattgagattagaaattgcaacatcatgaaatctatacctaaagtactaatggtcaacagccattttctcgaacgcttgtacatatgtcactgtgattccatagtctttgtcacaatggatcaactgcctcactctctgaaatcattggagatatcaaattgcaagaacttgagatgtttactggataatggaacatgcacttcttcatcaataattatgcatgatgacaatgtacagcatggtagcacaatcatttctcatttggagtatgtgtacattggctggtgtccatctctcacctgcatatcaagaagtggtgagttacctgaatctgtcaaacatttgttcatttggaattgttcagagctatcgtgcttgtcaatgaaaggccaattaccaaaaagtattgagagactggagattcaatcctgtccaaagcttgagtcaatagcaaacaggttgcacagaaacacctccttggaatctattcagatatggaactgtgaaaacctcaaatccctccctgaaggattgcatttccttgtgaatttaaaggagatcaaaattattggttgcccaaatttggtttccttcccagaagaaggtttgcccgcctcaagtctgtcagaactttccatcatgagctgtgagaaactagtggccctgccgaacagcatgtacaatctcgactccctcaaagagctggagattggatactgtccaagcattcaatattttccggaaataaactttccagacaacttaacatccctttggatcaatgaccataatgcctgtgaagcaatgttcaattggggcttatacaagctctcttttcttagggacctcaccatcataggtggaaatttgtttatgccacttgaaaagctggggacaatgcttccatccactttaactagcctcactgttcaaggctttccacacttggaaaacctgtcatcagagggctttcataaacttacctctttatctagcctaaccctaagacatctctcaaatctaacattcctacctttctcggggtttaaataccttacctctcttgaagagctttctatttataactgtcccaagctcttatgtttaccagaaaagggccttccttcctcacttttggagctatatatacaagactgtcctttcctgaaagaacagtgcaggaaagataaagggagagactggttgaagattgctgacgttccttatgttgagattgatggcaaatttatctatgactcggattatgaggattga

SEQ ID NO: 27425 - DNA, 1497 bp, Glycine max
  Peptide Sequence Number=SeqID_144203
atgactcagttgaaagcatctcctgcgtctgcgtgttcgtcccttgccattgctccttcctttcatcatgcatcaataacaacagggcaccttctgcgccatcaattctccaaggcaaagcctttgtcactcaaagagctggggctaaaaacaagcgttggtgccaataaacttcaaggtgagattgttttgtctcaacttcagcagttcactggagttattaaagcagctgcacgcattgatacagaggtagtttctgaaaccacgaagggtggtggcctacgtggaaaattgaataaggtggtgctggcttatagtggtggcttagacacatcagtcattgttccatggctgagagagaattatggttgtgaagttgtttgcttcactgctgatgttggccaaggcataaaagaattggatggtttagaagcaaaagccaaagccagtggggcttgtcaattagtggtaaaggacttgaaggaggaatttgttagagagtacatatttccttgcctgcgtgctggtgcagtgtatgagaggaagtatttgcttgggacatcaatggcccgccctgtaattgcaaaggcgatggttgatgttgccaaagaagttggagctgatgctgtctctcatgggtgtacagggaaaggaaatgatcaggcatgcgttcgatttgagcttactttctttgctctgaaccccaagctaaatgttgtggctccatggagggagtgggatattacaggtagagaagatgctatcgagtatgctaaaaagcataatatacctgttcctgtgacaaagaaatccatttatagcagggataggaatctttggcacctaagccatgagggtgatattttggaagacccagctaatgagcctaaaaaggacatgtacatgatgtctgtagacgctgaggatgctcctgatgaagcagaatatgtggaaattgagatagagtctggccttcctgtttcagtcaatgggaagaggctttcgccagcaactttacttactgagctcaatgagattggtggaaggcatggaattggccggatcgacatggttgagaatcggcttgtaggtatgaagagccgtggagtttatgaaactccaggtggaaccatcctgtttgctgcagcacgcgagctggagtttttgacacttgatcgagaaacaatacaagtcaaagattcattagcccttaaatatgcagagttagtatatgctggcagatggtttgatccacttcgggagtcaatggatgcctttatgcagaagatcacagagacaacaacaggttctgtgactttgaaattgtacaaaggttctgttactgtaaccagtcgaaagagtccctttagcctgtataggcaagacatttcatcatttgagagtgggcagatatatgatcaagctgatgctgctgggttcatccggctttatggtcttccaatgagggtccgagcaatgcttgagcagggcatctaa

SEQ ID NO: 27426 - DNA, 870 bp, Glycine max
  Peptide Sequence Number=SeqID_144204
caacaagggtcagatccaacaaagcaatcaccggcaaccggttttccggtgagctatagcaattcaacaacgtattcgaccaacgaggcttcctacgctccagtcccacctccccagcccaaacctcttgtcaattggtccaccggcctctgtgactgcttctccgaatgtggaaactgttgcatgacgtgttggtgtccatgtgttacctttggccgagttgcagaaattgttgacaagggatccacatcatgtggtgctagtggggctctgtatacgctgatttgctgtgtcattggctgtggctgcctatactcttgcttctaccgccccaagatgagacgacagtatggtctaaagggaaatggttgttcggattgcttgattcattgcttctgcgagccctgcgccctctgtcaagaatatcgtgagcttcaacaccgtggatttgacatgattattgggtggcatggaaatgtcgagcaacgaagtcggggagtagccatgactgctacaacagctccatcagtcgaaaatggcatgagccccagctcagatccaagaaagccatcggcaccggccaccggtttcccggtgagctacagcaccagcaccacggaggctgaggtgtattcgtattcatacggtccagttgtagtaccagtaccacctccccaccctaaacctattgtggaatggtcaaccggcctctgtgattgcttttccgattggggaaactcttgcatgacgttctggtgtccatgtgttacctttggtcgagttgcagaaattgttgacaggggatctccatgtggtggtgtggctggggctggggctgggtatactcttgcttctaccgctcctatatga

SEQ ID NO: 27427 - DNA, 924 bp, Glycine max
  Peptide Sequence Number=SeqID_144205
atgccaaacgcaaacatgcttctccttttcctcttccttctggcgctcttctcagccatgacaacaccgtcaacctccgcgatcgacaccttcatctttgccggctgctcccagcccaagttcacgccgggttccgcctacgaaaataccgtcaactcgctcctcacctctctcgtcaactccgccgccttcgccaactacaacaacttcaccgtccccgcctcctccgacgccgtctacggcctcttccagtgccgcggcgacctcaccaacgaccagtgctctcgctgcgtgtcgcgtgcggttacccagcttggcaccctctgcttcgcctcctgtggcggcgcgttgcaggtcgacggctgtttcgtcaagtatgacaatgccaccttcatcggagtcgaggacaagacattggtcaccaagaaatgtgggccgtccgttgggttgacctccgacgcgttgacccggagggacgctgtgctggcgtatttgcagacgtccgatggggtttataagacgttcaggacgagcgggtatggggatttccagggtgtggcgcagtgcaccggggatttgagtcccagcgagtgccaggattgtctttctgatgccatccaacggttgaaaaccgagtgcgggcccactaactgggccgatatttacttggctaagtgctacgcgcgctactccgaaggtgggactcgctcgcgtggtaataataatgttttcaatttcgcttgcatgctgttacttcccacctcaaaaagggaaaaaagggtggtagatgatagcaatcacaatgatgatgagatcgagaagacactcgctatactaattggactcattgcgggggttgctctaatcatcgttttcctttccttcttgtccaaggtctgcgaaaagcacaaaggtggtaaataa

SEQ ID NO: 27428 - DNA, 1479 bp, Glycine max
  Peptide Sequence Number=SeqID_144206
atggacgacgtcaaaggtaaggtgaagggcttcatgaagaaagtcaacaaccctttctcctcttcctcatccggcaaattcaagggccaaggtagagtcctcggttcttcttcttcttcttctcccactaattccaatcctacccctcgcccccaccctaattcgcagaaaccctcctcttcagccacaccctatcccaaaccctcaccccagaaaacggacccatatagaaccaccgagaagcctcgcaaagatgatggctttgacccctttgattctttggtcactaattccaatagatcacaaaatgggtactcgctggacgtctttgaatgccctatttgtaaacaaccctttagatccgaagaagaggtgtctgcacatgttgacggttgtttgaataaccctgttgagcgtggaggtgatgatggaaatggggcctcagagagtgatggtgggtctaatactaatagtgatagtgaatttgaggtttgtgttgagacttacagttcagggaagccatctgaaggatcggtcgatgttgttctcaaactgttgaggaatattggtagggaacctgcgaatgtgaagtttaggaggatcaggatgaataatcccaagataaaagaggctgttggtgatgttgccgggggagttgagttgctgagtttcgtaggatttgaactccgggaggagaatggagagacatgggcagtgatggaggttcccacagaggagcaaataaaaatcattaagaaagcaatagtgttgctggaatcacaacttgtacaacaaggacctccaaagagagatgattcgccgtctgcaacttctgctgagatgggtccaaaggctgaaccaaagctggtcgacagacaggttcttttgggcggtgatctagggttttgtggacaattagacattgtaaaaattggtgatatgtttggtcaaaacacttctgtgaaggtcttctttgctgtccctgaaagggttgcagctaaaattgagctaccagattccttctatagcctttcagccgaagaggtcaatagagaagctgaattaaggagaaaaaagattgcagattctcagcttttaatccctaagtcacttagagaaaaacaagcaaaagcttccaggaagagatacactaaagctattatcaggattcagtttccagatggagttgtacttcaaggtgtatttgctccatgggaaccaactgctgctatctacaagtttgtctgctcggcattaaaagaaccaggcttggaatttgagctaatgcatccggtacttatccaacgacgtgtgatcccccattttccaaaagcaggggaaaatgctaaaacaatagaggaagaggacctggtaccttctgctctaattaagttcaagcccctggaaacagattctgttgttttcaccggtctcagaaatgaattgcttgaaataagtgaaccacttgtaaatggttaa

SEQ ID NO: 27429 - DNA, 1665 bp, Glycine max
  Peptide Sequence Number=SeqID_144207
atggagagagatttcatgggtctcaacttgaaagaaccactagctgtggtgaaggaggagatgaacaatgatggctgcaaaaactctggcatgtttcaacttttgtgcttcaaaaaaggtcggattgcacagtggccattctcgaacaaagtatctgcccttccacatttgatgtctttcaaggcttctcaagatgataagactaagaatacagtgtctgataccttatcatcttctgggtttatgtctatcttaagtcaagaagcatttgacactagtcagaaacgctctgctggtgaaccccagaagtctttcaatcatgatgggcaaggtgaccttcatttttcgctgacttcatatcctgtacaacatgatgtgaatcatcctcatgatgtgaagatgttttcagttccaaatcaagcaatttcagtttccttggggaatccattcctgaagaatcattttgcagctgctggtcagaagccgttacttgggggaatacctgttaccacatctcattcagttcttccctctgctgttgctgttgctggaatgaccgaatcatgtaacagtgtgaaaccatctgctcaacttaccatcttctatgctggtactgtcaatatctttgatgatatctccgctgagaaggcacaagctatcatgttgttggctggcaatagcttatctgcagcttctaacatggcacagccaaatgttcaggtgcctatctcgaagttgggtgctggtgctggtgtgcctgtgagtcaacctgcaaatacatcacctggctctggtctttcaagtcctttatctgtttcttcacataccggtgtacagtcagggagtggcttaactagcactgatgaatttctggctgctaaaacaactggagttcccaacactcctatttgcaatgtggagcctccaaaggtagtcagtgcaaccactatgttgacatcagctgtacctcaggcccggaaagcatccttggctcgatttttagaaaaacgcaaagaaagggtgatgagtgcagcaccatacaacctcaacaagaagtctgaagagtgtgccactgcagaatacgctgttaggtcaatcagtgctaatttgccaaaccagtttcatcagagccacttgctcagaagtctttccacttggaaatttacagataatgcaactggtaatcggcagtttaacaattcagaatctcctgaggagtctgagcagtttggtggaaatcgtgggaaatatgcccaacttgattccatatttgaaaagtttaatcaacagggaatggcaagacaaagacctggttcagtaaatggtgctagttctgagaggatgcacgatctagaagaaacttatgacacattaactgatggaatggatggaaaactgatgaatgctgccacatactttgaatttgatgaggatgaaattgaaaaagaagattatgcatttcgatatgatgccaattttccacttggttcaaaatatgatgtaaagggcatcaaatgttttatgtccagattgatgtttgatgcagtgataaattatacacatgttgggtgggagggcaacacctactacaccaagagctgcgctcagtattcagagaatagagaattctctgacctcaccaaaatggttcactcacaacaatga

SEQ ID NO: 27430 - DNA, 234 bp, Glycine max
  Peptide Sequence Number=SeqID_144208
atgggagaggccaaggtgagtatagagtattggaaattggccttagggcctaactcaaccgaacaaaaccagcttgtaagaatcactaaaccactgcccttgaggctgcaattaaggcagcccccggagaagccacaactaaggctggctacgaggaccaaaattaaggtggctttccaatataaaggcaaaaaaggatatcctagtcacagttgtcgaaagcagacagaataa

SEQ ID NO: 27431 - DNA, 606 bp, Glycine max
  Peptide Sequence Number=SeqID_144209
atgagagcacacaaatttgccagttgcagagatgaagcaggggaagaatgtgctgttcgtgttcctaggaacttcagattattggaagagcttgagagaggtgagaagggaattggagatggaactgttagctatggaatggatgatgctgatgatatctacatgcagtcctggactgggactattattggcccccctggtcaaactttggtgtttgtgtatctcatcttggaactgattatagttcaatcagaatgggagactgttcatgaagggcgtatataccagctgaaattattttgtggcaaggattatccagacaatccaccaactgttagatttcagactaggattaacatgacttgtgtcaaccaagaaactggagtggttgagccacatttgtttcctatgcttgctaattggcaaagagagtgtacaatggaagacattttgatgcaattgaagaaagaaatgatatctccacaaaatcggaagctagctcagccacctgaagttgtagaatgcatgtgttctctacagaaggaattggatcttgcggctgcgttttgttttgtggaagcaacaagatctggtgttgaagaagtg

SEQ ID NO: 27432 - DNA, 222 bp, Glycine max
  Peptide Sequence Number=SeqID_144210
atgagagagcttaagttgtttaacttaactcctaatcccttaagaagtcaagctaaaccacttggattcaagaacaaagagaccgtcagaatcatgctattttgtgagagtgctccaaccatgtgggatcgacacaagcttaaaggagcactcaaaccggatatttaccccgaaagcctaaactccgaagagtccgtcaaggagaaaaatgaagggaaatga

SEQ ID NO: 27433 - DNA, 1329 bp, Glycine max
  Peptide Sequence Number=SeqID_144211
atggccgaagcttccgtaacggttggaggcaaggcttcttctctctcttcctcctccgtcttcgccgtcgccacgggcctcgctcacgtgcggatcgactcatccgcgctcgatagactctccaagaccaccgccacggaaacgacgtcgtctcagcaccgcatctgcgtccccgatttcctaaccctagaggaatcccgcgccttccttctggtcctcctcaacaacctcgtcctctccaatgccccctcccgcattcccctcctcctatcccaaaccctcaattccaatcctcccaccttccaattcctagatgctgacgtcacccaaccagaccttctcacctcttccacgctgctcgctgtttccgccattctcgaccgccagtccgccgcgctctccgccttcgccgacgtcgccgccgccttctcctgtgaggccttgaaggccgatataacgcccttcaatttgatggattccggcgacggacacgcctccaaggccgaggtcgccgtcgccgccgacatgcgggttctgctcaacggatccaaatccgtcggcaaggagaatattcgatccgtcgcgagggttcccaaggttcacgggagtgtgagggagcaggccaaagccgtgcactcgagaatgcgtgttgagttgaattcgggggttaagggtgttgttgttgggagtgaggaagctgtatgcactgtgctgttgccgttggctgcagcactgaaagaacttggtgagtgtagtttcgcacgtgccaagagtaattcggaggttattggtggtgatggtttgagattgggcattggggaggtgtttgggaaggaatgccccactcaggatggtttgagcagtggtttaaataaggctgtgaacttgtttctgggaaaggagtatggtaagtttgcacacgaggtctttgtgatgtttggacttgtgtggaaagttgtggtgtgggaagctgtgacggcggttgcggtgcttgaggctgctgagttgaatgatgtgatcctaggtgtcaaggaaatgaaagtagaggggaacacgaaagtagaggagaagaagaagaagaagaaagttgttttggggaaagggactagctcgattttggcattgatcaaggagaggttactgagtggtcgagagatagctttagggacttgggtggcagattttctatcacttttggatttggctaaacctgagtttaatgaatttttattgaaagtaaaggatgttgtagagagcaatgaaagcaggagattacccaagattcctaaggtgtgttatagtctgcttaaattttccactcttttgtag

SEQ ID NO: 27434 - DNA, 501 bp, Glycine max
  Peptide Sequence Number=SeqID_144212
atgctggaagatcaacttcgaggaaaaggttgggttgcaaacatgtatcatttggactatgtttctaagttctacggctacaattaccatatacttgcttattactgtgttaatgatgcagatattgacaacatggaaatgcagaacttgatgatgccattctcctgtgaaagcttcttaggttctccagaagctgaatttgcaggaaacttggaagagaattttcctgatcacaatgaagttccagttttagttcctattattaattcagttaaaaatgaaatccatgaaggtcaaaagaggaaagcaactgatatatgggagccaagttctgcaaattcaactcctgctgtttttgagagtggaagcaagacaaaaaatagttgtggaagaggcaagagagtaaaaaggaatatgatagaagacaagaaaccgaatgaagtagttcatgttagagccaaacgaggtcaagctactgatagtcacagtttagcagaaagg

SEQ ID NO: 27435 - DNA, 1152 bp, Glycine max
  Peptide Sequence Number=SeqID_144213
atgtcgggtatgggagacgggtacgtgggcaccgcccaagacgcggtgaggattcgacggttggagaagcagagagaagcggagcgtcgcaaaatccaagagctcaaaaccaagtcgacctccgccaagggccaacccggtctcctccaattcggttccagcacttccgagattcttgagactgcctttaagaaggaaactgtgggtttggtcactagagagcagtatgtagaaaagagggttaacattcagagcaaaattgaggaggaagagaaggagaaacttcagaagcaacagcaagaagaggaggagcttcaattagaaaagcgtaaaaagaggaagatcaggggcaactctcgattgtcctttgctgaggatgttgacaatgatccccaagacgacgaaccacatcatagtaagggtaatgcttgctgtttcaaattagagtttttcttcatttatcagtgtagtgggcatgttgccaagctgaaaatacaaaaaaaggcattaaactttgctatacttctagcagataatctggaagcaaatagattacggtgtggtaagcttggtaaagaccctactgttgaaactagctttctacctgacagtgagcgagaggctgaggagcaagctgagcgtgaaaggctgcggaaacagtggcttcgtgagcaggagcaaattcgaaatgagcctcttgaaatcacgtacagctactgggatggaactggccacaggcgtgtgatccaggcaagtaaagaccttaagcttcaagtacgcaagggtgacagcataggagagtttcttcgagcagttcaacagcaacttgctcctgaattccgagagattcgaacaactacagtagaaaatttgttatacgtgaaagaagaccttatcattcctcatcaacatagcttctatgagctaattgtgaacaaagctagaggcaaaagtggaccgctttttcatttcgatgtgcatgaggatgtacgaacaattgctgatgccactatagagaaggatgagtctcatgctgggaaggttgtagaaaggcattggtatgaaaagaacaagcatatatttcctgcttcaagatgggagatatatgatccagcgaagaaatgggaacgttatactatccacggggattga

SEQ ID NO: 27436 - DNA, 258 bp, Glycine max
  Peptide Sequence Number=SeqID_144214
atggacttgcagacaatgggtatggcaataatgttggacgagataataaactatgtccagtccttgcagcaccaagtggagttcctctctatgaagcttaatgcagcaagtacctattatgacttcaattcagagtcagatgttttggaaacaatgcagagagcaagagcatccgaggtgaaagagttggacaggtatgtgagagaagaatgtgaaggagtttcttgctttgaaccaacatggtcatggcccctgtga

SEQ ID NO: 27437 - DNA, 1332 bp, Glycine max
  Peptide Sequence Number=SeqID_144215
atggacgaagtggaatccatattcacaaagcactttgccaacaacgataggaaaaaggcaatgaaatttttaagaccccaacaacataaagattctcacatggtcactttccttttcgggttgtctacaggttgctttgtatccttgttttgtgtatatgcaatcttggcacatttgtgcggtatattctcctctagtaacgagccagcttatatggaaacagtctaccccgttttcagtgtgtttacattgttaagcctgcacttgtttatgtatggatgcaacctgttcatgtggaagaatacaagaatcaattacaatttcatatttgaattttcaccaagcacagcactcaagcacagagatgcatttctgataagcactaccttaatgacaactgtgattggggcaatggtcatacatcttcttctaagggctgcaaacttttctcctaccgaaattgatgccattcctggaattcttcttctgtttttcatagcactgctcatttgcccatttgacattttttatcgcccaacacgttactgcttcatccgtgttatttgcaacatagtatgctctcccttttataaggttctgctagtagacttttttatggctgaccaactaactagccagattccattgctaaggcatttggaaactgcaggttgtcacatttttgctagagctttcaaaacacaccaccctgatacatgccattctggaagagtatatatggaaataacttacatcatctcatttttgccatattattggcgtgctttgcagtgtgcgagacggtggtttgatgatggtgacgtgaaccatttggctaacatgggcaagtatgtttcagcaatggtggcagcaggggctagagtaacatacagcagacagaatgaccatctatggtttgctatagtcttaattacttctgtagtggccacaatgtatcaactgtactgggattttatcaaggactggggatttcttaatcctaaatccataaatccatggctcagagatgatctaattctaaagaataaaagcatatactatatgtctattgtcttaaatattgtccttagagtgacatgggtagagactatcatgcacttcaaagtagggcgtgcccaatcacgactactagaatttttattagctgcacttgaggttattcgaagagggcattggaatttctacaggttggaaaatgagcatctaaataacgttggccattatcgggcagtgaagacagttccactaccatttcgagagatgtcctatggacatgctaaccaaaatagaggcatggagtgtaaagaataa

SEQ ID NO: 27438 - DNA, 501 bp, Glycine max
  Peptide Sequence Number=SeqID_144216
atggagttggcatgggacggggcgaaatttgggttacctaatgcctcaaatggttttttcatcacacatgcagatgtgactgaaataattttaggtgacaaatgtttaaacatatctgtactgcagctgtggatgatgtttatgaatgattggagtacaagcattggtttttctccagtgtacggtttccttgagccccagtctatacgctgcacaaaggacacatgtgaagaatgtcaaaaggcacattggcaacttcttgtgttgtgtccacgagagaacattatagtatggttctgttctgtacgaagaaagcctgatgttcacattaagtttgcagtgaacaatgcaatgaagaaaatatgcagtaatctccaaggcaaggacaatgcacctccacctccacctcaatggattgaggctaagtatttttcagatggaacaacattagacactgacaccatgacgacatacgcaagaaatgggcagcctattttctag

SEQ ID NO: 27439 - DNA, 546 bp, Glycine max
  Peptide Sequence Number=SeqID_144217
atggaatttatgcataagactccagtgccgccttggagtttgatagtcaccgttttcggtgtgtcgagcaccaatagcgcttcgaggccatcaagggatggtctttccacagggagagacaagtatcctgacttccagggagatatctcttgcagacattgggcacgactagtgacccctatggctaaatttgacccggagatagtcatagaattttatgccaatgcctggcctactgaggagggggttcgggacatgcgctcacgggacaggatttcgcccggaccgctgcagggaggcagcaatgtcttgcctagcgaccacaactctgacctccctctgcctaagtgtcagttggtgcatgccatcctgacacagatgagcgttcacatggcccaagtgattgctgatgccatttatttgtttgctggaatggcgcctactaggcaccctctggacctagagaagtccaacagggccttggggttgccggctctaatcacgggcctctgccagtcctacggagttcctatcacccccagcaag

SEQ ID NO: 27440 - DNA, 380 bp, Glycine max
  Peptide Sequence Number=SeqID_144218
cgccaagcctgacctatacgtctaagcgccactttgcttctgtaagttttcctttgaataaggctaagcgcgtctgtgcgctaagccctgagtttgacaagttcaaggaggaacttgagagaagacattgggatgagaaactaactgatttttctgacagtagcatagacatcgctattatgaaggagttttacaccaacctctatgaccccgaggataaatcacctaagcaggtgagggtgagagggggagaatttgtgtacatattccaaatttcactctcgaggcctgatcctcaggagttggctgctaagctttgtatcccaaggaggggatttgagcttaatgctgatgggaagtctttgaagacactgaggtag

SEQ ID NO: 27441 - DNA, 197 bp, Glycine max
  Peptide Sequence Number=SeqID_144219
attcaatggatgactcctcaaccattgaagaaactaaggtaaattctgaatatgaagaagtttgggaagcatttaatgaaacacatgaagaagcgcaaaggcttgctgtttcaatcaataatttgagaagcaatctaaaattgcatatcactaaattgacttcaacacaaaatgagttggataaaccgagacaataa

SEQ ID NO: 27442 - DNA, 736 bp, Glycine max
  Peptide Sequence Number=SeqID_144220
ctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatctgcagtagtagacaaccaaaagatgaccactataaatgttgcaagaatatcgacagaggccccaaatggtttgtcagttgctaaaagtggtaatggatggttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 27443 - DNA, 201 bp, Glycine max
  Peptide Sequence Number=SeqID_144221
atggatacaaatttttggctgctacttagtatcggcaataggtctgaaaaagtatctaaaaatatgaaatttagatatttgtaccctgtcgagctaggtgttctgtccagtgttgtggtggatagtgctgctagccctcgctttgtgatgacgaaccctgatttgaggggacgtgttactagtctcacattgagtgattag

SEQ ID NO: 27444 - DNA, 234 bp, Glycine max
  Peptide Sequence Number=SeqID_144222
atgggcttctcaaattctctatttcccgaaggaaactccctcccttggccacctatctttaattgtgagggttacctgatggaagctcccttggagcttggaggcctaggatcttcttcatcaatggatttctttgcttcttggaagaaaaatggcagcgaaatggagaaagaagaaagagaggaaacgccccttcaaggagaaaaagagtctagaaaaagctcaccaccatag

SEQ ID NO: 27445 - DNA, 237 bp, Glycine max
  Peptide Sequence Number=SeqID_144223
atgtttctcttaatcaatgttttaaagggagtcaacgacagtcaagaaagtaaatccaaggttgctgctagatggattgtagttaaatgtaataagcaaaaaggaagcactacatgcgggtactacgtagtgcatttgatgtcaacaatagttctaggaggtttcaaggataactcggaaatgaaaatcaatgttaacgttcaaacttttaacattggtagtttcaacatcggttaa

SEQ ID NO: 27446 - DNA, 171 bp, Glycine max
  Peptide Sequence Number=SeqID_144224
atggaaagagaagatctctatgaatttattgatacagcagcacaaatagctggcttagagtctgaggaagatataacagaaaaatggcgtgaatggtcatacacttcgatcaagcttatcgataccgtcgacctcgagggggggcccggtaccagcttttgttccctttag

SEQ ID NO: 27447 - DNA, 519 bp, Glycine max
  Peptide Sequence Number=SeqID_144225
atggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgagtcaggaacaacgaatccctttatgataaacagattcattttgcaagttcgttattacgggtagttcctacaaaggatcggactaatgacgtatacaatacttga

SEQ ID NO: 27448 - DNA, 699 bp, Glycine max
  Peptide Sequence Number=SeqID_144226
atgtcacctgtgtgtgccacctacagcgagtggcatgtatgcaagaacatgtttcccaaaaccaggttggaaaattccctagtcaatcctccaaagggctcgcaaaacctaaggtccgcccttagtgagtcccaccaattcacaccaccatgcctccagtactttccactttgtaaaaggcatgtatgcaagagcaagcaagttcgtcaccaatacatgccatcctcggcaagtgccatgtatgccaaaacacaacacttacacgcacacaagactcgtcaaacccaagcttcgggtttgctgatctttacaagtttacagaatccaaggcctatccttggaatacatgcttataaaaaacccaaggtctgcgcttggtactcttacctccaaaacccaaggttcgcccttggtacatactcctacaaaacccaaggtacccctttggtacgctcacatgcagcaactatgacgaccattgacaagggtccaagttcaaccaagcgaactgccaccccatcattgggcaagacctttcatcaggttgaagcccatactcattcctcacaatcatcagaggagtacttttgcatgtcaaatcaaaccagtgtttcaaagattgctctttttatcaagtcaaacaaacatccgagttcattttggcattcgggaaaatcatttgttgcgttcaccctctag

SEQ ID NO: 27449 - DNA, 765 bp, Glycine max
  Peptide Sequence Number=SeqID_144227
atgcccttgcggggtagaattgcatcacaatggatcccctttgatgaagatgccattaatcagttcttggggcatccgtttttcctggatgaggggcaacgctgtgaattcagtcaaaggaggagtcaggcctcagggttggatgaggaggccattagtcagcagctatgtgttctagggcaagactttgctcgaagcgtgataaggagacgagtgtggatcatgcgcagtagcatgaccaccttgacacaaatttggattacattgtttgtcagcaacatcctccccatctatcataattctgacctccccctaccaaagttccaactggtctatgccatcttgacccaagtgagtgttcatatggcccagttgatctcagatgtcatatatcaatttgtagggatcacgcctcctaaacacccagtggacccagagaagtccaacagagcactggggtttctggccttgatcacaagcctctgcccgttttatagggtgtcgcatgtgaccgaccagcaggcggctaatcataggggtcaggtgcagctgaatgagagcttctaccggtacaccctgcatcaacagagccaggaccctagtccgttcccgtggactacccctgaggagttcggggccacaattgcatggcctggagataggcctgattttcaggaaggggcaggactcgcagggacccccggagatgaggatggagctcagaaggatgatgatatggctgatgtgatggactacttcctttga

SEQ ID NO: 27450 - DNA, 417 bp, Glycine max
  Peptide Sequence Number=SeqID_144228
atggttgacaacacacgcatgaaggagcttacaggggatgtcaaaaggatcctggagatgatggaaaaccgcaataaagaatatgctgctcggaatgttaagattgattttcccatattagatggatcagatgttttacaatggatattcaaggctgaccagttttttaactatcataaaacaccgggtgagcaacgattaattattgcttcaattcacttggataaagaggttgtgccctgctaccaaatgatgactcgtgaaaattcattcaaaacatggattgcttttacgcgagccttagagacagaatttggcccatcaccgtatgaatgtcctagatctcagttgtttaaacttgctcaaattggttcagttcagtcatattacgtgcagttcacggctttagctaatcga

SEQ ID NO: 27451 - DNA, 369 bp, Glycine max
  Peptide Sequence Number=SeqID_144229
atggcaaattcttggtacaatgccaacaaagcaaacaagaaaacagagcaccacaatataatgttaatcaagagaggaaatgtcaagcaacccaatttaatcgactattttaagcttggaacatttaatagttcctttctctcaagtagcactggacaactcctaaaatggagagaatggaaatgggattggaaaaataaaatattaattaggagatggtttcgagagaaaaagatatctggttgcatggatgtaaaggagaagatgacgttttgttttctcgaatgtggaggccactgccatttcaagttgacggagtgtacaaagggggaagccatgtgccatttcacaagcacttccaactattaa

SEQ ID NO: 27452 - DNA, 459 bp, Glycine max
  Peptide Sequence Number=SeqID_144230
atgttggataatactggtccaactatgtatccttttcaaaatgataaggcgtacatagaatttcatgatgaatgctggggagttcctgcttatgatgacaacaaattgtttgagctgcttgcattgtctggattgctcatggactacaactggacagaaattctaaaaagaaaggaaactctaagagaagttttcgctggatttgatgccaataccgttgccaaaatggaggaaaaggaaatcatggagactgcatcaaacaaagcactttctttagccgatagcagagtcatgtgcgtaattgttaaagaatgtggatcattcagcagttacatatggggttacgtgaatcataaaccaataataaacagatacagatacccaagaaatgtgccattgaggagtccaaaggcagaggcacttagcaaggacttggtgaagcgtggattttcggcatag

SEQ ID NO: 27453 - DNA, 233 bp, Glycine max
  Peptide Sequence Number=SeqID_144231
catgcaccactggtctctcaacactaggtggtctagtggacaacgatcatagacgtgaggctttgcgtgtccgctttacggcagacgtcgaagccgatgcgtccgaagtaggaggaggacgaggagcagaaggagatgaaggaggaggaagaggaggaggaggaggaggagtgaaggcagaaaagaaagaggggaacgagcaacaatttgaaggttgtacattcaggaactaa

SEQ ID NO: 27454 - DNA, 387 bp, Glycine max
  Peptide Sequence Number=SeqID_144232
atggatttctacagctcttggaacttaggaaacaagtttgtgaactttagagggcattttcgaaatctaaccaaatgggagtggaattggaggattttgaatccaaaactgaatttcttacatccaataaccttgagaaacatatatggtttgcctcaattggatttctacatcaatgtgaatgttgttttaaaagtgggtgattggcaattccaaatgagaaagtgtctgatacttgcaatcggcaactacatgaggattgacatgcattacgaggaatggaaggaaaacgagaatagtccaaactattcaaaggaacctgggggaatgatgagtgttgataacctgactaagggtcttattctggttagtgcgagggacttatag

SEQ ID NO: 27455 - DNA, 570 bp, Glycine max
  Peptide Sequence Number=SeqID_144233
atggctaatcgcaccttctctctgtttattccttacacgaacatctgctttctccgcactcctacttggagattcctagattcaacgattactacattgtcgacctcaatgatctctactaccacgtgcacctttgccttaacgaggcaaaccattcatccattgctgcgacatgccgtgattgatgtctatattgacttgattcattcttacatgaatttgagaaggatcagagaggtgaatgatggttctaatgatgtgaataaagatgtggtaagtatagaagcaaagtttcatgatgaatcgaaggtgattcaaaggtgttttgatgataacaatgatgatgataaaggtgatgacaaaaagctcaaagatcaatcaaagaacaactcaaatgaatcaagaacaattcaagagttcaagataagaatcaagaagaattcaagaactcaagaagaaagtctaaagacaagaatcaagattcaaggttcaagatctcaagaatcaagatcaagattcaagactcaagattcaagaataaagagaagactcaatcaagataagtattaa

SEQ ID NO: 27456 - DNA, 243 bp, Glycine max
  Peptide Sequence Number=SeqID_144234
atgaatcattatcctttcgaaggtcatcaaagtgatacttctgcaagcaaacattcgttcggtggtgttgcgaaaacatatcctaatttttcatggcctactatgaccgcttcacaacaacatgatgctccaattgcaacacctaatgccccattaggtactactgtaccaagagcaataactgatatggatggcttattaggtgttgatttacgtcaccaattttctagtgaggctgaccaa

SEQ ID NO: 27457 - DNA, 615 bp, Glycine max
  Peptide Sequence Number=SeqID_144235
atggcttccctcaatcaccttcgaatttcactctcaacacaacttttcatacacatagacaccatgtattccggcaatgcaagcagcagcagcagcagaggctcttccggatccggaaagtaccgcggggtgaggcgtagaaccagcggaaaatgggtgtcggagattcgcgagccgaagaagcctaacagaatttggttaggcacgttccccacgccggaaatggccgccgtggcgtatgacgttgccgctttggctctcaagggtaaggatgctgggctcaactttccggactccgcttcttcgcttcctgtcccggcttcgctctctgcgcgcgacattcaggtggcggctgcagctgccgcggctgctgccggagcagcgaatgatgctatgaggacacaaacagcaaataataacttttcagaggcacaagagaatcaaactgggatgagtaaccagtttgtggatgaggatttgatctttgacatgcccaatgttctggtcaacatggctcagggaatgctgcttagtcctcctccttttgacattggtttggaaccgaatagcccagaaaacaccgaacaagagacaaacctgtggaatttcccttaa

SEQ ID NO: 27458 - DNA, 390 bp, Glycine max
  Peptide Sequence Number=SeqID_144236
atgaccagacgaagggagactgttgaagcggaatcatatttgtaccctcagatggtagagtgtggccatggaatgtattacacaccaccaacattttctcagttttcgacacagatgtatcagtatccattcgaaggtcatcaaagtgatacttctacaagcgaacattcagtaggtggtgttgcgaaaacatatcccaatttttcatggtctactatgaccccttcacagcaacatgatgctccaattcccacacttaatgccccattaggtactcaatggaatgtgttgatttacgtcaccaattttctgctgaggcctgaccaagttgaagcgggggcacattggggcagaagaaatcctgatagacaagcacggagatgggaatga

SEQ ID NO: 27459 - DNA, 558 bp, Glycine max
  Peptide Sequence Number=SeqID_144237
atgaaggaattcaaatacccacttaaatatattgcaagcatatgttccagagcagaaccttatggaattttccatattgtccctcccacttgctggaaaccaccatgctctcttgagaaaaagaacatattagaaaagtctgaatttgttgctcagattcagcgaattgatggacaccaagttcagcatgcacaagaaactatggctagtgctcatggaaatacaaaaaccaagagaaaaagagatgtaaaagtagctttagactctcagcttggtaatagaaacaccagcattccaaataaccagaatgttgaaaaatgtgactgtaagtctgaacctggtcctaaattcagtctcaaagcatttaagaaatatgatgacatatttaagagccagtacttcagttacaaggataataagaagattgtaggttccaatataaaattagccatacgtcagctgtgggaaccatctggggagaatattgaggcagcctctaaaagtaagaacaatttatatcaaatgctttatatcattattcatcccgtggtaatgtga

SEQ ID NO: 27460 - DNA, 609 bp, Glycine max
  Peptide Sequence Number=SeqID_144238
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctccccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaatggcttacgaacggggcggagatttcctggaagatgccaggaagatacttaa

SEQ ID NO: 27461 - DNA, 624 bp, Glycine max
  Peptide Sequence Number=SeqID_144239
gaaactcttgtcttagttcccaaaggagatgagttagagtacagagacaatttgatattggtgagaatgattgatctttcaagtaataagctgtctggagcaattccatctgaaatttccaagctatctgctttgcggtttttgaacttgtctagaaatcatctgtctggagggataccaaatgacatgggaaaaatgaaattgttagaatcccttgatctctcactaaacaacatttcaggtcaaatccctcaaagcttatctgatttgtccttcctcagtgtcctgaatctatcatacaacaacttatcaggcagaattcccacgagcacccaacttcagagctttgaagaacttagctacactggaaatcctgagctttgtggtcctcctgtaacaaaaaattgcacagacaaggaagagttgacagagagtgcttctgttggacacggtgatggtaatttctttggaacatcagagttttatatcggtatgggagttggatttgcagcaggattttggggtttttgcagtgttgttttcttcaacagaacttggaggcgtgcttattttcattatcttgaccacttgagagatctgatttatgtgataatagttttgaag

SEQ ID NO: 27462 - DNA, 2133 bp, Glycine max
  Peptide Sequence Number=SeqID_144240
ccaaaatcgtgacctatgagtggggtgaatacctcaagcgcgccaaagcgggcgaacaccagacggtgatgatgggctggaccggcgacaacggggatccggacaacttcttcgccacgctgttcagctgcgcggcggcgaaagacggctccaactactcccgctggtgctacaagccgtttgaagatctgattcaaccggcgcgcgccgaatccaaccacgacaagcgcatcgaactgtacaagcaggcgcaggtggtgatgcacgatcaggctccggcgctgattgtcgcacactccaccgtgtacgagcctgtgcgtaaggaagtgaaaggctacgtcgtggatccactcggggcgcaacaggtttgcgcccctgctgaccagtctccggcgtatggccgtcgaatcgttcaaaggcatttcatactccgacgtttggggttagttatcccaacgtttatcggcattacattgctgacttttgcattcgtccatatgatccccggcgacccggtgaccatcatggccggggaacgcggtatctccgccgagcgccacgcgcagctgatggcggaaatggggctggacaagccgctctatcaacaatatttctcctacgtgtccaacgtgctgcaaggcgatctgggcacctccctcaaaagccgcatctccgtctggagcgagttcgttccgcgctttcaggccacgctggaactgggcatttgcgcgatgatcttcgcggtgctggtgggcattccggtcggggtgctggcggcggtcaaacgcggctcggtctttgaccataccgcggtgggtatctcgctgaccggctattcgatgccgattttctggtggggcatgatgctgatcatgctggtgtcggtgcagcttaacctgacgccgccagccgctgaccggcttcatgctgatagacaccctgatctggggcgagccgggcgacttcgtcgacgcggtgatgcacatgatcctgccggccatcgtgctgggcaccatcccgctggcggtgatcgtgcgcatgacccgttcctcgatgctggaggtgttgggcgaagactacatccgcaccgcgcgcgccaagggcgtgagccgcatgcgggtgatcgtcgttcacgcgctgcgcaacgcgctgctgccggtggtgacggtgatcgggctgcaggtcggcaccatgctggccggcgccattctgaccgaaaccatcttctcctggccggggctgggccgctggctgatcgacgcgctgcagcgccgcgactacccggtggtgcagggcggggtgttgctggtcgcctacgtgctctacggcgtggtcaacccgcgtattcgccacaagaaataaggggcgctctcatgtctcaaatcactgaatctgcagttaaaggtgcgccgaagccgatgaccccgggccgtggtcggcctggtgtatatcgttctgatgctggtgatcgcgctcggcgccggcgtgctggcgccgcatgcgccggcggaccagttccgcgacgcgctgctcaagccgccggtgtggcaagagggcggcagctggcaatatatcctcggcaccgacgacgtgggccgcgacgtgctgtcgcgcctgatgtacggtgcgcgcctgtcgctgctggtcggctgcctggtggtggtgctgtcgctgatcatgggcgtgatattcggcctgctggccggttacttcggcggcgtggtggacgcgattatcatgcgcgtcgtcgacatcatgctggccctgccgagcctgctgctggcgctggtgctggtggcggtattcgggccgtcgatcgtcaacgcctcgctggcgctgaccttcgtcgccctgccgcactatgtgcgtctgacgcgcgcagcggtgctggtggaggtgaaccgcgactactcaccgcttcgcgggtggcgggcgccggcgcgctgcgcctgatgttcgtcaatattctgcctaactgcctggcgcctttgatcgtgcaggcttctctcggtttctcgaacgccttctggacatggccgctctcggtttctgggcatgggcgcgcagccgcctacgccggagtggtgcaccatgctctccaacgtgctgctgttcgcgctaagcgcctggtgg

SEQ ID NO: 27463 - DNA, 1293 bp, Glycine max
  Peptide Sequence Number=SeqID_144241
atgtgtgaagaacatggatatcaaaggagtgggaaaaaatgcagagagaagtttgagaatttgtacaaatattacaagaagacaaaagaaggtaaggcaggaaggcatgatgggaagcattacagattctttcgtcaacttgaagccttatatggagaaaatagtaacacagtttcagtcccagaaaccaatgttgttgttggcagcattcattttcaaggcccttctcaaacaaatcaagataataataagtttcaatctcacaacaacaacaacaacaggcattgtgatagcctcagcctcactaactccactaattttgacacatcaacatctgaaggtcatgatggcaatgatcacagtatggagaatgagtccatggagaagaggataaagaggaagagtgggaggagttggaaggtgaagataaaggacttcattgactcacaaatgaggaagctggtggagaagcaaaaggagtggttggataagcttgtgaagacacttgaagagaaggagaaggagagaatgctaagagaggaagaatggaggaagcaagaggcaaacaggttagagagggagcaaaagttctgggccaaagagagagcatggattgaagcaagagatgctgctttgatggaggctttgcataagttaactggaagagaaataatgaaggttgaaactgatcctgagggtactataaatgtaatgactgcagctgaagttcaaaaccagaataacgaagatgagagtgaaattttgaacagcagtaatgttatcagaggtgctgatagctggcaagaatctgagatcacaagacttgaacagctgagagctgagatggagacaaggtttccatatagtgaaatttcagaagaggtttcatgggatgtagtagcaacaaagatggctgattttggctacgaaaggagtgctttgatgtgcaaagagaaatgggaaagtatcaacaaggaagagaagaatagcaagaatcgcaaggaaaacttatctagaaactgcttttacttcaagaacaatcatgaggatcaacaacaatcttctctatacgatcaaggaagtgcctattgtgatgatgatgtcaatgagcaagggaaagagattgagaggcttcaaacaaataatggttcttcttcaccttcaaaatccaatattgttggaaatgttgttccttctgatagttgctttcccttcctgatgggtgctgatcagggtggaaacttgtgggagaactatggcttaaagctcaataaagaaaatcaaaatcattga

SEQ ID NO: 27464 - DNA, 1386 bp, Glycine max
  Peptide Sequence Number=SeqID_144242
ggcaaattcaacgtcaccgccaagggcgggctggtggaggaggagcacgtcgactgggtgatcacccggccttacatgttcctggtgatcctgaacctggccgggctggcgttcggcgtttggcggttggcctatggcccgacggacgaggtgatgacggtgatcatcagcctggtgtgggtgctgtacaacatgacgattctcggcggtgcggtggcggtggcggtggaggccaagcaggtacgtcaggcgcaccgcgtggaaatcgccatgccggcggcgatcgcgcgcgccgacggccatctgtatccctgcacgctgcgcgattactccgacggcggcgtgggcattgagatgcgggtggaaaacgcgttgaaagacggcgacaggctctcgctgctgctcaagcgcggccagcaggagtacagcttcccctgcgtggtaacgcgcgccttcggcaacaaggtgggggtgcgcctggtcgacctctccacccgcgaacacatcgatttcattcagtgcaccttcgcccgcgccgatacctgggcgctgtggcaggacgggttccccgaagaccggccgatcgaaagcctgcgcgacgtactggcgctgggcttccgggggtatgtgcgcatggcggactacgcgccgccgctggtgcgcggtctgctggtcggggtcacctcgctgaccgcctgggtcgtgtcgtttattccgcgcggcgtcggcagggatccgaccttgggtcaacaagaaacagtgggcatcagcaccctgtcgcaggccgaaaccgccaccgcgccgaccgtggcggcccagccgccgatcgccgcggcggccgatacggcgatcgcgccaccgccggccgccgcgccgcaggatccgaatgcgccggtgcgcgacgtgtcgctgccgtttgcgcagatagcgccgccgccgggcacctttgttctacgcggtacccggccggacgggcagatcgaattcggcgtgcgcagcgacgaggtggtctcgcaggcgatgctcgatatggagtttacgccgtcgccggcgctgatcccggtggagtcgcacgttaaggtctacctgaacgacgagctgatgggcgtgaccacgatcgccaaggagcaactgggcaagcccaatcgcatccagatggcgatcgatccgcgctatatcaccgattttaaccgcgttcggttggtgttcgtcggtcattatcaaaatatctgcgaaaacccggccagcacctcgctgtggctcgacgtcagcaagtccagcgcgctgaagctgcgtttccagacgctgccggtgaaaaacgagctgtcgcacttccatgagccgttattggacagccgcgataatcggccgctgacgctgccgatg

SEQ ID NO: 27465 - DNA, 129 bp, Glycine max
  Peptide Sequence Number=SeqID_144243
atggtttcaaacacggttcttatttccaaaaactatgatcatgtgtttgagacttgggtatctggtcatgcacacatgggttcaggtttcaactcctcaacatcgcacctcccaacacctccgttctag

SEQ ID NO: 27466 - DNA, 294 bp, Glycine max
  Peptide Sequence Number=SeqID_144244
atggcgatggttagggaaaactgtggtgatagcaccgggaggaaagagcgcgaggctgaaaagatattgagcgcgatgatcgttactacaaccaccaccgccgtaattaccatcatggtggtggcaacaacaacaacaaaaatcatgatggtaatgatgatgaacatgctggtggtggtggaagtaacaatgataatagtcatgatggtggtgacggttgacgatgattgtggttgtagtcatgatagttgtgacaaagacagtcatagcagtggtggtcatggaagatggtga

SEQ ID NO: 27467 - DNA, 150 bp, Glycine max
  Peptide Sequence Number=SeqID_144245
atggacttttggaagcttttcattgttgcattattgccagttttgaaggtattgttgattactgctgtggggacaatcctcgcaattaatcgcttgaacatactcggggaaactgccaggaaaaacctcaatactttacaagtttattaa

SEQ ID NO: 27468 - DNA, 270 bp, Glycine max
  Peptide Sequence Number=SeqID_144246
atggcaggctggcagctaaacaaggatggcgctttgactcaacctatgaccacaaagataacaatggtgatcccaatccgtttgtctttgtccttggctctggcaagaagagttgaatcatatcagaatcaatgtctaggaggtattcgtagagttatcatacctccatcacttgggtatcaaaacacatcacaagagcccatcccaccaaatgaatatttgaactcaccacatctctccccttcccgtctcccttcaccactagattaa

SEQ ID NO: 27469 - DNA, 759 bp, Glycine max
  Peptide Sequence Number=SeqID_144247
atggaggggagtgttagtatcaagaggagaaatacctggtccccatctgagggaacttcacctgaaccatcaagaagttccaaagccttaactccaccagaattggggatctcaaagaactttgatacggggaactttgaagaaggaaagggagaagaagaggaaggagctgggggaggaagtgagaaaatgaatgcagagaaagtggtggagatgagagaaagagataaaggtcttcttgttgttgaggatgatgatgctgaacaagttgcaaacataaccgaactatgccgattcagcggtgccaagatctacccagggaaaggcatcagatttgttcgtggtgattctcaggttttcctgtttgctaactcgaaatgtaagaggtatttccacaacaggttgaagccatcaaagctcacctggactgcaatgtacagaaagcaacacaagaaggacattgctcaagaagctgtgaagaaaagaagacgtgctgccaaaaagccttactccaggtccattgtcggtgccactttggaagttatccagaaaaagagagctgagaagccagaagttcgagatgcaaatagggaagctgcccttcgtgaaattaaggagaggaacaagaaaacaaaggatgagaagaaggctaagaaagcagagtttgccaagtcccaaaaatcacaagggaaaggaaatgtttcgaagggtgccatgcccaaaggtcccaaacttggtggtggaggcgggaaacgctga

SEQ ID NO: 27470 - DNA, 558 bp, Glycine max
  Peptide Sequence Number=SeqID_144248
atgattatggttgaaactagaggtttggatcaagctttagatagggttataggaagagccttagggagagatcatgtggagcatgcagatgataaggtccatgaacagcctgaagaagcggttgttgatgatgtagttcctgatgccaagggttttctaggcgggtcccacgacacatcagtgttgatggactatgtttatcatctggcaccgactgaacgtcctgagctgaaattatcctcccatggaaagaaagttgagaaatttggcaggcctgctctagagattgaaggcttagtgactggcaaaagattaattcctctaatcacatgtttgttggacactggtgatcaaggacttatgtctgcttttgtggagagctttgagcctcttcatgtgggtgatgtcatcttcctcttagtcaaattgcttgaagtgagttctaaagaggcaagagctgagacaagcggaagctatgcatggggagccgctgaactggtgcatatgtatgagaatttgaatgatgcgttaaagagcattgctagacaacttgcatga

SEQ ID NO: 27471 - DNA, 326 bp, Glycine max
  Peptide Sequence Number=SeqID_144249
atgaaactcccaacaacgtttgcagacccagaatccttgtcttacctttacaccttgctccaatcttccttcgaccaaatgaatgatcccaccaacaacaacaacaacaacacttccacaactgggagaaaacgccgcagaaaaaacgaggatgatgatgatgatggtggtggtgatggtgatgatggttcatccaacaacaacaacaacaaaaggagcaagaagaagaaggaggagctaaagggtatcctcacttcaattctcttgttagacgaacaagagaaacttgaccagcaacagaacaacagggtctcagaggaagaaaa

SEQ ID NO: 27472 - DNA, 801 bp, Glycine max
  Peptide Sequence Number=SeqID_144250
atgaagcttctaggagataaaaaactgaagacaaagagcaagtggttgaccaacctgtacgttgctccagttgaagagactattgtcgaacagcctgaaactatgaaagttaatcctcctcatcctgatgttaatttgataaaagtcgaacaagaaaatgtggttttcgacaatgcccaatcaatcgaaccaaatgtcactgtgccttcgacaaaagacaataaatctccaatttctaaagctaaaggagaaaaagaaagttctcaaaatgataggtcagcaaaaccttttgaagaaagcaacatgttcgaattagatgatgaggattacacaattttgcatagatggaaaagttatgaaactcaaactaaagttgcctcagaacccaatgcaaatcaacccaacaatgtttatgaatatcaagaaaacatcatgcctaaatctaacaaagaaactttgaatgcttttaactcgatcttctcaaatggacatgcatcttacagaaagtttctagtcagtaaggtcgagactagaagaaaaatgaaagaagcttcttccatgaaagcttcttacaccaagttgaaggattcgatttctgcattggacaaggaagaaaaagatattgagattcagatttctatattgcagactcgaatggatgatgaacgagagaagaaaagaaaggaagtggacaaaagaaatgctctaattgaaaagagaagaagtcaaagaccattggaagttctttatcttcctcctgaaagctcaactaaaaacgaaaaggaccttggaaaaagataa

SEQ ID NO: 27473 - DNA, 381 bp, Glycine max
  Peptide Sequence Number=SeqID_144251
atggatgaagatgagtggatgtatgaaataatgtctgaacgagcggatatggattatgaaaatgcagaatcatgtggtgcgaatgaaccacatgttgattgttcggaagcgttcaagacttctcaggtgtttgagtgccgagaggatgttttgcggtgggctcgatccgtggctcatgaaaacggatttgtggcggtgattttaaggtcggacaaaaacacaggtagtagaggaaggagtacgtttgagttaattggttgtgaaaggagtggcgagtataagtgtaggaaaaaagaatttatcagaagagacactgggactaggaaatgtgggtgtcccttcaagcttcgttgcaagccagtggctggaggagaaggctag

SEQ ID NO: 27474 - DNA, 291 bp, Glycine max
  Peptide Sequence Number=SeqID_144252
atggatgaactgaaggatttgatcaaacaagttgcgcctcgtgggattcccccttatggtgttgatgaaacacaaatggtaacacgattgttttttcggaaaccaagtcaccatgagtattcagaaaaagttataaaatttgaaataattgaactcaaaaccaacgaggacgtgatgaaggtgctcattgagtctaactactggaaaaagattgggccaatagaaattttagttgttttcagtaaacctttaccacaaatggaagacgagttgtccttgtcgcaaaattag

SEQ ID NO: 27475 - DNA, 207 bp, Glycine max
  Peptide Sequence Number=SeqID_144253
atgtgggttaaagctgccattttttcctttggagatgtgaaggattgtggtcatgatgaagctaatttcctgtaccttgggtttgctatagtggctttgatcattgatccaaacaatgaatcccaaaacggagacaacttgaatgtccaccaaccaatcagacctccattaattgccaactatttcttacccaaacttcaaaagtag

SEQ ID NO: 27476 - DNA, 405 bp, Glycine max
  Peptide Sequence Number=SeqID_144254
atgaaacaggccaaatacagtctaaaggcccaagtggagaaggacgaaggcccaagtggagaaggacaaagcccccgagtggagaaggatgaaggcccaagtaatccttgtggcgtctacccggacttatcttccttcactggaagtggcgtctacccagacttatcttccttcattggaagtggcgtctacccagacttatcttctttaaccggaagtggcgtctacccagacttatcttccttcactggaagtggcgtctaccctgacttatcttccttcaccggaagtggcgtcatccaaatctccgtagcctgtatcaaacgatccactcctactcaggttcacatcaataacttttcactcgcatgtccgattcaggagcatagcgtatcgagacgctag

SEQ ID NO: 27477 - DNA, 611 bp, Glycine max
  Peptide Sequence Number=SeqID_144255
gtacactggcgaaagaagcactggatccggaccggggcggtgccggaggaccgacggcagaagtgggtgctcgaaggacacggtggcaggtcagaagtactgcgacgcacatgcaccgtggcggaacgttcaaaagcctggaacaacgtgaaggatctctctgctataactctgtcttcttcacactctgcttcattcaatctccttcactcggtcaaagttccgctgtggccaagagtgacagcaagagcttgtctagaaaccgtgatcatgtggatggggatggcaaatcaaatggccatgtcttgaggcatttctttgatgattggccaaggacactgcaagagcctgacaatggtgaaagcaatggaagccagaacaacaactcaggaaaatgtctttctatgtcaacaccaggaatcgatccctcggatgtgtcgttgaaattgaccactggctatggagaggacgcgtgccaggcagcttcggtgggaggaccacttgcagaggcattgagatcatccaccaccagctccacttcttcaccaaccagtgttctgcttcagttgcctcctagttctgcttgtgagaccagcttcattagcacctaa

SEQ ID NO: 27478 - DNA, 702 bp, Glycine max
  Peptide Sequence Number=SeqID_144256
atgtcagagcccccaaaaccgaggctagtcatctgcatgggcgacatccacggcttcataacaaagctccaaatcctctggtcgaacctcgaagccagcctcgaccgatccgaattcgaaaccgcaaccctaatcttcctcggcgattactgcgaccgaggccccggcacccgccacctcatcgagttcctcgtttctctaccctcccgttaccttctcggaggggtggttcaaaggggaagggtacgagaatatgcagcttcaagggagaaggggacggagtatcagggttccatttacgacgctggacccacctttgagtcctatggagttctccatgcctctgctgtgttgttatatcctggactgaagggcagttcattgaatgcagatttggttaaggctgttcctgatgatcacaagaaatttcttgctgatttggtttgggtccatgaagaggacgatgtctttgtgaacactgatgatggagttaaatgctgcaagttgattgctgttcatgctggtttggagaaaggaaaagatttgaaagagcagttaaaacttttgaaagctcgggatactcgggtgcctaaggtggaggctctaagtgggagaaagagtgtatgggatatcccagaggaactaactgcaagtccgtcaccatgggaaactccacgtagaaggcttaaggctgatcattga

SEQ ID NO: 27479 - DNA, 2592 bp, Glycine max
  Peptide Sequence Number=SeqID_144257
atgggttcattctctggcacttgtgaaattgtcgaagcaagggaagacctaaatacagagaaagatacggggatatatcagtccaattctggatatagcctggatgagaaatttcagaagcatcctgtgcagaaactgggatataagggtaatctagatgatgatattaataagctgtttgagtcaattactcttaaatcttcctcaagggatttgggctttatacatggtacaagccctaagatgaaaagtgcattgaaaaaaccaattgcagtgggtgcttctcggtccccacgagttggaccttctgagcctgtgactttgaagcaggcactaagagacctatgtatatctaaggcatcagaaatggcttccatgaaaagattatcaaagtcaactgcttctccacgaatatctgaggttgggaagatacatacattgtacaattcagttgtagttgaaggtagacgatctgagccttctaatgttgagagtaaaggtagtacaagtgaaatatctctagtgccagaagagagcaactcactttctttggataatgcttaccagtctcgttcaactgttaaaagcacttcgctgagcccaaatgttcaatcttccaaaattgctgttgcaattgcaattacacaaaatgatactggggcttcattgatgccaagtgacctggctagttcatcaagtaaagttggggttctatcaccgtcatcagagcctgctcaaatagagaaacaaacatctgaatcttcttcatctagttgtaacaccaatggaagtaaattagagttgcccgaaaatgcttcttcccctaaaaagataggaaataaagcctctgcatcaaagaatgggcggaaaggtaggttacaaacagtctcttcctcatctacttcggtaaatggcaatagagtgtgcaaactgtcacgcaatgcccctcgtacagtcaaatcaattatcaagaacaaaaattttggaaagaaaaaagtaaagcaggattcagtttctgctttatttgatcctacatgcagtgaagtaaatgacaagtcagtttctggtacaactcaacttgtttgtgagagatgttggtgtgctattgaaaataacaaaggtattacatcattggactctatcagtcctggagagggaataaactctgttaataactctggcgctgcatcagctggctgtaatagcagcagagaagttacaaaagtgaaaaagaacaccgtattgaaagagcaacttgaattttctcaaagttcaaagagtagccaaggtgactacagtagtagtacaagtaccagtgatgagagtaatctcagtgggtctagttgtggcaataggcctcacatgtcaaaggatgttagatggaaagccatacgccatgctcaaattcagaatggagtcttgggcttgagacacttcaatcttttgaagaagctaggttgtggagacattgggactgtatatcttgctgaactaattggcaaaagttgtttgtttgctattaaggtgatggacaatgagtttttggcaagaaggaagaagatgcctagggctcaaactgaacgagaaatattgaggatgctggatcatccttttcttccaacactgtatgctcagtttacatcagataatttgtcatgtctggtcatggagtattgtccaggtggtgatcttcatgttctacggcagaagcagcttggcagaagtttttcagagccagcagcaaggttttatgttgccgaagtccttcttgctttggagtacttgcacatgcttggagtggtttaccgtgatttgaaacctgaaaacattcttgttcgagaagacggccacattatgctcacagattttgatctgtcgctaaggtgtgatgttagcccaacacttctgaagtcatcttatgtggatcctgctaagatttctggtccttgtgcacaatcgagttgcattgagccattctgtattgaaccagcctgtcaagttccgtgcttcagcccaagactcctacctcctgccgcaaaagcaaggaaattaaaaaatgaccttggtgctcagctcagatcattgccacagctcgtggctgagcccacagatgcaagatcaaattcatttgtcggtactcatgaatacttggcgcctgagatcatcaaaggagaaggacatggagctgcagttgactggtggacatttggtgtttttctatatgagcttttatatggtagaacaccctttaaaggttctaataatgaagaaacattagccaacgtggtgttgcaaggtctcagattccctgacaccccatttgttagtatccaagcgagggatctcattagagggttgttggttaaagagcctgaaaaccgtttgggttcagagaaaggggctgctgagataaaacagcaccccttcttcgaaggccttaattgggcgttaatacgttgcgctatcccaccagaactgccagacttgtgtgaatttggagtttcagagatgaccccacagtcccagggaaagggtgttaagtatgtagagtgcaatgcagcaggagagctagttgaatttgagttgttttga

SEQ ID NO: 27480 - DNA, 721 bp, Glycine max
  Peptide Sequence Number=SeqID_144258
agggctgcacgccctcaccttcagagggttgcacgccctcaccttcagaggactacacgtcctcgccttcagagggttgcatgccctcaccttcagaggactacacgtcctcgccatcagagggctacacgtcctcgccttcagaggactacacatccttgccatcagagggttgcacgccctcacctttagaggactacacgtcctcgccttcagagggtcatgtaccttcaccttcagaggactacacatcctcgccattagagagctgcacgccctcaccttcagaggactacacgtcctcgccatcagagggctgcacgccctcacccttagaggactacacgtcctcgccttcagagggtcatgtaccttcaccttcaaaggactacatgtcctcgcctttagagggctacacgccctcaccttcagaggactgcacgtcctcgccttcagagggctacacgtcctcaccttcataggactacacgcccttacctttagaggactagacttcctcgcctttagaggactacacatcctcgccttcagaggactacacgtcctcgccttcagaggactgcacgcccttgccgtcagaggactacacaccctccacttcagaggactacacgtcctcgccttcagagggctacacgttctcgctttcagagggctcaacatctgcaccttaagagaatttagggtcgtctgcccttaa

SEQ ID NO: 27481 - DNA, 281 bp, Glycine max
  Peptide Sequence Number=SeqID_144259
atggacttgcagttgaagcaatggagaaaccagcatgagtcagagcaagaacaagaacattattccccaaacatggcaaaatttctatctcaacaacaacacccaccaccatttccctctgcactccctctctttgtacctgaacaacccaacaccaaagtcagcaccttgtcagcattttctgattccacattaccctcttctcccagatttcccagaatggagagttgcttcagctttgcacaatggcaagagcttgagttgcaggctctgatattcag

SEQ ID NO: 27482 - DNA, 495 bp, Glycine max
  Peptide Sequence Number=SeqID_144260
atgatacttgaggagggggagaactttccagtatactccaggttctatcgctcgaagccagaaccgcaggaattggcagctcaattatgcatccctggaaggggattcgagttaaatgctgatggactgcctctaaagatcttacggaagaatctaactacacttgctcagacaaggagcattctttctctctctaacctggtccctacctctcacacctctaatatcacattagatagggccaggttgatttttggaatcattcagaagatggatatgaaactgggctatattatttcagctcaaatttctatgattgcccagcatgactcttttaggtttgtgtttctagccttaatcactgctctttgcaaagccaggggagtcatttctgattctttgacattggagagcctcggtccatctattaatgtggcttatgcgaagaaaaactactggaacctagatgacctctcagttactttcagagggtag

SEQ ID NO: 27483 - DNA, 243 bp, Glycine max
  Peptide Sequence Number=SeqID_144261
atgcataaaacgccattaacgaagacgcgaagcttaccccgacccttgacggtggaagcccaaagcgtagctgcaagtcctcagtgcctcaaatcaccaaatgcgacacggacggaggaagaagaagacattttcgcccattcacttacaatgctggatgcaccagcaatactgctgggtgcacctaacaacacccacaaaatcacgattcgtttgggcctcataggcttacctataagctaa

SEQ ID NO: 27484 - DNA, 204 bp, Glycine max
  Peptide Sequence Number=SeqID_144262
atgtctaaagaagttgatatggatgatcgaaatgaacaagaatgtagtgtgaatgaacaacatgttgattgtttggatgcgttcaatacttctcaggtgtttgatacccaagatgatgttttgcagtgtgctcgatcagttgctcatgaaaatggatttgttgcaatcattatgaggtctgacatacagactggtagtagatga

SEQ ID NO: 27485 - DNA, 966 bp, Glycine max
  Peptide Sequence Number=SeqID_144263
atggaagaaaagctacctcctgggttcaggttccatcccacagacgaagaactcatcacatattatttattaaggaaagtgtccgatattagcttcacatccaaagctgtagcagttgttgatttcaataaatctgaaccttgggacctcccaggtaaggcttcgatgggcgagaaggaatggtatttcttcagcttgaaagatcggaaatatccaactgggcttcgaaccaaccgagccactgaatcagggtattggaaaaccacaggaaaagacaaggaaatatttgggggtggagttttgatagggatgaagaaaaccttagtcttttatatgggaagagctccgaggggtgagaaaagtaactgggttatgcacgaatataggcttgaaaacaagcaaccctattcttccaaggaagaatgggtgatttgcagagtcttccaaaagagctcagcaccaaagaaaccacagcagacatcatcctcccaaccatctcaagagtctcctatctcaatggtcaatgaatttggtgatgtcgacctaccaaatcttaatagcattgcaaattcatccagtagcttcaccaacaatattgcatacaatggtgatcatcctagcaatgttaacaccaataatatgaatttgaccatgaattggccttcttcaactgagctggttccatctctcccatggccttctggattgctgaatcctaacctttctgtgaattcattgcttctcaaggcattgcaacttagaaatacttatcaacaaagagaaactacgaccagtactagtgatcatcactttgcaacatatgttcctcaaggattttctcatcataatattggaactgataaacatcacttccccccaaatctcagtgcttcttcttcttccaaagctttagaatcttgtgtgccgcagcaggagcaaccattcaatatggactccatttggtga

SEQ ID NO: 27486 - DNA, 411 bp, Glycine max
  Peptide Sequence Number=SeqID_144264
atggttagaattggagggttaggtcgtgctctaggtaaggttataggtaaagccttagggagagaggatcatcatgattcagatgatgatgctcctgatatgactgaggatgtacctgcacatggtgtagaagctgttgatggtgctgagggatttgttgttgatgatgctgagggattcctaggtgagccgcgtgacccatcaatgctaattgactattgtgaccatgttgcagaacgtcctgaattaaagttatcctcccatggaaggaaggttcataaatttgggaggcttgctccagaaattgaagggctagtcgctgtcacaggattatgtcctttgatcgcatgttcattagccactagcgatcaggaattaagtccttgccctccaatcattggtttcccatga

SEQ ID NO: 27487 - DNA, 372 bp, Glycine max
  Peptide Sequence Number=SeqID_144265
atgggaaaggggcaaggtgctttgaaaatgaacaaggaatctcatttgataaagaaatcatcatcagttaacgaggcacaccagaggccaccggtgataatctacacgcattctccgaagaagctcaccggactctatcgcgccgaccacgaccccgaggacgccgacgaggccgacttgaaaccgccgcggaaggaggagccgaaggcgaacgaagcggcgtcgccggaggaggtggagagtagttgctgcaactgcgtggctccgctgatccctgattacaacaacgccaataattatgcggtatttgaatccgatttcaataagcccttgctcaccttcgcgaatccctccttcttcttctcaggatga

SEQ ID NO: 27488 - DNA, 1335 bp, Glycine max
  Peptide Sequence Number=SeqID_144266
atgccgctatgtcccaaagaagaagcacttgttaaactcttctacaatgtctctagccctttccagcttctcttcctcattctcttctcctctgccgttttccttgtcaccttcttaaccttcacaggcagattccccttaatccaaagggatcaagaatatgaatatgtgtataccgaggatgaagaagaagaggaagaagaaactcaagaagggtattcttgtgttgattctactgacagattagaagtaacttgtggcaaggagactcgtgtgtttctgcacaatgaggggcatcagaggactcattcttattcggaagaattcataagccccgaggagagcttgaatgaagagtcagaagaaaagcattattctgaaacgttgtctctccataactcagcacaagtttctgacttcgaaaatgaagaagcggaaacggttcaagtagactttccagcaagagatcccgattctgcccaggttgaaagaaggaccacctctcccatcaacctcaccgcatacaaaagaaacaaaaaccgtgacgacgatcatgttagcgttgaaattattaaaaacaagaaggtgcaagagacaaaccttgcaagggatgagagattctttgtttttgcttctacccaattgcagagtaagaagttaatgattgaagagagggatgatgagtcctcgaaatggaagagctccatcattggcagggattctgatactgaagacgcattttcttcttcatcaagaagaagttgccccaagtgggaatcatacacattgttccaaaaatatgatgaagagatggcaatcctagacagaattagtgcacagaaacatcatgaaactgagtcattaaggtccatccaaatgtctccaagatcaatgtcagagcgtattgtgtacaagtttcaaaatgtaaataaaaagcccgctgaggttggtcacaacccatatcgtgaactagaggctgcatatgttgcacaaatttgtttaacatgggaagcccttagttggaactacaaaaattttcgttccaaacatgcctcacgccaggatcatgataccggttgttctgccaccgttgcacagcaattccagcaatttcaggttttgttacagagatacattgagaatgagccttatgagcatggcaggagacctgagatctttgctagaatgaggcttttggcaccaaacttgctcctagtgccagaatatcaagatttagaggaggatcagaaggatggtggttttcaatgcaaaatatcatcagcttcatttctaaagataatggaggacgggatcaagacattcatgattttctga

SEQ ID NO: 27489 - DNA, 2182 bp, Glycine max
  Peptide Sequence Number=SeqID_144267
aaagccatggtgaggtctaatgcaaacctagatgagaagtgggcagaacgtatttgggacccgcgttctgcgactgagggtgattcggaagaaaatccccgcgcagtatgcatctgcgtagtacctgaatcgttgcgttgcagcaagagggaagctttcattcctcagttcgtgggccttggtccataccataatttaagccctgacctcatcttgaccaaggaaaggaagttggccgcagccaagagggtcctcaaagacctcctctccgacagcatgaacctaatccaacaacgcatcatctcaaagtttggctcacatacccaaactttctaccacccagatttcaaatccacaaataatgatcataccctctcctttattgatgataccctctccttactacttgccgttgacggcttgttcttgttggctttcataaggcttctcaccagcagcagcagtacagctggcggcgaccttgatgatgcagagttctctaacttcctaactggaaaaatcaggatgctcctgtttaacgctgctggtgtagaactgaccaagaatgttcttatcagggaagttttcatgctcgagaaccaaattccctctctggtacttgagcagatcactggatcagctcagggtctgggactgggttcaaacgtggtgactttctgtaaaaaccactgtcctgttctcaacttagaagagctccccaacgtggactatgttcatttgctggatctaatgtaccatttgattgtacctagggctcagtctccgcctcagccccaagagcctgaagctcggcctgaagctccgctagaaactgagtccaatgatgacgaacctcagccagagcccgggattggacaatattttccatcaatctttggaggcggggaatgggaattaattatagtgccgctgatgtttatatgcgtcattccgtatattgttgtagcccttattcatctcatcattgtgaatccctttttgccggatcccaagcctgaacctcatcctgctgagcctgattccgagactgaacctcagtcagagccagaacttgagcccgagactgaacctcagcaagagccagaactggagcctgagactgaaactcagcaagacccagaactggagcctgagacccaacctcagtcagagccagaactggagcctgagactgaagctcagcaagagccagaacaggagcctgagactgaacctcagccagagcccgagagtgaattccagctcttcggatcttgggaaagctttggatatgttctggtggccgaagtgttccttccgggatattttatttatctcgttgcgaagctacttttatgggtgatatgttcattaatatatcgcccaattaaaagggtgttcagttatttatttggtttggtcaaaagagcatttcggcggagaaacttcaactctgcgttccgatggtctcatgaagctctaaagaacatgggaagtagggttaattatccattggtgggatccttaacacaagcggttgcaggtcttgaggagctcacacaagaacagcagtcaacagattgggacgagggtgctccactggctgaaaggattccacctgcgaagaaactccgcagtgctgggatctacttccaaccagctaaaagtggcgccatctcatctattgatttcgttgaagaaagttgcattttctacttgccatgtatcagaatgggtgtcaactcagaagtgataatcagaaacctcgtggcttacgagactttaattaaatctgacacccccttggtcttcacaaggtacattgagttgatgagagctattatagtcacttctgaggatgtgaagattttggtagatagccaaatcatcacaagcgagttaacgaatcaagccgtcgcggactttttcaatgggatgagcaactcgattaggcctaccaagactgaagtattggataaagtgatccacaaagttaaatccaagttcgacagtacgcggaaacgaaactgggctgttatcaagcatatgtctaagacattctttgcagttatggggggtcttttactcttggctttcacgggtctgcaaacttattgctccttctttggttgctctcgtacttcaaaacttggtcaactacctgaaaacggggaatattatg

SEQ ID NO: 27490 - DNA, 258 bp, Glycine max
  Peptide Sequence Number=SeqID_144268
atgaagaagaagagggtgaaggttaaggatcttaaccatgcagggaaatgcttgaggaagagaaagttaaaggtggaaaaggatatggatattttgatggcactcatagacctaaaagtggtgtcaagggttttaagaatgcatgacttaagtgaagagcagttgcactggtgtgaggagaagatgagcaaagtgagaatcatggaagggaaacttcaaagagattattccaccccacttttcttcccctcacattga

SEQ ID NO: 27491 - DNA, 657 bp, Glycine max
  Peptide Sequence Number=SeqID_144269
atgttgacaaaaggcagcatcagtcatcaccacgtgtgtgtggatcacattcacatcgcctttttctctctcactactcacaagacgacacatcactctggacacaatcccagatctcaatcatcaatcaatgttccacaagtgcggccttacatcactgcctctgcacccgcctccactgtagcacttctctctattcatatcctctcaccctgctacacccttttttctctcttctgtttcttcttcctcttctcctctcggggtgtcccctctcactctgtgactgtcgctggcagctcagcctttttgggttttcatctgctgaaaaataaagggcctgagaagaaggtgttccttgttaagatctgtggtttggttttcgggagggaacaagaaaaaaaggaaaagatgaatagctacagctactatgggtaccaagagaagaacaccttgacaagctgtgaggagacgaggatggaatcagtgatttgccccaaacctcgccgattgggtctcataaaccactcttccatcaacacagaagtcggaccctcgaggcaccccatcatcaggaaattctctgttcttttttctttttggtttttcaagcaaatcggttataaaaattatgacttttctgtatttgttcactaa

SEQ ID NO: 27492 - DNA, 351 bp, Glycine max
  Peptide Sequence Number=SeqID_144270
atggagaatctatcaaaattaggtcccatccttggctacactcatgacaattgctacatcacatctcccccaatctctgggcacgaaaacatgctcgtaagttcccttcttgatcgtgataataatgcatggaaaaaagatgtttttgatgttttattctcagaggaagatgcccagaaaattttgaagttgtctctgctcaacactttcgatgatgacaagttgatttggcacttatctcaaaataaaacgcttttggtgttggcatatgcattcgaaatgaacaaggagattttatcaaagcaaggaccaattatttccatggagtctctcgaaaccagtagaagctga

SEQ ID NO: 27493 - DNA, 1390 bp, Glycine max
  Peptide Sequence Number=SeqID_144271
atgatgagctctaacgcaaaccttgactcaacacaacacaacactgatgggaactgggtagtccatatttggcacacgctttcggcgactgaggctgatttggaaaattctcgcgtggtttgcgtctgcgaggtaccggaatcgttgcgttgcagcaagagggaagctttcatccctcagtttgtggggcttggtccataccatcatttccgtgctgacctcatcatgaccccgaaaaagaagttggccgcagccaagagggtcctcaaagacctcctcccttccgacatgaaccaattccaactacaaatctcaaacttaggctcagaagttacgactttctaccacccagatgtcaaatccacatataatgatcataccctctccttcctattaaccgttgatggcttgttcttgttggctttcataaccagcagtggccaccctgatgcagaattctctaacttcttaaccggaaacctcatgatgctcctttttaacgctgctgaatcaaatggtcatgagggtctgggctcaaacgtggtaaatttctgtaaacaacactgtccagtactagtcaaggtagaagtgttcgctaacaacactgttcatttgttggatctcatgtaccatttgattgtacctaggcctcagtctcctcctcagcccctcgagcctgaagaagctcagcaaaaccctgtgcctgaacctcagccagcaaccgaacccaatcacgaacctcagccagagcccgtgtttgtgaatttgtgtgagaacattggaagacaattctctggaagctggcaaagtcaaatacttacaatactagcggtgtttatattcgtgactccattcttaattgtggtagatcttgtttatctcattgtgatgaagccatttttgccggagcccgagcccgagccccagcccgagcccgagcctgaatctcaaccagagcccgagtcacagcccgagaccgatgaatttcggttcggatcctggaaagaccttggatatcttattgtgggcgaattaatccttccggcatattttatttatctcattctgaagctattttggtgggtgataagttcaataattcgaacaattataagggcgctgagttatttatttggtttggttaaaaaggcatttcggcggagtagctttaactctgcgtttggatggttacatgatgctctatccaacatggaaggtagggttaataatccattactgagacccttgacagaagcgttggcacatcttaaggagatgacagaagagcggcagacaagagattcggacgagggtgctccactagctgatcaaaggattccatccgcaatgcaactccacaatgctgggatcttcttcaaaccaattgaaa

SEQ ID NO: 27494 - DNA, 1760 bp, Glycine max
  Peptide Sequence Number=SeqID_144272
tcctttggtccttcaatacaggctgagaagatcagagaggaagaaaaggaggcagatgagaaagaaatcatcaggttgatgaaagagcaggaggacaaaaatttggaaatttcatcattggaacaaaagtctcaagaatatgagcatcgattggacgaattaagaaataagattaaggagcttgaggtttcttctgattcaaaagatcagaagtggaacatgaaaatgaaccaaatgcagactgttataaactttcaattgagttccctacagaaattggaattatcttgggaatgcattaagcaaaatgttatgaaagagcaaacggtttatgcagaggattgtgatcggttaggtgtttatcttaaaccgctgttacatgcagctgagaactaccatactcttcttgctgaaaataaaaaaatgtttaatgagattcaagaattaaaaggcaaaaaggaaaaacaatctattgttaaactcattggtgaaaatgatttggttgtggcaaatccatccaaagaaggaaaagatgctcttcgatcatttaaatttaacaaggttttcggctctgccacaacccaagcggaggtatactctgacattcaatcctttataagatcagttctagatgggtataatgtgtgtatatttgcttatggccaaactggttcagggaaaacttatacaatgactggtccaaatggggcaacaagcgagactattggtgttaattatcgagctctaaatgacctcttcaagattgccacaagtagagaaagcctcatagactacgagattggagttcaaatggttgagatatataatgagcaaggcttagcagtaccagatgctagcttgtttcctgtgaaatcgccttcagatgtaattaagctaatggacattggacttaaaaatagagccattggtgcaactgctatgaatgaaagaagtagccgttctcacagtgttgtctcaattcatattcgtgggaaggacttgaagactggttctactatggttggtaatcttcatttggtagatttggcaggaagtgaaagggtagatcggtctgaagtaactggggataggcttaaggaagcacaacatataaacagatcactatctgcccttggagatgttatttttgccctttctcaaaaaagcccccatgtaccatacagaaacagcaaacttactcaacttctacaaacttctcttggtgaccaagcgaagacactcatgtttgttcaaattaattcagacgtaagttcatattctgaaacactgagcactttaaagtttgctgaaagggtttctggagttgaattaggagctgcacgaagtagcaaagagagcaaagatgtgagagaattaatggaacaggtgtcttctttgaagaacgctatttttgcaaaagaggaggagattgagaggcttcaattactcaaaggttcagttggtagcattgttaagcgaaaccaaatttcacgaagtagaagtattaagcactatgaagcttttaaccagcaaccgatggatgaccatatacaccaaaatgaatttctccatcaatctgaacttcatgggggaaatataggaaagaatattgctgcaattgcagaaacttcaagatttacagattctgattttgatgaaaaatcaagtgatctttctgacagtgctgttgctccaggcacagaaactgacggttcagaaaattctagtctcaccgaacgcacaacatcatcagataagag

SEQ ID NO: 27495 - DNA, 450 bp, Glycine max
  Peptide Sequence Number=SeqID_144273
atgaccatagacaaggagtatatgttagataaactgccaacaattactttctcgatgaaggatgtggaaggaatcaaacctcatgatgacaacccaatagtaatcacagttgtgacaattgggttcaatgttaagaaggaggccccaactagcggacaacttgaaaggagtaatcattggaggaagcctagagcaaaaaccaagattggtcaatcgttgccacttattatggaggaagaactaatcagatatttggacaacaagagaagaacaacaaaagaagaatttgggaaactcctagctgcaaatttcattagagaggtcgagtattcgacttggttggaaaatgtcatcatggtgaagaacagcaacaacaagtggcacatatgcatagactatacaaacttaaacaatgccttccctaaggatccatactgttgcccaggatag

SEQ ID NO: 27496 - DNA, 207 bp, Glycine max
  Peptide Sequence Number=SeqID_144274
atggagaagagaagtagaagaaagacacctatctgccgtgacagaggcttaagaaagggaggaatccctgagacaacaactggaggaacttcctatggcagggataacactatgaactgcaagatcttcctagacacattgagaaggatgactataaaatggttctcaagcctcttgcgagatccatttctaactttcaggagttag

SEQ ID NO: 27497 - DNA, 783 bp, Glycine max
  Peptide Sequence Number=SeqID_144275
cgctgttcatgtgtcctccaccatcgagtctggagccccgcaaatttattgcctagcgctgttcgccaattctccattctccacttttatccagagccccatgaatttattgccaagcgctgttcatgcatcttccacccacgagtctggagccctccctgcaaatttattgcctcgcgttgttcgccatttctccattctcaatcttattcggagacccatgaattcattgcctagcgctgtccatgtgtcctccaccaatgagtctgaagccccacgaattcattgcctagcgctgttcgccaattctccattctccactcttattcggagacccatgaattcattgcctagcgttgttcatgtgtcatccaccatcgagtctggagccccgcgaattcattgcctagcgctgttcgccaattctccattctcaatctttcggagacccatgaattcattgcctagcgctgttcatgtgtcctccgttatcaagcgcagagcctccgaaagaagaaggactgacgagagtcgttatagactaatcacgaaaagggcaggacggacgaaatcagtgtcttatctttgctttcctcttatctccgatgagagatacttggcaccctttgttgcacaatatgtgaagtcccgagacgtgccggaaatcaaaaggaagcaggcttacgcgatccgtgaaattccgcccacttgggccttccagtttcttcctccagaaggcggttgcttctggaggaagcaaccttgctcgcctgggcgagctgg

SEQ ID NO: 27498 - DNA, 464 bp, Glycine max
  Peptide Sequence Number=SeqID_144276
tgtgtttggtgagcacatggtcatggggtgcagcatgctccacgtcgtcccatcttgtcacagcacgagtcatgccatgcctatgtatgttatgtatgtctctgggttcggtgtgaggcgaatgcaaagcaaaggatcaaaacctcagagcgcactctcccaccaccacaccgaccccaacctccaccgccaccgccctcgaccccttccacgtcatctcctcctccctctcccacttctaccccctcgccatgggcgggactctcttcttcaattcgggaccgtgcgaggttgctgggccccagggaagtttctgcgtttggaaaaaggggttttgccgtaccaacagagtgttggtggggtcgctagagagtactttcgcgtgaaggatgagtgcttggacaacttcaagagcttcttgttggaccaatctggcttgaacttcaccgtttttgaggctcttg

SEQ ID NO: 27499 - DNA, 860 bp, Glycine max
  Peptide Sequence Number=SeqID_144277
gatcccactgtcatccagaggcggcgggcccgatgacaagcagagaccaagtttggtcattctgcacccatgatacgcggagataccttatggttattcgcacccttttgtcatccagaggcggcgggcccgatgacaagcagagaccaaagaccaagtttggtcattctgcacccatgatacgcggagataccttatggttattcgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaaagaccaagtttggtcattctgcacccatgatacgcggagataccttatggttattcgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaaagactgacatagtcttctgcaccttttgttcctccgggaacaacaagtcatttacatgtggaaatttcatggtcgcccgcgactctcgtcaaccgagaggagcgaaattagtgtcatacactgattttcggggacctttgcttgatgacatgcgaccattctttggtccttgtgaggagcgacaagtcatggtcacccacgactctcgtcaaccgagaggagcgagattagtgtcatacactgattttcggggacctttgcttgatgacaagcgaccattctttggtccttgtgag

SEQ ID NO: 27500 - DNA, 1055 bp, Glycine max
  Peptide Sequence Number=SeqID_144278
atggatcaagaagatgaaaccctaaaatgtaaaagaattggtagtgattatagtagaagacctattggaagaccatgcaaaatgccatatccaaaattggtgccacaaagaggacttggagtggcacaacttgaaaaacttagacttgaacaagaacaaaaggagaagacagctgtaatagctgcaattgcatcatcatccaattctgatatcccttatgataagcatccttcaagctctgtttcaattgcaaacagtcgtggatataatgctggctggcatggcgctctagttttggggcatgcaactgggccccagttgcgggatccccatgatttggaatttgggaagaagaacattgggatgaatcctcgattgacttttgcatcaactttgccttgtgagtccaatactatcatgcccttcccgaattgggtgcagcaaacacaacaacaccaacaacatcctttctcatcaacggtgggtgtctcctcaaggacttcatcaacaattgtgcctcattcctcagtagagccctattcaaacaaccaaacctatgtttctaagaggctagataagataatagggattaaaagaccaaacccattctccgtgaagaaaacacctctgtcctcatccaatttaaagccttttgagtcgaaccctattaggcccttccataattggatgcacagaacacaacaacatccttcttcatcaatgatgatatggactaaacgaccaaatgccttctcccttgatattccacctgtgtcctcttccaaatttaaacctctcagtttccctaatcctcctgtgtcctcttccaattttaaacctctcactttccttgatcctatgaaagcaagtgaatccatttcatgcagcagtggaagaagattcaacttggattttggcaattcaacgataagggaaattccttctctttcagcgtccaactcagagctgatctcaaagaaaaataaaaaaggaaagaagaatattggtggagattttcacacagtggatcctcctactcgatgctcatgttccaa

SEQ ID NO: 27501 - DNA, 1332 bp, Glycine max
  Peptide Sequence Number=SeqID_144279
atgaattccccgcctgatgacaacaattcagaacctagagagttgggcagcccggatgctagttccaatgaaattgagaattttctatccttatatggtgaggtggaagccaaacatcgattgcttttggttcagtggttaactagtcttgtcccctcattgaaccttccaataaatgtcacggatggtgaattaagagcatgcttgagcaatggtacagttttgtgccagatactgaacaagctacgacatggtaccgtgaatgtggttagtgaacctgataattttctgccatcacaatcagaaaatgttaaatcgtttctgaaagctttggacggaatgggattgccccggtttgaaatatccgacctagagaaggggtctatgaaggctgttgtggattgtcttttaacacttagagagaaaagtttgcagaatgctttgggagataatatttctgtaactaattccaacacggtgagccctcatgggaatgcaccattcaattttcattgttctccaacatttggtggagagcagaggaagattgcagctgggtcgatgttgcaacgtgttaatagtacccctattattatggcagaaccatcagtttcattaatacaccatgttggtcataagtttcatgaggagtttcaactgaaacctgggagttacgcagatcttcctgctgcaaaaatatcagaaatgatgaaatcaaacagtatagataatgctcccactcagtctcttctgagtgttgtgaatggtattcttgaagaaagtgttgaaagaagaaatggggaaatacctcatcgtgtggcatgcttgttgaaaaaggttacccaagagattgagcggcgcatgtcaactcaagcagaacatttgcgaactcaaaacaatcttttcaaggctcgggaagaaaaataccaatcgagaataagagtacttgaggcacttgcatctggaactagagatgagagtgagatatgttctagccaggttcagcagtttaagggtgagatgatcaaagagaaagaaaagaaggtagatgagaatgaagttgttaggttgataaaagagcaggaggacaaaaatttggaaatttcagctttgaaggtagaactggaaacagccaaaagaacatgtgaagtacaattctcacagttggaagaagaagccaacggttttaaagcaacattgacacggaaggtccaagaatatgagcatcaattggaagaattaagaaatgaggtaacggtttcttattttgcacaaaaagcaatatattggtacaccatgagagacaggacaagaccaagaggttttagttaa

SEQ ID NO: 27502 - DNA, 186 bp, Glycine max
  Peptide Sequence Number=SeqID_144280
atgaatcctagtacgggaacttggtttatggaggttgtgaaccctcctttaggcatgcatcagttgatcctacctcatgtcatgggtttaccttttataagggtggttcaaaatgacccttttggtcttgcggtgccttggtggtttggattggctccttgtggccctattgtttctgggttctaa

SEQ ID NO: 27503 - DNA, 666 bp, Glycine max
  Peptide Sequence Number=SeqID_144281
atggataacattatatttgtgtacgtcacgtatgagcaattcctcccgtacagtgttcgtaactatatcataaagtacgtacgcaagttaacaagccatgtgcactcttacatccatgtatccttccctgaattcacaggggaacaagtcctcgagagaaagagaagccaagcctacattgccatccgaacccacctcagtgtaaactcagcccaaagagccggcaggctcaaagccgaagtggtgacggatagccaaaccctagtagtcctcggcattgacgacaatgaagaaaacacgttccaaggacttacagtgtggtggagtgcaaatcataaatcctcgaatccctccaaagagaataggttcttaaaactgaccttccacaagcgttattggcgcttacatccaacatgtcttcaaagaaggcagggccattgcgtttcaggacaggacgccaaagctgtacaccgacaactccagcagtggttgaatctcatgcctaagtcaattgctcaagactctgagacttgcttgaagagtctgattgagtccattgaggagaccaagaagaagctgctgacacaagatgaagtaaaaaaggccaataaggatgagaaagcacacttgaaggaagaacgagaaaaggaaccgttagctaaatag

SEQ ID NO: 27504 - DNA, 571 bp, Glycine max
  Peptide Sequence Number=SeqID_144282
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatgggccccgtgctaagtttcggattggttggccccctcctcccccccgggagggacgaatcaaagcgacaagggctgaatctcagtggatcgtggcagcaatgccactctgccacttacaataccccgtcgcgtatttaagtcgtctgcaaaggattctacccgccgctcgatgggaattgcgcttcaatgcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacg

SEQ ID NO: 27505 - DNA, 402 bp, Glycine max
  Peptide Sequence Number=SeqID_144283
atgcagagacacccgacggttatctgcaagctcacttttgttaccgtgacacaagagtttggcggcatgtggagacacctgatggttatccgcacacacgctttttgctatcctgtgacccgagagtccagtggcatgcggagacacccgatggttatccgcacacacacttttgttaccgcggatctacaaagcggtaatccgtacaacacaacatctgttggcactgacccttacatcatgcagcaggcagatctacccgacgtcatgcaacaggcagatctacccagtggtaatccgtacaacacaacatctgctggcactgaccctcgagtcatgcagcaggtggatctacccagcggtaatccatacaacacaacatctgttggcactaacccttaa

SEQ ID NO: 27506 - DNA, 297 bp, Glycine max
  Peptide Sequence Number=SeqID_144284
atggaaaatggtgggttacacaccttcaagctttgcagatttggccttcgccggcgaaaggatcaaagtgggtctgaaaagaggcaaaatgcgaaaactagggcaaatgaagaggatgagggagaaacccttgctgtgactaccattcctacacggccaaatttcccatcagcccaacaatgtcattacttagccaatagtagtccctctcacccaatcatccataaaagccatccccaaaacagccacaaggcctgcttgcttaccacacgcctaatgcctaaacaccgcctttag

SEQ ID NO: 27507 - DNA, 712 bp, Glycine max
  Peptide Sequence Number=SeqID_144285
gtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgagtttaggaggtgacatgtttggtggttctcctatactagtcatttgtctgttgtcaggagagctgtatcgagaatcatcggtgagtggcttgtgctatgttgcgtgtcaatatgttcatgcagtcatgcctatgccagaaatgcactcaagtgaccgggttgtcgaccagggatggctggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaggctgcaccg

SEQ ID NO: 27508 - DNA, 597 bp, Glycine max
  Peptide Sequence Number=SeqID_144286
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacggggcccttcggggcctcttccccgggcgtcgaacagtcaactcagaactggtacggacaaggggaaatccgactgtttaattaaaacaaagcattgcgatggtccctgcgggatgttgacgcaatgtgatttctggcccagtgctctgaatgtcaaaggtgaagaaattcaacccaagcgcgggtaa

SEQ ID NO: 27509 - DNA, 297 bp, Glycine max
  Peptide Sequence Number=SeqID_144287
actcatcttctccttgaagtggcgtctcatctctctcttcctttctccattacactgccattcatcttacaagaagcaaaggaatccattgatgaagaagatcctaggcctacaagctccaatgcagcttccatcacactctttgtagccactctgttgtgcacttcctctcaatgtgacctctcattaatgcctgcaatggtaatgaactacattgatgataaagcacccgtgaaaggtcttagatatgaggcaaatgccaaggcagagaatcaagaagctaagactaggacataa

SEQ ID NO: 27510 - DNA, 219 bp, Glycine max
  Peptide Sequence Number=SeqID_144288
atgtgcctttactcgatgccactgttgctgccttctatggcaccggatccaaggaacagacgtagcttcaagtcaggcatattttgtagaacgcttaaagccttaataccaagttcttttccttgcagttgcagtgtattactcatggctactgctgctactacttacctcacaatactaatatgtttcacatgccatagaccccttaatgggatttaa

SEQ ID NO: 27511 - DNA, 276 bp, Glycine max
  Peptide Sequence Number=SeqID_144289
atggggtgtatcgctagcaggaatggcggcttggaaggctgtattgccagcagggtcagcgagtcccacgtggaggtgtgttgccaatgcaaaaggcgacactctcctctcttctctcctacctgtaacgtcactggcactggcagtgatgggttcatctttgtcgtcagtgactatggcgggttaagctctctcgccagtgactataacagattccactcacataacaaatctcctccgttaatacttttaaaacagaccacaatccataaatag

SEQ ID NO: 27512 - DNA, 603 bp, Glycine max
  Peptide Sequence Number=SeqID_144290
atggcttctagcagtgcctctggccttaaggatctcttaagccctcaagcagactcaaactcaatggctatcaccaaaccaataatgaaaccattccaaaagcttgaggaggtttctcttggaagcaatgcctctttgtcaaccttaattagccccccatcatctccatctttgcaattctcattgtctattgcttccaatatagatatgcctttgaaccatgagggaaattaccttggggaaaaaaaggaaaagcttgaaataagaaaggacaatgatgagagaaaacttgggaaggagcttgagattataaggatggactgtgagagctaccttgagataaaggttgggaagaaggaaatgaaagacaacaagaacaatgaatttactcctggaaaatgttttcctccaccaatttcttgcctcaaaaaggttaaggttggcaagcccttcaagtatctagcatatgataaggaaagtgaaacctatgttgttgaagagataaaaattcctgaagggagtcttttccatgctactagggaggaagagaggttgaagttgtttgccgattttctagatgaggaagagtcacaagagaagtag

SEQ ID NO: 27513 - DNA, 390 bp, Glycine max
  Peptide Sequence Number=SeqID_144291
atgcgatatatggagcataatgaggttttaaaaatgctctcctccgtcagctggatcgcagcggcgaagatccctcttccaaggcccatcacatcggtctatcctcgtaaaaccctaaccgcactctccctcctctcttccccaatggaggtcgaagtcaagatgcgtctcgccaacgcccaccgctatgtcaccactctactctcgctctttcatgtcatcatccaccgccagcagaacctcttcttcaatggcaccgcctcagagctctccgtgcgtcgcattgtcctctgcctccgcttctacggctacgacgagtgctgcgtcgcttcgttgaaggcgcgagcggtgctagtggacggcgtgagaaagagagaaaaacaaggataa

SEQ ID NO: 27514 - DNA, 354 bp, Glycine max
  Peptide Sequence Number=SeqID_144292
atgctccaaccacatggtatcaacataagcttaaaggagcactcaaaccgaatgtttttacccccaaggcctagactccgaagaatccatgaaggcctcaccttcttgattcagtgccacgtgtgttgctattgcagcaaattagtcccaaacgacgttgtgtattgctgttgcaacattctttcagtctcttcttcttctcatacattcaaaggtggagtagttgaagctgctggtggggagggagctagcaattgcaatggcaactcgaacgctgcagcattcaaaggtggatcagttgaagacgcggttgcagcattctttcagtctcttcttcttctcatccatttttaa

SEQ ID NO: 27515 - DNA, 1062 bp, Glycine max
  Peptide Sequence Number=SeqID_144293
gctgagttggagaggcgtaatttccataaacgcctcaccaatttagtcgatggatgcatagacctagctttcgtgaaagaattctatgcaaatttttacagttatgaggatcatccaccaaagcattccagagtcagaggtcatttggtgaagattcatgctgacagtctcaacaaattcttggagacacctgtggtattagctgagggggagaccttactcgcttactctagatattgcaggttgcctacagactgcagagagatagtggttgccttatgcatacctggcctagggttcatcttgaactcagagggccatcctgggaagattttcaggaaggatctaactacactagctcaggtgtggagtgtcctctcatactccaacttagcccccacatcacacacttctgacttgacaatgcatagagctaggctgatatttggcctagtctctcgcttggatatgaacataggagcgctgatctctggccagatgacctttatagtccagtctaacacttctagacttgggttccctgctttaatcaccgcattatgtagagccagaggacttctctctgatagcatcacttttgagcgcctgagcccggtcattaacttggtctatatcaggaaaaactgttggaaccctgatgatctgatagttactatcagaagggccaggagagcgaggacaaggccagttgaggccctttccacatctgcagctccccctccagcatgtaccctagcagctccttctgccccagctcctgcagattttcagtgtcttgaagccatgcttcaaagcatccatcaggggcaaattatcttattacaaagtttacagatagtggcaccaccagactctattccttcagtagagcagtttaatgagtgggtagcctggcccgaaactcagtcttctcttcacaaggaagatgaaggtcccacagcccaggtaccacagcagattgaggatgagtcatctgagactaccacttgtcataccctaatttcgtccggggattataatttgatgatatacaaccattga

SEQ ID NO: 27516 - DNA, 297 bp, Glycine max
  Peptide Sequence Number=SeqID_144294
atggcatctaagaagaggaaagctccatctacacctatccagaccagatttgataggtccagattcacatccctagaggcttgggagagatacactaacattgtggtgcttagaaagctactaccagagaggaatgtggtagtctattacacagagtttgatgagttcaaggaggaactcgagagacgccattgggatgagaagctgactggtttctctgatagtagcatagacatcgatattgtgaaggagttttatgccaacctctatgaccccgagtataaatcacctaagcag

SEQ ID NO: 27517 - DNA, 186 bp, Glycine max
  Peptide Sequence Number=SeqID_144295
atgggctcagaaatctgccctgaggttcatgagaaccctagggccttctttagccactctagcctaatcctcttgaagtcttctatccaatacccttggggggtaagattgcatcagtacccatcaagttacctccatcacgtcttcccaggtcaaggtgaaaaaggagattttgtgaagtgctga

SEQ ID NO: 27518 - DNA, 252 bp, Glycine max
  Peptide Sequence Number=SeqID_144296
atggagacttgcactaggcaatcactgtggaggatgcatgaacgaaaattaattcatggggctccgaataaaagtggagaatggagaattgcactaggcaatcacttcgcgtggctccagactcattgggggagtatgcatgaacggcaatcaattcatggggctccgaataaaaatggagaatggagaatggagaattgcactaggcaatcacttcgcgtggctccagactcattggtggaggatgcatga

SEQ ID NO: 27519 - DNA, 246 bp, Glycine max
  Peptide Sequence Number=SeqID_144297
atgtctatttttgtggaacgctggcataaggaaactagtggtttccatttgctcgtcggagaagggcgttccaaaacttcgagtaacttcatgttgacgacgttgtcgatatgttggtggaattactcgaggtcagtgttgcaaaggcaagagctgagacgattcaatgtcatggctcttatgttcggctatcgtggctatgctacgtgtatcagacaaaaatcaagacatgtcactggattatag

SEQ ID NO: 27520 - DNA, 1340 bp, Glycine max
  Peptide Sequence Number=SeqID_144298
cagcagcaggcgcaaaagcaggtgcgtgcgatagagctgatgttaaaagggcttatccagcaggcctggcccgatccggtgcgcctcaacaaccatctcaagacgctgtttaatgctgaccgcgtcagacgctggctgaaactgggtgagatcaacgatgtcctgagcggcatgatgttcagtgaactggcgcagatgctggtggataaaaaagagttcagccgctactacgcctcactgtttaacgaccccgccatgcttacgcttctggtggagccgcgaaaaaccctacaaactttcctcgacgacattcggcaaatccgcaaccatctcaccgtacagaaagcgttaagttcggcgcaaattcagctgctggatagctactacacgcagatctcgcggccggttcagcgggcgtttgaggaggggagaacccgcgtcaatccggccggattcatggcggtggatgccagcgaattacatacgttctgggaaaaggcgcagaaaatggatcgggtcacgggcggggatctgtttgaagtccgagacaccattgaaaagccgacgcagcgcgcgccgcgtaccccggaacaacgcgaacagctcatttccggtgtgttatggggggcggttggcgtcatggtgattgccattgtggcggggggcttctggctggtgaccagcagcaaaccacaacctgccgtcgccaaagccgcagaggcggcaccgccacaggaaatgcgcgagaccccttcctcgcgtgaaacactcacgcggatgggcgtcacctgggacgagaataatttccgttcggccatcaaccgcaacgatacccgcgtggcgcagctctttttgcagggcggaatggactggaagctctcctggaccgaagaggcgatgtcggcaggttatgacgacgtgctggaggtgatgttgcgctaccggcagaacatggtggaagagaagccgtgtcgtcgctttattaacacgctcagccacgccatggcgaacggcgagtcgctgacttccgtaaggaaagagtacctgaaagcgttctgcaccgtgcctgcggtggtgaaacgccagcagcacgatctcgacatggcgacgcgccgggcccagtcgcagccggatgccagcaacaaaaaatggcagtccatccagacggccatttatgagggatgcaggctcatgcccgacccgatagcctggaggaataagctgagggtaccgcgaagcggcgatttaccgccgggagcccgggtcgccagggcggtggcgattgagccgccctggcacgttcactggtcatgccgttacagagtagcaaggaacataaa

SEQ ID NO: 27521 - DNA, 693 bp, Glycine max
  Peptide Sequence Number=SeqID_144299
atgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatggtacacaactgtcattgtttacacatcatatgtggattggtggatttctcatagtcggtgctgctgcgcatgcagctatttttatggctttcacagttttggtttgtatattcataatgataccatga

SEQ ID NO: 27522 - DNA, 561 bp, Glycine max
  Peptide Sequence Number=SeqID_144300
atgggagatcgcttaaaggatatgattcgtgaccttggacaagagtcttttcagcaagcacatgctcctatgtatgatacattgcaaactgattcaaagaagcctttgtatccagggccagatatggatggagtgacaaaagctttagttcactacttcaatatcaaaagattcatgcttgcctcaatgattgcatactgtacatacatgaatttcaagaaatgccctaggtgtggggtatcacggtacaaagtgaaggatgatgacgagtgtagtagtgatgaaaactcaaagaagggccccccatcgaaggtcttgtggtatcttcggtatcctcccatcattccaaggtttaagcgtttgtttgctaatggagacgacgcaaaagaccttacatggcatgcaaatgggagaaattacgatggaatgctccgtcatccggctaattcctccttggtattgcatgaagtgaaaatacatgatattgtgtatgatggtatcgggcccaagacagccaggaaagacatcgatgtttatctcagtcccttgattgaagactga

SEQ ID NO: 27523 - DNA, 423 bp, Glycine max
  Peptide Sequence Number=SeqID_144301
atgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaa

SEQ ID NO: 27524 - DNA, 210 bp, Glycine max
  Peptide Sequence Number=SeqID_144302
atgacggtgtcctcaccaccgacgttgacatactaccaaacaacgtcggtgccactgacgttgtattcttgcattacaaagacaggtcctaggatgaccgatgttgttgttgtcgacatacaacgacatctggaacaaagacggtgtggggcccgtcgtagataccggttttcaaccgatgtagaagcttctttttgtagttgtgaataa

SEQ ID NO: 27525 - DNA, 309 bp, Glycine max
  Peptide Sequence Number=SeqID_144303
atgccggaaatacatccggcaaaacaaaaacttctagaaatctttgaccaacttcgactttctcaatcttcttccaagagtccaaagcaagcatcaaagcttaaccatcaagcaaaattagcaacaaggccatttgataaaagctcaaaacatcaatctagaaaactatcaaagtttaaccaccaagtagaaactatacctcaaagtttaaccacttggcagaagcaacgaggcttaaccatcaagagtagaagcaaaacaacgattcaatgcttaaccattcatggcaaaagcttaaacaatgcttaa

SEQ ID NO: 27526 - DNA, 309 bp, Glycine max
  Peptide Sequence Number=SeqID_144304
atgcatcaatacaaccttggcagtgatgaagaggagaaaggaggggagatagtggtctccaaggttttctaccaaacacagcctagacaatgtggttccctcatgaaagattcatcagctcctcctgggaaacatatgaagggtcaaagtgtgcatgctgaggtaatgaataataacaaaaacaacaacaataatgggtatgttgaatactaccattcttcaaatttcatatcttttgatcaaggagggcaaaatgctcgagtaatttctcattttcctgtccatgaaggtgctcctttcattccttga

SEQ ID NO: 27527 - DNA, 264 bp, Glycine max
  Peptide Sequence Number=SeqID_144305
atgaatgtgttgagtggtgcaaccctctattgtaaaatcacccatccatccaacatcttcatgattcacttacatatggaatcattaggtagcgatcaaggggttcccacaaaccctaagagaataaaggtcattcttgagtggcccactccaccaagtgttgagggaagaagcccagagtttcaagaagctctagatttgatgataaatccttttcaaggggaaggggatgatgcaatcctaccccctaagggcactagatag

SEQ ID NO: 27528 - DNA, 168 bp, Glycine max
  Peptide Sequence Number=SeqID_144306
atgactctcagctcatcagttgggcttagcgcgatagaagaatctgatagagcatcaacatcaagaccgcgcgctaagcgtgagatcaatgcgctaagcgcaacggttgtcttcaatgaggctcagcgcatgactggcgctaagctcaaatccacttattcgcgctaa

SEQ ID NO: 27529 - DNA, 228 bp, Glycine max
  Peptide Sequence Number=SeqID_144307
atggccgccataaattttgctaaggaattggctctgatcttgatgatcacaatgattgtcatgttagttttggagccacagcctgtggagtgtgcatttgctgtcccactcaatccctgcacacttcctgagtgcattgctcaatgcaagaaaattctgcacgcaaaatttatgagtgcatcttgcacaactggctctcagggaaacctttgcatttgcttaggttga

SEQ ID NO: 27530 - DNA, 313 bp, Glycine max
  Peptide Sequence Number=SeqID_144308
atgatgatgatgatgttagtggtagttgcaatgactgtgatgattgacaacagtgatgatgatagtaatgttagtggtggggtggtggtagcggtgttggtggtggcaacaagtagtgacagtgtggtgaaagtgacacaggtggtactattagtagtggcagcaatatcggtggtgatggtgatgtcggtggcgacgatggtgacaatgatggtggtgacaccaagtggtaatggcagtggttgtgacgacattggtggtgattttagtggcaatgatgaaggtggtggtgatggttgcatcgatattggtg

SEQ ID NO: 27531 - DNA, 1650 bp, Glycine max
  Peptide Sequence Number=SeqID_144309
atggcctccgaagccctagaagataacaagcctcccctccaggacgacaatcacgccaaatcggagattcccgagaaagacgcttcctcggacgccgtcgcggcgaaatccgagaacgcgaatgccggcgataaagacggaggagcagctggcaatcaggaagtagaagaggaagccgacgccgctgaggagaagaaagaagagatcgacgaagacggagaggagaaagatgaacaagaagaaaaagaggaggaagacgaagcggaagagaaagagaaagagaaggcgaagggtaagggtaagaggaggaggagtaagaaggatccggttacgccggcgccgagtgagaggcccacgagggagaggaaaacggtggagcgcttctctgtgccctctccggcgaagtctgcaaggtcctccgctagtaaaggtttaataattgaaaagggacgtggcacgcagctcaaggatatcccaaacgtggctttcaagttgtcaaagagaaaacctgatgacaacctgcatatgcttcatactttactgtttggaaagaaaacaaaggcacacaatttaaagagaaatataggccagttttctggttatgtgtggactgaaaatgaggacaaacagagggccaagataaaggagaagattgacaaatttgtcaaagaaaagttgttggacttctgtgatgttcttaatattcaagtaaacaagaccaatgtgaagaaggaggagctatctgcaaagttgttggaatatttggagtccccacatgctacaactgatattctacttgctgataaagagcagaaaggtaaaaagagaaccagaaagtcattccctagcaaatctcctggggaagcatctacagagacacctgccaagaagcaaaaacaaacttcccaatctgggaaaaagcaaaagcagtcttctgatgatgatgaggatgataaagctgaactttcagatgcaaaaggtgtttctcaggaagatgaagatgttgcagtaccgaacaatgaaagtgatgatgaggaaagtagatcagaggaagaggaagagaaatcaaagtctcgcaagcgtacttccaaaaaagctgttaaagagagttcagttagcaaagctgatagaacctcatctgtcaagaagacccctgtgaaagatgccaagagcattgaaaaaactaaaaagaaaccaacttcaaaaaagggtgttgctgagcatgacagtgcttctgcctctgtttccaagtcgaagcaacctgcatccaagaaacagaaaactgcaagtgaaaagcaggacactaaggggaaggctgcaagcaaaaaacgaactgacaaatcttcaaaggctttggttaaggatcaagggaaaagtaaaagtaataagaaggccaaggcagaacctactaagcaggacatgcatgctgtagttgttgatattctgaaggaagtagatttcaatactgcaactttgtccgatatcctcaggcaacttggtacccactttggtatggatttaatgcatagaaaagcagaggtgaaggatataattacagatgtaattaataacatgtctgatgaagaagaggctgagaatgatggtgacacagataaagatgatgatggtgatgatgatgatgatgcatga

SEQ ID NO: 27532 - DNA, 1365 bp, Glycine max
  Peptide Sequence Number=SeqID_144310
atgaaagaaatgagagatgtatatatattggggttgttggaaggttcttacgtgatggcaattgcaggcatgtctagcattgaacttaacgtaaagcagcaaggagaaccaacccgggttcagcctgcacaggaaacagaaaagggactctacttcctttcaaacctagaccagaacattgctgttccagtgcgcacggtttattgcttcaaatccggttctagaggaaacgaggatgctgcacaagttatcaaggaagccttgtcgaaaattcttgtcccttattaccccatggctggcacgttgatgataagcttggaagggaagttaatagtggataaccctggggagggtgcggtgttcgttgaggctgaagcagattgtgacattgaagagattggggacttgacaaagcctgaccctgatgctcttgggaaactggtgtacaatgttcctggtgctcgaagcattcttgagatgcctcttatgactgttcaggtgacaaagttcaaatgcggaggatttacattggggctatgcatgatccactgcatgaaagatggactatgtgccatggagttcgtgaatgcatggagcgagacagcccgaggtttggacttgaagaccccaccatttctcgatcgaaccataatcaaagcacgcgaccctcccaagatagagttccaacacaacgaattcgcccaaatagaagacatatcaaacactaaaaaactctacgaggaagaaaacatgctctacagatccttctgcttcgattctgagaagctcgacatgctcaagaaaaaggccacggaagatggggttctggaaaagtgctccacttttgaagcactctcaggttttgtatggagagctcgaactgcagcattaagaatgcaacctgatcaacaaacaaagcttttgttcgcggtagatggaaggtcaagatttgtgccaccaataccaaaagggtactttgggaatgctattgtgctgacaaattcgttgtgtaatgctggggagttattgaagaaccctttatcattttctgtgggattgattcgtgaggctattgagatggtcacggatagttacatgagatctgccattgactattttgaagtcacaagagctaggccttctttagcagctacccttttgatcacaacttggactaagttgtcttttcacactacagattttggctggggagaacctctttgttctggccctgtgaccctgccagagaaagaagttatcttgttcttgtcacatggtcaagaaaggaaaagtgtaaatgttcttctgggtttgccaagttctgctatggaaatttttgaagcattggtgatgatgcaggtgtga

SEQ ID NO: 27533 - DNA, 222 bp, Glycine max
  Peptide Sequence Number=SeqID_144311
atgtcaatgtggccaccgtcgaagcattggaatgggaaaaaaagagggcctgaaggaagagtggggccgaaaaaagttccgaggggcgttgtggggcagcaacaacaagctcaagcttcgaagagccgagagagaccaatcgagagtcgaaggcatgatattagaagacaagttgaaggcttgttaaaggtcaaagaggagtttgtccgaacaattgagtag

SEQ ID NO: 27534 - DNA, 447 bp, Glycine max
  Peptide Sequence Number=SeqID_144312
atggtgtggcgtctcctctcaactcttcttcttctccattccgctgccattaaaattcaaaaagcaaaggactccattgatgaagaagatccaaggcctagaagctccaatggagctacatcaaacactcacattacagcaggaaaggaagcttctgtcaccattgagaactctcgctctgatgagaagcttttgtcagtcttccatgaaggtgtgaagtatggtgttggaattggccctggtatctatgacatccactccccaagaataccactaactgaagaaattgcttacaaaatcaacaagatgctggcaatgctcaagaacaacatcttgtgggtgaaccctgactgtgggctcatgacttgtaagcacactgaggtgaaactagccctcacaaacatggttgtcgtagcaaaactcatccgcaatgaacttgccaagtga

SEQ ID NO: 27535 - DNA, 954 bp, Glycine max
  Peptide Sequence Number=SeqID_144313
atgctgtcatcggtgcaggaagtgtacggacgtggccagacctggcgtctgacgcagttctggctcagcaaagggctgtttgataacaccgtcaacctgaaagccggtcgcgtcaccgtcggggaagatttcgacaatttcgacagcaagttccagaaccttgcattcggcagcggccaggcgggtaactggcgcggcgatcgctggtttaactggccggtttcccagtggggcggccgcgtgaaggttaacttcacgccggaagtgttcttccaggtgggcttctacaaccagaacagtgccaactacgatcgcggtgacggtttccgtctggacaccagcaactccgaaggcaacctggtgccggtggaactgggctggaaaccgaccttcgggccggccaacctgccgggtaactaccgcattggttactactactcgtcggccaacggcgataactacggcagctggcgcgatggcgcttatcagagcaaggatcacgcttatggcggctacgtgctgttacagcagcagctgaccgcgcagggcggcgatgccagccggggtctgggcgtgacggtgcaggcggtgatgaacgatcacaaaacctcgaaaaccgacaactatcagtcgatcagctttacctggaaagggccgtttgatgcgcgtccgcaggatgagattggcgtcggcgcggcgcgtattcacgtcaacagcgcgtatacccgttcgctgcgtcagcagaatgatgccaacggcgaaactgatttcgacagcccaacctatctgccgattcaggatggttccgagtacaactacgaggtttattacaatgcgcagctgaccaaatggctgcagctgcgtccaaacctgcaatacgtggtggcaccgggtgcggtgagcgaggtgaaagatgcgtttgtgggtgggatcagtgcgaacgtgaatttctaa

SEQ ID NO: 27536 - DNA, 306 bp, Glycine max
  Peptide Sequence Number=SeqID_144314
atggacagaccttacaccctttaccgcgcaacgcactcagcgaaacaaatcggcgcgggtgaagggcttttccagcccggcgaggtcagcggaaaaacgctcgaggaactgctgggtggtggcgacgcggccgtggcccatcagcaacagcggaatcagaaatgccaccgccacctgcaccacgctaaaccccttcagcgcggtgcggcgctggctcagcaggaacgcgctgctcagggtaaagcccagcatcagtccggccagcacttcacttaccgagtgcgcatggatcaccaggcgcgataa

SEQ ID NO: 27537 - DNA, 745 bp, Glycine max
  Peptide Sequence Number=SeqID_144315
atggccgctgaaaccggtaaagttataacgcgcgctgccaatgccgaagccgagaaacataattttcgagatgctgaccagcaggcccgccaggccaaacgccagcagccagtaccagacggtgcgacggttgtcgcttttccacggcagcaccagtgcgatgatcaccgcagtggggatcagcaacatactgtcgccgaaataggtgcatccgcatccggaaaaagtcttattgccagcacgctctatcgtgaaatccgtgaccaggtcggtgacgagcatatcggtgtgatccccgaagatgcctactataaagatcaaagccacctcaccatggaagagagggtgaaaaccaactacgaccatccgagcgcgatggaccacgatttgctgctgcagcatctgcgcgcactgaaggccggcgaagatatcgacctgccggtttacagctacgttgagcacacccgcaccgacgagtgtattcacctgaagccgaagaaagtgattattctggaagggattctgctgctgaccgatgcacggctgcgccaggagcttaacttctcgatcttcgttgataccccgctggatatctgcctgatgcgccgtatgaagcgcgacgtcaacgagcgcgggcgctcgatggactcggtgatgagccagtaccaaaagaccgtgcgtccgatgttcctgcagtttattgagccttccaagcagtatgccgacatcattgtgccgcgcggtg

SEQ ID NO: 27538 - DNA, 1746 bp, Glycine max
  Peptide Sequence Number=SeqID_144316
atgacggcactggtgttgctggtcaatcccaacgactttcgtacctatatggtacagcaggtaaaacagcgcagtggttatcagcttgaagtgagcggcgacctgcgctggcacgtctggccgcagctcagcattctggcgggccgcatgagcctgaccgcgcccggcgccagccagccgatggtgaccgccgataatatgcgtctggacgtcaatctgtggccgctgctgtcgcatcagttgagcgtcagccaggtgatgctgaaaaacgcgattattcgcgccacgccagacagcgcggtgcagaaaccgcagggcgcgccgattgagccgggcgacagtgaaccggctatcgccgccagcaacggctggacctttaacatcagtaaactgcgcatcgccgatagcctgctcatctggcagcagccgggcggtgacgagtacaacttccgcgatctcaacctcaatctgaatcaggacgataaccggcaggccagcgttgagctggcgacccgcgtgtcgcgcaatcagcgcaatctcagcctgaacctgaaagggcagatggacgtggcgcactatccgcaccgtatcagcggccagctggatgagctggagtacacgcttgacggcgccaacctgccgccgcagggcattaaaggtacgctgagcgggcgggcgcagtgggatggcgaccagcagcagtttgcgctgaacaagctgcagttaaccgcgaacgacagcgccctcgacggcagcgctgagggccggctggccctgccgcagcagctcaacctcgcgctgcatgcgacctcgctcaatctggataacctgatggccagcgcgcccgccagcgataacagcaccacgcagcaggctaacgtgatgcgcacgccggtgatcgctgagccgcgcgcgcacaataatgccgactcgccgctcaatagcatggatttgcagctgacgctcgacgctgacagcagcgtgtggcgcggtctgacgctcagcaatctgcaaattgacgcccgcaatcagcgcggactgctgacgctcaacaagctgcagggcaaatttggtgacggccacttttccattcccggctcggtggatatccgtcagccggtcacgcaggtggcgtttcagccggagctgagcagcattgccatcgcgccgctgcttaaagcgctggaactgccagcttcgctgcagggcacggtctcgctcaagggcgacatcagcggtgccgggctgagcgtggcggaggcgaaacagaactggcagggcaatgcagaactggaagcgactaatctgcagctggcgcagctgaatttacagcagatggtgcgccgcgccgtggcgcgcgtcagcaatcgcgtcagtaacgatcagccggatgatcagggaattgaacagttaagcgggcgcatcagcctgaagcagggcaacgtcacgctgccggacctgcagggcggcagcagccggctggcgctgcaaacgcacggcaacgtggatgtggtgaagcagcagctggatgtcaccattaatatgattctgcgcggctggcagggcgacgaccggctggcgaaagtcctcaacggccagccgattccgctgcgcatgtacggtaactggaacaacctgcagtattcgctgccagtggatgatgtggtgcgccagcagttgcagggcgaagccaaaacgcgccttaatcagtggctggatagccagaagtctgcaccgcggcaataa

SEQ ID NO: 27539 - DNA, 756 bp, Glycine max
  Peptide Sequence Number=SeqID_144317
atgactccattgccgtcactccaaaaaggtttacaacacctaatgtcctatcttttggaatttgggatgaccgtccctttcaatgagtcaatctctttctttctcataagaggactgcacgtcctcaccttcagaggactacacaccctcaccatcagaggactacacgtcctcaccttaagaggactacacgtccttgccatcagagggctgcaagccctcaccatcagaggactacaagtcctcgccatcaaagggctgcacgtcctcgccatcagagggctgcacgccctcacctttagagggctacacgccctcgccttcagagagctgcacgtcgtcaccatcagaggactgcacgccctcaccttcagaggactacacgtcctcaccttcagaggactgcacgtccttaccattcgaggactgcacgtcctcaccattagaggactgcacgtcctcgccatcagagggctgcacgccctcaccttcagaaggctacacaccctcaccatcaaagggatgcacgtcctcacctttagaggacttcacgtccataacttaagaggctacaggtcctcaccatcagagggctgcacgccctcaccttcagaggactacacgtcctcgcctttagaggactgcacgccctcaccttcagaggactgcacgtcctcaccttcagagggctacacgccctcaccttcagacaacgacacgtcctcgccatcggaggactacatgtccttgccttga

SEQ ID NO: 27540 - DNA, 361 bp, Glycine max
  Peptide Sequence Number=SeqID_144318
atgaaaactaaattgataccgttactggtatccgcgactttcctctccgggtgcaccatcgaaccaggttcgcacctttccactagtggaaaagatgtcattgagcaacaggatagcaattttgacatcgacaaatacgttaacgtcttccctctgacgccgcgtctggttgaacagatgcgtccgaagccgctggttgctcaggctaacccgctgctgcagaacgagattcagagctatcaataccgcgttggcatcggcgacgtactgaacgtcaccgtatgggatcaccctgagctgaccacgccggccggtcagtaccgtagcgccagcgacaccggtaactgggtgcaggcagacg

SEQ ID NO: 27541 - DNA, 1074 bp, Glycine max
  Peptide Sequence Number=SeqID_144319
atggcagatgtcccgttttgtctgggtattaacgtggattttagcgctggtgctgattccgctggcgcgtgctatttccaaacgcgtgctgaatcatttcgcaaccgtaacgcgcaggaagcctggcaggcgttgcagagcgaagaggtgatgggctttgacgtgatcgccttcttcgacgtcgatggcagctgcccgcaggccagcatctccggtgtaccggtgctgcataacgagcaggagctgtggcagctgaccaacagcgaaacccagtttatcgtcgcggttgagtttgagcagagtcagcaccgcgaccgctggctgaaaatgctggcgatgcataactgtcgctcggtctcggttatcccgacgttgcgcggcgtaccgctgtacggcaccgatatggcttacatcttcagccatgaagtgatgattctgcgtgtgaataacaacctggcgaaacgcacctcgcgtgtcctgaagcgggcattcgatatcgtcggcgcgctcagcatcatcatcgcgctgtcgcctgcgctgctggtgctcggcttcatggttggccgtgatggcggaccaccgatttacggtcacgaacgtgtgggtctcaacggccgcaagttcaagtgcctgaagttccgctcgatggtaattaactcgaaagaggtgctggaagaggtgctgcgcaccgacccggtagcccgcgccgagtgggacaaagatttcaaactgaaaaacgatccacgtattaccaaagtcggtcatttcatccgtaaaaccagcctggatgagctgccgcagctgtggaacgtcgtgcgcggtgacatgagcctcgttggcccgcgcccggtgattgaagatgaactctgccgttatgccggtgatgttgattattacctgatggcaaagccaggcatgacgggattgtggcaggtcagcggtcgtaacgacgttgactatgagacgcgcgtctatttcgattcgtggtatgtcaaaaactggtcgctgtggaatgacatcgcgattctgtttaagacggtcggcgtggtactcaaacgcgacggcgcttattga

SEQ ID NO: 27542 - DNA, 939 bp, Glycine max
  Peptide Sequence Number=SeqID_144320
atgctcccgctgcgggagcaagtgaaagtcataaatcgatcaggaaaccgctcttcgccccgtgaagcgcgacttcagcttatcgaccaggcgattgatgaagtaagcgcggttatcacggttggtgaggaagaagtagcgcgcaaaactgacgctggccagcagcgaattgccatccattttgtagcgcagcggcagcttgaacgctttgtaggtatggatatcgcgcgccgtcaggtgcggcttcatggtgtcgagccagaagaaggagtacttcaccgactcgcctttgtgtttggaaccaaatttggtcaccagatggtaggtcgccagcggtttggcgatcatcacaaattcgtagcccatgcggtcggcgcggatgcagaagtcataatcctgatggcgaatatagcgcgcatcaaactggattctggcggcatcttcgcgtttcagcacgatggtactggtctggataaagccgtaacagccaaacaggtactccgccacggtctcgtttttacccggcggctgcatcggcatcactttgaggaagctgccgtcctgatgaatattgacctggctgaagatgacatagcgcgatttaccctgcgcttccagcttgcggatggtatcgcacacttccagcagcttgtccgcgtgccactcgtcgtcggcgtcgaggaagctgatgaagtcgccctgcgccagttcaatacctttgttgcgcgcgccggcaccgttgagtttgacctcagacagctccagtttgatgtccagatcctgataccgctcgccgcgtaccacctgcgccagttccgcggcatcagcggatttgtcatccacgatgatgacttcaaagttgcgataggtttgcgctttgacgcaatccagcgtcgtgacaatcgatttcgacgcgttataagcgggaattacaattga

SEQ ID NO: 27543 - DNA, 3465 bp, Glycine max
  Peptide Sequence Number=SeqID_144321
atgcggccccatgaccacgggattgttagcatgaaaagaagagaagtcttgcaaactgcagcctcctccattgttgccgcgctgtcggtgagcgcgttttccagttacgccgccaaaagtggtcagccggcgctgaaagcggttgatgcctccagcgtcccgccgggcgatgtgccgattctgacgccggaaaacgtctataccatgccaccgcagttctggcagaactttgagggcaaactgtggattggcgcagcaggcaaagatgccagccaggccggcaaccagattccggtgtatctgcgcgacgccagcggcaaggtttcccaggtgagccagccaattgcgctcaataaaggcaactttgcccagtttattcacgataatgccgcgttaatcgccaatcccgcgcactcgatggtggtggaagataaccagggtaatacgctgttttccatcagcgatgtgtcgcgcccgaacgccagcaacttcagccagcgcctggcgcagccgaatggctatcagctgatcggcgaaatcccgtcggtggaagagctgcgtaaaacccgaccgctgtttgccggggcgaaaatcaagctgaaaagctggcacgaagggctggaagtgggcggcggcgagttcgtcggcgtgtatggcgaaggcgaagatgatggcggcgtgattttcagcggcaacggattttactggcgccgcgtggtggaagatttcaaccgcctgacgctgtttgacttcggcgccatcgccgacggcaaaaccgatacggcaccggcgatcaaagccatgtatcagtggtcgctcaaggctaaccagcagatctgcgtgcagtttccggcgggcaccttctttgtgaccggctgtgactttggcgatcagcagcaacgcttcttccgcatttccggcgcgatggttaacttcggctatttcccggcgaccacgctggtatccgacggtcgttccgaattcctgttccaggtgaatgcgcgctggaccgaaatctccaacctgatcttcaacggtcagaacgacaagcggccaaacaaacaggggctgttccgcaacacctgtccgggcggccagttcttccgcggtgcctgcctgcgcttcaaccgcgtcggcggcacctcgatcagcctgctggatacgctggactgcaaaatcgaccagtggtacgccgacacctgtaccggtgacgtgatcaaagccagctggtccggacagaagcagggtgcatgggaccacagtacggcgattgagctgtcgaacttcaacgcccagcgctgtaccggcggcatggtacttaacctgccgcgctgcagccagtcaatcattcataacggctggattgagcacagcgagcaccccggcgacatctctaacggccagtggattattgatgcgctgagcctggaagattgcaaaaacccgctgaacgcgcgcaattcccgcctcaacatgcgccagaccaatctgcagtctggcagctggatcgataactcgctggaaggcgagcgctggctgaatatctgggagatgggctcaacgcgggtagagtcttacggcgtggccatcgacggcagcctgaaatacaactacatcacatcgcgtttccgtctgaccaacaacaccaatcaggccacctggttcgagctggggaatttttactcgcccaccgtgggtgacagctgggagatcgagctgtttggtcagtcgcagttcagcaacggcagcgacaagcagccgctgctcgatgtgatgggcggtaaacagaccggcggtcgcgcggtgattcatctgcagcgcaaaaccagcaaggcggaagccagctggtccgcggaaggcagttcgccggtgctggaggtgcgcgtcgatgcacgcagcgataccgatagcaaagtgttcgtcaaactggcgggctggacgccgacggcagtggtgctgattaagagcaccgccaaagaccggttcctcaccggccgctgtgcgcgcgttgacgccaccatggcgcagggcagtccgaccagcggcagccagccggccccgcagcggtttagcctgcacaacggtaaagctggcatcggcggcaacgagcagggcgatttgctgctggcgtcgcgcgcgctgaagcccgaacaggtggatacgcgccagccgaaggggtttgtttcagtggtgatcaacggcgagcaggtaacggtgcaatttatcgcggaggccacagcggcagcgagccgggccgggcaaagcgcaataaattgcgccgctacggccgcgcgtggggatctggatatcgatgtcatcagccgctatccaaccagctccggatatttactgcagcagcacatccagcaggattcgctgtttctgcacaacagtaaggcgccaaaagggctggtcagcagcctgaagcgcaaagtcgccaaccgtctgatgccggacatcatgatggcgcaccttggcaaaggtggcgtgtataaatccttctcggtgccgccgcatctggcggaattcacccgcagcctggcgaaatatgacgccatcatccaggttggtggctcgttcttcgtcgatctgtacggcgtcactcagttcgatcacgcgctgtgcgcgctgatggcgaagaagcccctgcacatgatcggtcactcggtgggcccgttcgaaaacccgcgcgtcaatgcgctggcgaactttgtttttgaccgcgtcgacagcctggtgctgcgcgaagaggtcagcctcgatcgcctgaagcaggatggcgtgaccaccagccgggtgaagaagggcgtggacaccgcgttcctggtgcaggcgcgtgaggtggaaaatccgagccacaacctgctgcactggcagaacatcattcagtcgcgcaaaaccatcgccatcaccgtgcgtgaactggcaccgttcgacaaacgtcttggcgtcacgcagaaagagtacgaagccgcgtttggccgggtgatcaacgccatgatcgccgaaggctatcaggtggtggcgttctccacctgtaccggcatcgacagctatgccaaagatgaccgtatggtggcgctgacgctgcgcgaccacgttgagcagccggagcactaccatgtgatcatggacgagttcaacgacctggaactcggcatcctgctcagccactgccatctcaccatcggcacgcgcctgcactcggcaatcatttccatgaacttcggcacgccagccgtggccatcaactacgagcacaaatcactcggcgtgatgaaccagctgggtctgccgcagatggccaccgatgtgcagagcctgatggatggctcgctgatcgacaaagtgcaaacggtgctggcggactatgacaacgtgaagcaaaaagtgaacaccgcggtggcgcaggagcgtgaaatcggcaaccgcatcaccgaagaaattctcaacgtcctggggtaa

SEQ ID NO: 27544 - DNA, 633 bp, Glycine max
  Peptide Sequence Number=SeqID_144322
gcgcgccaggtggaaaatccgagccacaacctgctgcactggcagaacatcattcagtcgcgcaaaaccatcgccatcaccgtgcgtgagctggcaccgttcgacaaacgtcttggcgttacgcagaaagagtatgaagccgcgtttggccgggtgatcaacgccatgatcgccgaaggttatcaggtggtggcgttctccacctgtaccggcatcgacagctatgccaaagatgaccgtatggtggcgctgacgctgcgcgaccacgttgagcagccggagcactaccacgtgatcatggacgagttcaacgacctggaactcggcatcctgctcagccactgccatctcaccatcggcacgcgcctgcactcggcaatcatctccatgaacttcggcacgccagccgtggccatcaactacgagcacaaatcgctcggcgtgatgaaccagctgggtctgccgcagatggccaccgacgtgcagagcctgatggacggctcgctgatcgacaaagtgcagacggtgctggcggactacgacaacgtgaagcaaaaagtgaacaccgcggtggcgcaggagcgtgaaatcggcaaccgcatcaccgaagaaattctcaacgtcctggggtaa

SEQ ID NO: 27545 - DNA, 1028 bp, Glycine max
  Peptide Sequence Number=SeqID_144323
ggatccttcgtcccccatggacgtcaagatgttctcgccgctgctattggacgtccagagcaccctagacgtgtccgtgctgctggagccggtgtcaccatcaagcaatactttggatcggctccacggacgtcccacaatgcttcctccctgcctcctgacgaattgcagcagctgacccagcaaatctgggaccagctagaggagtctatcacagagaaagtgacgaggcagatgcaatctcaaggacttgcagtgcctcctgagcctctggttggtccctccggtcctcgagtgagcacaaacgggagttatgttgatccttcaagaaacgatcctgagaccggtgactctgataggtgcggcttgtacatagaagcagatcctgcccgcctggtttccatggggagagtttatgagggatccattgttgttcataacactcctttgttgcctggccaagtaaatgtgagcacttcacaccttccttgcttggccaacacatctggtcaagtctttatcacagtagttgtgtctccggcaaaaccacctccgaagcctgatccggaggtcgatgatccgctttatctgatgacattaaccatcccaaagcttttcttgaggccttatcaggttagatgggatgccactgtgttcggggtctttaatcctgatttccccaactacataaagcacgaagacctctctgaaatcgcacatggtggtcaatgtctcagcatatcagtgttacagttgcatctgactgaaacaagtatgcgagcggggaattttgatctgtatggattcctcgagccacagtcgattcagaggtctaggcaatcgcagtttgaggctgaaagttacataaagagttggatgcagagttcaaaacgcgatgtctaccttggagcctacctgaatggcggacactggcagatggtggccatcgtgcccaaggaacacctagttgtctggttttgttcattgcataacaggctagacaactaccttaaggggataattaacat

SEQ ID NO: 27546 - DNA, 165 bp, Glycine max
  Peptide Sequence Number=SeqID_144324
atgatgcttcacagcctaaatcaaaggctcctgctaggtgaattgtcgtcaagaaataattgggaagcgtattttaacgatcctagaccattggagcctgagagattaaaaacattgcggatccagtgggcacagttttatctccgagttagagatcaggcctag

SEQ ID NO: 27547 - DNA, 273 bp, Glycine max
  Peptide Sequence Number=SeqID_144325
atgattaccagtgacactcccggaactgagatcgcagctgaaactgcagcagcaatgagatcgtggttgcaattgtggaaaatcagagaacttcttgatgcaaatagagttattaacctaaaagtttacaataacaaaatgaaactaaaccctagcccacggagaagagttaatatgctggaagtatgtgatggaaggaagagaaagagacattatagtacctggagcgagcgagggagagtgagtgagcggcgagcgagggagactgagtga

SEQ ID NO: 27548 - DNA, 834 bp, Glycine max
  Peptide Sequence Number=SeqID_144326
atgcacaatgaccaattactgattataaaattcagatggaatagctggaaccattttgcctgcaatattaaagaagacttaattcgagaaacagccgatgctatggtgtcaactggccttgctgctctaggttaccaatatattaacatagatgattgttggggagagcttaaccgagactcaaagggcaatttggttcccaaagcctcaacatttccttccggaatgaaggctctagctgattatgttcataaaaatggtttgaagttggggatatattctgatgcaggaaatcaaacgtgcagtaaaactatgcctggatcacttggacatgaagaacaagatgcaaaaacatttgcttcctgggggattgactacttgaagtatgataactgtgagaataacaatataagccccaaagaaaggtaccctccaatgagtgaagctttggcaaacactggaaggccaattttcttctctttgtgtgaatggggatcagaagatccagcaacttgggccaaaagtgtgggaaatagttggagaacaacaggagacattcaagataagtgggatagtatgatatctcgtgcagatctaaatgacaaatgggcttcttatgctggacctggaggatggaatgatcctgacatgctagaagttggaaatggaggcatgacaacagaagaatatcgtgctcatttcagcatatggtcattagctaaggctcctttgttgattggttgtgacattagagcactggatgccaccacaaaagaattgctaagcaacaaagaagttattgcagttaatcaaggcatggacagactaaattaa

SEQ ID NO: 27549 - DNA, 1179 bp, Glycine max
  Peptide Sequence Number=SeqID_144327
atgcctgtattttctagggtgggaagtgttgatgtgttacactgctactatgcccatggagaagaaaatgaaaattttcagaggcgaagctattggatgcttgaactggatatgatgcatatagtatttgtccactacttggatgttaaggtgttttctgggttcttcgtctttcaggttaacaaaaccaatattggtggaaaaacatattctgatgaggttacatcagattcccagaagagcagttctttgtcatctggctttcccagaaattatggtagtatgccttcaggaagtacagattccatgagcccaacgagcactttgacatctttatgtgaagatgctgattcagataatcatgggcagttaccagtttctggagcagaatatatcccacatgttcaggggaataagtctagagctagtgatactacttacattgagggtcagagagcacatggcattgcatcctgggacaatgccatggaacagtctgcaggaaagcatgctgatccttctcttgtatcatctacgtccattccatcaagtgcaatgggaaacatacttgacaaaaaccatactgttccaggcaaccttttagggcataaaattgccctcactgaagtggaaaggggcgctcagcctgtccaatcaaactggcagattccttttgaagacaatactggagaattgcctaattggggctttacccaatcattgggtttggaatttggatctgattatggcccagaaattgatcctgagctgttcacttttaatggtgagttaaaagagcagtatacacatgggcaatctcaacctgcactgaaatccaattctgcgtatgaagttcctggtgaagcaagtatcaattatgccttgaccatgaggcgtggattattggatggagaggagagcctcaagaaggttgatagtttctctaggtggatgaccaaagaacttgcaggtgtggatgatctgcatatgcagtcttcccctggtatttcatggagcacagatgaatgtggggatgtgatagatgatacatcattgcacctgtccctgtctcaagaccagctgtttagcataaacgatttttcacctaaatgggcttatgctgaatcagaaattgagtttgttttccttttcttgtatgtcgtgagcataagtaattaa

SEQ ID NO: 27550 - DNA, 318 bp, Glycine max
  Peptide Sequence Number=SeqID_144328
atgggtaaaaagcaattacgcagcttattcttctctgaaattgtcaaagggaaagcattcggaatagagatgcaaactgctactgtgatacaaacccaatttgtagcagacacatattggcttttcagccaattagcacatagtaccatacatatttacaacaataatagcttctataattcttcatcattgaagcatatactctatccaatgcaaaccaatactaatccgaagtccaagccattcacacctaatagacaaagtcacatagatgccatcaaagacgcttcttcattttcacccaaaaaccctaattga

SEQ ID NO: 27551 - DNA, 936 bp, Glycine max
  Peptide Sequence Number=SeqID_144329
atggctatcaacaacggtgctttagctgaaatggaagttctgagtcatacttggaaacgcttcctaagttcttccaacatagttgattcattgttaaattttcagaatggaagaagttgcttgggggattttatttaccattacatcacatcagagaaattctctccagagtgcctgcttgattgcctagacctctcctctgaacatgttgcactagagattgcaaaccgtgtggaagcctcaatatacgtgtggcggcgtagaagagctcactctaaacccccacctaatcctaatcgttcaactacaaagtcatcctgggaaattgtcaaggacttcatggctgatggagataagagagagctattagcagaaagagctgaaaatgttctactttcattgaagcaacgattcccgggtctaactcaaactaccttggataccagcaagatccagtgcaacaaggatgttggaaaatccatactagagagctattcaagagttttggagagcatggcatttaacattgtggctcgcatagacgatttgctatatgtggatggcttaactaaacattcagataggtttccactggttccaatgacagtgtctgtctcaggcactcctcacaaagcaattggcggcacaccaaaaagcttttcacctgcaccaccactaattagtcctgcaaggggagagagatctcctttcctccgcaacaaccacaacaacatcaaacctcaatgtcgtggttttggggtcagaagagtattgtcaaattatctcggggcagaatcgaaagaaacaaagattgtaagcaattcaactgtgatgaatggttcaaacccaagcagcaataaagcagaacagccagaacgtcaaaagaagtcacatgccatgaatggcaagacaaaactgactagtgaggttgtatag

SEQ ID NO: 27552 - DNA, 1070 bp, Glycine max
  Peptide Sequence Number=SeqID_144330
atggagactttaggcaacaagggtgaaaattttcaaaagaaaaaagatggggttccttcttctgctagtgattcaactcacgaagccaaagggtgttctcctcctcctcttggttggcctattcggaaggctacactctccaaatgccgtaaatcagatgaaaaagaaaatgaacctgtttctcacttggaagattcaaaatttaccaccgtcagttcaaaaatgtcaggaattgatgcaatgaaggaaaggtttgcaaaattactgcttggggaagacatgtcaggatctgggaaaggagtgtgcagcgctttggccatctctaatgctattactaatttgtgtgccactgtgtttgggcaattgtggagactagaacctataccttgtgaaaagaaagaaatgtggcggagagagatggaatgccttcttagtgttagtgatcacattgttgagttaataccttcttggcaaacatttccagatggaagtaagcttgaggtaatgacttgcaggccaaggtcagatcttttcatgaatcttccagctctgcgcaaacttgacaacatgcttcttgaaattttagatagttggaaagatatggagttttggtatgttgaccaaggaattgtagcccaagatgcagatggatcagcttcattttacaaaagaattcaacggcaagaggataaatggtggctcccagttcctcgtgtccccccttctggcctcagtgagaactcaagaaagcagttgaatcacacaagagaatgtgcaagccaaatactaaaagcttctatggctatcaacaacggtgctttagctgaaatggaagttcccgagtcatacttggaaacccttcctaagaatggaaggacttgcttgggggattttatttaccattacatcacatcagagaaattctctccagagtgcctgcttgattgcctagacctctcctctgagcatgttgcactagagattgcaaactgtgtggaagcctcgatatacgtgtggcgtagaagagctcactctaaacccccagctaatcctaatcgttcatctacaaa

SEQ ID NO: 27553 - DNA, 429 bp, Glycine max
  Peptide Sequence Number=SeqID_144331
atggaggttcctggtcttctgtttttttctacttatacattacttgtcttgttctgggctgagatatatcaccaggtctgcctctggatttacatgagtgtaagcaaaactgcagctggtttggaagctgcaaaactcctccttgcagttatatcattctttgcggctcttgcatttttattgtatggtggaaggttgtttttcttgttgagacgctttcccatagaatccagaggccgtcaaaagaaactttacgagcttgcactttctgcatttgatgagaattcagatcttgatgtcttggaccatcccattcttaacctaatgtactatttgttggtagagattgttccatcagcgctggtgctcttcatattgcgtaagctgcccccgaggcgagtttctgatcagtaccaccccattaaatga

SEQ ID NO: 27554 - DNA, 1547 bp, Glycine max
  Peptide Sequence Number=SeqID_144332
tggaggttcccgctgaggttttagctgatggaattttgtgctgtcaagctccacctcataagattggacgggttcccttctatgtaacatgttccaatagtgaaatggagcttcatttgcgactggtggggttactttcgttaaactcaatgcacactttaaatcaagtgtttgagggtgatatggataaaagaaacttaatattcaagcttatttcactgaaagaggaagaggaatattcaagtaaggaagagacaactgcagagatggatatatcacaacagaagttgaaggagcatatgtttcacaagcaggttaaggagaagttgtactcatggcttcttcacaaagttactgaaactggtaaagggcctcttgtattagatgaagaggggcaaggcgtgttacacttaattgctgctcttggttatgattgggctataaatcctatcataactgctggagtcaatatcaacttccgtgacgtgaatggatggacagctctacactgggctgcattctgtggccgagagcgaacagttgctgtccttgtctccatggatgcagccgctggtgcattgacagatccatgtcccgaatttcctttgggtagaacacctgcagatcttgcttctagcaaaggccacaaaggaatttctggttttcttgctgagtcattattaactagccacctcgaatcactcacaatggatgaaaataaagatggtaggaaagaaacttcaggaatgaaagtagtgcagacagtttcagagcgaactgcgacacctgtgcttaatggtgatatacctgatgatatctgccttaaggattctcttaatgctgtccgtaatgctacacaagctgctgatcgtatatatcaagtattcagaatgcagtcatttcagaggaagcagttagctctgtatgaagatgatgaatttggattgtcagatcaacaagctctttctctcctagcttctaaggcgtgcagatctggtcaaggagagggtttagccaatgctgctgcaatacaaatacagaaaaagtttcgtggttggacgaagagaaaagaattcttgattattcgccaaagaattgttaaaatccaggcccatgtaagaggtcaccaggtcaggaagcagtataaaccaatcatttggtctgtgggaatcctggaaaaggttatattacgctggagacgcaagggcagtggtttacgtggatttcgaccagcttcccagaacaaggtccccgaacaaccaagcgaatctccgaaagaggatgactatgattacctcaaggaaggaaggaaacaaagtgaagtgaagttcaaaaaggccctttcacgggtgaagtccatggttcagtatccagaggcacgggctcaatatcggcgggtgctaaatgtagttgaggacttccgtcaaaccaagggaggtaatttgaatttgataaattcggaagagacagtcgacggtgtggaggatttgattgatattgacatgcttttagatgatgaaaatttcttacctatagctttcgattga

SEQ ID NO: 27555 - DNA, 474 bp, Glycine max
  Peptide Sequence Number=SeqID_144333
atggacaatgcctctcttgcaatttcaccatttctgccaagcacggattttttgcatgaatactgtaaggtggagagagagagcatagcaagactcaagatgagtttgatgaaagaaagtggcaatggagaaagtacggagaaaaaagggttcactaattttgaaaccctcgctgcgtacatctggagtgggggtgagaccacgcttacaggatcctttgtcccgtggatatacgggaatgccatcgtgcaggcatttgttacgttaacagtgaaggagctcaacgaaagaccactcttggaggttgtgaaactcatcaaagacagcataaaggattggagacatttggctatgttggaaaaggttgattttgggtggaaggaggcagtgaatagcatgccagtcccttgcggggctgccatgtccaagttcaaggaagagatgaaagctcataacagtatcaaaaatgcgtag

SEQ ID NO: 27556 - DNA, 945 bp, Glycine max
  Peptide Sequence Number=SeqID_144334
atggcaagtagacaagtaagatgtaaccagtgtggatcagtattaatggttccggcggcagcggtccgtgttgttgagtgcagagtgtgccatggcatgaaccagattcgaccctccacaggtccatggagtcaagtatacaactcctttcatcagtttggaggtcgtctcagaagctttgtgaataccataatgcctggttcagttaacagaaatccgggttattattatgggacgacacctcaattagggtattatcctcagccactaaggccatcatacaatgtatttggcccaaagagggctgtcctatgcggaattcgctatcatgggcaggatagccagcagctaaacggcaccgtgaatgatgttaaaaacatgaatatgtttctggttaagtattgtgggtttcctagggaatccattctcattctcacagatgatatggaggagagagacccgctaaaattcccgacaaaatataacattcaaatggccatgaggtggctgattgagggtagccagtcaggggattcattggtgttccacttcgcagggcatggcgctcaggaaccggatatgtctggagatgaacttgataggtctgacgaagtaatatgtcctgttgattccagagagcagggaaatatacttgatgatgagattaatgctacaattgttaggccactaccacgcggtgctaaacttcatgccgttattgattcatgccatagtgggactgttcttgatttagcttatgtttggagcctgagggaaggctattggacatgggattatcaatactatcgagttcgtagacctaataaagacacaagtggaggggtagcaatttgcatttcaggttgccacgatgatcaatcgtccaaagaaacccctgtatgccttaagtggtggctatgcgtttactggcgcctttacttatag

SEQ ID NO: 27557 - DNA, 360 bp, Glycine max
  Peptide Sequence Number=SeqID_144335
atgaatggggttctgacttatcttttcacaaaaacaatcagagaataccctggaataacttatgggggtctcctagaaaagatgcatgacgaaattaaaaagattaaccgaagcagatgcaataaccgcatattgcaacatatcttcaatcgtagaattgcacaggttggattccatcaccatttattgtcactaatttctaatatttgtattcaatttcaagcgcagcaccaatggctgtggtatcgtagaatatcgggattttactacaccaaaaatgaacttattagggttcattcgaggccgattttaattttggtggatagcacaatggtgatcaatgctgatgtggtggtgtaa

SEQ ID NO: 27558 - DNA, 1419 bp, Glycine max
  Peptide Sequence Number=SeqID_144336
atggcatatgagaatgcaaccctcactgttgctaacagagaggtcatattcatcaaaccttcaaaacccactcctagaaccattctttcactgtctagcattgacaatgatcccgagaacaatatcttcatgcaaaccctttatgtataccaatctccaaattacaattcccctaacactaccaaacttgaccctgcaaaagtgatcaaagaggccctctcaaaggctctcacttactattatcctttagcaggaaaattagtaaaacatgctgatggaaaactcagaatcaactgcaacaccgaaggagttccattcatagaggctatttgtaactgcaacctctcttctcttcgttacctagatggcaacgacgtcgaaatcgcgaaacactttgggatcgattttccttctcaagatgaatttggaaaccaatatcctttggttttcaaggtgattaagtttctctgtgggggtttcatctttgtagtggggtgttcacacgctgtttgtgacggaactgggttatctcagttcttacgagccgtagcagaacttgcaagcggaaaagctgaaccctctgtgaaacctgtgtgggaaagagagagactagtgggaacattcactagtcaacccttgcgaaatcccgaaagctatataagcacttatcatgttcatgaattacccgatgtgggactattcttaacaccaaccacagattattcgcatgaatgctgtaaggtggacggtgagagcatcacaagactcaagatgagtttgatgaaagaaagtgaccatggagaaagtactgagaaaaaagggtacacaacttttgaaaccctagctgcgtacatctggaggtcaagagccagagccttgaaactgagctactatggtgaagctatgctgactatcatagtgggggcgagaccacacttgaaggatcctttgccccttggatattacggaaacaccaccgtggaagcatgcgttacgttaacagtgaaggagctgaacgaaagaccactcttggaggttgtgaaactcatcagaaagaccctaaaggaggttgctttcagcagtgattatatgagacactcgatcaacagtatggaaatgaaaccaatgaagtttaattacgaaagtggtgcaatattgactctgacagatgcgagacatttgggtatgttggagaaggttgatttcgggtggaagcagccagtgaatacaatgccagtcccatgcgacatgtttggaatttcaggtgtttggtcgatcatggctcctagtaatttggatccttcaatgagagctagtggaggagctaaggtttatgtttgcctacctagtgctaccatgcccaagttcaaggaagacatgaaagctcttacacgtatccaaaagagaagttctctatga

SEQ ID NO: 27559 - DNA, 618 bp, Glycine max
  Peptide Sequence Number=SeqID_144337
atgatgactagttcggttaacatcaatcagggttattatgggacaactaatcaatttgggtattatcctcagcctcctcagtcactaaggccatcataccatatatatggctcaaagatagctgtgctatgtcgaattcgctatcatggaaagagttacagactaaaaggctccgtgaatgatgtaaaatgcatgaaatacttcctgattaaggagtttgggtttcttagtgactccattctcatgctcacagatgatagagacgagagaaaccagttaagaaccccaacgaaatataacattcaaatgaccatgagatggctgattgagggtagccaatcaggggattcaatggtgttccacttctcaggacatggcacactggaaatgaatatgtatggggatgagattgatgggtttgacgaagcaatatgtcctgttgattatgaagagcagggaaagatactcgatgatgagattaatgctgcaattgttaggccactaccacgaggtgctaaattccatgcctttattgatgcatgccatagtgggactgttcttggtttagcttttgtgtgcaagatgaataggtcagttttgggaatgcttgctctgtga

SEQ ID NO: 27560 - DNA, 588 bp, Glycine max
  Peptide Sequence Number=SeqID_144338
gttcggtaccagcaagtgagaacagagcaggtgctgaagcagcagtgtggttcggtttgggggaggcaagagaaggctaattgggcaactcagcagcaccaccagccccaagttcagaatagggttcgtgatttgcgtgagtttgggtatgactatgaagctgtgaaatgcacgcacgttttgcctcactctgcatggcaccctcttcaagtgaagaaccagaatacccaacaggtgccttatttcggatccgggtcgcgacccgggttgcaaggtggatccggtgttactaaaaggggttgcgctggaacgggggttttcttgcctcgtcaatatggggcccctcctcctgaatctcgcaagcaaacagctgcacctgttttggtcccagctaaggttattcatgctctgaacctcaaaattgatgacctcaatagccaaccacgtttcttgggtgcttttgacgtggactatgatgctttgttagcgaggaggaatgctcttctcttgcagcagaagttaagcatgctgcgagaagaggcagctaactatgaagctcttagcctgcctcaagaatggacgtactga

SEQ ID NO: 27561 - DNA, 1233 bp, Glycine max
  Peptide Sequence Number=SeqID_144339
atgaagaagctctgtcccaatcttactcgcgaggatgggctcgaaacggtgctggaggttcctattccagaggagattttcaccatcaaaagtggaaccagcagagcttggcataacatgaagtcatggatgaagccaaatgttgaatcttcaagatcatcatcactctttggaggccaaaacacagatatccaactattgcttggtgttgttggagcgccattgatccctctccctataacctctcacaaccaacctatcaccattaaatcccataacactgaggcttcgatggcgaaatacatagtgaaacagtacgtggcggctgtgggaggagagagtgctttgaattcggtggaaagcatgtatgcaatgggggaggtgagagtagggtcagagttttcagcaggggaagaatgtgtgagtagcaagaagatggggaagaagaagccagaactgtggtgtttggaactggttgtttctgggtacaaaatcagtgccgggagtgatgggaaagtggcatggaggcaaacacctttccaccattctcatgcttctcgtggcccaccaagaccacttaggcgtttacttcagggtcttgatccaaggtctacgggcaatttgttcaacaactccatatgcataggagagaagacagtgaataatgaagaatgtttcatattgaaacttgaagccgattccaattcacttcgaacaagaagtagcagcaacgtagagattattcgccacacggtgtggggctacttcagccagagaacaggccttttggtccaattagaagattctcacttgctcaaactcaaatccaatgcaagtgatgccatattttgggaaaccaacatggagtcccttatacaagactacagaactgtagatggcattaacatagcacacggggggaagacttgggtcgcattgtcaaggtttggtgaaggccctgagagccattctaggacaagaataaaagaggtttggcaaattgaagaagtggattttaacatcaaagggttgtccatggattgcttcctaccacctcgtgatttgatgagagatgaagaaaaaagggtagaagagtgccgggtggttgcaagcaattcaaagttgccctataaaattcaatctgcttcttcttttaagattagtgtttccaaagtagctgccgttaacgtggatgattcaagtgctagtgaaactgatgatgaggatgtgtaa

SEQ ID NO: 27562 - DNA, 339 bp, Glycine max
  Peptide Sequence Number=SeqID_144340
gatgatgaaaaatgcttccacaaaacagtacccaaagaagtagttgatatccttgtagagttctataaatcttctgaaattagtaatcaagttcagaaagaagtagcaataataggtgaaagtgaaattggtttcatggagaggaacagaacacggactgcatttcttactcagtgtcacattcttatgagaagatcttctttgcatctgtttcgtgatgtaagcaattattggttacgtctagctatgtttgttctagcagctattagtcttggcactatattctttgacgttggttcaggtgatgcatctatcgaggtaaagcagaatagcacataa

SEQ ID NO: 27563 - DNA, 177 bp, Glycine max
  Peptide Sequence Number=SeqID_144341
atgatatatgcaaaagaacttaaagatgaagatgtgattatgcaagatgcgaccaacattctaattctaattggaattgagaatggtagcccatggccttggccattggtggttgctggttacagggccacaagagccatgtggtctgattttatttctgattattggtctagttaa

SEQ ID NO: 27564 - DNA, 249 bp, Glycine max
  Peptide Sequence Number=SeqID_144342
atgcgttttcaaggcttggaattcattcagtctccattttatgttcgtttaaattgcatcttcaaagctcccccaccctcacatcttgttaaggtgccaagagctttgtctgccattacccctgtagaagcaaagcttcatgatgaatcgagatttattcaaagatgttttgatgataacaaagatgatcacaaaggtgatgacaaaaacctcaaaggtcaaagaatgagttcaagatgttcaagatag

SEQ ID NO: 27565 - DNA, 991 bp, Glycine max
  Peptide Sequence Number=SeqID_144343
gactacacgtcctcgccttcaaagggctacacgccctcgccttcttagggctacacgcccttaccatcagaaggctacccgccctcgccttgcttttagaggactacacatctttgcaatcagaggactacatgtcctcgccttcagagggctacacgccctcgcctttagaagactacacgtcctcgcctttagaggactacacctccacgccttcaaagggctacaccttctcgcgttcagaggactacacatcctcgccattagaggagtacacatcctcgccttcagaggactccacgtcctcgccttcagaggtctacacgcccatacctttacagtacgacacgtcctcacctttagaggactgcacgccttcgccttaagagggccgcacatcctcgccttcagaggtctacccatgctcgccataagagaattacacgtccccgccttcagaggtctacaagtcctcgccttcagagggctacacgtcgtcctcgccatcagagggctacttgcccttgcctttagaggactacatgtcctccccttcagaggactacacgtcctcgccatcagagtgctacacgcccttgctttgagagcactacacatcctcgcctttagagggctacatgccctagccttcagagggctacacgttgtcgccttcagagaactacacgtcctcgccttcagaggactacacgtcctcaccttcagaggactacacgtcctcgccatcagagggctacatgcccttgcctttagtggactacacgtcctcgccttcagaggactacacgtcctcaccttcataggactagacgtcctcgcctttagagggctacacgctctcacctttagagggctacatgccctcgccttcagagggctacacgttgtcgccctcagagaacttcacgtcctcgccttcagaggactacatgtcctcaccttcagaggactacacgtcctcgccatctga

SEQ ID NO: 27566 - DNA, 1041 bp, Glycine max
  Peptide Sequence Number=SeqID_144344
atgaagagaggcattgaaatagttggtgttcaatgtttggagaatggggaaaatatgacattggggagtgagtgtggcccacaagaagaagatgccaccaatggaatggaaggacgctctaatggggtgcaagagcaaccaataagtggggacaatggggttttaacaatgattgaagaatttaagactccctttgatgttacaaatgttgttttagaggaatccgaggatcaggccatggagggtgacatagaggaagaacaattacaaagagaaacaaaggggctgttagaaaaaattagagatgaaggtagaactgatatggcacaggagagaggagaatatgtagaaggaatatgtggagggaaaaatgaaagtgataaaaaatttggttcagctgttgaagatatggagatggaggtagcatgggaagacacacatagtggtatcatcgaggggaatgaagaagacttgggaaaggaagaagatccaaatgtatgtgaagagatgcttcattcaaaaaatgatgaaagtaaggatactatgttagaaggaaaagaatctgataatacaaatgattcactagtagagccaatggctgaaccttctgaactgcagattccagctgaaccaattagagatttgcctatagaagcactagtttataatatttcagtggacgaagactcatctgaggttatcagtgaaaatattggcattcctcggagcctccgccggattgtcctactacattgcccaatgagaaaatcacagttgcatgaattaaatgaagggatgtacccgttagatgcagaagctagagaaattgctaatgaaagtgcacttgatttgtttgatggaaaccaaatagaccatgacgagtatgcatacacaattgatttaaatgaaggctcttcaaatgttgtaaggcatacaaattctatgcaggttcttgtttcgtctgtagaagaagagtcaaggccatctaaatgttcctctgcagaaaaccatgtttgcccttctcaagaggtcaggatctaa

SEQ ID NO: 27567 - DNA, 1797 bp, Glycine max
  Peptide Sequence Number=SeqID_144345
atgtctgttgatcattcacaattggactcctcaaacacttcttctaatccattaaattccccaattattgttcctcctagaagatctaacagggacagaaccagaccaaagaagtttcaagactttcacactacatttacattagctgttactggtcaatcctcaggtattcattatcctttagcttatgtcttatcttacaagaatttgtctcctacatatcacagttttattatggttgtatcctctgagacagaacctaagtcatttaaagaagcttctcaatcagacaaatggattaaagcaatgaatgctgaaattgaggctttaaaggctaatcatacttggattttgactgaccttccacctaacaaatctgctattggatgtaaatgggtttataaaatcaaacacaaggctgatgggtcaatggagagatataaagctaggttagtggcaaagaggtatactcagattgagggtcaggactatcttgataccttttcaccagtggccaagataactattgtgagattattgcttgttttagctgctgttaacaactggcatttacaacaattaaatgtgaacaatgcttttttgcatggagatcttaatgaagaagtttacatggctttgcctcctggtatgcactcaacaaaatctgatcaagtttgtcgattgcagagatctttgtatggtcttaaacaaaccagtagacagtggtatgctcggttgtctactttcctcatctcacatggctatagacaatgtttttctgatcattctttgtttattaagcagtatcttcaatcttttactgctttactagtttatgtagatgatattgtcttgccaggcaatgatcttctagaaattaagtccataactcagcttctggatcaagtttttaaaatcaaagatcttggtgacttaaaattttttcttggacttgaagtggctcgaagtaaacaagggatcaatatttgtcaaagaaaatatattcttgatatcttgcatgatgcaggcatgttaggaagcaagcctgtctctactcccattgactatgctgtaagactacaccaacaatctggaattccacttgatgatacaacagcttcatcataccgtaggctcattggtcgcctcatttacctcacaaacacaaggtccgatatcacatatgcggtgcaacatttaagtcaatttgtagctcatccttctttagctcatcaacaagcagcttataggattctcagatacttgaaagcagcaccaggttctggtatatttttccctgcttccagcacattgcagctcaaagcttttagcgactctgactgggcaggatgcgttaatacaaggcaatctatcactggctactcagtctatcttggtaattcccttatttcttggaaatccaaaaagcaggccacagtgtctagaagttcatccgaggctgagtatcggacactagccagtgctacatgtgaattacagtggttaacccacttgcttaatgactttggaattgtttacactcaaccaactcttttgttttgtgataatcgctccgctcttcacattgctgcaaatcctgtcttttatgaacgtacgaaacatattgagatagactgtcacattgtgcgcgagaaattgcattccggccttatcaaattgctacccattgcttctgctcaacaacttgcagacatatatactaaagctcttccaccaggcgctttccattttcttcagtgcaagctgggaatgtcagacatacattctccagcttga

SEQ ID NO: 27568 - DNA, 1162 bp, Glycine max
  Peptide Sequence Number=SeqID_144346
tgtggaatgtggaagaactttgaattacagacttacagtgcaaaaacaaaaccttaacccaaccggaccgggtatcaaaggcagagaagagagtaacaaggttgcttcgaacagtttagaatcatgtcttggtgcaccattgagtccgatcccgggctcacggagtgtcttgtttgatatagatgctgattggtacattcttttagactttgattttgcttctttctcttcccaggttgaggaactgtattcattggaccttgactctctcaacagccttaggcctgtttatgggttgatttttcttttcaaatggcgtccaggagaaaaggatgatcgtgtcgttatcaaagatcccaaccctaacttgttttttgctagtcaggtaattaataatgcttgtgctacccaagcgatcttgtccattcttatgaattcaccagatattgatattggtccagagctgacgaaattgaaagaatttaccaagaatttccctcctgagctcaaaggtttagccatcaataacagtgaggccatacgtacagcccataatagctttgccaggccagaaccttttgttcctgaagagcaaaaggttgctagcaaagatgatgatgtttaccatttcataagctatctacctgttgatggggtactatatgagcttgatggattaaaggagggtcccatcagccttggtcagtgctctggtgggcaaggtgatatggaatggctgaagatggtgcagcccgtgatccaggaacgcattgaaaggtattcccaaagtgaaataagatttaatctcctggcagtcatcaagaacaggaaagagatgtatactgctgagctgaaggaacttcagaagaggagggagcgcattttgcagcagctagcagcatcaaagtcagacagacttgtggacaatagcagttttgaggcactgaacaattctctctctgaagtgaatgctgggattgaagcagctactgagaagatcttgatggaggaagaaaaattcaaaaaatggagaacagaaaatattcggaggaaacacaactacataccctttttgtttaactttctaaagattctcgctgagaagaagcagctgaagcccctcattgagaaggccaagcagaaaacaagcagccctcggtga

SEQ ID NO: 27569 - DNA, 912 bp, Glycine max
  Peptide Sequence Number=SeqID_144347
atgttcaaattcttgaaagaggtggtgagtggatctggaaccggcctcaaagatctaccatacaataccggtgaaccttacgcttctgcttggggctcttggcttcattttcgcggcacatccaaggatgacggttctcctgtgccaatattttctctgtctgggagcaaagctcaggatgggcatttagctgcggggcgtaatggcgttaaaagtcttcgcactgttaggcatccgaatattttgtcgtttcttcacagcaccgagatcgaaaccgtcgacgctggttctcccaaggttacaatttatatggtgaccgagccggtgatgccgccgttggacaagattaaggagttgagtcttgaaggtacacaaagggatgaatattatgcttggggcctgcatcaaatagcaaaagctgtcagcttcttaaataacgattgtaaacttgttcatggtaatgtttgcttggctagtgttgttgtcacacaaacattggactggaaactccatgcttttgatgttctatcagagtttgatgggagtaatgaagcttcttctgggcaaatgctgcataggtttcttggtatgaggttaaaaggtcctgaatgtccttactctttggccgaccaaactgtagatactccttcaacagcacctgttggtgtaagctcaacaccagattttgctgaacaccctgtccctacatccccaacgtcaacagatgtctggggggaactagagaatggactcgacgaggagcgtgaaaatgacaaggatgggtgggatgatctggaaccacttgaagaaataaaaccagctccagctcttgcaaaaattcaagcagctcaaaggaggccagttcctcaacctgattcgcagctaaaaacaaggtattggttattcaactaa

SEQ ID NO: 27570 - DNA, 411 bp, Glycine max
  Peptide Sequence Number=SeqID_144348
atgaactcgctaagcgagcatgctgcactaagcgagtcaatactcattgtatgtaagcgtttctctgaagaactcgctaagcgcgcttaccgtgctaagcgaatgtcttccaaaaaaagaaagagcattagtgcaaggcccacagctcaatatgacacaagaaggttccactacttcgaggcctggaccagatatacggataatgtgctaggaagatatatactagctaagaggaaggtacaaatataccatatggaattggatgagttcaaggctgaattggagaggcataacttccataagcgcctcaccaattttgccgacagcagcatcgacctagccttggtgaaggagttctatgccaacctctatagccccaaggggccttcaccaaaacaagtcagaatatga

SEQ ID NO: 27571 - DNA, 342 bp, Glycine max
  Peptide Sequence Number=SeqID_144349
atgaccaataacgatgtgctgcgcagcgtgcgctatatgctggatttgagcgacagcaaagtggtggagatttttgcgctggcgggcagtgaagtaccgcgtgaagatgtgcaggcgtggctgaagaaagatgacgatgagacgtttcgtaaactgccggatgtgctgatgggctacttcctcaacggtctgattttctaccgtcgcggcaaaagcgaagacgcgccggccccgtcggttgagcgccgcatgaacaataatatctttctcaaaaagttacgcatcgccttcgcgctgaaaaccaccgatatcccggatatcttactgaaggctaacttcaag

SEQ ID NO: 27572 - DNA, 369 bp, Glycine max
  Peptide Sequence Number=SeqID_144350
atgctgaaggattcttgttctgatctgtatcatagtgcgtaccaagaagtatcaaggtttaggaagagatataatttcttatacgaaaatgatcttcctgctgaaagacaggctcttaagaaggaattgaaaaaatataaagacccgaagcgtgtaaatgaaatagaagaacgtatatcatggattgataaacaagtgaagtctgattcagcgaagcatattgatgcagaaatatcggctaagcacaaaaagaaagagagagaagcagcaaagcagggaaaacgtcctttttatctcaagaaatgtcaatcttcttcctttcttgccctctcttttcctcctctgtttctccccatatgtcgaaaatga

SEQ ID NO: 27573 - DNA, 264 bp, Glycine max
  Peptide Sequence Number=SeqID_144351
atgtcgagggaattgcaccctctacgagcatggcatagtaggcagatagaaagaatgaggccatgccaggagatatgcacgtcagtttacaagtgtcacactctggtgcatattgtgctagtagatagaccagatgccacacccatcaccatcagtattgctacattccttggggatttacatctggttgacaattgggtggtcaataaggaccgaggagatcacaccaacatgacgtcggaggaggaagaagtgtatcactag

SEQ ID NO: 27574 - DNA, 125 bp, Glycine max
  Peptide Sequence Number=SeqID_144352
atggtttatccaagtggtactagacacgaatcccttaagcatgtagtaaagggtttgaatcctgacgaatgcatatatggagaaaatcttgttgagagggagatcccacttatgagtgccaacag

SEQ ID NO: 27575 - DNA, 228 bp, Glycine max
  Peptide Sequence Number=SeqID_144353
atgagactttttcgcagtctcgtccggaagacgctgacatcttcgggaaaggtgcagatgacgacggcactcactgcatgctaccagactttgagtctgatggatagcgaacgagtgtgtgtgggttaccatatagggcgtctccgcgtgccaacggactcacaggtcacgatagcaaaaggtggggcggtcgacaaaagcgaggcttttgctcctacgtatccttaa

SEQ ID NO: 27576 - DNA, 210 bp, Glycine max
  Peptide Sequence Number=SeqID_144354
atgagattttggatatttagcatttcacttctaaatggccatttagaggaaacactgggttcgacaaaaatagaagaaaatcactcaaagtgtatcgatctcacacagggcaaggatgggcattctcaccctgggagtgttggtttggccagcggttcagggataaaggggatgtcccacattatttccatgacacacatgcaacaatga

SEQ ID NO: 27577 - DNA, 309 bp, Glycine max
  Peptide Sequence Number=SeqID_144355
atggcaaaggtctccacggaggccattgcctccctcacccagtattatgaccagcctttgaggtgcttcacctttggggacttccagttgacacccacgaatttccaaaatagtcaaaatctcgacacaggaattgaaccgggggaagaaagtcgaaaatggggtggttggagtaccaaggaaatgtttggaagcaaaggcaagaaccttggcaagtcaagagcctgggcgagctgggcggcaaccaccttcctcttttctcctataaataggggaaagagggcagagcaaaagtgttcagcccttctg

SEQ ID NO: 27578 - DNA, 384 bp, Glycine max
  Peptide Sequence Number=SeqID_144356
atgatgggggagatgtgcgaggattttaagatccaacatcacaattccacaccctaccgaccaaagatgaacggagccgtggaggtagccaataagaatatcaagaagattatccagaagatgattgtgtcatacaaggattggcacgagaagctcccattcgcgttacatgtacgcatgcgccggttcagcgaaggggacttggtgctaaagaaagtctcccaagctctgaaagacaacagaggaaagtgggccccgaactacgaagggcctttcgttgtaaaaagggctttctccggaggggccctggtgctcaccaacatggattgtgaggagctaccttcacctgtgaactccgatgttgtcaagcgatactacgcttag

SEQ ID NO: 27579 - DNA, 500 bp, Glycine max
  Peptide Sequence Number=SeqID_144357
aaagtgcacacgaagaagtcttcaaagcagtgtctgaggaaaatgtagatgacgctgaacccaacactgaagatttggaagttggtcctgttacatgtgaagaacagaattccaaggaaactcaagaacctgataatgtacaaaacacagcaaagagggttccaggcaaaagaaagctacaaattcaaggcaaatggaggggtgttgaccctgttgtctttttcaaagatgaaacaattattaatagtataagggatttctatggaattgatgagcgttttccattcaatggtcaccttgttacaagaaacagtgatacaaatcatgtgaaaagaatttattatatctccaagtcagtcaaggatgttcttgagttgaacttcaaagttgggcagcaacttaaaataacatcaattggcctgaagatgtttgcattgaagactgatctaggcaagggagacaaatttagtcagaatttgattagtaaaagtgacgtgtaa

SEQ ID NO: 27580 - DNA, 1548 bp, Glycine max
  Peptide Sequence Number=SeqID_144358
atgggtggtggcgggagaggaggcagatcacgcactcagagaaaacacttccgccagagcagagagaacgtgtggaagcgttccaaatcggatcccgatccttcttcaaccgaaaacaatcccgcgtggactcccttcgccactgagaacgccgcttttgatttctactacaaagagcagggaatagtggacctgcaatactgggaccaattcgtcccacttctcagaactccattgcccgcaaccttcagaatcaactctagtagccggttctacgacgaccttcgttctcaattggagaatgacttcgtgcattctcttcgcgatgaggttgttgaaggaggtgaaacggaggctattcggccgttgctgtggtaccctgggaacttcgcttggcattcaaatttttctcggatgcagctcaggaagaaccaaacgcttgagaggttccatgaattcttaaaactagaaaatgagattggaaatatcacaagacaggaagctgtcagtatggttcctcccctcttcttggatgtgcattcagatcattttgtgcttgatatgtgtgctgcaccaggttcaaaaacgttccaattgcttgagattatacaccaatcatctaaagcaggatcactacctgatggaatggttatagcaaatgatcttgatgtccaaagatgtaatcttctgatccaccaaacaaaaagaatgtgcacagccaacctaattgttacaaatcacgaagctcagcacttcccaggatgccgtttaaacaggaattatgaaaggatggagttagatcacgatattggccaactgttatttgatcgtgttctgtgtgatgtcccatgcagtggagatggtacccttcgtaaggcacctgatctctggaggaaatggaacacagggatgggacatggccttcacagcctacaagttttaattgctatgcgaggtttatctctacttaaaattggtggaagaatggtctattcaacatgctcaatgaatcctattgagaatgaagctgtggttgctgaggttttgcgaaggtgtggagggtctgttaaacttcttgatgtctctagtgagcttccacaacttattcgtcggccaggtctcaggagatggaaggtatatgacaagggcacttggttggtctcttacaaagatgttcctaagtatcgtagaagtgtaattctttccagtatgtttccttctggcagaggccatcatgatcttgtggatagtagttgtagtgttgatccagagggcgttactaatggtattaatggaaatgctggagatggtgttcaagcagttgagaatcctgtgatgtccgagtctggtgcggaagtttgcgatttccctctagagcgttgcatgaggatagtgcctcatgatcagaacactggagccttcttcattgctgtactgcaaaaagtttctcctctgccaggtagtttttcttatgaccatatattgtttctctctctctggtctgttaacagaatagtgatgaacattttggtgaacataggacaataa

SEQ ID NO: 27581 - DNA, 665 bp, Glycine max
  Peptide Sequence Number=SeqID_144359
atgcagactcgcgctgctgcaaagagaaaggcaaacgctgacaccgtagtagtcacggttgagaaacaacaccccaaaaagcaaagggttgtgttgggtgaacttaccaatattccaaaccttattctccccgaaactcaaagtccgcgcaaagagaaactccaatgtcggaagaatcccaatgtcaagaaaccatctcccacaaacaacaccctttcttccccccacattgatgaaccttatgtttccgacatcaacgactatctttgtgcaatggagatgcagagaaagagaagaccaatgtttaactacatggacagagttcagcacgtggttactgaaaacatgagaggaatattggtggattggttagtggaagttgctgtggagtacaagcttctctcagaaacccttcatctatctgtgtcatacattgataggtttttgtctgttaatcctatgggcaaatcgaggcttcagttgctcggtgtttcttccatgctcattgcttcgaagtatgaggaagttaatccaccccgtgttgacaaattctgcagcattacggataacacttataaaaaggcagaggttgtagagatggaagctaaaatacttgcggccctaaattttgaaattggaaatcctactgcaatcacttttctaag

SEQ ID NO: 27582 - DNA, 366 bp, Glycine max
  Peptide Sequence Number=SeqID_144360
atggcctctatttatagcctaagtgtcacactgtcagaccctaatttcgtccggagactatcattcatggatattttgattctcgctagccgaaatgagttgttcgacaccaattaccgtgcaagacggaagatcattctatgttttggtcaagggtgcgaagataggggaaaaagggtctttttagggttttttctagatcccaactcgcccaggcttgcttgggcccccaaatggcttagggctgaagtaaccaactcgcctgggcaagcaaggttacttcagagtgaagcatcagctcacctgggcgagctgcaagtccaccaagtgcctttttttgctataaataggtgtgatggaggctga

SEQ ID NO: 27583 - DNA, 861 bp, Glycine max
  Peptide Sequence Number=SeqID_144361
atggagtcacgcgccgcaaagagaagggccaaccaatcccaaaacgaacccctcacaaaacgacgcgtcgtgttgggtgaactttccaacttgcccaatctcatccttcctcaaccagcggtcactgacaagaccctcactgttcacaacggtgtttctgcagaatcaaacgttaatgctcctattgtttccgacatctataactatcttcgtacaatcgagatggagaagcgaaggccaatggttgattacattgagaatgttcagaaagaggttacaacgatcatgagagcaatattggtggattggatagtagaggttgccgaagaatacaagcttctctctgataccatttttctctctgtttcatatatcgatagagttttgtctattaatcctgtcagcaagccgaggctacagttactgggtatttcttccatgttcattgcatctaagtatgaggaaattagcccgccgcatgtggaagaattctgctttatcactgacaacacgtatgacaagacagaggtggtgagtatggaggctgacatacttaaggccctgaattttgaattgggcaaccccactgttaagacctttttaaggaggtttactggaattgcctgtgagaataaaaaggcttcaagtttgcaatttgagtttatgagttattatcttgctgagctaagtttgttggagtattgttgtttgaagttcttaccttctttggtggctgcatctgttgtatttcttgccaggtttatcatttggcctgatctgcaaccttggagttgtcaaattaaggcctgtggtttacggcttcttgaagttgtcgtaattatagttactacaatcttatga

SEQ ID NO: 27584 - DNA, 1041 bp, Glycine max
  Peptide Sequence Number=SeqID_144362
atggagactcgtgccgcctcaaagagaaaggcaaacgccgccaccatagtcatagtcgaaaaacaacaccccaagaggcagcgtgtcgtgttgggtgaactttccaatttaccaaacattattgtccccgaaactcaaaatccacgcaaagagaaactacaatgtcggaagaatcccaatatgaagaaaccatctctcacaaacaacaccctttctttcccccagatcgatgaatcttatgatttcgagatctttgagtatcttcacgcaatggagagaaagagaagaccaatgattgattacgtggagaaagttcagaaacaagttacgacaactatgagggcaatattggtggattggttggtagaggtagctgaggagtacaagcttctcccagatacccttcatctatctgtttcgtacatcgatagatttttgtctgttagtcctgttagtaaatcaaggcttcaattgctgggtgtttcatccatgctcattgctgccaagtatgaggaagttgacccaccccgtgttgatgcgttctgcaatatcactgataacacataccacaaggcagaggttgtaaagatggaagctgacatactcaagactctaaagtttgagatggggaatccaactgtaaacacctttctaaggaggtttgctgatgttgcttctgagaaccagaaaactccaaatttgcagattgaatttttgattggctaccttgctgagctaagtttgttggactatgattgtttgatattcttgccttctattttggcggcatcagctatatttcttgctagatttattatctggcctgaagtgcatccttggacttcttccttgtctgaatgcttgggttacacaccggctgatttaaaagaatgtgtcctcatcttgcatgacttgtatttgtcaagaaaggcagtgtccttcaaagctgttcgggagaaatacaagcaacacaagttcaaatatgtagctaatctgccttcccctccacatgtaccaagttattactttgaagaacagtga

SEQ ID NO: 27585 - DNA, 489 bp, Glycine max
  Peptide Sequence Number=SeqID_144363
atgacatcggcagaaatgcagttgagaagagaaaggggcctatgctttacttgtgatgacaagttttcccctagccatcgttgtcctaataagcaatattttgttccacagtgggaagaagaggatgaacctgcattacaaccagatccaccagacgaggttttggttggaaatggaaatgccttcactgctgaaggattaattcaagacttggagatgaaaatccaaggtcatacactgaagctaccagtgtacctacttccagtttctggtgctgatctagtgctcggggctgcatggttggcaacaattgtgcctgatctttcagattatagtactctgacattgaagttttacttgggattaccccctagaagaactcacaatcattcaatcccattggttgaaggtgctggaccagtaaaagtcaagccatataggtatcctcacagccggaaggatcagattgaagtaattaatgatagctga

SEQ ID NO: 27586 - DNA, 1203 bp, Glycine max
  Peptide Sequence Number=SeqID_144364
atgatactccagtggctgtccaacgtcacttccaaccttgttgagcttgaccttagttataacctcttggagggttccacatcaaaccattttggccgtgtaatgaattctcttgagcacctcgacctctcatataatatattcaaggctgacgatttcaaatccttcgcgaatatatgcaccttacattctttatacatgccagcaaaccatttgactgaagaccttccatcaatccttcataatttgtctagtggttgtgttaaacactcattacaagatttggatttgtcagataatcaaatcactggctctttacccgacctttcagtattctcatctctaaaatcattgtttcttgatcaaaatcaattaaggggaaagatacctgaaggcatccgcttaccgtttcatttggaatctctgtcaatccaatcaaactctttagaaggtggaattcccaaatcatttgggaactcatgtgctttgagatcactggatatgtctggtaacaatttgaataaagagctttcggtgataattcatcaattgtctgggtgtgccagattctcgctgcaagaattgaacataggaggaaatcaaatcaatggtacgctttctgacctttcaatattctctgccttgaaaacattgggtctttcacgaaatcaattaaatggaaaaattccagagagtaccaaattgccatctctgttagagtctttgtcaattggatcaaactctttagaaggtggaattcacaaatcatttggggatgcatgtgctttgcgctcattgcacatgcctaataatagcttgagtgaagagtttccaatgataatccatcacttgtctggatgtgctagatattcattggaacgattatatctaagcatgaatcaaatcaatggtacgcttcctgacctttcaatattctcatctttaagaggattatatcttgagggaaacaagctaaatggagagattcctaaagatattaaatttccacctcaactggagagactagatatgcaatcaaattccttgaagggtgtgctcactgactatcatttcgctaatatgtctaagttagaccacttggagttatctgacaactctttagtgaccttggcatttagccaaaattgggtcccaccatttcagttgcgcttcataggattgcgatcttgcaagctaggtcca

SEQ ID NO: 27587 - DNA, 389 bp, Glycine max
  Peptide Sequence Number=SeqID_144365
tttcaatcacacttcgttatggttattacggcgattcatgcatcctgcttggccctgcctcgtcccgtttgatgaagaccagttctgtttttgtgaagcagcttcaagtgtcaaacgaggacaataatcaagttattctccatgccttcaacgaggagcccgagttaagctcccaaactaattggacagtgtcaaatttcttccttgttgaagcgtataaaagcaagggctccaccatccgtatgaggtgggaagcacacactactagtagtttggatcagctacatgggatggtgatcaaaggagaaaagaagtttgaactactacagcctaaacaaacgagcttcctcaatgcaattgctcttcgcaagactgttaatggtaattga

SEQ ID NO: 27588 - DNA, 522 bp, Glycine max
  Peptide Sequence Number=SeqID_144366
atggtgtggactgctgacagctctggccttttgtgggtgagttgggcctatcgtgctttactggacttacagtatccatcggaacattctgtgctctctgccatatggaaattgaatgtggctcccaaaatcaagtttttcatctggcggattgctttgaacagggttgctacaggagaacttgagaaagaggggacttctgctaccctttctcacggtggctgtgcatcaaggattgatcagcatatctggatgttgtgtgggccgcaggacatgttagcgataagtggagcagggcagcacgtatctgagggggacataagtataaggagggacatggtcgactttgaaggtctaacaatggaatcacatgcatcttgttgcaagtgcaaagggaactcattgagggcttcagagtctgacggattttctctaccgttgagggcttttctctgccattgcaaagtaaatgttgtgttgcgtactgttagaacagacaccaacttgggaataaggttctaa

SEQ ID NO: 27589 - DNA, 1431 bp, Glycine max
  Peptide Sequence Number=SeqID_144367
atgagtgctccgtcgcgagaagaggaatcggaggcgaaccggcttctagaagaagcagcatcatcatgggaggaagaggtggcatacgaagcgggggagaagatcctggtggcggatttggagtttgacagggtggacgatgggagcgctcctcctcctttctcgtggaagaagctgtggctgttcactgggcctgggttcttgatgagcatagcgtttttggatccggggaatctggagggggatctccaggctggggccatcgcgggctactccctcctctggctcctcatgtgggccaccttcatgggcctcttgatccagcttctctccgccagggtcggtgtggccacgggccgccacctcgccgagctctgcagggacgagtatcccaattgggcccgcctcgtgctctggttcatggccgagctggccctgattggcgctgacattcaagaggttattggaagtgccatcgccatccaaattcttagccgaggcttcttccctctctgggctggagttctaatcactgcttccgattgctttttctttctatttcttgagaactatggagtgaggaagttggaagctgcttttgcggttctcatcgctgtcatgggtctttcttttgcctggatgtttggtgatgctcaacctaatagagaagagcttttaatgggtattttggttccaagacttggctcaaaaacaattcgtcaggctgtgggtgttgtgggttgtgtcattatgcctcacaatgtattcctgcattctgctttggttcagtcaaggaaggttgatcctaaaaagataggtcgggtacaggaggctctcaactactattcaattgagtcatcggctgcacttgcagtctccttcatgatcaatctttttgtcaccacagtttttgccaagggtttttatggaaccaagcaggcagatagcataggattggtcaatgcagggcagtatcttgaagagaagtatgggggaggagtcttccctattctttatatatgggggattgggttattggcagctgggcagagtagcaccatcactggcacatatgctgggcaattcataatggggggtttcctcaaccttcgtttaaagaaatggttgagggcattgatcactcgaagttttgcaattgtgccaactataattgtagctattgtttttaatagatccgaaggctcattggatgttttgaatgaatggctcaatgtgcttcagtcaatgcaaattccctttgctctaattcccctcctcacattggtctccaaagagcagatcatgggaacctttagggttgggcctgttcttgagctagaaatctctatttccctggttaagaacggttttgtcactctgtctagtttagcagctagagtcaatttgattatcaaatctagatttatttaa

SEQ ID NO: 27590 - DNA, 410 bp, Glycine max
  Peptide Sequence Number=SeqID_144368
ttctgaagttccttgaagtccatgaaggtggtgatcagaatagtcatgcggcagtcgacgtcacatacagaacaagtaatgtagttgcaaggcaaaccgaaactcagcccttgatgcaagtggagacaaatcgattgacatatggaacaaatgcaaaagatgatgaagaagaagattcaggagcatccagtagctcttcagaggagttatatgatgaaaaattgtgttgcatttgttatgatgaacaacgcagtagcttctttgttccttgtggacattgtgccacttgctatgactgtgcacagaggattttagatgaggagagcatagtgtgtcctatatgccgaaggcttattcacaaagggaatgagttactaatactatggcttgggcagagttcatctaattaa

SEQ ID NO: 27591 - DNA, 414 bp, Glycine max
  Peptide Sequence Number=SeqID_144369
atggttagcaaacttttaatggtcggtcggttatcgagtgatagcatcaaaaaatccgaccgacaggcaatggaaggggtgttggacgtgacaaagttcttggaggaacacccgggaggagaagaggtgattctagaggtagctgggaaggatgcgaccaaagagtttgacgttattggacacagcaaagcagcacaaaatatggtcctaaagtaccaagtgggtgtcctccaaggtgccacagttcaagaggtagacttgaaggatgttgtggacaaggaatccaacaccaaagagatgagtgccttcgtgatcaaagagggtgcaaggtctaagtcccttgctttttacgagttctttgttccacttcttgtagctggtctatattttggttaccgatgcctcacttattag

SEQ ID NO: 27592 - DNA, 468 bp, Glycine max
  Peptide Sequence Number=SeqID_144370
atgaaggtgattaggcaggttcagttgaagacacagtcctccgtaggtatgccattgaacttattgggtcttggtgcaggtggaggctgtggcgttggagtaggacttggttgggggtttggtgctgcctttggtagcaagtatcggtcctcacgggtcacatttcaaggagtggattttgataggaaggagaaagttaacagcacggagttgtcaaaacccagcaccgaagttagagaagcctgtggagatagcaattgtgacttccgagtttcgattattgtcctttcaaatcgtagcactacagttctggttgcagctctcatttcttggataatggttgcacttggtaaacagtttgatatgcacgcttcgtttggtgcaagagaaataagcggaaatagagatgagataggaaatggtgtatttgatggtgtggaatttggaaataagaaagaaaaagtgtag

SEQ ID NO: 27593 - DNA, 1812 bp, Glycine max
  Peptide Sequence Number=SeqID_144371
atgaagtcccaaatgaagaaaaaaagagtgaatcccattcccaacactccttgcaacgtggcggaaggttcctgcaggggtcacctttgcatcaagccttgttgtttcttctgcagcatgagagaaccagacgcatctctcagaagggctggaatagcgacctgcttcagagaaatgcctcaagctcagggagagaatcatcatgaacacgtgttggtgctgagtggactatggcacatcgcaatgagccaacccaacgactcagagttcccatccctcggcatattcaagtgcatggcaagtctaatccacaaaggcataaacgacagaaactggcttctcacaaatcaaaacatatacataccctattacgctgctcacatcattggctcttacacaatgaacaaggaggagtttgcacaaaaagccgtgcaatcaggtgtgatacccccattattggacttgcttagtgggaaaatcagttgggttgagcaaagagttgctgttagagcacttggtcacttggccagttacaaaagcactttcgaatcagtagcacagcacgaacaagaagtggtgaaactggccttgaaattggcttcaacttgtttacaagtggtctatgttgacttcgtagctttgaaggaaaacaaaaggctcgagtaccacagaaacttgatgaccagaggggttggggatttggagatggagaatcgcaaggcagaggaatgggctagccagcttcagtgttggtctctttaccttctgaattgctttgcttgcaaagataggtctttggatctcatttgcaaaaaagtgtttctcaaggacttatgtgatatgtggggtgggttgataagtcacacgtcaccagcaggggttggactgataagaatcttgtgttatagcaaagtaggaaggaaaaacattgctgaattaccaaaagttgtgaacactctaggcaacctttcaagatcttcagatgattggcagtatataggtatcgattgtcttcttctgcttctcaaggacccagatacgaggtacaaagttcttgatgttgctgcttcttaccttgttgatttgattgaacttagaagccttggggataaatccaacgtgggtgagaccatctcaaaggttctcctgaatttgaaacctaacagagaaaaagttggagcagcattattgcaagaggtggtggataggaggaacaaggataagctgctctcggaggaaaagttagaggaaacaagggttttggtgagtttgataaagcaacaagcgaaccacatgttcaggttgggagaggttgaagaggcattgttgaaatactctgaagcgctcggtgtttgtcccttgaggtttagaaaagagagaatggtgatatatagtaacaaagcgcagtgtcatattcttcttaagaacgcagattctgcgatcagtgactcaacgcgtgctctttgcctgtccaacccagcaaacactcacaggaaaagcctttggaggaggtcacaggcatatgatatgaaaggaatggcgaaagagagcctcatggactgcataatgttcattaacatgaccatgcgagtgaagattccttaccacgcagcgcgcatgatctccaaacacatggaggccacgtggctctttgccactgctcgctcgaaggtggaaaaaacaacgcaagaattgaaccaagttggcggggataatgagaacggtggcaaccatgaagagcaaccgcgtgatcatgaggcgaagatgatgatgatggaaaacagatacaacaatctcttacacggtaattaa

SEQ ID NO: 27594 - DNA, 414 bp, Glycine max
  Peptide Sequence Number=SeqID_144372
atgaccccttcttataatgagaaagtatataacctcatttcagtcgggtccgacttttgccactcatactttcacttcactgatcaaattgtgttattactgcttccggatttctactgtgttgctgttgcggttactgctccaaggcatttccaacaggtcgccctcgtttgctcaagattccaaactcaacgctggcgactaagcaccatatttgtgcccgtgggacctaacccaacaagttacatgacaacagccatgcagcaccaaaggtactctctttcaagagaaaacttccattccaaatgtaaacttatttcaattgcgaatgttaaccacttgaacaatcaaggagagatccaagggatgcaaagcatggaccttcccgacggggatgatcaaaagaaaaattaa

SEQ ID NO: 27595 - DNA, 2658 bp, Glycine max
  Peptide Sequence Number=SeqID_144373
atggacccatctatagtgaagcttctggaagatgacgaggatgaaagtatgcattcaggagcagatgtggaagcatttcaggctgcattaaatagagacataggaggagatacttcaacttctcagctgtctggttcagacacaggaagcaataattcattgagccagtcgttaccgaagtggccaacttctagccatgacaaccaaagtgactgtcataatcaagagcctaaagttgtgcagcaccaagagcaacgacattcatctgaaatggagcagaagccacagcaacctcttgttgaacaactacataatgttgcttccaaggatgcgattaatctcccttcgtctcagaaacaatctcaagatgaaagtgttcaaggccatactgtacaagctccccaccaaaattctcaaacaaatggaattcagaattctgaaaaagatcctgtcttcaaccatgaggcagtcaacacacataattccaatcatggatctcagtatgcaaagctgcagcagatgagtaatcaacaggccaccgtcaatgaacagcctggaagtcaggtcaatcggaataaacagaaagatgaaatgcccaaagatcagtttgtgcggcttatgaaaggtattgtaggggatcagatgcttagattagcattaacaaaagtgcaattacagacaagatccaacccaggacccgctgggcagcagcatcctcctgtaaggatgccaaatgttaattcaggtgcaacaaaatttaatgatccccatgcattagcacagctgcatcagagaagtatgaatgccgctgcagatcaatctaataatacttcttcagccgtccaagtaaagaatgaaccaacctatccaactatggaaattaatgctaaaaaatctcagaaactggatgttcaagtagaatctgaaggagtgcaactaaatcagttaccatcatccagttctaatgctgttagtcaagaaatggaaagatcctcacttcacttacaaggccttaataaggagcaacaacagcatctacatttcccttcagcatatggtagcagtggtggtaattataaccctttttcgggctcaaccagtagttccacatcatctctcagaccacaacctcttgattcacacatgaggcaaattccacatcagagcatcagtccaaaccaattaggtgggacaacacagggtttgattggtttaacaaaacttgaccagcaaaattctttcaatgatcccaagagaatgcctggtggatttgtgtcccctatggtaaacaatacagcatcacaactaactacaaattcttggcaaccatcagcaaacaaagaacaaaattcagcctcgttttcatctgttccatatgtaaaaaaggagcctaatgacctgtctactgagcagcaacacaggcataatgtgtctaatcaaggcaccctaaaggaggagttttcaagaggccttccagcatccacaagtatgctgcatacaacatcttctagcttgcttcctctcaattcttcttccccttctgtatctcaacttgaccccagtgccactttaagctctcagatcccatcaaatacatctgttataaatgcaaggacacctctgaaaaaaccttcccctggccagaagaaaccaattgaagcacttggttcttcacctcctcctccaagtaagaaacaaaaagtgtctggggcatctctcgagccaagcattgaacagcttaatgatgttactgctgttagtggtgttgatcttagggaggaggaagaacaattattttctgggcccaaggaggacagtcgagcttcagaagcatttcgcagagttgtgcaagaagaggaggaaagactgattttgcagaaagctccattgcaaagaaaattgattgagattataactgagtgtggcttgaagagtatgagtgatgatttggagagatgcttgtcattgtgtgtggaggaaagaatgcgaggagtaataagtaatgtgattagaatgtcaaaacagcgggttgatttggagaagacaagacatcggactgttgtcacttcagatgtccggcagcaaatcctaacaatgaataggaaggcaagggaagaatgggagaaaaaacaggctgaaacagagaagctgcggaaactaaatgatgtagattgtaatgctgggattgatggtgacaaggagaaggatgagggtcgcactaaagcaatgaaggtgaacaaagaagtggatgacaagatgaggacaaatgctgctaatgttgctgcccgagctgctgttgggggagacgacatgctgtcaaagtggcaacttatggctgagcaagccagacagaagaaacgtggagggggaatggatgcttcatctggttctcagccagctaaagatgtgagccacagatcttcatcaacatctggaaggagtacaaaagataatcaagcaagggagaaaaaaggtccaacttctggggctggtagaaaatttgggagaagtcatgccacaacacctcaaactagcatagctcgaagcatatctgtcaaggatgtgattgcagtcctggagagggaaccccagatgtccaaatcatcactcttatatcgattgtatgagagaattcattctgacacctcaactgaataa

SEQ ID NO: 27596 - DNA, 558 bp, Glycine max
  Peptide Sequence Number=SeqID_144374
atggtcttcctctatgataaagattccccgaggcagcaaaaaagaaaaagcatgagctgcaatggttgccgagtcctccgcaaaagatgcagcgagaggtgcagcctgagatcctccctgaactggatcgattgtccgcatgcacaggcccatgcaactctcttcctggctaagttcttcggccgtagcgacctcatgtttttcatctcctccgtcccactaaacaacagacccgcgctctttcagtctcttctgtttgaagcgtgcggacggaccgttaatcccgttaacggtgccgtcggactcctgctgagcggtaactggcacgtgtgccaggccgccgtccacacggtgctcgccggaggcgttctccggccgctgtcggaggttgtggcgccatcagaaagcatgttctctcatcagttccagtctctggcgtcagattctttgaagagaagcagcgatgcaacagcaccggttatgtcgaccatggtttctggagaatcagagatttgcagcagcgacgatgggaaaaagcttttgaatctgttcgtctag

SEQ ID NO: 27597 - DNA, 264 bp, Glycine max
  Peptide Sequence Number=SeqID_144375
atggtcgggactgatgataggaataaagagaaaataacaacttttgacatcatgggggtgtgtgagagaaagagaaagaaaaaagggaattgttcagatgatgttgattccaatagtgttgagaaggtagtagctatgtgggagatgagactttcgttgaaacttctgcttgctgccttgaatggaaaggattctgcagtagctatgtgcagattctgcaggctcatgggtactacctctgctgagctgttgttgaatcggtaa

SEQ ID NO: 27598 - DNA, 770 bp, Glycine max
  Peptide Sequence Number=SeqID_144376
caccctcaccggcagaggaccacgtgtcctccccttcaggtggctacacgccctcaccttcagaggactacatgtcctcgcctttagagggctacacgccctcgcctttagagggctacacgccttcaccttcagaggactgcgcgtcctcacctttagggggttgcacgacttcgtcttcagaggactacacgtcctcaccttcaaaagactacacgtcctcgtctttagagggctacacatcctcgtcttcaaagggcgacactccctcgcctttagaggactacacatcctcgcctttagaggactacacgccctcgccttcagagggctacacgccctcaccttcaaaggactacgcgtcctcacctttagggggtttcacgacctcgccttcagaggactacacgtcctcaccttcagaggattgtacgtcctcaccttcagaggaccacacatcctcaccttcaaaagactacacgtcctcatcttcagagggctacacgtcctcgtcttcaatgggcgacacgccctcgcctttagaggactacacgtcctcaccttcagaaggctacacgacctcgccttcagaggactacacgtcctcaccttcagagggctacgcgtcctcgccttcagaggactacacgtcctcaccgtcggaggactacacgtcctcaccttcagaggactacatgtcctcaccttccaaggactacttgtcctcaccttcaagagggctgcacgccctcaccttcagaggactacat

SEQ ID NO: 27599 - DNA, 771 bp, Glycine max
  Peptide Sequence Number=SeqID_144377
atgtcgaatcgatctagtcagggtagacaacatgacaacaataacaacaagggtttcgccaaaacccataatcagaagaaattcgtccccaaaaaccaaagtcaaaatcccaatcctaacccaactccaaccctctcaacctccctcagacaaacacaaccaaacagagggcagaaggggaatttcgttaaatacttgccgcaagacgaagctgtggcagcgggtctcggcgccgaagatggagcattggatcccctcgaatctcagagagtcgtagatcttttgaacacacagctatctcgcttgctcaagttgaaacccaagcaattctggacacaagtggctactgacacctccctgcatgagcttttggacagcttcttgcagttcaggagcaggtggtatgatttccctcatcgcggggtgcaagggattgttgccggtgttattgttggggagctcgagttgagtcgccgcgttttcatggtattgtatcgcatttcttcgaataaagaccccggtgcacgacctgtggatgctctcagtttgagagaccatgaagttcccaatcgcccatataactggcttgtagttgataaaagtggtcagttacaggcaaaggtggagaagaagttgcttgaattgccgaagttgttggatatatgtgccatataccatcatgaaaatgaagaactgacaagatcactggtgcataatcaaccaactgatatgacattttctgtggaatggacagaaccgttattatcatga

SEQ ID NO: 27600 - DNA, 1662 bp, Glycine max
  Peptide Sequence Number=SeqID_144378
atggactcttttgttagtgtatacgaaccagcagctgttttcttctcttgcccagtagaaatgagttatgggaatgaggaactgctgagcctccttgccagattgcatgattcactaattccatcattgcaaaagggattccgtgtgatttttgctgacaaacaagatgatacagtatctaatgtcttagtaagtttgaagatgttaaaaattagattggtgaagtttggttggcaactattgcacttgtgctatctaagtgatgaagtgttcagagatagcatccctcttccagctgccacaaagatgtttcctgccaatgtagaggacccagtcatcagagcagatattctggttcaaacatttagagagatcaattcgatatcattacattctcaggaaagccatctgaaggaaacatttcttcaagatgttgaaagaaatttcaatatactaagcaggattgagagattaagggatggtggatggatattcattgatgatgaacagtttcaatatatatctgggatgttgagttctgtttataaggagccgtattctgcctcaacccctgcgccaaaccaaacattgctgatggatgaagatgctgcaatttcagagtcaaacatcagtcagattagggacctgttccctgattatggtaaaggttttttagctgcgtgtcttgaggtctatgaccagaatccagaagaggttattcaaagaattttagagggaacccttcatgaagatctgcagaacatggacacctcactagagacattgccaccagccaagtctaccactgtgggtgggaatgataaaggaaaaggtaagttaattgattctacgccagcatcctcaaatccagaagttgttagggggaagcaacaggcagagggcccagtgatgtcatcctctgcttcactgggaaaatttgtgaggaaatctagagctgacttgcctgatcgcagtattctggataaaaaggatgaaaaagatacatcaagaactgctgctatgattttacaatatgaatatgaagatgagtatgatgactcttttgatgacttgggtctaagtgtagcagattctggagtagaagaaaatgagacactgggtgaccaaataaacgcaaagtcagggaattcgtgggcaacagggagtggaaactctgtcaaaaatgcccctgattcaaaatggggctccaggaaaaagccgcagtactatgtcaaggatggtaagaactacagctacaaagtggctggtgcagtagcagtggcaaattctgatgaagcttcgttaataacgcaagctcagaaagaattgatacatggccttggacgtggtggcaaccttcctcttgacgcggtaaagaaagtgactgattcctacaaggaggatgataaccaatcccaggtttctgaaatggaagggagagggatttcgggcaattcgtttggtaggggaaggaaggaaggtggaaaacaagtttcatctcatcagcaacaggagaaacaatccgatgattccgaggtggatagcaataatcaaagggggagagggagaggaagagggaggggaaggggaggaggaagaaacaatcattaccagaaggaccgagccatgaagaagcatttctctggaatgagtggttattaa

SEQ ID NO: 27601 - DNA, 939 bp, Glycine max
  Peptide Sequence Number=SeqID_144379
atggatgatctttcatccagccttctgtgccaagaaaacgaaacgtgtttggaagaaggaggtgaagaattagaataccaattcgttggatcacagcatgattgtggggtttcagaggatgaacatgtgggaattttgattgagagagagatcgttcttgggttcaaaaaggatgaaactatggtgattggggactgggtgaaacgtgcacgcatggaagcaatcaattgggttctcaaaacaagagcaacactgggttttcgcttcgaaacggcttatttgtcagtcacatacttcgatcgatttcttttcagacggtccattgatagtgaaaagagttgggcaattcggttgctatcaattgcatgtctctctctggctgcaaagatggaggagtgcattgtgccggggctatcagagttcaaattggatgattattcctttgagggaaaagtgattcagaaaatggagcttttggtgctcagcacattggagtggaaaatgggaatcatcactccatttgatttcctttcctatttcatcagaaaaatctgcaaagaatccccaccaagtcctattttttccaagaccatgcaactcatcttcaccacaatgaaagaggtcaatttaatggatcacaagccatcagttattgctgcggcagctactttggtggcaatggatcagcaattaacgatagatgcggtggagttgaagatgagttcaattccacaacataggcttctagaatctaaagatgtatttgagtactacaatctaattcaaagattatacgaggagaataccaaaagcgacacgcatacgccaattgagatgacagagagctcccgagttacttcttctgcagcaatggcaaagagaagaagactcgcattcagtgatgatgaaggaagtagtcatgggaagggaccgggctag

SEQ ID NO: 27602 - DNA, 1080 bp, Glycine max
  Peptide Sequence Number=SeqID_144380
atggaccccagaatctggagcaaactacctcctgatgttgtggaacacatacttttgttactccctctcaaaacactcttgaatctcagacccacttgcaaggccttcacctctctcctcttttcaccttcctttgtttccaaacactcttcttcttcttcctcacccttctcttcctatctcttaatttcccaccctcagtgccctcactatttccgtctctacgattccaacctttgctcttggcgcaccctctctctatccctctctaactctctccacttatctgcttccttcactcttgtttcctcttctggtggcctcttttgtctctacaaccccacctcttcttcctttcttgtgcacaacctctttgtcaggtcctctagaaaaatcgaatccccaataactcgctctcgtcacttgggacatgtcacttttgttaccacccctcttggctactacatagtgcttctttgttcaaagtcaacttccaacaccagtgtctttgtttacgactctagtaaactctcttggcggtgttttgagggttttaatgttgttttcagcgacagttttcaccagcagggtactttctttgatggggggttgtatttcaccacccctgaaccgttttcggtggtgttttttgatttggagagtggtgaatgggagaggtacgttgctgagttgccacaacaagtcactttcgtgaggctggtgagtgatgaagaagggaagttgtatctgcttggtggggttgggaacgatggtatctcgaggagcatcaagttgtgggaattgataaagggtgaaagggtttgggtggaagtggtggggttgcctgagattatgtgtagaaaatttgtgtcggtttgttaccataactatgagcatgtttattgcttctggcacgagggaatgatctgcgtttgcttctatatgtggccggagatattgtattacagtgttctgaggaggacttgggattggcttccaaggtgcccctatttgcctctgaaatttagctgtggtttcaagtggttttcttttgttccaaagctctatgcttcggtatga

SEQ ID NO: 27603 - DNA, 273 bp, Glycine max
  Peptide Sequence Number=SeqID_144381
atgttgaaagtgtattttctaatagtgaacaaccgatgtagaatgaagggaagacattctacatcggttataggcacaaccgatgtagaatggttaagaaaaatcgacattctacgatggttcgtcgctaataaccgatgtggaatgtcttcctttctacatcggttttacttaataaccgatgtagaatgttcaccattctgcatcggtctgataactgttattgaaggacgcgagactttcaacatcgtcttctacgatgacgcgtcataa

SEQ ID NO: 27604 - DNA, 1032 bp, Glycine max
  Peptide Sequence Number=SeqID_144382
atgggacctggtgttggagccttccctgatggagaacgggattgctttggcaaaatgttggccaatgaagcccattattgctcaccacaattacttgaggaagatgatgggaatgttggaatgcaatccatgttttgctccactcttgatgttgggggaaataagaatatgttttactcttttgactctcacaactctagtttgcagtatatttctcaagaaagcagtcacaataatagcacttgttgtggccatagtgtcttcatggccaatccggaggatcatacaaactaccattttggtcatgttgatcatgtgctagcaaatagtacatccatggatttttgcatgatagatgagaaaaaccctggctcttttgtccaatctgacattgtcatgaaagagaatgccagtttgaatgaagatgagggaagtgacaaatcagagaatgtttttcctgccaaacatttgaagttcaaaaggatgtctgatcatatgcccgaactcaaagtgcatgtagaagataaaataaactcacatgggaatggtaacaaaaaacctcgtgtttcaaaagatgagcagcattgcatgaagaaccagaaacttgacaaaattgggaaccaggcagaagagattaatgcaggttcagatggacacagttctagtagttacactcgagaggatgataatgcttctgctctcaacttcaaagggaaaacaaaagctagtaagggatcagcaacagatcctcagagcctttatgcaaggaaaagaagagaaagaatagatgacaggctaagaattctgcaaaatcttgtccccaacggaacaaaggttgatataagcactatgcttgaagaggcagtccaatacgtgaaatttttgcagctccagaacaagcttataatggacttgacctcgtactcaatctcaatcctaagagttctccacctttgtgaccttataaacatcgcaagagatgtcgaagttccacttaattggggaattaaagggaagcttgaaggcatgtaa

SEQ ID NO: 27605 - DNA, 714 bp, Glycine max
  misc_feature (6)..(6): n is a, c, g, or t
  Peptide Sequence Number=SeqID_144383
gggganacgcctggtatctttatagtcctgtcgggtttcgccacctctgacttgagcgtcgatttttgtgatgctcgtcagggggtcggagcctatggaaaaacgccagctacgcggcctttttacggttcctggccttttgctggccttttgctcacatgttctttcgtgcgttatcccctgattctgtggataaccgtattaccgcctttgagtgagctgataccgctcgccgcagccgaacgaccgagcgcagcgattggggtagtcccttcaacgctccaccaaaagttgaagtttgtggtggaagggcatttgatcatagtctcgggggaggaagacattcttgttagttgtccttcttctacaccctatgtggaggtcgcagaggagtccttggagacggcctttcaagcattggaagtagtgagcaatgctcatgtggagtctccccaagtgcaactgccctcatccgatgctgcattgatggtagcccgtgtgatgttggggcatggatacgagcccagcatgggtttgggctggaacgaagatggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 27606 - DNA, 381 bp, Glycine max
  Peptide Sequence Number=SeqID_144384
atggatatactcttttttatcgtcatggggctgattgtcctggtgtttggtatctatcccatggcccgttttctttatcaggatttttacccgtatttaaaggatagtttcacccacagtgaggtcctgcaatccggcattgcggtcaacgcggatataattgccgcacaccagaccagcgcctggagcggaagtaaaccgatctatcgtatcacctttaaatttaagacccgcgagcaggtggaagttcaagctagcctgaatcacaccctgaatttcagcgacattgaacgttttaagccgggtaatggcacaacgattaaatacgatccggcgaacccgcagagaattgcgctatacgacaggccgctttttttgtaa

SEQ ID NO: 27607 - DNA, 657 bp, Glycine max
  Peptide Sequence Number=SeqID_144385
atgcgtatccacggcgatagtaggccagccaaacgcggtgttcagcaccacgatccggcaggtcttaatgacgttctcggctttgctgttaaacaggccgatggttttgatataggacttcacgccttccacgcccagctccagcatggcttttggcgtattggcgaccggatagagcagggctgtggctttattgacgctcacatcggtcgcctgcgcagagagcagcaccgcgatcagcagctcaaacggggaggtaaagttcagctccgtcgtcggatgcggaacgctacgctcggccgcgcggcgcttacgtttctcatcaatcaggtattttatcgccagcatcatgccaaggccaataaacgcgccagggggcagcattgccagcaggaatggcgtatcggtgtggaacacttcaacgcgcagcgctttggcccagctgcccagcagcgcatctgcgccgtcaaacagcgtaccgttaccgaggatctcgcgcagcgagcccagcacgaacatggcgcaggtggcgcccattccaatggaaaaaccatccagcgccgacatggcggggctgtttttcaccgcgaacgcttccgcacggccaacgacgatacagttggtgacgataaggggaataaagatcccgagcgactg

SEQ ID NO: 27608 - DNA, 126 bp, Glycine max
  Peptide Sequence Number=SeqID_144386
atggatcttcatggagggagtttgtcaacagttagcacaggagcacaagcaattccaggacattcaacacgagatgatggacactgcaagttttggtactgcattgatggattttctgacagatga

SEQ ID NO: 27609 - DNA, 126 bp, Glycine max
  Peptide Sequence Number=SeqID_144387
atggatcttcatggagggagtttctcaacagttagcacaggagcacaagcaattccaggacattcaacacgagatgatggacactgcaagttttggtactgcattgatggattttctgacagatga

SEQ ID NO: 27610 - DNA, 282 bp, Glycine max
  Peptide Sequence Number=SeqID_144388
atgtcaaatgaagaattgaagttgcaggatccacgatgtcggatacaatgtcctgacatcctgcccgaaaatactggagttgctgcacaatgcataagtcaagataaaatgtcaaatgaagcattgaagctgcaggatccacgatgtcggatacgatattttcaggaaaatgatagatctcatccagcacaagccgttgcagcccagaaacgcacactgctatataaccatgaaggctgcacgagttctgtaccaagtccgggattgaagagttatttgtga

SEQ ID NO: 27611 - DNA, 451 bp, Glycine max
  Peptide Sequence Number=SeqID_144389
atgcagtcccatttgcaatcacagatccaatcacagggacttgcactgcctccaaagcctgaggttggtccctcagctgctcgtgtcagcacaaaggggagttgtgttgatccctcaacgaccaatctagacacgggtgactcagacaaatgcgggttgtacattgaaaaaaatccttcccgcctggttgccctaggaagagtttatgagggatccacaatcgttcacaacatccctttgttgaatggccaagtgaaggtttttgttgaggaggttaaacatgcatatgctcctgttcctgtacccactagcgaggtagctatgtatccagcaaaacctgcaaatgggtcggatcctcaggttacgtgggatgctaccgtgtttgaggtgtttgatgaagacttccccttgtacataaagcatgaagatctgtctgaaatagcacacgatg

SEQ ID NO: 27612 - DNA, 162 bp, Glycine max
  Peptide Sequence Number=SeqID_144390
ctagttgctcactcacttgctcccccaggaattagaactattcctccaagtcccaaatggctatcaacttctcatggatgtattgaagcgcatttaacagacaacagtgaaccagtaggattcatcatcacaaaaatagatgaattctggcaacttaagcag

SEQ ID NO: 27613 - DNA, 403 bp, Glycine max
  Peptide Sequence Number=SeqID_144391
atgggtcaacgtcacgcggagagcgaccacgacgcagtgatcagcgatacggcgattccgctgaggttccagaccgccgaggtcggcgtggactggcttcagtgcaacatcgagtgccaggaaggctgcccggtcaacacgaactgccggggctacctcatgctggccgccgagggtcggttcgaggagggctacatcctggcccgcgatccgaacccggtggcagccatctgcggctacgtctgctcggcgccgtgcgagaaggcctgccgccgcgcggacatcgacaagccgctcgccatccgcgcgatgaagcgcttcctcgtcgactggcactacggcaacaacatgccggacaacgtcgtcgtgcaggcgccgacgggcaagagcgtggccgtcatcg

SEQ ID NO: 27614 - DNA, 339 bp, Glycine max
  Peptide Sequence Number=SeqID_144392
atggaaattatacttttgtacccaagtttgggttttgtcaaaaagaagttgaggtttaagttgaggatgactgtttttgtatgggtttgggattataaatttatggcacgtgttgctgataaaataaaattgatagacggatcaagggaagctcttaagctttctataaggattactgatctttggtatattgggattcccggaaagactgaacaagtcgaaatggtggttattgattctgatggagacgaaatcgatgttgtttgcaagcaggatcagctgaagtctcgcaaggctgatttgaaagaaaatttgacttatgtgatgcataattttaaa

SEQ ID NO: 27615 - DNA, 633 bp, Glycine max
  Peptide Sequence Number=SeqID_144393
atgggtgaagcagaggaggtgcaagagcaaatgaaggccgacatggaggtcatgaaagcgcaaatggccacaatgatggaggccatgatgagcatgaagaagataatggaagccaatgcggttgcagttgccactaccagtgctgttgctaagtacgaatggccccatgatgtgcaaattcaaaacgagcttgccttcccaccatatggcttgcctcccaactatacaccacccaatgtggcatacactcccaaagaggatgtcaataactccactcccatactcattgagagccgacaacctcatcatgtacatgtctctcaactcatgggggagacacatgaaattccccaccacaatctagctgactccgagccttgcctcggatatgccactgaagggcaagcagttggtggtatacccctgcaaaacactttggaggggcctcaatttcgcccccaaccacaacccttctatggaaaaatggtgggttacacaccttcaagctttgcggatttggtcttcaccggccaaaggatcaaaatggagagcattgttgcacgatccgtgaaattccgtaacatgccggaaatcaaaaggaagcattgttacgcaatccgtgaggttccataa

SEQ ID NO: 27616 - DNA, 258 bp, Glycine max
  Peptide Sequence Number=SeqID_144394
atgaccttggctgccttggccaatctacgacaagcagacgatgaatccctcagaaagttcattggcaaatttgggcgcacagtcgtccagatccgaaatctcaaccctgagataaagttgcattccatgcttctcgcactacaccctagcaagttcgtagataatttgtgcaaaaaactacctggtagcatggatgagccgcacgaacgagccaagggttacatccagatagaagaaatgtccaaattctggaatgaa

SEQ ID NO: 27617 - DNA, 249 bp, Glycine max
  Peptide Sequence Number=SeqID_144395
atgagacctactggtggcgtactgcacactgaatcgttcgatgagggtgtcgaagctatctatggatcttggaaggcgtccaaatgctcgtctggatctgttgtctcatcataccgctcgaggttaagtgatttccaccccaagggtatgtctacctccataacgcggtcgataaaaggatgtcaatggacagtctgtgttgttggacgatgcatgagagagactcggatcgtctgcagtgttgcttga

SEQ ID NO: 27618 - DNA, 303 bp, Glycine max
  Peptide Sequence Number=SeqID_144396
atggcgctaaagcgcgcgtcctataccccggccgtcggggcaaggaccaagcccccgatgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggtga

SEQ ID NO: 27619 - DNA, 447 bp, Glycine max
  Peptide Sequence Number=SeqID_144397
atggcatttgatgaagcgggtatggaaataaagcttcaattgcaagaacttgaagagacccgcttagaagcccctgagaactccaagatttacaaagagaaattgagattaaaaatgaagttaccggcaaagtcttcaaagagaacggtcaccaactcaagctttttcattatagcccccaagtggaggaggaatttgtggtggacttgtctttggtcttgccaattttatgtgatgatgtgccttgaatggaacttgaggagtttccttcccttttcttttatatgttgtctctttgtttgtgtcgcaacctacccttcggtgggagggcgacacgtgactcgcgggttcgtgtcccacgaaaggaatacgcgcggagtcgccaccaacgtttatttgaggaaaacgtcagaaaaaaccggaaaagacatgatctacgaaccctaa

SEQ ID NO: 27620 - DNA, 435 bp, Glycine max
  Peptide Sequence Number=SeqID_144398
atgttaatgtgtaatgatcaattttcgtgtgttggtccgattgagttattatgcaccgttggaagaacaccagatgaagtaataaacttacttgaacgcactacgacccctactcatgacgcgctcttgtattacaacgggagatggaacatgccaccccagaacaaatttgtaggatgcgcgttcataggaaaaaatccaaagaaatttgaaattccttcaggatgtatccttgatgaactgaaggatttgataaaacaagttgcacctaaagggattccccctcatggaattcacgaatcacaagcggtaagaagattgttttttcggcaaccagaacgttttgagtattcagataaagttgtaaaatatgaaattaatgagctgaaaaccaacgatgaagtgctgaaggtattagcacaacctaactactag

SEQ ID NO: 27621 - DNA, 282 bp, Glycine max
  Peptide Sequence Number=SeqID_144399
atggtgctttccaaggcagcgttctttcacaaaaagtatttcaatatctacacaaatgagatgccatcatcaattagagaatatgtaaccaagaacaggaattgtgaagatattgcaatgtctttccttgttgcaaatgctaccggtgcaccccccatatgggttaaagcggaaaagttgcgccttggtgatgggttcgaatccataactgcatataatgaccctcccatatgtaaggtaaggctgcgcataatgaccctttcccataccttggcacagtga

SEQ ID NO: 27622 - DNA, 216 bp, Glycine max
  Peptide Sequence Number=SeqID_144400
atgaagcttcattgtaagaactgtgatgacgagagtgatgagcaaaatgatggcgacagcgatgaagtctatttcgttgaagcctttgggaagagacggcaccgtgaggcgccatttggtggaggagattccgattgtggtgccaaggtacaccgtcaagcctctggcgacggtgacattggaaagcacggaccaaagggtgctaaggctggataa

SEQ ID NO: 27623 - DNA, 492 bp, Glycine max
  Peptide Sequence Number=SeqID_144401
atggacatcctagcactcttgatcttcggggtggtcctctttccaaatgtggatgggttggtggactgggcagcgattgatgcttttctcgccttttacgaccgtaaggaaagcttggttgtcgctatcttggccgatctatatgacacgtttgaccgaagatgtgagaagagcaatgcaagaatcgtttgttgtacaccgaccctctacgtatggtggttgaaagcctacgcgcaaggtctggattggcttccgaatttgagaactactaaagtggtggagggtgaagctccgaaagaagacgaacaggtacaagccctcaaaacaaagcttgagagagcccaaacaggaaaagaaaaattcaagtcagtgactgttaggattcgaaaagggaacgctgaactgagagacatcaacatagccatcaccaaggccttggagcaagagaccaagagggcccgcaaggaagaacatggccggaacaagttttga

SEQ ID NO: 27624 - DNA, 303 bp, Glycine max
  Peptide Sequence Number=SeqID_144402
atggaagtgctatcatatagctttgtatcgactaagtcacgagttggagataagcggactcgaaccgctgacatccgccacagggatccagctacaggagaaccgggaacggagagcttcccccgccccccttttttttccgcccgactctttgctcttaagaatactgggttctatggtcggtccgcgacccctggatgccgaaggcgtccttggggtgatctcgtagttcctacgggggagatagtgcatcaagctgttcgcaagggccagcttgatcctcttccccaggatcccaaatga

SEQ ID NO: 27625 - DNA, 692 bp, Glycine max
  Peptide Sequence Number=SeqID_144403
aggttgcttgttgggtgtccaccgaggagagacaagcagcaagaataagaggcttatacctcagagcaattttatggcaagatatcagcttctttgacaaggaaaccaatactggtgaggttgttggaaggatgtcaggtgacacacttcttattcaagaagccctgggagagaagtgtgtggcatgttttttaggacgtttagtcatagcattcatcaagggttggcttctaacccttgtccttctatgttgtattccacctcttgtaatctctggttccatgatgagctttacttttgcaaagttgccatcccatggacaagcagcttattctgaagcagcaactgtagtagagcgcacaattgattcaattcgacaagttgcatcatttacaggcgagagtcaagctatagctcaatacaatcaatccttaaccaaagcttacaggactgcagtgcaagatggagtggttgctggtttaggcctgggcatcaaagaaaacattgcctatggtaaggatggggcaacaaatgaagaaatcagagctgccactgaagttgctaatgcagcaaaattcattgatagatttccacatactactacagcatcaggaaccaggaaaagtgaactgtttgtggctgatgtcaacacccagttgaagaacaaaaacatcactactgatatcaaataa

SEQ ID NO: 27626 - DNA, 1107 bp, Glycine max
  Peptide Sequence Number=SeqID_144404
atgtcaatccttgccctcggaagaaaacaaaaaaagaaagtttccaatcaaaaaagtgggagaaaacaaaaagagaaaattcccaatcaaagattgagagaaagcaaaaaagaaaggaaagaaaattcccaatcaaggattgaaagaaaacaaaagaaatatgcagaaaggtctttagaccagacaacatctgacaaatacagagttgtcaccaaaaaacaccgagactattttagtctcacagttatccagaactacgtatgtgtgagttcctcattgaggatacgtagaagcaagagcctcgcttttgtcggccaccccacaatctttgtcatactgaccctgcggtcatgtgacgtgcagagacaaattatgggttttccaggtgggccccaagatacattagtgttgacatcatatgttaatcatgtggtagccaaagtgtgggcaagagaggaacatactgagttgaagttggtctctcgtaggaggaaggtcaagaaattaggaaagcctacacttgaaattgaaggtttagtggctggtacaagcttaagttctctaaatacatgttcattggacatagaagacaggggacttttgtatacttttgcagacaaatggcataaggaaactagtagcttccatatgctcataagagagatcagcataaccctcaatgatgtggcatcagtattacatctacccattataggtgttttccatacctatgatgcaatagatgtagaccagattgtggagttgctagttgagttgcttggagtgactacacaaaaagaagtagatgagatacaacaatgtaaaggggcatgtgttcgccttgcctggctacaagacatttaccgtacgaaatgtctcacaaggcaatggacactagcaactaaagcatatttgttgcatattaaaggttgctcactgtttgttaacaagagttccacacatatcggtgtggttggggagcctcttagacatccacccatggtgcaacatcatacaatagttatgccacatctacctgtattgcctgatgatacagtagcacctattgatgttgagatgcctcaactatgccacatccacctatag

SEQ ID NO: 27627 - DNA, 309 bp, Glycine max
  Peptide Sequence Number=SeqID_144405
atggagatgtcagtgcatttccctgcgtgtgatgtagccatagtgttgggttgccgtcatccacccctgccgtcactggctatgattatgccacatctatctatgttggctgatgatacaacaactatgccacatccacctatagcagcacctgttgatgctaagatgcctcaacatgcagtggttgtatgccaaaagatagcaaaaagattgcaagatatgttagatatgaggatggtgattgttggagtgtcattgagtacaaaaatgtttatgttcggtcaagacgaatacacaggggagaaatga

SEQ ID NO: 27628 - DNA, 222 bp, Glycine max
  Peptide Sequence Number=SeqID_144406
atggctcagctgcgcctcgccggcgtcacgctgctcaaccagagcgtactgctgcgcgacgtcaacgacgatgccgacacgctggcggcgctcagcaacgcgctgttcgacgccggtatcctgccttactacatccacgtgctggacaaggtgcagggcgcggcgcacttcatggtcagcgacgatgaagcgcgcgccatcatgcaggcgctgctgagcaag

SEQ ID NO: 27629 - DNA, 252 bp, Glycine max
  Peptide Sequence Number=SeqID_144407
atgcctaaatcatctcccaacatgcatgtgaagcaagaagtatcaacaagagtcaagccaaggctattatgcaagcaatcaatggggaaaaacacaccgaataaaatagatgatgatggctcaaattctcaccaaggagaaaaacaaggatttcaatttacaaaatgccaagaaactcctatttcaaaaacaattaccaattacctgtacataacctataattcaaagagaaacatgcaatgttgtacataa

SEQ ID NO: 27630 - DNA, 174 bp, Glycine max
  Peptide Sequence Number=SeqID_144408
atgacaagctcaggtgaatcacttcatatggaaaactctcagctaagactccaatcaaagggagttcaatgctcaagtaatagctgctatgatgacggaaactttgaaaatgagttcatattttcttggactgtgcccaggccaaacgcatctgggaagcttaattgccactaa

SEQ ID NO: 27631 - DNA, 390 bp, Glycine max
  Peptide Sequence Number=SeqID_144409
atgtcgcaactcgctacttactacgtcagcaattcaacgacggtttcaaagaaacgtcgtagaagctcaaccggtggcatatccgtaattaagggcttcagaacgacgacgtttgccgctactcgtcgtagacatccagctgttgtggcgattcctactcattatttcttctccgacaaagaccatcgtctccgacaaccaccatctcgtgtccgttgcgtctcgttccgtttgaagccgccgccgacaaaggcccttggttgttgttggttgtcttcatcgtggtctacattgtactgtttaaggaagataagctggttccataagcgtttcagtggggtttatgtggggctcgttgatgaagctgacttgcgggcagtgagtgaatga

SEQ ID NO: 27632 - DNA, 642 bp, Glycine max
  Peptide Sequence Number=SeqID_144410
ttcagtccacgagttgcaggatcagccaccggttatacagaacagccggtgggctagccttcctctggagcttcttggtgatgttattaatagattggaagcaagcgagagtacatggcctggtcgtaagcatgtggttgcatgtgttgccatgtgcaagtcctggagagaaatgtgcaaagaaattgtcagcagtcctgaattttgtgggaagattactttccctgtttccttgaagcaggataaatggcttcctctccacactcttgctgcatgtggagaattttaccttttagattctctgttgaagcacaatgttgatatcaatgttctgaaaaatgaagattcagggccattgaaggaatccacatccttgattgagcaccgtaagtgggatggattatattgtcttccttcggagaagagtgagattgtttcagatgagtatcttcctacaaatgatccaaagtctaacaataatataaatgatgaagctgcagaactagtcaagctgacagagcaatcacttcttctcaagaaaaggacaaaccaaacaaagcccaggcctatagtagtgagattggatgatggagatgtggcaccaatttcagtcaaaagaccagagccaatggatgatattgt

SEQ ID NO: 27633 - DNA, 312 bp, Glycine max
  Peptide Sequence Number=SeqID_144411
atggcacttcgacacttgtggtgccagctgggcatacattttttgtgcgccaaacaagattccgaggtccctgccaatctcaaaaacttgatattcagtaaatttaactgcttgaggatgcagattatgggcaacctacttgcacctacgaaagatgcatggaaaaaatgttcaggaccgtggctttatttccttgacgttcgcggaatgacagttcatggatcaggagtaatcaatggtcagggacgagattggtggggcaaaccatatggaactggagcatgcagccacatgcctacggttagaacttag

SEQ ID NO: 27634 - DNA, 606 bp, Glycine max
  Peptide Sequence Number=SeqID_144412
aaaacaccgagactttttccagtctcacaagttatccagaactacgtaggtctgagttcctcattggaggatacgtaggagcaagagcctcgcttttgtcgaccacaccgccttttgtcgccataactcaagagctggtagcccgcggagacaccttacggttatccgcacctcgtcattcagtgaccccaagtgtgattgatgagcagaggccaatgtggtcatctggccttttccggagatgtcagcattttccgatggagacttttcaagtctcacaagttatccagaactacgtaggtcatgtgacatgcacccatgatacgcggagataccttatggttattcgcacccttttgtcatccagaggcggcgggcccgatgacaagcagagaccaaagaccaagtttggtcattctgcacccatgatacgcggagataccttatggttattcgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaa

SEQ ID NO: 27635 - DNA, 288 bp, Glycine max
  Peptide Sequence Number=SeqID_144413
atggaagtatcagttggtctgtgccgtcctgacatagggatcgcgcccacaagacacccaatggacccagaggagcccaacagagccctggggtttccagctctggttacaggcctctatttgtcctacaaggtgcccgttccccccagcaagggatcgcgcccgcaagacaccagtggacccgaagaagtccaacagggtcttggagttgtcagctctgattacgggcctctatcagttctacagagtgcctctcgcccccagcaaggtcatcaagatccctactaa

SEQ ID NO: 27636 - DNA, 603 bp, Glycine max
  Peptide Sequence Number=SeqID_144414
gacgggatcatgctcttcggcgtgcgcctcaccgtatcggataataaccctacaaccttaaggaagagcgccagcatgaacaatctctcccaatacgactctcaaccaccgcacgatcccaacgcagggtacgcctcagacgatgtcgttcatccctcccgtcacacccgagaacgcaaacgaggtgttccgtggacggaggaagaacacaggttgttcctgttgggattacagaacgttggaaaaggaaattggagaggaatttctagaaacttcgtgatgactcgaaccccgacacaggttgctagtcatgctcagaagtacttcctccgctgccacaggcagaaccgccgccgccggagatctagtctcttcgacatcaccaccaactcggtgatggaaccgtggccggagaaggaagaggaacaagcggcggcgccatctactaggttgaaaccggttctgccggtgcctcagtcgtcgaagatggcagagttggacttgaatgggaagtcgctgtcgctgaagctttcggtatccaagccacctatttctaatgagaattttggcggtggtggggatagcattagcagtgttgcttga

SEQ ID NO: 27637 - DNA, 846 bp, Glycine max
  Peptide Sequence Number=SeqID_144415
atggttgcatggtttgtggagctgttcgagtttggcttaaagtttaaggctcatgggcctatcaaagctcaatgcttggctgatttcattgtagaactttccccctctaccgatcccagtagcattgatggtggagactggtggatgttctacattgacaaagcatgcaatacaaagggcagtggagcaggaattacacttgaaggaccaggagacatctctcttgagcagccattaaggttcgattttaaaacctttaacaatcaagttgaatatgaggctttgatcgcatgccttaaattggaaaatgaggaagacaatgatagagtcgatgtcttgtcaagattgacaagctctaagaggcaaggtctgcatagaacatgcattcaggagactctggctgccccaagcatagattcttggatgaacgtcatatggaaatacttagtaaatgaccaactaccaagtgacaacagcgaagccaggaaggaggaagaagcatggcagctcgggtcctctaagttggttactattggccgacattgcaaactgactacatggagtattcgaagaaatggcatggacatcctaggagctttctcaattgcgaagggacaggaaactcctttccgattgacacatggcactaatgccataattcctgtggaagttgatgaacccttaataagaagaacccattttgatgaggcactcaacaatgaaaaccttgctttcgaattgtacatgattgacaaggtgagaaatcacgcttatattgaggaggaagtttgcaaaaggagagcaactcagaagcacgggtcaaaactgaaaaggggagaattctga

SEQ ID NO: 27638 - DNA, 1041 bp, Glycine max
  Peptide Sequence Number=SeqID_144416
atggatgaactgggacatcgtgcaatcggttctatccaaatggaagagttgttcgagtaccatgacaaggtcagaggggaggaagaagtagccgtagaggtggttacaagggtggctatgcaagaagatgtggtaataacaaccaacaacaagtcgaggaaggcgaacaaagacaacaagaaaacccccaaggagaaaggttatacgaactcatccaggaaatgtcatctacgagcactcaagagcatcaacttcgtacaaactgaggagacaccatgtcaatctctaccagccattatgttcacaaacgcgaacttcattggaagtaaagtggatatgctaacaactttcggctcaaacaagttctctcaatccttaatggtcccatatgagttagtagacgcagatacctcatacaatgttcttcttaagataccctttctaaacataattggagccattatttccacaatgcacctaaccatgatattcccatcattaacaggagagatcatcatcgttaaagctaatcaagtggatgtaagagaatgttatgtgaagagttgcaagattgaactatacagcgtaagggaggacgtgagtaaggcatcaacctctagtgtcaatgcattcatcagtgctttagaggatctagacccatgtgtagactttgaagatcggctaagcctgtggcctagagaaaacgcaaaattggagaggaaagactacactgacctcaacagagcttgtcccaaggatgcctatcgtttgctaagcaatggtagattagtagatggagcatctaacttgtgttacaaagttatgcccttcggcctcaagaacgcagatgatatggtggtgaagtcatcctttcccaaccaacatgctggtgacgtagctaagatctttacggaactcaaaaagcataacatgaggctcaacctcaagaaatgcaccttcagggttgaaagagagaaagcaaagtcattcttcaagctgctgaagaaatcacaagatgagtttgattggaatgaagagtga

SEQ ID NO: 27639 - DNA, 1104 bp, Glycine max
  Peptide Sequence Number=SeqID_144417
atggtgatattattctcctattccaaagacactcaatacgttgagaaacttcttaataagtttggttactatgaccttaacctagtgaataccccttatgatgctaactcacagttgaagaaaaacacaggaaacattgttgatcaaactcaactgagtcgatataatcatagtcctaatcaagaccatcaggaagctcttgtgagactcatgagatacttgagaagtaccatggaatatggtattaagtatagtggatttctcgctttattagaatggtacagtgatgctaattggatctctgattcatatgagataaaattcactagtggttatgtgtttacacttggtggtggtgcgaaccgcagagcacattgttgctggaatcaatggcaagcatatgtcttctcttcttcttctattctcgagctcgacttggtcacgattcgccggagcggaaaaagagctttgagccctgctgtcggcaaaatgtccctcccttacatcttcggcatcggccttgccctaatccttcgcaagaccgttgccggaatcaacgaatttggtttctcgcggttcctcatcttcatgggagtcacgatttccatcatacccttccccgtcctagcatgcatcctaaccgagctcaagctcctcactcctcgcgtcggcgacactgccatggccgtcgcagcgttcaacgatgttgatgcatggatcctccttgcccttgccattgcactcgccgccgtcgacgtcaacagccacattcacaagagccccttcgtctcgctacgagtgctcctctccagcatggcctttgtcgccttcatgatgataataatttggctaggagacttgaccaaaccggacggtggagaaataaagaaaaaaggtttctacatcccacatgcaatcacggaacttgcagcttcgggaaaatttgaaagcgaagatggatggaagtgggaatcagtagtgattggatgtgccacttcaatgggagcaaacgcatgcttcccttgctttgcttacggtattattattatagagcttggtaaacttttccctaattttgagttcttcaatcgttacatgcgctaa

SEQ ID NO: 27640 - DNA, 213 bp, Glycine max
  Peptide Sequence Number=SeqID_144418
atgtcacatgagaggattcatttccctttgttatgcagaatgccagtgcagcagttgaaccacaagcagaaagtactcacaatcatcttcagtttagaactctggagggccaacaaacagaatatccatgttagtatgttacaattattacagcgtgatgaaaattggcaatggttagttaatggttcgtatctaaaatggaacggactctga

SEQ ID NO: 27641 - DNA, 1506 bp, Glycine max
  Peptide Sequence Number=SeqID_144419
atggggtccaccccagatgcacagaagctgtttgatgaaatgccccacaaggattctatctcttggaactcattggtttctgggttttcaagaataggagaccttggtaattgtttgagggtgttttatacaatgaggtatgaaatggcatttgaatggaatgagcttacactcttatctgttatctcggcttgtgcctttgcgaaagcccgggatgagggctggtgtcttcattgttgtgcagtgaaattgggtatggagttggaggttaaggttgttaatgcttttattaacatgtatgggaagtttggctgtgttgactctgctttcaagctgttctgggcactgccagagcagaatatggtgtcgtggaattcaatgttggctgtttggacacaaaatggaatccctaatgaagccgttaattattttaatatgatgagagtcaatggactttttcccgatgaagccaccattctgagcttgcttcaagcctgtgaaaaattgcctttaggaagattggtagaggccatacatggagtgatcttcacctgtggtcttaatgaaaatataacgattgcaaccacccttttgaacttgtattcaaagttagggagattgaatgtgtctcataaggtctttgcagagataagcaagcctgataaagtggcattgactgccatgcttgcagggtatgccatgcatgggcatgggaaagaagcaatagagttctttaaatggactgtaagggaaggtatgaagcctgatcatgttacatttactcatttgttaagtgcttgtagccattcagggcttgtcatggatggaaagtactactttcaaatcatgtctgatttttacagagttcaaccccaattggatcactattcatgtatggttgatcttcttggccgctgtggtatgctcaatgatgcttatcgtctgataaagagcatgccattagagccaaattctggagtttggggtgcccttcttggtgcttgtagggtttatcgtaacatcaatcttgggaaggaagctgcagagaatttgattgcactaaatccttcagaccctagaaattatatcatgctttccaacatatattctgctgcaggtctgtggagtgatgcatcaaaagtgagagctttaatgaagactaaagtttttattagaaacgctggatgcagttttattgagcatgggaataaaatccatcgttttgtggtagatgattattctcaccctgattcagacaaaatacacaggaagctggaagagattatgagaaaaattaaagaggttggtttcgtgtctgaaactgaatccattctccatgatgttgatgaagaggtgaaaacagatatgattaacaagcacagtgagaagatagcacttgcatttggacttttgagaagcgtacaatcattatccgagattcaaagcgatttcaccacttttcagatggattatgctcttgtgctgattattggtagtgatctctga

SEQ ID NO: 27642 - DNA, 723 bp, Glycine max
  Peptide Sequence Number=SeqID_144420
atggagaaggaagaatggtttaagctcaggtttctttgtgtgtatgttcagaacttcccctgcagatatttagcttattccccaagtacctatcaagaaatggtgtattggcaggcctgctacaagactattttgcattcccttgttcatgctctcgcacctcattccccaagtgatcctacagtgaagaaagttgctgacaaattggcaagttttgtggctaaaaatggaaggcaatttgaggatgtaacacgtcaaaaaaatcctggggatacacctttcaaatttttgtttgatgagagatgtgctgaatacaagtattatgaatatcggcttgctcaagaagaaaatgctcttgtgcaatcaagggaatcacagttcaatgttttggtattgattttgcttttgataatggttaaggaaaaagggggtacaagcacttcatcttccaaacagactaatggtcatcagagatcatctcagcagcatacataccaaattcctgcatctgctttatatgaaagtgctgacaatccaagagcttctggattttcaattcaaacatcatcagtaggaagcagtgaagagcccagtggttcatcaaatgctgattctttggcactaatggagttctacatgaaaaaagctgcacgggaagagaagtataaacaacctaagcattcaaaagatgagatgccccctcctgcttctcttctaggttaa

SEQ ID NO: 27643 - DNA, 213 bp, Glycine max
  Peptide Sequence Number=SeqID_144421
atgtggacacctgtcatacacatcaaactcaaccctgacacgggcgtcggtgtcgtgtcggacaccggacacggcaaggggctggggcgtccgtgcttcatagatgggatttgtttcgaaaatcttcctgagattattcaagaaaaactccacctttcccatttgtcacccagatttttctgtcttcataactttacatctaggtcgttttaa

SEQ ID NO: 27644 - DNA, 273 bp, Glycine max
  Peptide Sequence Number=SeqID_144422
atggtttccttgaatgaattgactaataaccaaagtgaaactaaggctaaaatcaactcacaaatcaagctttgtccgcaaaaatcactaaaaaccgttttaaggtctaacgccttaaagggtcctctttgcttttatcggttaacatggaccgttcaaaagcataaaatcaacacatcactttacttccttttgcgagaactacataggtctgatttcctctttgatggaggatacgtaggagcaaaagccccgcttttgtcgacctcgtga

SEQ ID NO: 27645 - DNA, 360 bp, Glycine max
  Peptide Sequence Number=SeqID_144423
atgagtgaaatagaggaggtgcaagagcagatgaaggccgacatgggggccatgaaagagcaaatgaccacaatgatggaagccacgatgagtatgagaaaaatgatggaggtcaatacgactacagtcgttgccgcaaataccgccactgaggtggacccgactcgcccatctggcctcaatcaagtaaatcctccagtctcggatatggtagggcaaggaggcgaagcattaggaagtacgggtgaccccattttgtggaagttcagaacaagcattccttcccaccatatggcctgcctccaaaatatacaccacccaatgtcgcccacgctcccgatgagaactgtcataccctaa

SEQ ID NO: 27646 - DNA, 590 bp, Glycine max
  Peptide Sequence Number=SeqID_144424
ggcatggatactttatggtgaagtttgactcaatggaagatagccatgagtggtggtctgtggttgttgttcaaccattacttaatcgtgaagacatgattgtcggagttcattacggagtgtttggcaaacccattaaggtggacctgaataccttgaatgcggaatatagacgttttgccagggtctacgttgaggttaaccttaacaaatcggtagttggcaggataaatatcaggaggggcactagtactatgttgagtacgagagtttgcacctcctatggccattatggtcatcggagtagggagtgcactcacaaacctcaagtggagacgatggctgcaaactctaatgcaaggctggcggtggcagaagccaaaaacaaccacttttgcaatggcaagaacccaatttcaaccaatcaagggatagtcaaatgggatagggtcctctcatcattggcagaaccacattcgaacactcccttaacccccgctaaaggaaatttcattaacggctccaccaagggtaaaggagtagcagccacaactcttcagactagcacagaaccctttcgcctatcctag

SEQ ID NO: 27647 - DNA, 1023 bp, Glycine max
  Peptide Sequence Number=SeqID_144425
atggagactctttcattgcatatccaacaactagtcaatgagggtatttggaagcctatcgtagtgtctcgtggcggtcccgctatttcccacctgcttttcacagatgacattttccttttctgcaaggtgcaggaatctcaagctcacttgatcaccactactcttgacactttctgttctgagtcaggttggaaggttaacctccataaatctacgatgatgagctccaagggaatcccaaaccgcatgaagaatatattcaaggatgtttgtggcatcgcgagtgtttccaaccttggccgctatctaggctattctggctgccttagtcaatctatgccgccattgatagaaaaactcacaacttcgtttggtcttcttctggtatacgaagggttggaatcttgcgaactaggaccagtcacgcgtcccaagcaaatgggagctttaggtatccgcatagctcgtaacaccaacacctctcttcttggcaagcttgtgtggaacatggttgagaggaaggacaccttgtgggttcgtgttcttatacacaagtacctgattcactccttctttatgagtgctaaggcccgccaggttcatggaaattggtgcgtaaaccatgtatacaccatgctttctgaggacttcttgtccagattagcctccattgactgcaatatttgtcccccagtttccaagatcgatgggtgtggtctcatagctccaatgaggtgcacacagctgcgtcgggctactcttggcacaacagtggccatcttgacaccgccccggccaacttcaaatggctttggaagcctctcattccagagaagattagaaccttcttttggcttattctccttgccaaccaatgatgttcgctatcgtcactacttagctacttgggcggcatgccatgattgctcccacccgcaggaagacactcttcattgtcttcgtgattgttcgcatgccagagagatttggactcatttgggtttccttgcccaacagtag

SEQ ID NO: 27648 - DNA, 264 bp, Glycine max
  Peptide Sequence Number=SeqID_144426
atggcaagcgttgatgaaattcaagaacttggcctcccttactggaaagaattgatagccatgaactttcgaggggtgaattacctcgttgaaatcacccaacaacagtcaagggttaaccgagccctcacgcagctgatggagataaggccaaagaagctcacattgagcaagagttggatgcgtatacacagcataacacatccacgtaacaggcgcctccataattcaaaaggtgatggcttgatgaaaactgtcaactag

SEQ ID NO: 27649 - DNA, 537 bp, Glycine max
  Peptide Sequence Number=SeqID_144427
atggccacttttgacatccgccactttcctacgcttagccatgaagctagggaagccctcactggcctagtctcaaaggaagaagtcaagcacgcccttatgtgtatgaagtctcataaactgcctaacctagatggttttcaatttgttttcttcaagaaatattgggacacaatccaaaataatatttggcagttgtttaggaaagcctttgtggagggttattctaaggagaagctagtggaaactctcgtcgttcttattcccaagcttgaccatacgaagcagttcagggacttccttcctattagtttatgtaacattcttcataaactgatctcaaaggttcttgttcatcgcctttgcccttaccttgaagagattatcaaccccttacaaggtagcttcgtctttggaagaggaactactgacaatgctattatggcccaggaagtggtccatcatatgcaccgctctaaggctaatgaggggatcatggccttcaaatttaattggaaaaggactatgacagagtga

SEQ ID NO: 27650 - DNA, 513 bp, Glycine max
  Peptide Sequence Number=SeqID_144428
atggccttagtagctcattttgatctagaagtacatcaaatagatgtgaaaacaacatttttaaatggggatcttgaagaagtgtacatggctcaacctatgggatttgaaagtgaaaaagaccaatgcatatgccttaaagtcagtgggggatatggtgaagcttcctatgtcattggcatagaaattcatagagatagatctataaggacattgagattatctcaaaaggcctacatagaaaaagttttgaaaagatctaatatggagaattgttcatcaattgtcactcctatagttaaaggggaaaaaattagtctcaatcaatgtccccaaacaacattggaacaagaaggcatgaaaagaattccttatgcttccgcaataggaagtctcatgtatgttcaagtcagcactagacctgatattgcctttgtagtaggaatgcagggaagacatcaaaaagattcaagcatggaacattggaaggcattaaagaaggttatgagataa

SEQ ID NO: 27651 - DNA, 657 bp, Glycine max
  Peptide Sequence Number=SeqID_144429
atgagtgttatgtatagtcctgttctcaattactcagatgtggagtatcagctatggaaaaaccaagacatggattcaagtattggacatccacaacaacactgtcaccaatccaattctggactattgaggtactgttctgctccaagctcaatgctggcaagccttattgacaacaccattcatggctgtgtcaatgaggaaccattcacaagtgagaatcagcagcagcagcagcattatcttccatccacgagttcagaaatggagaccatgttgtccaaaatgccaccatccaacattggatggagtaactcagaacctttgcaagaatttggaggcaagcctgtgaagcaggaaatagggcaatctgttccacaaggaccaccaaagcagaatggttattcttatggtggctctcagttaatttaccaatctcagcaaattcaaggcttgccaaatggttcttccattgcttctatcagtgcttttgatggctcttttggtgcggtgaactccatggcttcagaggactccattcaatctaaaatgggtgtcaggaattgctccaatctctttaggcaaaagagctcccctgctggatttttctccattgaaaatgaattaactacaccttgcaagatacttatttgttaa

SEQ ID NO: 27652 - DNA, 716 bp, Glycine max
  Peptide Sequence Number=SeqID_144430
atcttgcggcattgagagaagtaggaagctttaaagacaatgatgtttcaaatggacaagccaccgcatcaactagtgggttgcatagttctcttactttctcatcgagatcatcttcatgcttgaaacagatgccaccacaaatagctgaaaatggaaatgaaagcctagaagaaaattatgatcaaagtagaaacctagtaaatgacaacggtagctcaaaatgttacatacctagcttcaccaatgaattctgggaaagttctgcattcaatgcccccaaaacagaaaatgaagatgaaatcatgttttccacttcaaatggtttggaatctcaggaaacagatttcagctatcaaaatcatggtttgactcaccatttgagtctacctagctcttctactaagatgtcatccatagagatgtttcttcaaattcaaggttctgttccttataaaattcgagccaaaagaggctttgccactcacccaagaagcattgcagagagggagagaagaacaagaattagtgaaagaatcaagaaactgcaagacctttttccaagatcagaaaagccaacaagcacagcagatatgttagatttggcagttgagcacattaaggacctgcaacaacaagttcagatactctccgatcgtaaggcaaagtgcaaatgtaccaggaatgagaagcattacactagaacttgtgcctga

SEQ ID NO: 27653 - DNA, 363 bp, Glycine max
  Peptide Sequence Number=SeqID_144431
atgagaagcaattcaatgatgaagttttctagttacaaggcagtgtcattgttgtggtttttgttgatcatggcagggttagtggcacaagttcaaagcagtccttgcacaagcacattcttctctgcacttgtgcaactcattccttgtagggcagcagttgctccttttagccctattcctccaagtgattcttgttgtaatgcccttaaggcactagggcagccatgtttgtgtgtccttgttaatggccctccaatttctggggtagaccgtaatatggcctctcagctcccggacaagtgcacagctaactttgaaccatattcattcttcttacactcatctcttgccaaaaagtga

SEQ ID NO: 27654 - DNA, 2172 bp, Glycine max
  Peptide Sequence Number=SeqID_144432
atgtctacattattactcccaactttaaagccttcaaatatattcctttattgtgctttcctcatcaaaccagttagtccctcagcaacaatgttgaacagaaaaggggctaaccacagacgtgatgcagccagggctgagaatgctttgactcttctttatggcaatgagccaattggcatgcaaagagactggaatgaagagctgcagtcttgtagagaatttcctcatacatctcctcaggagaggattttgcgggatagggcactttataaagtgacatcagactttgttgatgcagctattaatggtgctattggagtgatcagtggttgcattcctccgataaacccaactgaccctgaatgctttcacatgtatgtgcacaacaatatattctttagttttgctattgatgctgaccttgagaagctgccaaagaaacgtgtggatgctaattcaaaatcttggagctccagcactttgcaaagttcttctgataaagattccattccacttcatggagaaagtcaggttcctaatgggggtaaagatgacagttcaagttcagaagatcttaatggcacagaaattactcaagatgtttctccagaagctcagctggctgagaatgagcaagccacatatgcttctgcaaacaatgatttgaagggcacaaaggcttaccaagaagctgatgttcctggactttataatcttgctatggctataattgactacaggggtcatagagtggtagctcagagtgtcttaccaggcattcttcaaggggacaagtcagactctctcttgtatggctctgttgacaatggaaagaaaatttgctggaatgaagattttcattctaaggtgtcagaggctgccaaatgccttcatttgaaggaacatttagtccttgatggatctggaaatcttttcaaattagctgcaccagtggaatgcaagggcattgttggtggtgatgaccgacattatcttcttgatttgttgagagtaactcctcgtgatgccaactatactggacctggttcccgattttgtatcttgagaccagaattaattactgcctattgccaggcccaagcagcagaggcattgaaatctaaggagaagaattttcaagaggcaaacagtttggccactgaatcccaaaatgctgctgaagctgaccagctggtaaatgattcccaaaatgctgctgatgctgacaagctggattcaacaaaggaagaaaaagctgaggatgttaaagagcttgcttctgtgattgccaaagcctctgatggttgtgaggatattgtttttaatcctaatgtcttcactgaattcaaacttgctgggagtccagaggaaatagcagctgatgaagataatgttagaaaagttagtcaatatcttacagatgtggtacttccaaagtttatacaagacctatgtacacttgaagtttcgccaatggatggccagacattaactgaagcattgcatgctcatggaattaatgttcgttatattggcagagtggctggggggactaaacatctacctcatctgtgggatctttgtaatagtgagattgttgtcagatctgctaagcatattatcaaggatttattgagagagacagaggaccatgatcttgcaccagcagtatctcatttcttaaattgcctatttggaagttgtcaagctcccagtggaaaagaacatgcagggcaacggtctccagggaaacattccaaagggctagctcggtggaaaggcagggcatctttaagaaagactcaacctttgtatgcaagtatcagctcggaagctctttggttagacattcaagaatttgcaatggttaaatataagtttgaattgccagcagatgctaggtcgcgtgtcaagaaaatttctcttatacgtaatctctgtctgaaggttggtataactgttgcagctcgtaaatatgatcttagttctgcaactcccttccaaacatcagatgtcttagatctccgtccggttgtcaagcattcagttcctgcctgttcagaagccaaggaacttgtggaaactggaaaacttcaattggctgagggcatgctcagtgaagcctacactttattctccgaggcattctcgattctacaacaggcatga

SEQ ID NO: 27655 - DNA, 378 bp, Glycine max
  Peptide Sequence Number=SeqID_144433
atgtgtggtgccacgtgtactcgttgcctaagtggaattacacttagggcaactaaaatcaaagtagtcaccttcttaggcggacttcgtcccttcttcttcggttgcaaatacaaacccataacatccttaacctccttagaactccaccctccttctctcagaaccaaacatcatccctacatatccctccacccacttcgatttccggtgacagtcgatggcgacgtcgaggctatgtcgagagaagctgggggcgaagcacttgttggcagcagaggagtggttcttggcgatagatctttgcttcctaaaaatgggatccaagtcagagcgagcgaactcagaagtgtgactcaggtggaactgtatttctga

SEQ ID NO: 27656 - DNA, 1287 bp, Glycine max
  Peptide Sequence Number=SeqID_144434
atggctttaggctccttcgatcgctgcccgaaaaactcctccgccacgccaacgaacccgctatatttttttggtgttgtttttgttgatcttttgccgccctatccaattgcagttggaaatggtggtaatttgaagaactatttgctttttggagccgcaaatacatattgggggacatctagatccattcatgggtcagcatcattggcaagggactattacgaagtgcttggtgtgagtaagaatgcgagttcttctgaaataaagaaagcatactatgggcttgcaaagaagctccatccagacacaaacaaagatgatcctgaggccgaaaagaagtttcaagaagtttcaatggcatatgaggttttgaaggatgaggaaaaacgccaacagtatgatcaggttggccatgatgcatatgtaaaccaagaaagcaccaatggttttggaggcaacagtggctttaatccatttgagcagatgttccgtgatcatgattttgtcaagagcttttttcatcagaatattggtggagaagatgtcaagacttttattgaactatcttttatggaagctgtccggggatgcaataaaactattacatttcaaacagaagtgctttgtaacacctgtggtggaagtggtgtgcctcctggtacaagacctgaaacctgtaagcgctgtaaagggtcaggagtgacatatgtacaaactggcatatttaggatggagagtacttgtggtacatgtaagggaactggcaaaattgtatcgaatttctgcaagtcatgtaaaggtacaaaggttaccaaaggaacaaaatcggtcaaattggatattatggctgggattgacaacaatgaaactataaaggtttatagaagtggtggtgcagatcctgatggagataatcctggtgatctttatgttactatcaaggtcagggacgatcctgtcttccgtagagaaggatctaatattcatgtagatgctatcttaagtatcactcaggcaattttgggtggaaccattcaggtcccaactcttactggagatgttgttctaaagattcgtcctggcacccaacctggtcagaaggtggttctgaaaaagaaagggatcaagacaaaaaattcttacacatttggggatcaatacgttcattttaacgtcagcattccaaacaatctgacagagagacagcgtgaattgattgaagagtttgccaaggaagagcaaggagattttgataaacagagagttgcatctgcttctggttga

SEQ ID NO: 27657 - DNA, 780 bp, Glycine max
  Peptide Sequence Number=SeqID_144435
atgggtcaaatgactcagtatgctgggagtttctcttgtctcaggcaaggggacccactagccccttttctgttcaacattgttgctgagggactaactgatgacacagtgttctttgggacaacatcgatggagaatgtcaaagcaatcaaggtgatgctgagatgttttgaattagtgttgggattgaagatcaattttgctaaaagtagttttggggcgtttgggacgacagaaaagtggattaacaatgctgccagctacttgaattgcagaaggttgcaagcacccttttcttatttgggtatccctattggggcaaacccagggcatagtgagacattggatgcagtagttaaaaaatgtgtcgaagaaggtggcagacaggttggtaaagctacagaggtggttcttgtggggaggaaacccagatcagcagatcaccagggtgagctggggaacaatatgcatgccaaatatgaaggttggcaggatttgaggaagttcaactatgctttacttgggaaatggagttggaacttgtttcaccatcaaggtgagttgtgggcacaagttttgaattcaaaatacgaagcggaggaagggagctggtttaatagcgacataaaatggaaaataggttctggttcaaaagtgttgttttggaaagatgcttggaaggaggagggagtgtcgctgaagggagaaatagtttcagctgcaaattttatggatgatatacagggttcagtagtacaaacacagcaacaagacacttga

SEQ ID NO: 27658 - DNA, 303 bp, Glycine max
  Peptide Sequence Number=SeqID_144436
atgataaggagagtcgttagccctactcggctactctcatatactattgttgctgactcctcggctggtactactcaacctggtgtctctcccccacagtgcccgtacttggtcgtagttttgttgctggctcctcggctggtgctcctactactgatgctcaagttattatgtgggtcatactggaacaattatatagtaaaggatccggctaaggaaccatgccaacaacaagagaagatcaaagcacgcctaaggagccaacaaagagaaccaccagctgaagggggtacatgcgagtag

SEQ ID NO: 27659 - DNA, 2433 bp, Glycine max
  Peptide Sequence Number=SeqID_144437
atgatttcaataaagagaagacaaagaggtgctccagtcacaatgcactcagttggccctcaagtccatcctagtagccaagatgaagactacaatctgagggagactgatccacaactcggtggtgaccggtggcctaatgccagaagagggtggatcggtggtgaaagattctcaagcacatatgaccttgttgagcagatgttctatctgtatgttagggtggtgaaagccaaagatctttcccccagcactctcacctcaagctgtgatccttatgtggaagtgaagctggggaactacaaaggaagaacaaagcacatagagaagaaaaccaacccagaatggaaccaagtctatgctttctccaaagacagaattcaatcttctgttctggaagtcattgtcaaagacaaagaaatgcttggaagagatgattatattggaagggtggcctttgatctcaatgaggttccaaccagagttcccccagacagtccattggctcctcaatggtacaggctcgaggaccggcgaggagaagggaaggtgaggggtgatatcatgcttgcagtgtggatgggaactcaagctgatgaagccttctcagaggcatggcattctgatgctgccgctgtgtctggagagggtgttttcaatgtcagatcaaaggtttatgtgtcaccaaaactgtggtatctcagggtgaatgccattgaagcacaagatgtgataccgagtgacagaaaccggctgccagaggtttttgtcaaggctcagatggggagccaagtgttgaggaccaagatatgtccaactaggacaaccacaccactttggaatgaagatttggtatttgtggcagctgaaccatttgaggagcagttgacaatcactgtggaggatcgcgtgcacccttcaagagatgaagtacttgggaagataatcttgccactgaccctctttgagaagcggctagaccacaggcctgttcattcacgctggttcaatcttgagaagtttggttttggaatgatggaagctgataggagaaatgagcttaagttttcaagcaggattcacctaagaatttcccttgaaggtggataccatgtccttgatgagtccactttgtactcaagtgaccaaagaccaacagctagacagctatggaagcagcctattggggtgcttgaagtagggatcttaggagcacaaggactcctcccaatgaagatgagggatggccgcggcaccacggatgcatattgtgttgccaagtatggccaaaaatgggtcagaaccagaacaattcttgacaattttagtccaaaatggaatgagcaatacacatgggagatttatgatccttgcactgtaataacacttggtgtttttgacaactgccatttaggaggaggggaaaaagccactgctggcactgcagccagggattcaagaattggaaaggtaagaattaggctctcaacacttgaagctcataggatatacactcatagccatccccttcttgttttgcacccacatggtgtcaagaaaatgggtgagcttcagctagcagtgaggttcactagcctctcactggctaacatggtttacatttatggccaacccttgcttccaaagcagcattacttgcgccctttcatcgttaaccaagtagagaatttgaggtaccaagccatgagcattgtggctgtgaggcttggaagagctgaacctcccctcaggaaggaggtagtagagtacatgttggatgttgattcccatatgtggagcatgagaagaagcaaagccaacttcttccgcatcatgtcacttttctctggcatcatcacaatggggcaatggtttagccaagtttgccattggaagaaccccatcacatcaatcctagttcacattctcttcctcatactcatttgctaccctgaattgatacttccaaccttgttcctctacatgttcttgattggcctgtggaactataggtttaggcctagacacccaccccacatggacacaaaactctcatgggcagaagtggttcaccccgatgaactcgacgaagagttcgacacattcccaacttctagaccacatgatgtggtgaaaatgaggtatgacaggcttcgaagtgttgcgggaaggattcaaacagttgttggggacatagcaacacagggagagaggtttcagtctctactgagttggagagaccccagggcaaccagcttctttgtagtgttcagcctttgttctgctgtggttctctatgcaacaccaccaaaagtggtggctatggtaacaggcttgtactatctgcggcatcccaagtttcgtagcaagctgccttctgtgcccagcaacttcttcaagaggcttccagctagaacagatagcatgttgtga

SEQ ID NO: 27660 - DNA, 294 bp, Glycine max
  Peptide Sequence Number=SeqID_144438
atggtgccaatagatagaccagatgtcatacccatcaccatcgatcactttcgatactgcttcattccttggggatttaggtctcgccagcaactgagtggtgccttactatgctcaagaattcatagtaacccagtgaggtttgatgtgagagttgttacaaccgaggaggacaatgagatcaaggaggatctagagatgttagaggaggaatggcgcaacaacagttggtggggagcttcccccaagagtaggctggcttgtggaggaaagcagtcaggaggatcccgatga

SEQ ID NO: 27661 - DNA, 492 bp, Glycine max
  Peptide Sequence Number=SeqID_144439
atggagtatatacatgcacaagggatcattcatagagaccttaaaccggagaatgtacttgttgatggggaaattcgcctcaaaattgctgattttggcattgcttgtgaggcttcgaagtgtgactccttgaggggtacgtaccgttggatggcgccagagatgatcaaaggcaaacgctatgggagaaaggttgatgtgtacagttttgggcttatcttgtgggagttggtgagtggaacagtaccatttgagggcttgagtccaatccaggttgctgttgctgttgcagataggaattcaaggccaattattccttcacattgcccacatgttttgagtggtttgataaagcagtgttgggaattgaaaccagagaagaggcctgagttctgccagattgttcgagttttggagcaattagatcaaggctgcagcttcttgccccccaagaaactcaagcaacaccctctttcattacgaaaatggtaa

SEQ ID NO: 27662 - DNA, 612 bp, Glycine max
  Peptide Sequence Number=SeqID_144440
atggacaaggaagagattccttcttcttgttcaaagagatgttatgcacccaaattaagcccaattgttttgcctttgctagtgtcattagtgcctgtgtggggaaaaatggggcacttcaacattgttcaactcttcatgctcatgtcatcaagtggggctatgatactaacaattttgtacagccttgcagttctccttcaaggaagacaagtgcagtctgttgttattaaaatgggttcagaaaggaatgtgtttgtggccagtgctttgattgatatgtattcaaagggtggtgatattgacgaggctcaatgtgtgttagatcagacttctaagaagaataatgtgttgtggacatccatgatcatgggttatgctcaatgtgggggaagttcagaggctgtggaactttttgattgtctattgaccaagcaagagtttattcctgatcataatatctgctttactgctgtcttaacagcttgtaatcatgcaggatttcttgacaaaggggtggaatacttcaacaaaatgacaacaaattatggcctgtctcctgatatagatcaacatgcttgcttgatcttttatgcagaaacggaaatttaa

SEQ ID NO: 27663 - DNA, 1020 bp, Glycine max
  Peptide Sequence Number=SeqID_144441
gtacctagaagacaaagcgaggggtatggccaatcaaggagattgggtcccgtttatggatgtgttagctttgctaatttttggggttgtcctctttccaaacgtagatggttggtggacctagcagcaatcgacgctttccttgcataccaccatagcaaggaaagtccggtggtggctgtcttggcagatttatttgacacatttaaccgaaggtgcaaaaagagtagcgcacggatcatctgttgcttgctcgccctctgtgtttggttggtttcacacttgttccagcaagacacaaggcatccatgtccgctccagagccatcgctcgtgtactgaaaagaggagaatagattgggaccagcttttggctgggataagaggtagaacaatcaattggtttccccgatggaaggaaggaaaggagggagtccttttctcatgtggagggtaccccaaacattccgctgataggaacgagggggatttcggcgcacaaaatttcaaggctatacaaagaatccgtaaggcatgggaaaccccgttaaggaaagatcaagaacctaggggcattcgtaatggcatcattggtggttaccatgaatggctgaaagttcatatacgaggtttagattggctcgccaagttaaaagtcgtcagcgaagagagttttgaagcaccggaagaggacgaagaagtccaagctctcaaaagcgagttaggaaaggcgaaacttgccaaggagaagttcaagttggccgctacacacatccggaaggagtgtgccggattacgggaagagaatgcaactaccgcaaaagcccttgaacaagaggccaagagggctcacaaggaagagtatggccgtaacaaatttcgcggagctctgtccaaaaggagcttgtctcagcgtttatgcgagacgaagaccaacatgctagctatcatcgccaagtaccaagaagagttaggtctagccacggcccacgagcatagggttgcggaagagtatgcccaa

SEQ ID NO: 27664 - DNA, 144 bp, Glycine max
  Peptide Sequence Number=SeqID_144442
atgaccgtgtcatacaaggactggcacaagatgctccctttcgcgctacatgatgctcagggacgggtacgagcaggcactaggctgatggtcagtagatcatcatcctgtgactggcttcgcatgttgaggaggccctgttaa

SEQ ID NO: 27665 - DNA, 221 bp, Glycine max
  Peptide Sequence Number=SeqID_144443
gtggccttgttggtgcttgcgcgcctagcgcaactctggatcgcttagcgtgcattagtgaatttcggcttagcgcgcatcttctcgctcagtggatggactcaagcggtgcgcttagcgggatgagccctcactcagcgaacatgcacagctcatccttcttccagattcttcctcgcgctcagccaaaggagtggtgcattcagtggatggctcgctaa

SEQ ID NO: 27666 - DNA, 684 bp, Glycine max
  Peptide Sequence Number=SeqID_144444
atggcaccggaggacatggagaagactacgttcatcaccttgtgggggacattttgttataaggtgatgtcctttgggctcaaaaacactggggcaacctatcaatgggcgatggtagctttgttccatgatatgatgcacagagagattgaagtctatgtggatgacatgatcgccaagtccaaaaccaaagaggaacatctcgttaacttgtggaagttgttcgagagattacggaagtacaagttaaggttgaaccccaccaagtgtacttttagggtcaagtcaggaaaattgttgggcttcatcgtaagtcaaaaggggatagaggttgaccccgagaaagtaaaagccatccttgagatgccagagccgcataccgagaagcaagtccaaggtttcttggggcgtttgaactacattgtaaggttcatatcacaactcacggctacctgcgagccgctcttcaagctcttacacaaggatcaatccattcgttggaacgatgactttcaagaggcatttgaaaggatcaaacagtgcctcatgaaccccctagtacttatgccatcggtggccgggagaccactctttctctatatgacggtgttggatgagtcgatggggtgcatgttggggctgcacgatgagtccggaaaagagaacgggttgtctactacttaa

SEQ ID NO: 27667 - DNA, 861 bp, Glycine max
  Peptide Sequence Number=SeqID_144445
gatggacccttgggtactagtaccctcacctttagaggactatacgtcctcgtcatcagagggttgcacgccctcaccttcagaggactacacgtcctcgcctttagagggtcatgtaccttcaccttcagaggactacacgtcctcgccttcagagggctgcacgccctcaccttcagaggactacacatcctcgctttcagagggtcatgtaccttcaccctcagcggactacacgtcctcgccatcagagggatgcacaccctcaccttcagaggactacacgtcctcgccttcagagggtcatgtaccttcacctttagaggactacacgtcctcgccttcagagggctgcacgacctcaccttcagaggactacacgtcctcaccttcagagggctgcatgccctcaccttaagaggactacacatcctcaccttcatagggctacacgccctcaactttagaggactacatgtcctcaccttcataggactacatgccctcacctttagagaactacacgtcctcgccatcagagggctgcacgccctcaccttcagaggactacacgtcctcacccttagagggcgacacgccctcaccttcagaggactacacgtccttgccatcagagggctgcacgccctcaccttcagaggactacacgtcctcgccttcagagggtcatgcacgccctcaccttcagaggactacgcgtcctcgccttcagagggctgcacgccctcaccttcaaaggactacatgtcctcaccttcagaggactacacgtcctcgccatcagagggctgcacgccctcaccttcagaggactacacgtcctggcctttagagggtcat

SEQ ID NO: 27668 - DNA, 516 bp, Glycine max
  Peptide Sequence Number=SeqID_144446
atgtgtctatcatcccctctgcaattccaagtcgtatcaagacgaaggcgacctaggccaaccccaagattggtgacaaggaatgggcagtttcctttattgggaacaacgaggatccgacctctttatcatcatcagatagaaacaatcattgtccaagcacctatctggacgaagcatgattatgagcatactccatctaaagcctttaaggctataccaatagattccatagttcatcttcgtcctccacaatggactcgtccaatgcagcccaacattatcaagatgtctcctcattggctcacaccagctggagctcattgtttagtgggcagaagttgtttcgtacttctgatgcttatgatgccaggaccttctagaaatagattgtgtggatggactcccaaaaatcctccacgtatggttatgatggaagtgacaatgttgagcatcacgatgtcattcaagtgttacatcttgttaggaagtaccattttgatgatgcgtgtgtga

SEQ ID NO: 27669 - DNA, 324 bp, Glycine max
  Peptide Sequence Number=SeqID_144447
atgctagagttggaattttcaattgtgttgaagtgggttctgcatgattggaacgatgaactctctgtgaagatattgaagaactgcgaagaagctatttcagggaaagggaaagggaaagggaaagaaggaaaggttataattatagacatagcaattgatgaagtaggtgatgattgcgaaatgactgaattgaagctagactatgatttagtgatgttgactatgtttaatggaaaagaaatagtgggagaaactaatttacgaggcaggattcagcaactacaaaattattcctatatgtggattcaaatctctcattga

SEQ ID NO: 27670 - DNA, 192 bp, Glycine max
  Peptide Sequence Number=SeqID_144448
atggtagccatagtcccaacaaagattcctcaacctccattttcccgaggatacaacttgaatgcaacatgtgcttatcatggaggagtttcgaggcattccactgagcatttgacttatgctcctgagttgatctccaagtctgttcaatcagaaattgctcgttctacacgtttggttggggtgtcgtaa

SEQ ID NO: 27671 - DNA, 195 bp, Glycine max
  Peptide Sequence Number=SeqID_144449
atggataaggataatcatatctcttctcatatggttggagggtacaaattgactaagcttggctcaaaagactttactgatccttccttgtacaagtccatagttagggcttctgaccctgatgacagaaggtcaactttcgatgctgttatatttcttggccctaatctcatctcttggtggtctaaaaagtag

SEQ ID NO: 27672 - DNA, 252 bp, Glycine max
  Peptide Sequence Number=SeqID_144450
atggcagatggagggtccacggaagcagaagatgagtgtttgggaatggaatccttgccattagagaagagaagaaacagaaagtataaggctgccataaagcatattagaaatgggaaattgaagagagcattagcaggtaggaggaacattgtggtgccaaattctaatggtgtgtgccctttttgcgggttggttgaagaatccacggatcatgttctgctttggtgtaaggagttatgggagaattga

SEQ ID NO: 27673 - DNA, 237 bp, Glycine max
  Peptide Sequence Number=SeqID_144451
atgactaggatggttgaagaggatactaaggagaagaagagtaaaggctttgccctaaaatcctccacaccatctagtgatgagagtgatgaagaaaatgcagaaggtttcgagagcgagaatctaacattacttgttagaaagtttaagaagtatctcaacaagaagaatcccaaaggaagatccttccaacgcaagaagaactttaagaagaatgactccacgtccctaacttaa

SEQ ID NO: 27674 - DNA, 351 bp, Glycine max
  Peptide Sequence Number=SeqID_144452
atggctccaaagaagcttccagctaagaaggcaaggaaagatgccactggagaaggttctagtacggccccacaaggttggtcgttccttaaggagagtcaggtccaattgagggaaggagagtatgctgaattccaggaggaaattgctaagaggcaatggactcaacttgcggcacccatggctaagtatgatccagaaatagtcatggagttctatgccaatgcatggtccacgaaggagggattcaggggcaagcactcctgggtgtggggccaatggatcccctttgatgaggatgtcattaatcagttcttggggcatccgttgatcctggaagaggggcaatga

SEQ ID NO: 27675 - DNA, 171 bp, Glycine max
  Peptide Sequence Number=SeqID_144453
atgactcaggctagtcaccatagggggggagttgcctatgcacggcagagtgacctcgacacttgctgcctagttttcttgagtgtgagtgccatgtgggcacgctcaagctatttcttgacgaatggtaccacattgcatttgagagttgaggtcagatggcaacagtaa

SEQ ID NO: 27676 - DNA, 327 bp, Glycine max
  Peptide Sequence Number=SeqID_144454
atggcacataaggctcttgcagctggatgtaacttagataaggagcagccgccgccgaggaagaaagcctgcaaaggtggcagaggaggtggctgcaaggaacttgaggatatttgttcaggacatttatcattttatttaagatcttcattagagcttgttgtcaccattgatccacaaatcatagcaatgatctctttggaaggttttggttttcttggtttacacagtaagcaaaaacaagtcattctggttagagctccaaaggcccaaaatcagcaacaaattctagaaggaaaaattgcaaaaaatgaagataaaagctag

SEQ ID NO: 27677 - DNA, 948 bp, Glycine max
  Peptide Sequence Number=SeqID_144455
atggcatttgttagtggtcttatagattttgaaactaaaggtggccatgttacttggagaaaaaacattcagaatggagtacacattagaaagaagctggacagatgtttagctaatccaaaatggcttttgttgtttcctcattcgatggaaaaactcctggtttcgaataattcagaccacaacccaatccttgttcattgcctgaaatctcccagccaacgcaaagaggcctttcacttccaagctgcatggatgaatcacccagattaccctccccttattgatcacgtttggcggggtacccctggcgatgccatttgcaaattagatgagggattcatcgtcaactggatcatactgtcacctcagaccttacccgacaggaaaggatgcttcaagatgaatatcagtaggaataagatcatgggattgttcattgatgatatctggtgctctgatttgggaacctttgttaaagaaaccctctttttttctaaggacctcttccaatccgacgatgcctgtgctcctcatagcttcccttacaacgctctagggccagacggattccaacctatattctataggtcttattggcatatagttggcaaagagatagactttgagaaagtttatgagagggttaatggggactttttgatgctcaccttaactgagtttagatttccagatcagactattcagctcatcatgaattgcaccatgccctcgaacttgtctttgaagtggaaatcaattctagaaagcttcactccaaccggtgatcttcgacaagctggtcgaaccaagaaagaggactttgctcatgtcgttgatatgataaataacaggcttgatgggtggaagagcaagctgcttagtcgagcagagagggtaacactagccaagtctgtattggccgccatacccacatacacaatgtag

SEQ ID NO: 27678 - DNA, 387 bp, Glycine max
  Peptide Sequence Number=SeqID_144456
atggcaatgcttgggaaaaaggcatggagtatgctacatgagccagataaaccgtgggttgccattctcaaagacagatacatccccaatcagtccatattgagtgcaaaaaacatcccaagttcttcttacacttggaatttaaaagagtgtgggagcgtctcaacttcactcaaaaaccaaactttaatcacgaaaacttctaggagtggttacggatatttgcaatccagcaggatgagcaactctatgcttcaacttgttggcaactgtggaagtctcgtaacaatagcatcttcaacgacaaggattggccattgcggtacattgttactccaagggaacaactacgtactattatcacccttacacatccctaattcatag

SEQ ID NO: 27679 - DNA, 273 bp, Glycine max
  Peptide Sequence Number=SeqID_144457
atggtgattctaccaaggttgagtggacatgaaagcgccaattgggagaagtgggaaaaaaaagggggaagcgtattacagagcaagagtctggccaggacctgctcgaatcgaaaagagaggagagtctttaagaaggaattcccaggttcaaaggagtatttacgaagtacaaagctaagacaagaaagaggacttcgagttatggggcaattcgaactggtgtatggacgagtcgaagtcgaggcagcaagagttctggacttagcataa

SEQ ID NO: 27680 - DNA, 522 bp, Glycine max
  Peptide Sequence Number=SeqID_144458
atggcaggatgcatcatcaagctattggcaaagagcctgggatacaattttatgcgagaaaaattacgaagactgtggaagctgaaggctggctttgagatgctagatattgggaatagtttcttcacgataaaatttgatattgaagaggatagaatcaaggtcaaccaagaggacccatggatgattttcgatcattaccttactgtcagggcttggtcaggagatttgatctctcaagaggcaaagatcgatacaaccatgtcatgggcccaagacaacaagcaaacacatgccaagaacaagcgaccacgacagagtttgaatccgagtgaagcgggtgtggctcagatgatgaagaatgatgacatcaacaaagacacaaacaagccatgtgtttatgatataggcaatggagccaaatccactgtcaacatgcaaccagtgtctaccaattcctatgtttttgttaatgaggaaaaagaagatagcgagggcatggacatgatcgtcagttcatag

SEQ ID NO: 27681 - DNA, 189 bp, Glycine max
  Peptide Sequence Number=SeqID_144459
atgacggtcaatttcatgacggttaaaaatcatcataataggccttacaaaaccattattgaaggccttatttgtagtagtgctctaagctcccgcatatttggtgtaagtcaaaaactctcttggttatcaatggggattaggtctaataaaggaggattagtctcttacaatgtgttgatgaactaa

SEQ ID NO: 27682 - DNA, 205 bp, Glycine max
  Peptide Sequence Number=SeqID_144460
ccttagtcagcaggggcagggtttcgctccttttgcgtgccctacttcagagcagtttagggctgaggtcgcatggcctgaagattggcccgaggcccaggcaggggaggtgcctgcaggatcccccggcgatgtagaggaggcccgtatggatgaggagatgacgaattttctcggtttcttgggaggaagtggagccacgtga

SEQ ID NO: 27683 - DNA, 255 bp, Glycine max
  Peptide Sequence Number=SeqID_144461
atgtcaaatgaagaattgaagttgcaggatccacgatgtcggatacaatgtcctgacatcctgcccgagaatactggagttgctgtacaatgcaagataaaaatttttcagaagaagatagatctcctccagcatcaaggagttgcagcccagaatcgtacacggctatataatcatggaggctgcacgagttctgtaccaagtccgggattgaagagttattttgtgagtttttgggacttgagtcttttgtga

SEQ ID NO: 27684 - DNA, 330 bp, Glycine max
  Peptide Sequence Number=SeqID_144462
atgattgatgtgcttccaaagggaagaatattgatgcagcatagggagtctcagggaaatcgggacacgacgacgtacaccaccatacctgatcacaacattcagtcaacggcgcaaagcatggcccaggcccttcccaccaacgagcacctccaccgcgagataggcaacgatgactgctcccctgattggcgggtgcagttctacgtgtccccttacgtccgcacccaatcgacgttatgcgatcttagaaggtgtttgttgaagaagaggatcataagtgtgagggaagagtcacgaattcgagaacgagattttgagattttttag

SEQ ID NO: 27685 - DNA, 294 bp, Glycine max
  Peptide Sequence Number=SeqID_144463
atggtagcaaggaaatgtgttatgaactcttgtaccctagttgtggcttgtgtagttatgcagttgtgtgttatggaagatgggttgatggcctatgattgtgggagtgaaaatttggaaggcccttatcccatcaagtgtggcggcatgcgtgtggagtattcggagaggatattcaatagggagcatgaaaggaagatgatggtaatgaggaatactttggcttggaatatttggcttcatcgaagtaatgtgattttcaagaatgaaggggtggatgctaacaaagcatga

SEQ ID NO: 27686 - DNA, 1912 bp, Glycine max
  Peptide Sequence Number=SeqID_144464
agagaaccatccttcgacaaactccgaggacgaccaccgatcctccttactggatctggcgcgtgccgaaatcacggaatcctctaactccaagacccgaacctgcggttcgggtcttggttcgggttccggcacctctgagcctcaggctcccttcccggaccaggtcctcgagaacgtgctcgagaacgttctccacttcctctcgtcgcggcgcgaccgcaacgccgcctcattggtgtgccgctcctggtaccgcgccgaggccctcacccgatccgagctcttcatcggcaactgctacgcgctctcccccactcgcgccaccgcccgcttcacgcgcgccaggtccgtcaccgtcaagggcaagccccgcttcgccgacttcgatcttatgcccgccgactggggggcccacttctccccctgggcctccgccctctcccaggcctacccctggctcgagaagctccacctcaagcgcatgctgctcaccgacgccgacctcgccctaatcgccgactccttcgccgccttccgcgaactcgtcctcgtctgctgcgagggcttcggcactcccggcctcgccgtcgtcgtctccaagtgcagattgctgagggtgcttgagcttgtggaatctgaggttgaggacgatgaggaggtggattggatttcgtgttttcccgagagccaaaccaatctggagtctcttgtgtttgactgtgttgatgttcctatcaatttcgaggctttggagggtttagtggctaggtcgcctcgcttgaagaagcttcgtttgaaccgatatgtttccatggctgagctctatcgtttgttgcttcgagctccgcagcttactcaccttggaacgggttcattcagtgctactgaggctggggcggtcggggatcaggagccggattatcaggagccggattacgcggccgcctttgaggcttgcagatccctggtttgcctgtctggattcagggagatttgggcggattaccttcctgctatttatcctgtctgcacaaatctgacatcgttgaatttgagctatgctgatgttaacacggatcagctgaagtcagttatccgccactgtcataagctgcagatattctgggtacttgattcgatacgtgatgaggggcttcaggcggtggctgcaacttgcaaggacttgcgcgaacttcgggtttttcctgtggatgcaagggaggagactgatgggcctgtttctgaggtggggtttgaagcaatttctcagggttgtaggaagttggaatcgattttgtttttcacccagaggatgactaatgcggctgtggtggctatgtcaaagaactgcccggatcttgtggtgtttcgtttatgtataattgggcggtataggccggatcctgtgactgaggaacccatggatgagggttttggtgctattgttatgaattgcaagaagctcactcggcttgctatgtctggtttgctgactgatcgtgtttttgagtacattgggatgtatgggaaattggttaggacgctgtcagttgcctttgctggggacactgacgtcggccttaaatatgtgcttgaaggatgccctaatttgcaaaagcttgaaatcagggatagtccttttggggatggagctctgagatccggtttgcatcattattacaacatgagattcctctggatgtcatcctgtaaattgacgcgccaagcttgccaagaggttgctcgagcattgcccaacctggttttggaagtgatcaacaacaacaacgaggagaatgcaggtgatgaagaggagaatgcaggtgatgaagttgagacattgtacatgtatcggtctcttgatggaccacgggatgatgctccaagatttgttaccatcctgcaatag

SEQ ID NO: 27687 - DNA, 1020 bp, Glycine max
  Peptide Sequence Number=SeqID_144465
atgacaaatggtgattttgtcccacaggttcgtgaagacatacgtaacacggccatagggagaacatatcatagaggtcatgttcgtgcagccgggtctggggtgacaattagtcaatactatgggaggacatcacgtgcctcaagtgcacgcgtgagcactaaggagagcaatgctgaaattactgtgaacctatctggggaagaacatgttggtcatgtaacaccgcctatggggttgtatgtccaacgtgaacattgtataaagctggtggcgttgggaaaaatatatgatggaccctctaccatacattgtgtggcatatgcagatgatgtcgtaagggttagcgttgaaaaagttattgacggtgaagctgaagtcccattcccaacatcagaaattaagtatgtgagacaggcccttaacacatttattgcatggtcaacacctttggtaatagtggtatcagatgaggattcaaccatcactccaaataaagttgccaaagttggcgaattaaacaatgatgttgctgaacaggaccccctgcgtgagttgattaagaccctcgttgacatttacgacaagcctgttgagtttgtgtgggatgttagtcaatttgggattccaaatgtagattcatcattgttcttaacatatactgatatcaacgaaataacatcaagcgacaaatgcttgaacatagccatacttcaattgtggaccatgtatatgaatgagtggagtaatagcttgggtcaacaatcggtgtatggattccttgagccacaatctatacacaatgcaaaggatagacgtgggcaatatgaagaatatattgaaaaatatcttaaggaatcacaacgacaactgtacttaggagcttatttgaatcaggcccattggcaaatggttgtgttgtgtcctaaagacaatgtcgtggtctggttttgttcggtgcgtagaaggcctgatgttcatataaaaactgcaattaacaagttaagtaatatattttaa

SEQ ID NO: 27688 - DNA, 558 bp, Glycine max
  Peptide Sequence Number=SeqID_144466
atggtgggttacacaccttccaactttgcagatatggtcttcaggatcgaagtgggtctgaaaagaggcaaatttggtcatcctactttgataaaaactggggcagatgaagaggatgagaatgagggagaaacccatgctgtggctgccattcctatatggccaagtttcccaccaacccaacaatgtcattactcagccaataataacccatctccttacccaccacccatttatccacaaaggtcatccctaaatcaaaccacaaaacgcacctaccacacgaccaatgcgaacaccacctctagcacgaaccaaaaacaccaacgaaggaaggaattttgcagcgaaaaagcctatagaattcaccctaattccgccataaccccaaccaagattcctcaacctccatttctccgagaatacgactcgaacgcaacgtgtgcttgtcatggagaagccccggggcgttcctttgagcattgtagggccctgaagcataaggtgcaaggtctaattgatgcgggttggctgaaatttgaggaaaattgcatgtaa

SEQ ID NO: 27689 - DNA, 282 bp, Glycine max
  Peptide Sequence Number=SeqID_144467
atgtggttaccatggcgatctccgaatcttttgatcaaagctgtggaaaatgactcccaatctgaatctgggttgttttggctccaaatgtgtagaaccaattttatgggacgaaggaatttcttgtacctcaaagaatttttcaaccctggcattccaaccaattgggtctgtccccccatgaatgctggcaactccaccttcttagcccaaatttgtgcttcctccatctctaacactggcttcccctcgaagatccagcaggtcggaccaatttgttag

SEQ ID NO: 27690 - DNA, 290 bp, Glycine max
  Peptide Sequence Number=SeqID_144468
atcttgctaacataactcttgcaattctttttggaaagcttcaggaacatgaaatggaacttatgagactaaaccaacatgaagaaaatgacaaaaaaaagaaaggaattgcacttaaagcctcatcttctactcaagaagaacgtgacaaagaggacttgaatgaaatagaagaagatgatgatttcaggctttttgtgaaaagattcaatataaatttcctagaaacaaaggaaatcaaaagagatcaaacttcaattcaaagaagaaaggagaagattcctccttag

SEQ ID NO: 27691 - DNA, 723 bp, Glycine max
  Peptide Sequence Number=SeqID_144469
atgggaagcgatggcgtgaggaaaccaagattcctatgccttcatgggttccgaacaagcggagaaatattgaaaacacagttacataagtggcctcaatcggttctagacaacctcgatctagtatttgtggatgctccttttccttgccttggcaaatccgatgtagaaggcatttttgatcccccttactacgagtggtttcagttcaacaaggaatttacagagtacaccaactttgacgagtgccttcagtacattgaggaatgcatgatcaagtacggacctattgatgggcttcttggtttctcacagggatcaatattatcggctgcgctgccgggtcttcaggagaaggtagtcttctacacatgtcttcttgacattggtccctacagcccttatgggcactctcggtcaaacatcggcgtggcactcacgaaggttccgaaagtgaaattcctaataatagtaggaggggcaaagtttaggtcaccttcagtgatggacaaagcatattcttcttccattagctgtccctccctccactttataggagagacagattttttgaacaagtatggggctgaactactagaatcctgtgttgaacccgtggtgattcaccaccccaaaggacacacaataccaagattagatgataagagcttgaagaccatgatggatttcatcgaaagaattaagaaagatgtctcaaaataa

SEQ ID NO: 27692 - DNA, 597 bp, Glycine max
  Peptide Sequence Number=SeqID_144470
atggctaagttcgggaggcctgctccagagattgaaggtcttgtggcggccagtggactaagtcctttgatcgtatgttccctagatatgggcgatcagggactaatgcctacttttgtggaatgttggcataaggaaactagtagtttccatttgccgtcgttgctacatctgcttgttgtagggacattccacaacttcaaactacttcatgtcgacgacgctattgatatgttggtggaattactcgagaatgagagttacgcttggggcactactgcacttttgcacatgtatgataatttaaataacgcgtcgaagagcatgacgaggcaacttgtaggatatatcactatgttacagtgttggatttacgagcatgtttcgtcagttggtgtcgttgtacctgtcgaggattataatgagaagagaccgcgtgcatgtcgatggacccctgacaaggcactgcctgttaacacgtatcgcaggcgtctagataaactgacccctgacgtgatgtgtattagcaaccgatggtggcagcggcacctaatgaggcagacgatgatgtgcatcatgtttgacatgcagtggtaa

SEQ ID NO: 27693 - DNA, 1038 bp, Glycine max
  Peptide Sequence Number=SeqID_144471
atgtcaccattgattatcttgcttgtttacttatgttgccatattctattgaagcttgaaggagaacaaattaaatctccatcaatcatgaaacaggatgttgcacaagataacaccaactcatatccaaagaaatcaatcccaccctacatgaaggctatctctggctcacttggagggattatggaggcttcttgcctgcagcccattgatgtgatcaagaccagattgcagcttgataggtcagggaattacaagggaatactgcattgtggtgccacaatttcacgaacagaaggggtacgggctttatggaaaggattgacaccttttgccacacatttgaccttgaagtattcacttcgaatgggttctaatgctgtacttcaatcagcatttaaggaccctgagactgggaaggttagcggtcatgggaggttcctttctgggtttggtgctggggtgcttgaggctgttattattgtcactccatttgaggtggtgaagataagactgcagcagcagaggggtctaagcccagagcttttgaaatataaaggtcctgttcactgtgctcgcatgattattagggaagaaggcttctgtggtctttgggctggagttgctcctactgtgatgcgtaatgggacaaatcagtctgccatgtttactgccaaaaatgctttcgatgtgcttttgtggaagaaagatgaaggggatgggagagtcctccaaccatggcaatctatgatttctggattccttgcaggcacagcagggcctatttgtactggtccatttgatgtagtgaaaacaaggttgatggctcagagccgagaaggtggtggtgtactgaaatacaagggtatgatccatgccattagaacaatatatgcagaagaaggacttcttgccttatggaaaggtctgttgcctcgactcatgaggatcccacctggacaggccattatgtggggtgtagctgatcaaataattggtttgtatgagaggagatatcttcaactttcaacattgtaa

SEQ ID NO: 27694 - DNA, 246 bp, Glycine max
  Peptide Sequence Number=SeqID_144472
atggagaaggagaagaagaacgcaatgaagaagaaccaacaacaaccatacgaaggtgtcatcattcaaacaacaagtcaagatattacttacctcgaaggagaacccatgaacttgacggaagcacgaacgcaggaacgagaagaagcaccaaaacgaagaagtcctatggagcaagaagcaggaagcagaacaggaggaagaagaagcgtatacagtgtggggaataatgactcgtacggatga

SEQ ID NO: 27695 - DNA, 975 bp, Glycine max
  Peptide Sequence Number=SeqID_144473
atggtggaatccactcgctccaaatccaacctcgattatttagaggatgcgatagccaagctcgccgccactcaagcatcgatgtcaaccaagctcaacgaccttcatcagaaactagcgattatggagtacattcaccattctccgatctcatcttccacacactcccctgcttcttccatttctctgtccatgcagccataccgcatgaaactcgaagtttcatgttttaatgggtttgacccggtgtgttggctattcaaaatcaatcagttctttgattatcatgcaatgctaaaccatgaaggcttgacgattgcctcattctacatggacagacctacgctcgcgtggtatcaatgtatgtcacgcaacaaccatattacattgtggcctggattcctgcaagctctggagtctcgctttgcgccctctcactttgatgatcccactggttccttgttcaaactcatccaacaagctgatgatgatgaactttcaccagaagatatgccatctattgaagcttttccaattgcacaggaacccgatgatccacctccaactcaaattagcttctatgccatctcagggcatatggcaccgaaaatgttacgcgtgatagggtccatctttgaccagaaagtcctcattttggtggacgaagtgctgggtgtgcaatggcttaagtcattgggtccagtcttgacggactatgtagacttgactatgaaattcaagcaccacaacaggaccatcgaactgcatgatggcattgatgcttttttccacatccgcctcatgaaccctgagctcccttctaaccaacaaacacaacccttgacccaagactcaaccatcatctctctacttcaccgacatcatagccttttccaaccaccaaccactttacccccaccccgcgatattacccacaccattaacctacagatacccccattttcaaaagcatga

SEQ ID NO: 27696 - DNA, 315 bp, Glycine max
  Peptide Sequence Number=SeqID_144474
atggcgccctctctagtggaagattttcatggcttacataatgaagttgtaggagagtttgaggacttcctcaacgttgagcatatggtaacaatggtagcagaaagctttaaggacttcctcaacatcgagcatagggcaacaacggtagcagaaagcactttccaaatatttctaatgggagagaatccagatcctaacttctactcaaccaaacaaagcattaatgatagaccagtcaacatgcatgaagcccaacacggaaggcctcagaggaaggtcacacctccgcaacattttcacgattacgtttaa

SEQ ID NO: 27697 - DNA, 219 bp, Glycine max
  Peptide Sequence Number=SeqID_144475
atggccgctaattcccacagattgggttcttcctacggcggcgctgccccttaccgatcaagagatgggcttagcacccgtcccgttggtgcctcggaggagatccaattgcgaattgatcccctggacttggacgatgagatcaccggtcttcatcgccaagttagaaggttgaaacatagcaaggttttaaaaatctgtctacagccgcaattttga

SEQ ID NO: 27698 - DNA, 483 bp, Glycine max
  Peptide Sequence Number=SeqID_144476
atggctagaggagtgagcaatgaaagacaaggtggatacgtgagtcctccggaagaagaagcttgtaagccacaggtgaaaggtttagagaaattgagtaggcatagcactggggctgagctaactgcctcttacaaggtgttccttggtcaagagatgaatcagaggggttgctatggtagcatatcctttgatgaaacatctataaaaacctgtgagacccaaaaatccccacagggttttaagggaggtgggtcgtggccattgttgaatggcaagtatcttgtcaggaacgggttgaacaccggttttatgtacgtcgtcctcgcgcacaagtatctggtgatacccatgcagcaaatcgagtttagtaaaccagcttgcgccaccaagctcatccaacaactcatcaataggagctcagggttcatgaggcggatgtggaaaaaagcatcaatgccatctgttaaatcatctgtttga

SEQ ID NO: 27699 - DNA, 1338 bp, Glycine max
  Peptide Sequence Number=SeqID_144477
atgaaaaagaaacgaaaggaaagtgaggccagtggatggtcgtcgaacttgccggagatttcgaagtcgcatcactcgctggagcggcgttcgcggctgaacaagcggtgcagggaagatcgcggcgtggcgacggtgccgccttcacgcggcgcgtcgttactcttgacgccgtcgcggggcttgaagcggaagatagggtgcatcgacaaggccacgcagatgggaaggagcatgaggatcgaggacgattacgtgaccgggggcagcgcgatcgggcaggggaagttcgggtcggtgacggtgtgccgcgcacgtgcgaacggcgcggagcacgcgtgcaagacgctgaggaagggggaggagacggtgcacagggaggtggagataatgcagcacgtgtcggggcaccctggggtggtgacgctggaggctgtgtatgaggatgatgagcgttggcaccttgtgatggagttgtgttctggagggaggttggttgataggatgaaggaggggccgtgctcggagcacgtggcggcgggggtactgaaggaagtgatgttggtggttaagtattgccatgatatgggtgtcgtgcatagggatattaagcctgagaatgttttgctcaccgggtccgggaagatcaagctcgcggatttcgggctcgccatcaggatttctgagggtcagaatttgacaggtgtggctgggagccctgcatatgttgcaccagaagtgttgtcgggtagatattctgagaaggtggatatatggagttctggggtgctcctgcatgctttgttggttggtggtcttccatttaaaggagattcaccggaagcagtttttgaggaaattaagaatgtcaaactagattttcaaacaggggtgtgggaatcaatatctaaacctgcacgagatcttgttgggagaatgctgacaagggatgtttcagcaaggatagcagctgatgaagtactaaggcatccatggatattgttctacaccgagcgcacattaaagatgttgccctttaaatcaaaattgaagctccaaaatgcagctgcttctgcacctgaatctgggttaggaggaaacaagatagatgatgatggttcccttgatgaggattattcaagcccattttcatcctctgaaagttgcaattcagagaatcatgaggactgtgtgtggattgatgcactttccactgcagtttcacgtgtgaggatatccgaaacaaagaggaccaagttgtggggtcccacaaccacaagtccacttgatcagcaaggttcatctaacatgaagactaacctctgtaaagcattctga

SEQ ID NO: 27700 - DNA, 192 bp, Glycine max
  Peptide Sequence Number=SeqID_144478
atgcgtgaaggagtgagtgaagcagcgatcttatcaaactggatggtggtgctgttctggtgtgggcttgactacgataagatttcgttgtgggcgttgatgattttggcggcacgggtcaacgcgtggagatgcggcgggattcggcgtttacgtgacgtggcgtttctgttatggagtgacggaaagtga

SEQ ID NO: 27701 - DNA, 213 bp, Glycine max
  Peptide Sequence Number=SeqID_144479
atgacaacaacaacttctctcttcctccttcacgaagttctcctacgtacctacacgagggctttatatggtatcctcttgagtctttggtctcttaaattttgggaaatggccctcgacttctcaaacattcaaagttttgggtacctacaaaaggaagtgcaacacttaagtcagatatcaaactcaagaagagatgagcataataaatga

SEQ ID NO: 27702 - DNA, 630 bp, Glycine max
  Peptide Sequence Number=SeqID_144480
atggacagagcaaggttggtgtatggcttggtcatgaagatagacatggacttgggctccataatctcagaccagatatctcaaatcgctcggtccaactcctctcggttgggctttccagcccttatcactgccttatgtttagccagaagagttgtgtctgattctctgacctttgagtctctgagcccgatcattaatttgtcatacattcagaagaattgttggaaccttgaggatccttctatcacatttccagggtcccgcaaggccaaggcccgagctcctttagatgcatcagtttcagcccctacacctccaacacctgtatcagctctagctggcccctccgtgcccaacattgacctgatcgtgcctatgttgcagaagcatgaaaaacctatctcagcaacaaccgatcatgaccatgcaagagtatctagcgcaagtggcttgacccggagtccagccttcctttttgggggaggtgaggctcctaaggcccaggatgcacagggcactctagaggataaggaggctgttgaggacaccccagaggctgcggaggatttaggggcagcagaggtgggcgtggacgttgattatgtagcagacgtcactacagcatag

SEQ ID NO: 27703 - DNA, 315 bp, Glycine max
  Peptide Sequence Number=SeqID_144481
atgttgctgaagggctcgctgaacgagccagattggctaagcgagactcatccacttagcgaggaagtcagctcgctaagcgagaacaaaaccctagagaatgttgagccacagagcagcacactcagcatgcagccagctcgcctagtgaggatgttgtctcttctcgcattagcgcgtccaagtccgcttagcgcacaaccactaattctcgctcagcgagacatgctcgctgagcgcaccttcgttttgagtattggaaaatgcttgaagtccttagaacttggtagagcagctagaagtctgcatttctag

SEQ ID NO: 27704 - DNA, 879 bp, Glycine max
  Peptide Sequence Number=SeqID_144482
atgggcgacttcacggttgcgttaaaccctcccaaaaccttccgctccgacaatctcctatccaccaccaaccgcatttccccagcggcgcgtggctttcaaacctcactcgcgttcaaaccgcgcgtttttcgaggaatccgcgcttcggtgatgccaagagagggccagccacaacaacaacaacaacaagcgtcgtctctcggagacgctctcgtcaacagtccgcgccgaaacgacgtcgtcgaggccatcggaagaaccgcatcgctctccaactgcctctccgaaacgaacctccacgccaccgttcccggcctcgagtccaaaacccgcggcaaagttcgagatatatacgacgctggggattacctcgttttggtgaccactgatcggcagagtgcgtttgatcggattcttgcttccattcctttcaaaggccaggttctcaatcagacgagtttgtggtggtttgaaagaactaagcatatcgtctctaatgcggttgtatcagctccagataacaatgttacaatagctaggaaatgttcagttttcccagttgagtttgttgctagagggttcgtcactggaagtactgatacatctctatggacagtctacaataaaggcgttcggaactattgtggaaatgtcatcccagatggaatggtaaaaaatcagaagttgcctaaaaatatactcactccaacaaccaaggctgcagatcatgatgttcctatcactccagatgagatttttggaaaaaccccatatctcgtacctggtaccgtactgatcatagaaaggggactgatgactcgagctgattatgtagaagcaagtgaaaaagcattatccttgtttgaatatggacag

SEQ ID NO: 27705 - DNA, 1098 bp, Glycine max
  Peptide Sequence Number=SeqID_144483
atgattgtacacagagatattattgttacaattatcaaggataagataatagaaaatctggtaagatggtacggatacatgcaaaggtggccattgaaggcactggtgaggagagtagattgcatggtttttagctttgtgaaaagggatggagggaggctaagaatgacattagaggaaattattaatagggatttcaagcttgctaaaaagtaccatccagatgcaaataagaataatccatctgctaagaggaaatttcaagatataagagaagcttacgagacattgagagactctaaaaagagagcagagtatgaccagatgcgtactcgtggttcagaagacatagaatatgatcgtgatgatgcagaaaggtttagaaatgcttatcgttctcatttttctgattcatttcataaagtattctatgagatatttgaagaagcaacaactcaattctcatcaaatatagaggtggagatgtctcttactttctccgaagcagcgagaggatgcaccaagcatgtgtcatttgatgcatcagttccttgtgatcattgcaatgggcagggctatccacttgatgccatcccaaaagtttgtccaacatgcaggggctcaggtcgagttacaatccccccatttacgtcaacatgcattacttgtaaaggatcaggccgaatcattaaggactcttgtataacatgtggaggatctggggtggttgaaggggttaaagaggttaaagttacaataccagcaggtgtggattcaggagatacaatccatgtgccagaaggtgggaatgctgctggaagtggaggtcaacctgggagtttatacattaaaataaaggcaattttctgtccaaatattctcacattaacatgtgctacctgctgggttaatgtccattttggtcatccaaagctacatgtggctgaggattcaatctttgtcagagatggtgcagatatctacgtggattctaatattagctttacgcaggctattcttggcggcaaagttgaggtgcctactttatctgggaagatgcagttaaaagtaagacaagatttactttttcagtattag

SEQ ID NO: 27706 - DNA, 144 bp, Glycine max
  Peptide Sequence Number=SeqID_144484
atgtctagcatgaaccataaagagaacggtctcgatttgaagctcgagtttaggatcccatatctccatccaagaagctttggaagtagatgttcctctccatccaagttggtgctttgggtggctcgccatagccgcatctaa

SEQ ID NO: 27707 - DNA, 297 bp, Glycine max
  Peptide Sequence Number=SeqID_144485
atggtaggaggtgatcaaggcaacaacaacgacaagagtggtagtgacaacgatggtaatggtggttgcggtggtgacaatggcaatgaaaatggtgggagtagtaacggtgaaaaaaacagtgataggatggtaatgacaatagtgatgtggagtgatggcaacaatgatagtggtggtggtggtggtggttgcagtgacaataatggagatgacagtgatggtaatagtagcaatgacgatgacaacaataatgaaatggtgatgataatggtagtaatgacgataatgcaatag

SEQ ID NO: 27708 - DNA, 348 bp, Glycine max
  Peptide Sequence Number=SeqID_144486
atgttgatggaagttccattggcaaccctgaggtgtggcgctttgaacaaagtctttagaattgttcaatgtgaatcagactcgcttgtggctttggatcttattaatcatgatcaacctccgtggcatccttatgttgctttgctcaacacgattctatctttcaaagatagacctcggttcctaagttttaaccatgtctatggtgaagagaaccaatgctcagattggctagctcgcatgggatcatcatctgcagatgtgttcactattttagattcctcacctcatcccctggcaactttcttgttagctgatgccatgagggtttctttctctaggctttag

SEQ ID NO: 27709 - DNA, 123 bp, Glycine max
  Peptide Sequence Number=SeqID_144487
atgatttatggacatggaaggtggaaccctagcttggcaagtgtggtgcagctagctgaggagagttattcttcacatgctttgtttccaatctcaccaagtctggcgacttccaaaccttaa

SEQ ID NO: 27710 - DNA, 1044 bp, Glycine max
  Peptide Sequence Number=SeqID_144488
atgtccctccgcaagaggctgagaaatcttgggcacaatctcaaggacaaagcctcggtgatcgcagcatcactctctctcaagcgccacgtgtcctccgtccgcatccatgtcctccacgccaccacccaccgcctctctgctccgccatccacgtcgcaaatcgccgccgttctctccgccggaaaaggctcctatctcctgtcacgcacctgcatagacaccatcatggaccgcctccacagaacccgaagcgccacggtggcactcaaatgcctcttcactcttcacaacatcgtatccgagagaaagggacccttaacgttgaaggacaacctctcccactacccttcgaacggaggacgcaacgcccttaacgtttccaccttccgcgacgacacggacgttgaaaccatggagctcagcgcgtgggttcgatggtacgctaatgttctcgaacatgtcttaaccgtttcgcgcgttttaggttattatctaataaactcgaatgacggcaccagagaggttttttcgagtgtcgagttgtttcgtgaaatacgaggtctcgtggattttgttgagcaagtgagccacgcgcctgagtcgctgcatctccaaaaaattgagttggtgttcaacgttgtgagattggtgtgtgaggattacgggcgcgtgcaacgcgagattttgcggcgcgtggaggagggtggaaatagggtggaggatttggatgttggagagttgagggaatttgtgaggtgtatgaagagattggaggggtgtagggagaaattggtggttttgtttgtgaataggaagcgaaacgatgcgttttgggatttgattggaaaggttaagtataagggggtggaggtgatggaggagatggaggggaagtggttgatggtagtgaaaaagggcatgaacgagttggctgagtcgactcggttcactaacccatttcttgagcctggggagtttatgtattccggtcccaccgggtggcgcgtggccacgtgtcaacctgttccaacggtgggatga

SEQ ID NO: 27711 - DNA, 690 bp, Glycine max
  Peptide Sequence Number=SeqID_144489
atgtccttgccatcagaggactacacgtcctcgccttcagagggccgcacgccctcgccttcagaggactacacgtcttcaaacttcagaggactacaagtcctcgtcgtcaaagggtcttgtacgttcacctttgtagggctacacgccctcaccttcagagtactacacgtcctcgcctttagaggactacacgtcctcgccatcagggactacatgtcccccattttcaaagggcgacacgccttcacctttagaggactgcacgtcctcgccatcataggactacactccctcagacatggtctgtgccatcatgacatagggatcgcacccacaaagacacccagtggacccggagaagtccaacagggccctggggtttccagctctggttgcgggcctctgtcagtcctacagggtgcccattcccccagcgaggaatcgctctcacaaagacacccagtggacccggagaagtccaacagggccctggggtttctagctcagggatcgcgcctgcaagacacccagtggacccgaagaagtccaacagggtcttggagttgtcaagctctaattacgggtctctgtcagttctacggagtgcctgtcacctccagcaagggcatcaggccccttactaatcgagctttcatcaagaagtactgcgtccccaggcaggcgtag

SEQ ID NO: 27712 - DNA, 462 bp, Glycine max
  Peptide Sequence Number=SeqID_144490
atggctaataccaaggccaatcaaagtgagtctagtgaaatctctccaaatgagaccagcaagaggcaaagaatgtcacctgcctctgttgaagaatgtccaagacttattcctaatctccctgatgacttatcccttcagattattgctagacttcctagaatttgttactatcatatatcccacccttcaacagattgcaagataaagaacaatttgacacccaccgtggtgtcccagtgtcaccatttgctgatcccaattgttatggcaattactcaaatcggaatgaacacaacaacctcaacccaaccaacgcagcaacaagataacgatgatgaagtacatgttgagaccaatttgtcctcgtttgtgtggcagttgcaagaacaacttttcgagatgcgtcgccaacacgctcaagagatttcaacccttcgacaagaaaatgttgaactctga

SEQ ID NO: 27713 - DNA, 381 bp, Glycine max
  Peptide Sequence Number=SeqID_144491
atgacaaatgcatcgaatgcaatggtgtcaatcaacagatcaaatgtaatgacatcgacaaatgcatcaaatgctacaacaccaattcttatatcaagtatgacaacttctacaccagtgtcgaatatgatgagcactacttctatgctattatattccaatgtaaatttagtgtcgaatacaagattagaacaaatctctccatttatcactatgcccacaatggggccaggaacttcataccaaggaggtcaaacattcaataacaataataatggaactcctcttaatttgagggaaatgcttatcacaatgggtcagaaaaaatacaaggttcaggtaggaatgaagaaagtgaacccttatctgcatagattttga

SEQ ID NO: 27714 - DNA, 237 bp, Glycine max
  Peptide Sequence Number=SeqID_144492
atggccaggaaaagaaagtttatttgtggtgcacttattataataaggcatgacatacgcaggagaattgctggaaattacgtgataaacctaccaatcgagaattgggacaaaaaggaggaacatctggaggagtatcttgaagaagtggacaagtctatgtggctgaaaagaatgaagaaaaggcaaactcttctagcttattggaatctactagccttagtcaggaagaaatag

SEQ ID NO: 27715 - DNA, 267 bp, Glycine max
  Peptide Sequence Number=SeqID_144493
atgagctcccatagggggctcagcttccgcacaaaagggttatttagcaagattgactgggctcttgaagctgtcaaactttttggcaactgtcagaattctgatgactttttcggcaactatcagaattccaatgactttctggtgactatcaaaattttgacgactattagaatttcgatgactttctacaaactcaattttccaacaatttttcctattgctttcaagtacagaggaggaggttgtgcatccacctcaaaataa

SEQ ID NO: 27716 - DNA, 595 bp, Glycine max
  Peptide Sequence Number=SeqID_144494
ccaaactttagaggaatacatcaccaagggcagggaactgattgcagaattgctaaagggaatatctctaagcttagggcttgaagaaaactacatacataaaaggatgaatgtagacttgggctcccagttgctggttatcaactgttacccaccatgtcctaagcctgaacttgtaatgggccttcctgcacacacagaccatgggcttctgaccctcctgatgcaaaacgagcttggagggcttcaaattcaacccaatggcaaatggattccggtccatcccttacccaactcctttttcatcaacacaggggatcacatggagatactgagcaatgggaaatacaagagcgttgttcatcgagctgtggcgaacacgaaaggcattaggttttccgttggtatagcacacgggcccgagcttgacaccattgtggggcccgcaccggagcttgttggtgatgatgatcctgctgcataccgtgccatcaaatatagagattacatgcagcttcagcaaaaccatgaactcgacgaactttccggtggcttaatattttgcatcacttacactttgttatacaaagattag

SEQ ID NO: 27717 - DNA, 534 bp, Glycine max
  Peptide Sequence Number=SeqID_144495
atgccaagcatctcacaaggaccaaagaatggtcgcatgtcatcgagcaaaggtccccggatgaaattaggaattaggccttgcaatgcttgcttcatcctcttagtcttggaccttgtcataggacctccaatcccttgtaaaggatcattagacagactacatggtcacatgattttctgtaccactaaggcgataggcatagaagaagagatcaagaatatggttaaaggggattcaatatcaaaggtccattgctttaacaagaaagaaacatcttcagatgcacttaagatgctacccatcacctttacaacaattgacttgaaggtgatagacctggtacaagacaaccttgcaataatcattgtggagatcactaactgtgtagttaaagaaacacttgtcgaccaagatagctcgactgacatcaaatgttcaaacagttggaaatcctcaaagaggagcttttaccatatgatgaaccctaggttagattctctgggaaagaataatcacaagggggtggattga

SEQ ID NO: 27718 - DNA, 653 bp, Glycine max
  Peptide Sequence Number=SeqID_144496
atggccaatacttgtaaacaggggaaatctcatctctttcttgttttaggatactcatggttgtggtggactacttgtaacgttgttgcggcaaggacccaaattttgaagcccggagatactttgaattccataaccaagttgtgttcagaaagtagtaaatatttcatgaagttttctgaaacaggttctggagcaggcgcttacttgttcataaaccaaccagttgacgcggattctgtagttctgtcgttggacctctctggtcaactgaaaatagaatcaaataacacaaaaactattatcctgtactcttcaccaccaccatcaaacaacattgtagccacctcgttggacataggcaactttttgttgcaacatcatcgctccgatgtgacggagagtgaattgtggaaaagttttgattatcctacttatacattgctccctgggatgatggatcacgggtgtgtcttccatgggaggaaaatgcgcggagtcgccaccaacgtttatttgaggaaaacgtcagaaaaaccggaaaggtgtagtctacgaagtttaattgtgaaaggttcgggagttgtttttacgcacggggaaggtattagcaccccacgcctccgtcacaagggaagacagcctttaaccaa

SEQ ID NO: 27719 - DNA, 519 bp, Glycine max
  Peptide Sequence Number=SeqID_144497
atggctgcctcttctgcttcaactcaaggttgtgttctcccaatcacttcttttgctactgaactcgtagagttcaatggcaaatgctttgcaccctcacctggtttggaggctgagaccaaaaagctttgggaaactcaggtaatgatccctttctctttagctgaaaagcaactagcttttgcagaattccctgttgagaccccaggtgaacaagccaaattgatcgaaatatggacatgctttttgacttgggatattttagttgttggtctcaatgtcaaagatgtagctttttatccttaccatcttcaacttttctctcatcaatttggtcttagtcaattgaaaccatatccaatcatgaagaaactcccaaatcttgaggactttgtggttacagaagataataggtggaacaacttctattcgaaagaatttattactgcaccaaggaattcgataattggtggaacaacttctattcgaaaaggaccatttcacttgagaattgcctaa

SEQ ID NO: 27720 - DNA, 540 bp, Glycine max
  Peptide Sequence Number=SeqID_144498
atgttcagcgttaaggaattagttgattcgaatagtctgaggtctgttccatccaattacatttgcctaaataatcccgaagattccatattgtataatgaaacagagaatattccaaccattgatttttcccaattcacctcttccaatcccaatgaacgatccaaggcaatccaacaactaggcaatgcttgccgcgattggggtttctttatgctaatcaatcacggtgtatcggagacactaagggatgaggtgattagggcaagccagggcttttttgatctgactgagaaagagaaaatggagcactcagggaggaacctatttgatccaataagatatgggacaagcttcaatgtcacggtggacaagacccttttctggagagattatctcaaatgtcatgttcaccctcactttaatgctccttccaagcctcctggttttaggtaccattcccctcactctttgtttttttactttgtcctatatcattcttggaaaaaagaaagatatataaagagaaaagtaggataa

SEQ ID NO: 27721 - DNA, 270 bp, Glycine max
  Peptide Sequence Number=SeqID_144499
atgaatctgaggttcgttttcgaaaaactcgacgcggcaagcctagatctaaactcaaaacggacaggatcctacccttttgcttcgtgtttggctgggctggaatggctttgggctggtgactggcttggccgatggtggtggttcacggaggaggagggtgttgctgagtggtggctagtggtggcttggctgttccggcattctgactgttcgtattcacctctgacgcgcacagtaattaatgcagcatttaaagggcagaattag

SEQ ID NO: 27722 - DNA, 1251 bp, Glycine max
  Peptide Sequence Number=SeqID_144500
atgaaggaagccgagctacagccgcccgcccgcaagcgcgcccgcagcctgaaattaagtaccgccgtcacgctgatgattggcagcgttattggcgcagtgctgctgctggtctacgcgctatggtttatgcaaatcagtcacgccactcgcgacggcttaaaagagacggcgctggcggtggcgcgcaccatggccgatatgccgcaggtgaagcgcggtctcggcgagccgccgcagagcaatattattcagccgctggcgcagtccattacccggcgtaacgacctgctttacgcgattgtgaccgacatgcgcggcattcgctattcgcatccggatagcgccatcatcggtaaaccctttatcggcgaggatatccgcccgaccctcgccgggcgggaaaacgtggcgattaaccacggcgtactggcgccggcgctgcgcgtgtttaccccggtattcaatgaacagcatcagcagataggcgtggtagtggtaggtatttcgctaagtaaagtcgacgaacagatcgccaatagccgctgggacgttctgctgaccattctgttcagcgcgctggtctgcgctatcggcacctggagcctggtgcgcggcttaaaacgtattctgctggggctggagccgcaggatatctccacccaattccagcagcgacaagcgatgctgcactcgctgaaagaaggcgtgatcgccgtggatagcagcggccaggtcacgctgattaacccggccgcccgcggcatgttacttagcgggccggataaaagcatcgatcgcaccccgctgcttgcggacctgcaggaagttctgcgcagcggcgagcctatctatgaccgcgcgctcggctgtaatggcttattgctgatcagcaataccgtcccggtgcgcagccagaacgccatcgtcggcgcgatcagcaccttccgcgataagaccgagatgagtcaactggtgcagcggctggacggcatgatgagctacgtcgatgccctgcgcaccacttcgcacgagtttatgaacaagctgcacgtgatcctcggcctgctgaatatgaaaagctatgacaagctggaagaatatgtgctgcaaaccgcccatgcctatcaggccgatatcggtgaaattcagcaccggataaaatcgccggtggtcgccggcttcctgattggtaaaatccagcgcgccaaagagcgaggcttcacgttgaacctcgccgaagagagcctg

SEQ ID NO: 27723 - DNA, 402 bp, Glycine max
  Peptide Sequence Number=SeqID_144501
atggaaaattgctcgattttgttgtttagccagaagggaatagaggtggatccagataaggtgaaagcaattctcgagatgctcgagtcacgtacagagaaacaagtcctaggtttcttagggaggttgttgcataagaatcagtctgttaagtgggataatgattgtcgggtagcattcaagagaattaaacggtttttgaggaatcctcctgtgctcataccaccagtgcctggaagacctcttatcatgtacatgacagtgttagatgagttgatggagtgtgtgttggggcaacacgattgtcgcaacctacccttcggcgggagggcgacgcgtgactcgctggatgcgtgttccacgaaaggaatacgcgcggagtcgccaccaacgtttatttga

SEQ ID NO: 27724 - DNA, 332 bp, Glycine max
  Peptide Sequence Number=SeqID_144502
atgtcattgcctggcgctgttcatgtgtcctccaccttcgagtttggagctatgcttcatgattgcctaagtgtggaccctcaacacggagcctctggtgactgggaaatatgtttttctgttattttccggatcgcaaaaaaagaaggagtagagacgagaattgtcatcacggaaagggcagaacggacgaaatcagtgtcttatctttgccttcctcttatcttcgatgagagatacttggcaccctttgttgcacaatatgtgaagtcccgagacgtgccgaaaatcaaaaggaagcaggcttacgcgatccgtgaaaattccgtaat

SEQ ID NO: 27725 - DNA, 156 bp, Glycine max
  Peptide Sequence Number=SeqID_144503
atgggttttcctttgccggcagtcatttaccttgccgaaaatttatctggtttcagcattcgtcatttgctctcccttgaggagatttcgttgtgctttgcttcggaggaaaggatgaggattcttttttataggccaaggttcaacaaagtctaa

SEQ ID NO: 27726 - DNA, 237 bp, Glycine max
  Peptide Sequence Number=SeqID_144504
atgtgtgaagacatgatgcagatgcgcaaaagcgcaacagagggacggactaccagcaacaatatgttatcaaagagaaaaactctagatgagggttcactgttatcaagcaagtcggagacccagcatgaccacagattcacctccactccttatgttcccatggacccgggtatagggcccctttgcaactcaccgtgtgtacaaatagtgttggtgtttgtgtgcatcaaatga

SEQ ID NO: 27727 - DNA, 502 bp, Glycine max
  Peptide Sequence Number=SeqID_144505
gaaattgtcctatgtcaagggagattgtctgatgtctggggtagtagccttgacattagtttgtcaagcccccaagtacggacaagagttgtttggtgttgagagtgataacctcaacaagcgtgagaattgcaagtctgtcaaacttgtcaagccccccaccctggacaagcgtgtgcggcacacgcgtaatactcttgcatacgtgtcacttgtggagtgcacacgtactggagatgcaatacgggggttgagggttttacatcgtattggtggaggcatttctcacctccgcgggagggtgcaaccttccactacttccttggctggggaacctgtcccggtcactgtgattctccccccttctatttttgggggagcaaggagaagtggtggtagggacgctaaggcgtctcttgcgtgtgacgtgaagctggaaaaccctgaggactcctacaagatagtcatccaggcttgcgggagtgatgactttcctttttag

SEQ ID NO: 27728 - DNA, 825 bp, Glycine max
  Peptide Sequence Number=SeqID_144506
atgagggaaaaaggggcaataatcatccttgaaggtgctaacaatgttactctaaagcaagcccttaagctcaacttcaaagcctcaaacaatcaggccaagtgcgaggcgcttattgcaggtctaaaactagcaaaagaaggagagcaacaccagagcaggcctgctctcaaagctggcaacaccaaaatgaccgggcaccttaagattattatccaagacacactccaaactcccaccataaacactgaggaaatgagaatgaagctcgagccagctactatatcatccttgatggtgagctattcaaaagaggacattccacgcaccactcctgacaatcgtcacaacttgagctccccttggcccttcaccatgtggggaatgaacatattgggaccactgccaaagaccccaggagcagttaaatatctactagtcgctatcaactactttaccaagtggatcgaggcaagaccattgcgacaagtcatagccaatgaggctctatgcactagacttgacaagtctacgggtctatgtgatgcaatcctccctaggaagggaccagtcactagagccatgagcaagaggctccaagaggattgggctagagctgctgaagaaggccctagggttctcatgaacctcaggagcacaaaatttcgtgctcttctcttcctctcccttcattcatctccttcttcctccaagctcttatccatggcctcttatggtgaagcaaaggaatccattgatgaagaagatcctaggcctacaagctccaatggagcttacatcactatcgaaggaggaactccctag

SEQ ID NO: 27729 - DNA, 420 bp, Glycine max
  Peptide Sequence Number=SeqID_144507
atggtgagagccattgatgtcctgggtcttttcttcaatattcggcccagtgtgctggtcagacttactggtgtgactatgccactatctgttgttgctctcgctactagagaatggggtcaacctgttgttgaggttggccatattggtggcattgtcgaggtctccctcaatgctctttcctttattttggctaagaggaagcaagatgacggtgctggggtgtcaggccgtaataagtcgagggcacctttgagccttcataccctgaggcaagctacagggttgatgcctggcttaggctgttcttcgagtttgcaagatctgcctctagctccatcaattgttgaggcttctgctcctgatgctgttgttgttgttgttgttcctgctcctccgactcctcctactgatgagtag

SEQ ID NO: 27730 - DNA, 705 bp, Glycine max
  Peptide Sequence Number=SeqID_144508
atggcggagaagacaaagaaaagactagacgaagttgcccagtccggaagcactaagggcgtcattgaccgtccatctcccatcagacgccacgtaaagtggaagatggcccgcaccaagaaatctgggcagacgacgtctgaggcagcaaagaaaattgctgagaagattgatgtcctgactgctgcccttgggcgaccagaacaccctggccgtgtccatgctgctggagtcggtgtcaccataaaacaatacttcggatcggctccacgaacctcccgtagttcttcctccctacctcctgaagacctccatatgcagtcccagtttcagtcacagatgcaatcacaggaacttgcactgcctctggagcctgaggttggtccctcagatgcacgtgtcagcacaaaggagagttgtgtcgatcccttagggaacaatccagagacgggtaagtcaaacaaatgcgggttgtacattgaagaaaatccttctcgcatggtttccctaggaagactttatgagggatccacagcggttcacaacatccctttattgcatgaccaagtgaaggttggtgttgaggaggttaaagatgaagaggctcgcattcctgtacccactgacaaggttaccctagtggggcagacacttaacaccttacttgcttggccgacacatcacgtgaagcgtttatcagaacag

SEQ ID NO: 27731 - DNA, 744 bp, Glycine max
  Peptide Sequence Number=SeqID_144509
atggatctggcactggtcaccggcggtagccgcggaattggacgggcaacatcgctgctgctggcgcaggcgggttatcgcgtggcaatcaatttccggcagcgcgcagcagaagcgttgcaggtggtagcagatatcgaagcgcagggcggcagtgcgtttgccttacaagcggatattgccgatgaagcgcaggtggtgcgcatgttccgccagctggatcagcagccgggcgcgctgcgcgtgctggtgaataacgccggtattctcttctcccagtgccgggttgaggatctggatgctgcgcgcattcagcgcgtgctggcaaccaacgtcaccggcacgtttatctgctgccgcgaagcggtaaaacgcatgagcaccgcacacggcggtcagggtggcgctattgttaacgtctcgtcagcggccgcgcgtaccggctcgcccaatgagtatgtcgattatgcggcgtcgaaaggcgcgatggacacgctgaccagaggattgtcactggaagtggcggcgcaggggattcgcgttaacagcgtgcggccagggctgatctacaccgatatgcatgccgacggcggcgagccggggcgcgttgatcgcctcgcgtcatcgctgccgatgcagcgcggcggccaggcggaggagatcgctgccgccatcgcctggctggccagtgacgccgcttcatacgtcaccggcagctttattgatgcatcaggcggtcgttga

SEQ ID NO: 27732 - DNA, 216 bp, Glycine max
  Peptide Sequence Number=SeqID_144510
atggaaaaaaatcccttgacaaatttgatgcgaaagtcgatgaggctatttttcttgaaaactctttggaagatgaagatggaggttttcaggataagggcattgcacttgaagatgaatccaaagttaaagagctttaacaaagcaaagaaatcactgccacacctcctaaagacctcccaagagaatggagaactcaaagagacctctcattga

SEQ ID NO: 27733 - DNA, 192 bp, Glycine max
  Peptide Sequence Number=SeqID_144511
atgaaggggattgggtttggctccatcttaggaaggatagatttcctactaacagaaagtgtagctaattcagatgatgagtggtctgcagatttgaggacaaatcctcttcaaaagggaggggatgatgcaatcctcccaaggaggggacccgtcaccgaagtcatggctaggagactccaggaagattag

SEQ ID NO: 27734 - DNA, 612 bp, Glycine max
  Peptide Sequence Number=SeqID_144512
atggcagtagtgcttgtccccctagtgcccgacgttcctaacaatcctacacgtaatcacgctaatatccaggccttgtgcgagtgtggattctggttcagtcatatgagttggctatttgataccacttctatcctagaaaggtgtggagaggcaaacaatgttggtgatttggagaaacaatccttctatagatttctccgcagcacttaccttgcccatccttttgctttgggagcccttctatatgccgcaggaggatttcctttccttgtttggggaatgggagtgaggattgtttgggtttatcacataacctggtttctaaactcagcttgccatgtctggggaatcaagcatggaacaccagggacttttggtaattggtttgagtttttatatatacattataatcttaggtgggtggcgttgcttgcatttggtgagggttggcacaataaccaccatgcttttgagtactcagctagacatggacttgagtggtggcaactagacatgacttggtacgttgtgagatttctccaagctattgggttggccactgatgtcaatttacccagagagtcagaagcagaaaatggcattcaatag

SEQ ID NO: 27735 - DNA, 942 bp, Glycine max
  Peptide Sequence Number=SeqID_144513
atgctggaacacaatacccgccaagccacccttgatcgactggaggaagcagtccaccgcctcacccaagcccaggccaccttatcccagaaccacgcaaacctcacccaaacacaaacctccatgaccaccaagctcgacttcgtccttgaacacctcgccgcattaatcataccaaccccatcccctcagccacctccgcacacgacctcacctccgccacccactcccaaaccacatatgaagcttgacgctccccgtttcgatgggcaagatccagtgggctggattttcaaaatcagccaattctttgactaccaaggcttacccgaccacaagaggatcaccgtagcttccttctatatggatggtccagcgctttcatggtaccaatggatgacccgcaatgggttcatctcctcctggccggcactactccaagctttggaatccaaatttgctccaacattttttgaagatccacagggggctctttttgaattgcaacaacgcagttctgttaatgattatttaacagaatttgaacgattagctaaccgaatcattggcctatcttcgccttccttgttgagttgttttatttcaggtctatacccggagctccggcgtgaggttcaggcgcttcagcctatgtcgttaccgcaagcagtggctcttgcaaagcttcaagaagaaaaactccaagatcgtcgctggccacctcgcgcacagccatttactcagtcacaggtttcgcgtcctgccactagttcttctctagttccttccacagttcgtcctcagattaagaggctcaccgtcggggaactcgttgtccgccgcgacaaaggcctttgttaccactgcgacaaaaagtggatcgtcggtcatcgttgtcgaccacgtctccacttactcatcgcagatgaggaagatgactga

SEQ ID NO: 27736 - DNA, 1047 bp, Glycine max
  Peptide Sequence Number=SeqID_144514
atgcttcataacattatgcaatgtcccactgaccacccagggttcactgttaaaaatggcatgattttttcacaagataagttgtggctcccggcgggacatgacctttctaaggtgctcatggatgaatatcaccacacctcaaccggcagccatatgggtgttgagaaaacttttcgtcgcattaatcaatacttctgttggcctaagatgcgccatgatatcaagcaatatatcggccactatggtatatgccaaatgacaaagcagcctaaccttaaacccgccggcctctggcaacccataccacttccttcttctttctgggttgacctctcaatggacttcattacaggcttaccaccttcccagagctacaccaccatcctggtagtggtggatcgttactctaaatccatccacattggtcccctcccgcaacattacactgcccacaaggtcgtcatcctattcctggacatcgtttgcaaacatcacggatttccccgcagcatcatctcggacagagacctcatcttcctcagtgccttttggcgtgatctttttttgcctcatggcaccggcctatcgcaatttgaggttatgtttggcaaacctccaccagtccttcctttttattgtgtcgggacatcacccgttgaagcagtggatagtatattaacatcgcgggagacaattcatagcacactcactcgcaggttacaaaaatatcaggcaaatatgaaacgtgtggccgatgctccccgctgggacatctgctttaacatcggcgactggttgccctcatcgtcgaaaatccatcccgtgtttcatatctccctccttaagccccaccatggaccaccaccacccgaagctccgaacttgccagctttcactgttgatcaccatcccctggtgcaaccattgagactattggactggaaaatggatgagtccacaatgcctccaacaccaatgacactggttcaatgggctaggcttccgcccgaagagaccacgtgggaaaattggccccaactctaa

SEQ ID NO: 27737 - DNA, 1430 bp, Glycine max
  Peptide Sequence Number=SeqID_144515
atggcgtttctgaccggccactcaggcgcggggaaaagtaccttactgaagctgatttgtggcattgagcgcccgagcgccgggcaaatctggttcagcggtcacgatatttcccggctgcgtcacagcgaagtgcctttcctgcgccgccagatcggcatgattttccaggatcaccatttgctgatggatcgttcggtctacgacaacgtagcgattccgctgattatttccggggccagcggcgaggatattcgccgtcgcgtgtcggcggcgctggacaaagtcggcctgctcgacaaagcaaaaagttatccgattcagctctctggcggtgaacagcagcgcgtcggcattgcccgcgcggtagtgaataaaccggccgtgctgctggcggatgaaccgaccggtaacctcgataacgcgctgtcggaagatattttgcgcctggacgtctgcacggaggccacgatggtcaataaacgtaacaagcgtccggctgcgccgaaagcggcgaagcagccgtcaaagagcaaagcgctgaagggcggctggcaggagcagtggcgctacgcgtggcgcggtacgctgtccgacatgtatcgtcagccgctggcgacgctgctgacggtaatggtgatcgcgatttcgctgacgctgcccagcgtgtgctacatggtgtggaaaaacgtcagccaggccgccgcgcagtggtacccggcgccgcagctgacggtttacctcgacaaagcgctggatgacacggcggcagagaacgtgaccgccgagctgaaaaagctcgatggcgtggacaaggtgaactacctgacgcgtgaagaggcgcaaagcgagttccgcaactggtccggttttggtggtgcgatggatatgctggagcagaacccactgccggcggtggcgatcatcacgccgaagctgaacttccagaactccgataccatggccaatctgcgcgatcgcgtggcgaaagtgcagggcgtggatgaggtgcgcatggatgacagctggtttgcgcgtttagccgcgctcaccgggctggtggggcaggtggcgtcaatgatcggcctgctgatggtggtggcggtgttcctggtgattggcaacagcgtgcgtctgagcatttttgcccggcgcgacaccatcaaccggtgcggtgctgtcgctgattctgtcggaagtgctggtgctgcgcctgcagtcggtggtggcgcaggtcgcctccgtcttcggtctgctgctgctgttaatcgcggccatcatcggctggattgccgcctggctggcgacggtgcaacatttacgtcgttttacgccgcagtaacccatagcaacgattttttgatatactcttcctctgctgccgacgacctgggagcagaggatttctccgatttcccccgccgtcatct

SEQ ID NO: 27738 - DNA, 369 bp, Glycine max
  Peptide Sequence Number=SeqID_144516
atgttccacacacctgacaactctgccaaaccgagtgaagcagtaaaatatgcatcatttcaagcacttcatgaatctcgaagtcatgtagatgacaagaaagtcacctcaatgttgtcaccatcaccatcacgactgatgttgcgacccaggtcatctcgggtgacacttgacctcttgtccatcatggaggagcctgtgacaacaatccgaattttgggtattgagattcaaccttacctcccaccaccacctgggtctgttcgaattttgggtgttgagcttcgaccttaccttccaccacctgggccattgttggaaatcgacgctcctgtatccaacgcaaacatgaagccacaaccctcataa

SEQ ID NO: 27739 - DNA, 297 bp, Glycine max
  Peptide Sequence Number=SeqID_144517
atggtaaaattagtaacattggcaaaagggaacacaacatggcaaaagggaagatttggtgaaaatacaatcatcagtaacattgatacaggttttgtgggtaatgttgggtcctgcacaaagattaataggcccgtggacattatcacagttgtggggggtcaaggatactcattacatgcagatatacagtatcttgatgctagatgggaagttcttgttgtgcttcctctgcgtgattgttttgcccaagagatcaacatgctatgccgccttgatgggtttgtagtcctctag

SEQ ID NO: 27740 - DNA, 396 bp, Glycine max
  Peptide Sequence Number=SeqID_144518
atgggtagtaatattcccacacaccctcataggccaattgatctaatgggggtagttttacaaactatttctccatataggtctgttttgaaagatattacgagggggtgctgctttttacgtgattttcacgctgcatgcaagccaaatcgccatgcacgctggcgatttcacgagggaaggccggtggttatcgccacctccattggtgagtcctacgtggacacatctcgctgggttgactggcgagtccagtctacgtatgtgcataggctagggttgggcaggcacaggggtgcaggaggtgcaggagttgcagagggaatcaccattgtgactagcgatttgcgcttcgggtatcgccactgctggcgatttgcgcttcgtgaattataa

SEQ ID NO: 27741 - DNA, 231 bp, Glycine max
  Peptide Sequence Number=SeqID_144519
atggttgatagtctgcttgcacaatttttggcagtgccacaaaacatcttaaagaaagcgacattgtacacgactcagccaggtgaagccccactgcctaggtcattgttgacactcgacttgcatgtatctgatgttgaagtagaagtcactactcttatactcggaccaccgggttcggagaaggaagcaatcgagaaggcaaagctggatttgcatttgaaaatctag

SEQ ID NO: 27742 - DNA, 300 bp, Glycine max
  Peptide Sequence Number=SeqID_144520
atgcatcggctgaaaaatgggagggagaaagaaaagttgaggaaatgcttctcaactgggacaaggaaaaatgaagaaatgagctctctatatatagggagtgaaacactattcaatgatggtgatgacaacacagaagtgacgctatggtcgtctaaaagtattaactttatggtttcactcaacgtggtagagttgtcgtcagtcattttggttgtgatggattctcaaactacaagtgctacaaacttaatgtgttgggagtgcaaacttggcaaaagagcattggatgtgtttggg

SEQ ID NO: 27743 - DNA, 234 bp, Glycine max
  Peptide Sequence Number=SeqID_144521
atgacaaaaaaagatgcaaagaagatggcggatagggtacctgggaatggccactttgatgacggcgacggaggacatcagtgtaggttttgggtgagagaagaggtagccgcgataggatttgggagaagagattgtggcaacggaggggtttggtttgagggttttgagcaactaagagagggaacaaaagttttcgaaagagctaggggaaggaatgaccagatagagtga

SEQ ID NO: 27744 - DNA, 213 bp, Glycine max
  Peptide Sequence Number=SeqID_144522
atgtgtctaccggggaaggggaaggaaacactgggttcagcaaaaatagaagaaaatcactcaaagtgtatcaatctcacacagtgcaaggcgaacaagtcaccgaagcacaagattttgggcaaggtttatggtgagttgggactttggctcaaggcttgtagaacggatggacatgatatatgtcagggtgttggtttggttcagggataa

SEQ ID NO: 27745 - DNA, 330 bp, Glycine max
  Peptide Sequence Number=SeqID_144523
atggtaggcccgatgagacctaagattgtgctctttggctcctctatagttcagatgagtttcgataatggtggttggggtgctattctggcaaatttgtattctagaaaggcggacataatattgcgaggatactcaggttggaattcaaggcaagctttggatgttttggatgaagttttctctaaggatgctcatgtgcaaccatcattggtaattgtgtactttgggggtaatgattccgttcaccctcacccatctggccttggtcctcatgtgcccctccaagaatacgttgcaaacatgaggaagattgctaaccatcttaag

SEQ ID NO: 27746 - DNA, 438 bp, Glycine max
  Peptide Sequence Number=SeqID_144524
atgggctatgtaaaactaacatggtgtggtggaatcgatggcagccacaaagttaataattgtaatggtgatagtggtactcgtgacaccaatgttgctaacagtggtgttggtggaatcagttgtaatgtttgtagtggtgatgatgataacaacaacaatgaaaatagtaacgatgacaatgatgtcaacaatagccgtgccagtgggggtgaccgtgacaatagtggcaatggcgccaacattgttaatagtggtgttggtggaggtagtagcaatgtttgtgatgatgatagtagtaataatgataacggcgttggtagcgatgacaatggtggcaagaataacgatgtcaatggtgatggtagtaatactagtgacaacaataataatagtaatgatgatgacaatgtaaatgattgtagtggtaacaattaa

SEQ ID NO: 27747 - DNA, 309 bp, Glycine max
  Peptide Sequence Number=SeqID_144525
atggagctttgtgacgagatgaatatcaaggccattaatctgtggtctgcaattcagacaagggatgactggttagatgttagtttcacggatggagttcatctatcagcagagggaagcaaggtagtggtgaaggaaatattaaaggttctaagagaagtagattggaagcctagtctgcattggatgtcaatgccaactgaatatgcagaagattcaccatattatcctcccaatcccgatggaacaacaaccataaatgtgtcctactgtatctcacggaagtggttgcaatgggatgatctgtag

SEQ ID NO: 27748 - DNA, 191 bp, Glycine max
  Peptide Sequence Number=SeqID_144526
atgagtcctagaccgacggcaactccgattgctgtggctatgggaccttctcctgggacacaaagagatttggtaatgctctgcatgatgcatcctcgtgtagcacatgaagcttactctcatgaccggagacagtccctgcctgctgtatctcactgcaaaacatggaggtcatgcacgctgattgactt

SEQ ID NO: 27749 - DNA, 136 bp, Glycine max
  Peptide Sequence Number=SeqID_144527
atgccaggtcaaacagctgagaggcatgctgcaccaggttggctgcatacacagggtcccgtggcattgaatgcgagcgatgcagctgcgagagctgctgctgcttctgcactgacctcactggtcggcgctgtgg

SEQ ID NO: 27750 - DNA, 468 bp, Glycine max
  Peptide Sequence Number=SeqID_144528
atgagaattggtcgacggcccgggcggccgcaaggggttcgcgttggccgattcattaatgcagctggcacgacaggtttcccgactggaaagcgggcagtgagcgcaacgcaattaatgtcgactctagaggatcccacacatacaagtcaatcagcgtgcatgacctccatgttttgcagtgagatacagcaggcagggactgtctccggtcatgagagagaaggtcccatagccacagcaatcggagttgccgtcggtctaggactcattgaacagagccatggccgctgtcaggaatgtgccatcctgtgtggccttaaacagccagacagctgcccaggcaagctcatcatggaatccagtggaagggtacagcttggcatgtgttttcagacctgcaagattgaaagcctgactgacactggctcatgcatgaagttgtacatgcatgcatcagggacttga

SEQ ID NO: 27751 - DNA, 417 bp, Glycine max
  Peptide Sequence Number=SeqID_144529
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggagcttgcttatactagggaagagaatgagaaatgtgatgtcttcagttttggagtgctttgtttggaaataatgatgggaaagcatccaggagatctcatctcttcattattttcaggatcagcgtctaatttgctattaaaggatgtgttggaccaacgactacctcatccagagaagccagatgttgaggaggtgatcttgattgcgaaaatagcatttgcttgcttaactgaaattaagtccatgttttcgcccaagcatggaacaagtgcataa

SEQ ID NO: 27752 - DNA, 534 bp, Glycine max
  Peptide Sequence Number=SeqID_144530
atggcatcgagaaaaagggccaaaatatatgacatcccttcaccatctactccagctccttcgtcagcaataatagaaccggatgtccagagctcccaaaccttagtccctatgctacagagcttatttcaaggacaagttattatcatgcatagcttgcgagaattggctcaccaaaggccaattataactatggagcagttccttgagcaagtagcacggcctggagctctaccttcaatggtgagacccaacgaggctgcttctcctgagcctacacctgcaagggttgaaccagtgccagctgatccacaatctccagcggcgaattcaccttctcctaagcttgaagtagttcccccatctccacctattattatcatctctgattccccatctggagaatctgttgctccccctgattccccagctggagaagctgctgatctctctggttccctatctggagaagttgttgctctctctgattcccctattttccatctgatagatgaggaggaggcccagacatag

SEQ ID NO: 27753 - DNA, 1923 bp, Glycine max
  Peptide Sequence Number=SeqID_144531
atgccaccgaaaacggcgaagcgagggtctgcgtcgagcttctcgaagaggggcggcagaggcggcaggggaaccctgaaggcttcacagaaccaacagcaacacgaacctgcggaagagaccgtgaaggtcgaagagaaacaacaacccgttgttgttgttgttgctgaggaggaacagcacacagtggtggtggaagaagagaaccctgctgttgaagagaaacggcttgtggttgaagagaaagaatctgtagtggttgttgaggacaaggctattgacatgaaccaaatggctcctgaggctgtggaagaagcgtcccatgcggctaatgggttgagcgtggcgaaaaggttttggttgtgtttacatttggttgtaatcaaggttttaaatggcaattgtggttttggtttcattgtgatcctatacattgcgggaaattggaacaaatgcggccagggtggtcacttgcggttgcagtttcgccacggaaatgtagtagctaatagcaggaaagctattgcacaatacgatgaagaggaggttaaggagtccatagatgaatatgagaaagatgaacgcttagatttggaggataatgatcctgagtatgaacctgaggagtatggtggagttgattatgatgagaaggaacttgaacaagatgagggtcatgaggtgggaaatgaagtagaagaagaagtggctgaagataatgtaggtgaagagggtgatacaggtgaggaagaagtcgaagatgttcacgatgaacttgagggtgaagaggagcatgagcatgagcatgagcatccagactttgctgatgttgaggaagaggaacaccgagaagttgtgaaggagaggcgaaagcggaaagaatttgaagtttttgttgggggcttggacaaggatgctactgagagtgatctgaggaaggtttttggtgaagttggggtggttacagaggtcaggttgatgatgaaccctcaaactaaaaagaacaagggatttgcattcttgcgttttgaaactgtggaacaagcaaaacgagctgtagcagagctcaaaaatcccgtgattaatggcaaacaatgtggtgtcactcctagtcaggacagtgataccctctatttgggaaacatatgcaagacatggacaaaggaggctttaaaagagaagttgaaacattatggagtcaccaatgttgaggatttaactttggtagaagatactaatgatgaaggaaagaaccgtggatttgcgtttttggaatttccctctcgttctgaagctatggatgcctttaagcgactgcagaggagggatgttgtatttggagttgataagcttgcaaaagtttcttttgcagattcctttattgatccgggtgatgaaattatggcacaggttaaaactgtgtttattgatgcattgcctccttcatgggatgaagattatgtccgggatcttctcaggaaatatggtgagattgaaaagattgagcttgccagaaacatgccagctgctcgtaggaaggactatgggtttgttacatttggcacacatgatgctgccgttaaatgtgctgatagtattacaggaacagagttgggtgagggacacaagaaggcaaaagttagagcaaggttgtctagaccactccaaagaggccgcggaaaacacagtagtcgtggggactatcgttctagtcggggatctggaatgatgacgaggccttcatggggccgacctgcacctcattcttttccttctcgtagtgtaagaggagttggaagccgtactcctcctgtcagatcagttagtgtgagagatagacgtcctatgatgtccataccagcaagaagtaggccagtgcctcctccatctagatcttatgataggagaccagttggtatgtag

SEQ ID NO: 27754 - DNA, 366 bp, Glycine max
  Peptide Sequence Number=SeqID_144532
atggctaaagaaacaaagaagctagagaatatggattatgcaaggacatcgacacttacacaagtagtttcatttcaaagagtcagtgttgaagggaggctttttggggattatgaggaagcatcaaagcagttgtcagacgacactgtagaggggggtggctcaaaagcaatggaatggctagaagggaaaagacaagtaggacaaaatgcatttaatgttaatgtggaaggacaggggaaggaaaccaagggaggagatgaagtcattgagaagcaacaaaatcctgaaaatccaacgacaatcaggcctaaagaaaaagctaggagaggcatgaaaaaactttgtcaagagcggatagcatga

SEQ ID NO: 27755 - DNA, 645 bp, Glycine max
  Peptide Sequence Number=SeqID_144533
atggataaccttaaacaagcactagggagtttcacagttgtaacattactctttgctggggttcttttgctgtacaactggtcctcctctttctccaacgaattagtgctatcccagaaagaaccactatgcgagcaatcaaattttaccactaccaatgttgaagcatatggagatggccttgacactgctttggccaaaacctcaatggaaaataaaacggtgataattgctatagtaaataaggcctatgtagagcaagatgtagagagtgacaccaccatgcttgacatatttcttggtagtttttggcttggtgagggaacaaggtctctcattgatcacctcctcatagttacggttgatcgaacggcctatgatcgatgccaatttttgaggttgaattgcttcagattagaaacggatggtgttgattttgaaggtgagaaaatatacatgtctcaagatttcatcaagatgatgtggagaaggactcgattcctcttggaagttctcaaacgtggctacaacttcgttttcacgatttacagacatgcagctaggatatctgatctgattaagagtgtttatcagcttgccaatttctcaaaactagatacaaatgtacaatggagttgggtttaa

SEQ ID NO: 27756 - DNA, 1137 bp, Glycine max
  Peptide Sequence Number=SeqID_144534
aggactgcacgtcctcgccttaagagggctgtacgccttcgccttcagaggactacacgtcctcgctttaagaggactacacgtcctcgccttaagaggtctgcacagcctcgccttcagagggcttcacgtcctcgccttcagaggactacaagtcctcgctttcagagggctacacgtcttcgccttcagaagatacatgtcctcgccttcagaggactacacgtcctcacctttagagggatacacttcttcgccttcagaggactacacgtcgtcgccttcagagagctacatgcccttgcctttagaggactacacgccctcgccttcagagggctacacatcctcgccatcacaggactacacgtcctcccctttacaggactacacgtcctcgccttcagaggactgcacatcctctccttgagagggctgcacgtcctcgccttcagagggctacatgtcctcgccttcagagggctgcacgtcctcgccttcagcggactacacgtcctcgccttcagagggctacacgtcctcgccttgagaggactacacgtcctcaccttccgaaggctacatgtcctcacctttagaggactacacgtcctcgcctttagagggctacacgtcttcgccttcagaggactacacgtcctcgccttcagaggactacatgtcctcgcctttagagggatacaggtcttcgccttcagaggactacatgtcgtcgccttcaaagagctaaatgcccttgccttcagaggactacacgccctcgcctttagagggctacacgtcctggccttcagaggactacatgccctccccattagaggactacatgtcctcgcctttagaggactacaggtcctcccctttaaagggctatacgccctcgccttcaaaggactacacgtcctcccctttagaggactgcacgtcctcgcctttagaggactccacgtcctccccttcagagggctacacgccctcgccttcagaggactacatgccctcgccttcagaggactgcacgtcctcaccttcagagggctgcacgtcctcgccttaagagggctacacgtcctcgccttcagagggctacacgtcctcgccttcagagggctacag

SEQ ID NO: 27757 - DNA, 354 bp, Glycine max
  Peptide Sequence Number=SeqID_144535
atggaggttgaggaaccctggcaggggttatggctaccattgcattatcaagtggtgtttaggcattgggcgtgtggtaagcaggcaagccttgtggctgatttggggatggcttttatggatgattggacccactttgatcctttcttcgaggaagaccaaatccgcaaagctttgaaggtgtgtaacccaccatttttccatagaagggttgtggttgggggcgaaattaaggcccctccaaagtgttttgtaggagtataccaccaactgttttcccttcagtggcatatccaaggcaaggctcgaagtcggctagattatggtcgggaatttcatgtgtctcccccatag

SEQ ID NO: 27758 - DNA, 279 bp, Glycine max
  Peptide Sequence Number=SeqID_144536
atggatgagcctgttcaggtggtatccagccaatgggtggatgccagggtctcttgtagtgacaatgtggaaaagattaagcccaagcgtcaggttttcctaggcaaggaaaagtcagactctagaaacccaactactgaagggcataatgaaaagccattggcaaaggagagaccgatggaagaggatccgattgaggaaaaaccaaggggagatcaaacggctatggtggtttcggagagggatatcatgtttattttatgcttttttgctttataa

SEQ ID NO: 27759 - DNA, 816 bp, Glycine max
  Peptide Sequence Number=SeqID_144537
atgggcaaaagcgattctgggggttctatccagcaacccctgatggaaagggaggttattccaatcggtgattcctcattggaggagacacgtagtgaggctttcgatagcaggtcctcttccttcgagagggtggagccttccactgctcctctagacgaagagcccatccttgacactacaatccttctttcttccccttcggtggctataggaaggaatattggtggtgaagttagggtttcaccccataaccaatgtcgtcgcagcactggggcaccgtcatttctcctcccttcgtcattggctatgaatggcatatccaagaagatgtttgaattcgactcaaacgtgtttcgcatgttcaaggatcatttcttcagggtcatggcaactgacatcgtggctggtgagttccctttgatgcatgatcaaaatggggaaccctatttctcattttattggcaattgagccctacaaggttcaaatcttttgatgagtgtcaaatgtccctagaggaaagggtggacaagtctattttggagcagttcccaactttgttggatgcaggggccatcccgtctttactttcagtaggtgaccctcgtactattctggatggtataatgggacaacttgaggccagatttgaccttaatgaggacgaagttatcgaagctactgggcttgtgtttgacttgagttgtctttctcccaccatcccccagggttcatcttcagatcttttggtcgttcaggctactattgcaactgcggctgtttccaatcctctagtgcctcctgtaacaccgtaa

SEQ ID NO: 27760 - DNA, 165 bp, Glycine max
  Peptide Sequence Number=SeqID_144538
atgactacaggtggccgtcgcgagccactattacttgccgccgaacccccacatgaagaggaacactttaatcagagcggaatcctcctcaaggatttggtggagaaaattcccctaatcctctatttcacagcgtctctgagggtgtttttacatttcctttga

SEQ ID NO: 27761 - DNA, 204 bp, Glycine max
  Peptide Sequence Number=SeqID_144539
atgaaatcccagtctaatatgtactggagcctcttgctcatggctctagtgactggtcccttcctagggaggattgcatcagttagcaaagcaaagagtgttagagatgattcatggaaactgggaagaatcatatgcgaagctgccaaaagtacgcatacacgaaggagatgcactggcggcatcttaaggatatctgtgtga

SEQ ID NO: 27762 - DNA, 459 bp, Glycine max
  Peptide Sequence Number=SeqID_144540
gtgctaataccttcctcaagcgtaaatacaactcccgaacttagaattttctttttgaccggtcttccttcggtttttccgacgttttcctcaaataaacgttggtggcgactccgcgcgtattcctttcgtggaacacgcatcccgcgagtcacgcgtcgcccgcccgcaaaagggcacgttgcgacacatccaaacttcaacaatggaagaagatctcaagaagactctcaaattcttagatgctacaaatgcaaccaacttggtcacatcaaaggaaattgtccctcaaatgaggaatggcctaagaaaagtgataagaaaaggtatgaagaaagaaggaccaagaaggcctacattgcatgggatgacaatgactcatccaacggttcagagaaggagatcaaccttctaaccaaggactatgagagtgatgagaacatctctcaagaagattaa

SEQ ID NO: 27763 - DNA, 564 bp, Glycine max
  Peptide Sequence Number=SeqID_144541
atggggccagtagtttccttttatcagttcctgggccaccccctaatattggagggcgacccaactgtgcgagcacaaccagagagggaggctatcacacagctactatgcataccggggcaagatttcactcgtgccgctgcaaagagacgagtgcgggtcatgcgcaccaacatgaccactcttacacagatatggatgacgttgctacttagcaacattccacccgatgaccacaatgttgatctaccccctatggaagtatcagttggtttgtgccgtcatgacatagggatcacgcccacgagacacctaggggacccggagaagtccaacagagccctggggtttccagctctggttacgggcctctgtcagtcctatagggtgcccatccccccagcaagttcatgccatcgtgacatagggatcacgcccgtaagacactcagtggacccggagaagtccaatagggtcctggggtttccagctttgattatgggcctctgtcagttctacggagtgcctgtcaccccccagcaaggtcatcaagccccctactaa

SEQ ID NO: 27764 - DNA, 744 bp, Glycine max
  Peptide Sequence Number=SeqID_144542
atgaatgtggggtacctcatctcccaccagatctcccttattgctcaggatgacacatccagacttggattctctgccttgattatagctttatgtaaggctaggggagttcagtctgacttaagatccttggagagcctaagtcctaccattaatttggcatacattaagaagaactgttggaatcttgttgatccaatagtaactttcagaggacccaggaaggccagaggtaagagatctgaggccccttccacttcagcatcatcaaaggcaccagtaccttcttcttctacacttcctccctcttcctccacagagatcctagtgattcctccagcacctttagagattccacttccagctccaatatctacaggtccagtagattttattttcactcctcaaatgctacactccatgcttcaaagcatccatagggggcagtccatcatcatgcagagccttcagggcttgggcttgcccttcattatgaacatggaggagtttgatgctcaggtgtcctggccaggagaccagccttcttcctctggagggggtggggcctccacagcccaggagcctgtgactgaggagcctccagcagcagcagcagcaacaaaggatgaggatgagctcactcctcctaagccttttgattttgatgtagtggtggagcctgagcagactattcaagattctttagcagctccaacactggatcttaatgaagaccagccatag

SEQ ID NO: 27765 - DNA, 156 bp, Glycine max
  Peptide Sequence Number=SeqID_144543
atgaacttcttaaacccttcattttcaacaaacttaaagattcaggttgttgtccttgccctcattgtggtggagtttcatgtccttgtgattctgaaggagcttttgtcctttgctgtggtagagttggagtatgacatggagagggagtgctaa

SEQ ID NO: 27766 - DNA, 960 bp, Glycine max
  Peptide Sequence Number=SeqID_144544
atgcccgtcggccaccctggtggatgtacagcggattcggtgacgacgccgcgttcaatgccagcgtgcaacgccatcgatcccggggcctgcggcgcaggcgcatgtccccaatgcgctcgcattgaccggcgcggtgaagcgaccgctggcgatccagttcaaccacaacgacccccccatcgtgccgcacatgcaggcggtgtatccgcagatggccgcccgggctggcgcgcgaccgttgccgcgcgtgctgccgccagtgggcgaagggcattgtggcttctctggatcacagattgtcgatgcgttgaagacggtccagcactgagccggcgtgtgccgcagttcatcagggacccacccaaaggattgctcggcaccattccgatcgaagcgatggaggccgacgtacaggtgctgcgcgctggtcgccccatcgaactggtcgaagctacgctgcgtcatgaccatcgcccggcgctgcgcgtgcgtgcatggttgatgcgcccgaacgatacgcaggccatcgccggcacgccgatcgctgccattgcagcgccggaatcaatgcccgcatgggatccaggtacggtctggccaggcggattcatcaagagcgtggagatccgccggcacgatcaggggccaggccgtgccacctactgggcgcgcgcgaagcatgcgctgctggacggcgagccggtcagtccactggcccgtgccgccaccctgttcgatctgtccaatggcatggccgtgcgcgccgatccgaaggaggtcgccttccccaacctcgatctgaccgcgcacctgttcggcatgcccgaaggcgagtggctgggcttcgatacgtcggtgtcgtttggccaccagggtctcggcttgaccagcacggtgctgcacgatgcacgcggtccgatcggcatgctcggccaggcactgaccgtgcgcccgtga

SEQ ID NO: 27767 - DNA, 585 bp, Glycine max
  Peptide Sequence Number=SeqID_144545
atgggggcatattctagggatgagaagctgttaatgcatttcttccaagaaagtttggccagagcggtggtcacctggtataccaatttggaggcttctcgtatttgctcatggaaggacttgattactgccttcattaggcagtaccaatacaatactgacatggctctggacaaaactcagctacagaatatgagcaagcgggagcatgaatcctttaaggagtatgcccaatggtggagggacttggcagcacaagtgttggtgggctacatgccctatagcttcgcaaatttagtatttgcgggcaagaggatcgaagtaggcttgaaaagagggaagttcgattatgtcgctcctgctggcatgaacaataggagattcaaggcaagtggggcaaagaagaaggaaggagatgcccacaccgtgactcagctcctacttggccgaagccctaacaaacccctcacaacacttccaatatgcccaacatcaaccaagctttttagcccacatcgaaaactcttccaatccggtgcccgtctagcaaagggcacccgctcaaccaccaagggcccccactaa

SEQ ID NO: 27768 - DNA, 348 bp, Glycine max
  Peptide Sequence Number=SeqID_144546
atggtgcaaagaaaagataaggagcttaggcgaagcagcaatgggatcttcggcgactatcacaagtggctgaaggctcggacacaagagttagattggctcccgaagctaaaggtttcaagtgaggaagaggtggaaacccctgaggagagtgaagaggtgcaagccttgaaggccgaacttgaaagggtgcaagcggtcaaggaaaggttcaagacaatggccatcaagcgagctcaagcttcaaagggtcgagagagaccagtcaagaggcgagggcataatattagaggactagtggaaggcttttcaaaggtcaaagaggagtttgtccgaacaattgagtag

SEQ ID NO: 27769 - DNA, 669 bp, Glycine max
  Peptide Sequence Number=SeqID_144547
atgcttgtcattgaagagaaggtgaggggtttagagactcgagccaaggatgttgaggatgtggtccaatctcatgcgaaagaggtagaaaggttaaaggcggatttggccacgacgaagaaggagagggatgtcgagaggtcagagaaggtacaaattgagcaaaaagcttataatgaggcatacgaggcttatgaatctagcttcaagcactgccttcgtcaagtgttgtttcactatgagttggtccttattgatgatatcttaaaggatgctccaccaagtggtgagcaaccgactactcctcctagtaaaacatttttggacgacgagtggatggcattgcctgtaccgtccaatcttgcctctatgatggaatttatctttggtttagtggagcctttaatcatgtcttctagtgtatcatctagtatgtattacctccgaatgagagaaggtacgccactgaaagaacatcttgatgagtcaaactttgttctgatggaattttgtgacattgatgtcaacatcaaagatgaagacttgaaaatgattctgttagcctgtctccctccttcatatgagaattttgtgaattcctttagtgttggcaaggactccaatacacttgaagaagccaagtctagtctctattctagagagctttga

SEQ ID NO: 27770 - DNA, 612 bp, Glycine max
  Peptide Sequence Number=SeqID_144548
atggcatccaggaagaggaaaagcactgcttccagacctcaagctcagtatgataccaggcggttccattctttggacgcttggaatagatataccgataacattcttggctggaatatccttccggagagaaatgtgcagatttatcatactgagtttgacgagtttaaagtggaattggagaggcgtaatctacacaaaggccttgccaatctccaagatggaagtatagatgtagctgtggtgaaggagttttatgctaatttatacaccacagaggagcaagcacccaagcaagccaaaattgaagctaggctctgtattccccgtaaggggtttgttttgaatgctgagggccagccatggaagcttcttagaaaagatttgatgacactggcccagacatggagtgtcttcttttactccaacctagctcccacatcccacacctcagatctaaatatggatagagctaggttggtctatggcttggtgactaagatggatatgaccatcggagcccttatctcaggtcagatttctttaattgctcagagtaactccactaggctcagatttccagccttgatcactgccttattgcgaagttag

SEQ ID NO: 27771 - DNA, 306 bp, Glycine max
  misc_feature (290)..(290): n is a, c, g, or t
  Peptide Sequence Number=SeqID_144549
atggtgagttgggaccttggctcaaggcttgtagaacggatggacatgatatacatcagagcgttggtcgcgtggatgagggcacacactgcctactcacgtctaaccacaagtaatgttagtaacaaaaagtgtggtgaccttggtcatgtggctccgctccctcccaagaaaccgagcaggccaatcatatcttcatccatgtgggattcattcgcctcaccgggggatcctgcaggctcctcccttgcctgggcctcgggccaatcttcaggccatgcaacctcagncccaaactgctccggg

SEQ ID NO: 27772 - DNA, 336 bp, Glycine max
  Peptide Sequence Number=SeqID_144550
atggtatgggttccaaaaggatccttagtcaaaaccaacattcaaggacccaagaaaatttgggtaccaaaatcaaaatatgattctatgaatgatggactccttgaagcaaagttgatggttgtcatcatcaaaaagggggagaatgtgaatgtaaatcatgcggggattttgcctaaaacaaattatttccaagagatcaaaggcactggtaatcgattaccaggtattgcaatcgattaccagagacaagattgcaaatggtttttcaaaagagttttgaaatttgaatcttgtaatcgattaccaataacgacatttcagaaaacactttga

SEQ ID NO: 27773 - DNA, 2493 bp, Glycine max
  Peptide Sequence Number=SeqID_144551
atgccttttggattgatgaatgctccagcaacatttcaggcaacaatgaatgatatattcagaccctttcttagacagtttgtgctggtgttttttgatgacattcttgtttatagcaagaatgaacaggaccatttgaaccatgtaaaactagtgctggaagttttggtgaagcattgctttgtggcaaacaagaagtgcagttttggttgttcacaagtggattatttaggccatatcatctctgctgttggtgtgtctgttgatcctagtaaagtgaagtgcataatggagtggcctgagcctaagactgtaaaaggggtgaggggtttcttaggtctcactggttactataggaagtttgttaaagactatgtcatgaccacatctcctgtcctagcattaccaaactttgatgtggcttttgaagtggagtgtgatgcagctggtagggacattggagctgttcttatgcaaaacagacaaccaattgcctatttcagcaaagccttgtctgaaaataacttggctaagtctgtttatgaaaaagaattaatggcattggttctttcaatccaacactggagacactacttgttagggaaggaatttgtagtgtatacagaccataagagcctgaagcatttcctacaacaaaagatttcttcaccagaccagcaatgttggttggctaagctgttaggctaccaatttgaagtaaagtataaaccgggtttggaaaacaaagctgcagatgcattgtccagatgctatgatgattgtgagttagcagttatggcttattcacctgtgtggataggtaggcagcaactgctgaaagatgtggaaaatgatgtgtcggttcaagaattgctaaagaaagtggtggaaaatcctgacaagtaccctggttttgtgatacatcaagggatatttgatctatacatcaaggggtattgttgtatcatgacattgttaaaagaatgtcatgaaacaccaatgggaggtcattctggatttttgagaacttacaagagagtagctgagaacttgtattggataggtatgcagaaaacagtcagggactatgttagagcatgtgatgtgtgccaacgacagaaatatgctgctacaactcctggagggttactacaacctctacccatacctaatgccatatgggaggacttgtctattgatttcataactggattgcctaagtctaggggttatgaggcaatattggttgttgtggataggctctctaaatacagtcatttcattttgttaaaacatccctacacagctaagactatagcagagatttttgtgaaggaagtgataaggctacatggcattcctatgtcaattgtgagtgacagagaccctctgtttattagtcatttttggagagaaatttttaagctacaggggacaagtctgaaaatgagttcatcttaccatccagagacagatggacaaacagaggttataaaccgatgtttagagagctatcttaggtgttttgtggctgaacaacctaaaacctggtcttattgggtgtcatgggcagagtattggtacaatactacctaccatgagtcaattggaaaaaccccttttgaggtagtgtatggcagacaacctcccaagttaattcgattccttagtaatgaaactaaggtagctgcagtggctttggaattacaggagagggatgaggctttgagtcaattgaaagctcatcttttgagggctcaacaacagatgaagacttatgctgacaagaagagaagagatgtgaagtttgaagtgggagagtgggtgttcttgaagctgaggcctcataggcagcagtctgttgtgaagagaattaatcagaagctagcagccagattttatggacctttcaaaatcattaaaaaaattggtgcagtggcctataaactgcaactgcctgatcagtccaaaatccaccctatatttcatgtttcattgcttaagaaggctgtaggggaatatcatgtgcagaatgagttgcctaaagatcttgaagtaatcatgcatgaggaaatttatcctgttagagtgctgggtactagaatcattatgaagaatggcagttcagttcctcagagtcttattcaatggaaagacaagtctattgatgatgtgacatgggaagatgatgttgttattaggggacagtttccgaaatttaaccttgaggacaaggttcttattgaagagggtggtattgataggaatgctgatgagctagtgggcattgatgagggcccaagacctaagactcactatgagacactgtattggatgactaaggatgagtggaagtggattcagatgaggattggtttgaggcagcagaaaaaccaggaggagccagaaagagaattagagggaggcatttgggaaagtgaaggtgcaggagctacaaaaggaggagataggtcaggattaagattaaaatag

SEQ ID NO: 27774 - DNA, 2695 bp, Glycine max
  Peptide Sequence Number=SeqID_144552
atgggtgatcggattgaagctctggagacacagatgggaaatgtcacaacgacattgcaagagcttgctctgcaaatgtcacaacacgctcagcagatgcaacagcagagtttggttttaactgagctcagtaaacaaatcggtcagaagggagcaacgcaagaaggtgaggcttttgtgggtgattcatcacagaacgagtctcgtctcgccggaaagaaggtgaaactacccctcttcgaaggtgaggatccagtggcgtggatcacacgtgctgagatctactttgacgtgcagaatacaccggaggagatgcgtgtgaagctgtcacgattgagcatgggaggatccacaatccattggttcaatttgctaatggaaacagaggacgatctttcatgggagaagctgaagaaagcactaattgcgcggtacggtggccggcgattagagaatccgtttgaagagttatctacgttgagacaaacgggaagtgtggaggagtttgtcgaggcgtttgagctgttgtcgtctcaggtgggacgtttacctgaggagcaatacttgggttactttatgagtgggttgaaagcacccatacgacggagggtaaggactctcaaccctgccaatcgtatgcagatgatgagaattgcgaaggatgtggaggaagagcttcgcgaggaagacgatgatgaaaacagagcctctatgaagaagaatgtgggtcgtagtgaatatgggcctagatctaaattccggactgggtccaacctgacccagaaggaaataacccgtttctcaaaatcgggttggactaacccatctcgcaaaactgtttctattggatccacttccaatacgacgtcgtcgttgagttcaacaggaaggaaacacgaaggggatcgtcgtggtggtacgaacgatcggtggagagggattagcagtgaggaaatggaggaaagacgagctaagggcttatgcttcaagtgtgggggtaagtaccaccctactcaacacaaatgccctgaacgttcactgcgtgtgcttattttgggtgatggtgagtctttgaatgatgacggtgagattgtagccatggagggtgaagagtcggaggaggaagagatgacggaggcggagtgtaagttgattggagttttggggaagatgggggagtctcaaacaatgaaaattgaagggaagttggagcatgttaatgtgggtgtgctcatcgatagtggagcaagccatagtttcatctctccagagttggtcactgctttgggtttgaaggttactccaaccactgtgaagagcatcaagttaggggatggtcacaaggtgttatctgaaggggtttgcagaagagttagacttgtcctagggtctaatgagtttgaaattgatgcgttggtattaggactgggtggtttggatgtggttctaggagtctcttggctcagtactttgggcaaggtggtgatggattggaaggatctaaccatgcagttttggcataatggtgaaatgatgactttgaagggtcaaggtggaaggcagttagttcaaggatgtttgcacacatacttagaagggaaggacagagctatgagtcctattgagttatggtctcttgaagagaagctactggacagtaatgtgaaaattcaaggaaacattggtgatttgctaacaacttttcctgaagtgtttacagaacaattatcattacctcccataagaagtcaggtacatcagataaatcttattcctaattatggacctgttaatatgcgaccatataagtatcctcatcaccagaaggaggagattgagaagcaagtggctgagttacttcaagctggagtaatcaggcctagtatgagtgctttctctagccctgttattttagttaaaaagaaagatggctcttggaggatgtgtgtggattatagatccttgaacaaagctacagtgccagacaaatatcctatacctgtagttgatgaactgttggatgagttgtttgggtctacagttttttctaagattgatttaaagtctggctatcatcagatacgggtgcatgagcaagatatccataagacagcttttagaacccacaatggccactatgaatatctggtcatgccttttggattgatgaatgctccagcaacatttcaggcaacaatgaatgatatattcagaccctttcttagacagtttgtgctggtgttttttgatgacattcttgtttatagcaagaatgaacaggaccatttgaaccatgtaaaactagtgctggaagttttggtgaagcattgttttgtggcaaacaagaagaagtgcagttttggttgttcacaagtggattatttaggccatatcatctctgctgctggtgtgtctgttgatcctagtaaagtgaagtgcataatggagtggcctgagcctaagactgtaaaaggggtgaggggtttcttaggtctcactggttactataggaagtttgttaaagactatggtaaaattgctagaccactcacagatttaacaaaaaaagacaacttcttatggaatgagtctgctagggaagcttttcagaagctgaagacagtcatgaccacatctcctgtcctagcattaccaaactttgatgtggcttttgaagtggagtgtgatgcagctg

SEQ ID NO: 27775 - DNA, 453 bp, Glycine max
  Peptide Sequence Number=SeqID_144553
atggctggagttgtcatctctggtgaagatgagtgggtgcagataaatcagttggagaggagaaaaagagagactagagaagtgcaaattcctgctgttgccatgaatgatgatggcaaaatagtactcgtgtctggcgaagatggacaaaagccagtcaataaggagaagaggaagcttacattaagaagcattccattctcattaacatgcatacttcacaagaattacatcttggcagatcctactgctgaagaagaatctattatggaaacccatgtgacaatagttttggatacatccggtcaactaatatctctttacaagcctggtgggccagctcttgcctatacttctgctatccaggattgtgtcgggctaacggggcaaagagtaaaggaactaaagagctacttagacaaagaaaattctgctatggaggtggtggtttga

SEQ ID NO: 27776 - DNA, 252 bp, Glycine max
  Peptide Sequence Number=SeqID_144554
atgggacctagccattcacattatgtgcaagcacaagagtgggctaaaaaggtacattatgaaaccactggtccagagatatgggaaggcacaggagggaaagatgatgcacttgttagcggtataggtattggtggtaccataatgggtgtagggaaatttcttaaagagaagaatcctaatataaatctctatggtatggaaccagctgaaagtccaatactctctggaggagaacctggtgagttataa

SEQ ID NO: 27777 - DNA, 150 bp, Glycine max
  Peptide Sequence Number=SeqID_144555
atgggacccatgaccaagagtaggacaaaacagtcagaggataccttccaacaaatggtatcagacatacttaacaaggcccaagtggagaatgatgaaggcccagaggcactaccaagaatcttgattgttgctgaaggcccaaactaa

SEQ ID NO: 27778 - DNA, 573 bp, Glycine max
  Peptide Sequence Number=SeqID_144556
atgtgggccggtgacatttttgaaaataaaccagcagcaaccctaacgcgaagctcgtcgtccctcccaaggcctctgccgtcttcattgcgcaagagagagagaggcggtgatttcttccagaagaaaaacgatggtgacgatgacggtgtgaagagaagtggcggcaacaatgggaacaagaatgcgcgaacatgcttggcttgcgatatggatgctatgttctcttttgtgttttctggagatcgtgcaccttatagccccgctaagtttttatacaggtctgtatatggtgatggcgtcacgctgcaaaccttgccacttatgaacaacaggatgcacatgattttttcatttccatgcttgatggaatccattagaaggtggagaaggtatcagagagaagaagcaaaaatccaagcttgggtaaacctcgaaaatgctaaagcagaggccaggtatcagagagaagaagcaaaaattcaagcttggtggaagttgctatggcttctttgtgcctttcactcaactgtggaagctgctgtgacttctaatatgtatggctggaactga

SEQ ID NO: 27779 - DNA, 468 bp, Glycine max
  Peptide Sequence Number=SeqID_144557
atgctccaaccatatgagatcagcataggcttaaaggagcactcaaacccggtgacccccaaggcctacactcagaagagtccgtcagggcctctccctcccgattcagaccgcgatagtagcatctctaacggtttcctgagattcttccagttttttcctctaaccgctccgatagagttctcaaacgtcagagagacagataagggattgaagcctccacttgtactgtcttggtgcgattcctttgtctctcttcgtaaacattatctcacaaatcccaacgaccgttttgggtttctgcgggaaaggaaaaggttacgatgcgaaaggtatttctctcagctcaaacatgatatcgaaatccccaacggcgaaaatgctcgtaattgggttgcaaacatggtgctcaaatttcacgacgatctcacggtgaatgagtctgagatcgtcatttttctgagacag

SEQ ID NO: 27780 - DNA, 789 bp, Glycine max
  Peptide Sequence Number=SeqID_144558
atgttaaaagctaatgagaagaccaaggtgatgtctatgcagttgaagcacatgaaggttaaggctgtgaaggacattggcaagaagattgaggatctaacctcggagaagaaaacgactgaggaggagttggggaccacaaggggcgagattgctgagatgaagaagacctttggaaagatgaagagcgagttgcaagggagggaaatagctaagttggatgaggccaagaggttgattgtgctaaatcatcaagaaggcttcaagaaggcacaacgtcaagtcaaagtgtggctcccctcatttgactctgcacaactcgatgtgaattgcgacatcgtggatgatgagattaatggggagtacaatggtacccccataggatgctcgggggctcgtctacccacaggcccttggggacttttgataatgcctgataccaagtggcatgaggaattcttcatagtctttttcgataaattgtctttcattgtcaattacaatggcttgagcaacaaggaggaacttgatttggcattttgtagtgggaaatggtttgagtatgttcgttccctacacgacaaaatgccaaggggacgtgatgttgtagagtgccttgggtggtgtgtggtggccattgttgagttcttggcattccttataggttttaacgtactgagcacaattttccctcaaggtcggccaatagtaaccaacgcagatgacccttggtgtcatgctccaacctccgacttgtattccgcaaattcccctgagcacctcgtttag

SEQ ID NO: 27781 - DNA, 642 bp, Glycine max
  Peptide Sequence Number=SeqID_144559
atggtagaagataaaatcattaataaaatattggtagatggaggggcttcactcaacatcttaccaagatctatgttatggaggtttggtagaaatgtagaagatttgatacctcataacatagtggtagcagatttttgtgggaagcctttagattctaaaggggctatttgtttggatgtttttgtgggtagcaagagaagacctacagagtttttagtaatttcctcactagccaatttcaacatgttattgggaaaagaatggatacataaagtagtagcaattaaatcaccagttcatcaaaaactgttcttttggaatgaagatggaatacttgaaatggtggaagctgatcaatcatcatatggaatatatgttgcctttgcatatgaaagtgaccaagcaatggctataattgctccattcaaaattgaggatttgttctatgtgaacaataagtcagaagcatactcaagctttatggctcggctatcgacttacatagccgataataagaaacaaacaactactgtggtagttgaaattggagatatgactactgtggccgtcaaaatcaaggaagcggctattgtgatcttcgaaatcaaagacaagaaaaaaagatggatattgaagtaa

SEQ ID NO: 27782 - DNA, 162 bp, Glycine max
  Peptide Sequence Number=SeqID_144560
atggtagaaaaaccaaaaagaaggtctgtgaattttgaagataagggttcgggagttgtttacgcatggggaagattcattttaattgcgaacaagaagtcatttaaggcgttggaccttgaaataatgttttacattttgaaaagcagagagaattgttaa

SEQ ID NO: 27783 - DNA, 396 bp, Glycine max
  Peptide Sequence Number=SeqID_144561
atggagaaagcaaatacatcactagtgagaacaaaatcagaccaactagtggagtcgatggtggcggccctgaagtcgccagcatcgagcgaccactccgcgaacggggtggttgaaggcggggggaccatctccaggaagtcgagccggcggctgacgggggcgtcaccggggcgcggcgggaagaacacgcacataaggaagtctaggagtgctcagataagtcaaatgaagctggagctcgatgatgtgagtagtggtgccgcacttagcagagcctcaagtgctagcttgggactctctttctccttcactggcttcactatgcctcctgaggaaattgcagactccaagcccttcagtgatgatgatatccgtaagtacatgacaatttaa

SEQ ID NO: 27784 - DNA, 264 bp, Glycine max
  Peptide Sequence Number=SeqID_144562
atgggtgaaaatgatatcatcattgataaacaggaatttaaaactccagtgactggtcatcctgctgggtttcttgatcctaagtatcctcctcatctgtcaaatgtagcacaggagtggctggaggagtggtcatcagtcccagggctggtgtggcagggttctctagaatatcaagagggtctactggcttctaaagagaagattgatccaccactggagagggtggatctgctgaaatctatggtgatctctctggagtag

SEQ ID NO: 27785 - DNA, 423 bp, Glycine max
  Peptide Sequence Number=SeqID_144563
atgggttctggtgtggcaagattcaaggaagcgtacaataacgacgaagagcgctgggagtttacagaaaaggagttgttgaaagatgaaccaagattcgaagcagaatttatgggagagtcttcaaagagatctaaagtttctgtctcaagtggttacttaccatcttctagcctagggacacccattgaagttgaagaatatgacatggcatcaatgtctcgtccaataggacaaaaagcagcaaaaaggaagaacaaaggaaaaggagatgcaagcgcttctaacaatttcgatctatcggccatagaaagtgtaatgaaggaaaaaaatgtcaacaccgcaaaacttattgagttaaaggagtcacaggaaaagcgtctgcaggaacaggagaagcatttagagtatggaattctctaa

SEQ ID NO: 27786 - DNA, 243 bp, Glycine max
  Peptide Sequence Number=SeqID_144564
atggacaaacggtcagtcatcgtgccaccatcgctccatgcaccatcgtcgcagcccctccctcacgcaatcaccatcgcagcccctccctcatgcaaccaccatcgttgcccctcaatctggggaatctggttgtggctgggttcttcagtgttccacttccaaatccttgttcagctggtgcatcagaatattcttcgagacttcatagaacagttgggagttgggtgccttgaacgatag

SEQ ID NO: 27787 - DNA, 576 bp, Glycine max
  Peptide Sequence Number=SeqID_144565
atgaattgcgttttcgttcatgcgtcctccacccatgagtttggagccatgcgtagtgattgcttagtgcaattctccattctcaatctttttcggagccccatgaattgcgttttcgttcatgcgtcctccaccttcaagtttggagccatacgtagtgattgcttagtgcaattctccattctcaatctttttcggagccccatgaattgcgtttttgttcatgcgtcctccaccttcgagtttggagccatgcgtagtgattgcatagtgcaattctccattctcaatctttttcggagccccatgaattgcgttttcgttcatgcgtcctccaccttcgagtttggagccatgcgtagtgatggcttagtgcaattctccattctcaatctttttcggagccccatgaattgcgttttcgttcatgcgtcctccaccttcgagtttggagccatgcgtagtgattgcttagtacaattctccattctcaatctttttcggagccccatgaattgcattttcgttcatgcgtcctccaccttcgagtttggagccatgcgtagtgatggctta

SEQ ID NO: 27788 - DNA, 147 bp, Glycine max
  Peptide Sequence Number=SeqID_144566
atgttgagtccacccaagccaaactcttcctccttggatagtcctctatcagaaagagagtggacgcgaacgaagtggaggcacgagaacgacaccgtgagtggaggagctgagacggagaggaagaggcatgagagattttactag

SEQ ID NO: 27789 - DNA, 522 bp, Glycine max
  Peptide Sequence Number=SeqID_144567
atgtcttctgtggatctaaagaaatctaacaaaataagagaaattgttagactgaaagagatcctcaagaaatggagaaaaatagccaactcatcaaaaagcactaccactatcgccacggctacctctaccacaagcaagagcatgaagtttctcaagagaacactttccctatcagaacgtgaaggagggtcaagcaatgttgtcccaaaagggtacctagctgtttgtgttggtgaagagctcaagaggttcactataccaactgaacatttgggtcaccaagcctttcagattctcctcagagaagcagaagaagaattcggctttcagcaaacgggtgttctgaggattccttgtgaagttgcagcttttgagagcatcttgaagatggtggaaggaaaggaggacatgttttcatcccaagaatgtagacttagcattgaagagatgatgattgagtactgctcagaaaaccaacttgcttattctcaccatcctcaaagtccattgtgcagatag

SEQ ID NO: 27790 - DNA, 944 bp, Glycine max
  Peptide Sequence Number=SeqID_144568
ggaggggattcgagctaaacgctgatggtcatcctttgaagatattaaggaagaacttgaccactttagctcagacatggagtgttctttccttctctaacttgattcctacctcccacacatctgatgtcacattagacagagccaagttaatctatggcatcatcgtgaagatggatacgaatgtgggttacctcatctcacaccagatctctatcactgcacagcatgattcatccagacttggattccccgccttgatcacagctctatgcaaggccagaggagtccaatcagattctagatccctggagagcttgagccctgccattaacttggcgtacatcaagaagaactgttggaatctagatgatccaacggtgacatttagagggccaaggaagaccagggttaagaaatctgaggtctccactacttcaacagcaccaaagacagcagctccttcttcttccacagctccagcacctcccatttcgactccagcacagactccaaccattcttgctccatctgctcatataccacttccagctcctttatcttttggaccctcagattttttatttacaccacaaattcttcattccatgctccatagcttacacagggggcaggccattatcatgcaaagccttcagggcttgggactgccatccatcatgagcatggatgagtttgacacacaggtggcctggccaggagtccagccttctccttctggagggggtgaggcctccgtagcccaggagcctgagccagaggagctagcagcagcaacagagggggaggatgagctcacttctcctgagcccttttattttgatgcagatccatctccagcacccattcctgatgattccatgccatccgcaccagcatctgagctagagcagcctatctctcaggattcaccagctgcttag

SEQ ID NO: 27791 - DNA, 261 bp, Glycine max
  Peptide Sequence Number=SeqID_144569
atggtgtttggcatgagagagagcattggagctccaatgaggttgccatcaccaccgttgtgtagatcggtggatggcagctactgctggaaaatacgtcggaaaaggggaaagggtcgttggaaagcggaagcaggtcgctggaataagtatgacaatggtaaaggtccaccggggacttcacttcaacaatgcgtaagcccagaccatccaactgagtccgaaattgagaagtacctacttgttttccctgcttcttaa

SEQ ID NO: 27792 - DNA, 402 bp, Glycine max
  Peptide Sequence Number=SeqID_144570
atgggtgggagggtcgtggcatgcgttgtctttgccgctagagacgcccatgccgaggtagaggaggcctttgtcagcaacaaggttcatgtagtactcgatgttctcgtaccacttattatcgtcgtcgatgatgcaatcgtcggggtcgaggtggtcgaagaaggtggcgatggtgtggtcaacgggggcactggccttgacaaggatgatgacagatctaggacgctagaaggagataatgaagttgcgaggggtgtattggcccgtgagagggagggagcctttattgtgtgcacaatctacgatctccacctcgagggtgatggtcttgttggtcaaagtcttcactcagggaagagaaagggagaacgaagaagtgggggaagcgtagagtggtga

SEQ ID NO: 27793 - DNA, 969 bp, Glycine max
  Peptide Sequence Number=SeqID_144571
atgtcttaccgttttatatactacttgtgcgaatcgatacacttgtcgaccgtccaacacaacacccacataacttttgatgaatcttgtaaggacaaacctttcatgagcaactacaacatgggtgctcaattcaaggtcagtaccatagtaaaaacatatctaatgttagaatgttactatggtacgattgttggcacattaattaactgctcatatgattgtcatgtcagaacgcaagggaaaatatccatcaaaacaacattgccacctcggaatctgacttaccctcttggtagctcagttagaagggccttgaagaagcccaagattaatactcaattgtatatgtctagtgtgcctaaatttaaaaccaaacataaccccaatccagagatgaatatcaggccaagtggtgttcatgaaaaaccaaggccaattgcaaatgcaaacgtgggaaatggggaagttgttcctaagccaattgccgacatgaaactgactgtcgaagaggcacatgtttatgcatatattttcaactcaaagttagaccccaatggcagcgagataggttttcgaactggaaacaattttggcactcgaaggcattttgaaagtctgtgtcccaataaaacaatagctcatgagggttccatcaagtcgtgtgtattggctattgtgtttgagaaactagacattagttggggtatagaggatatggatcattgggatatcctgcaaccaaggggaatcccaaactggggatctagcgacaattcaactttatgggtccttgagtggatgcagatggaagaatcttttgtcactatattgtatgggccgcttgatgacaaatatgttagaataaaacttgcaatgacattgctacttggtccacacaacaacaagagcaccatcgtcagtgccacagaattgaattgggatgaattcattcaggggaatcattga

SEQ ID NO: 27794 - DNA, 620 bp, Glycine max
  Peptide Sequence Number=SeqID_144572
aaatggataatgtggaagttttgggattttgtctaacatggattaacatcagaggtgtgcctttgcaattctggaataacgagtgtttcaccaaaatccttaacattattggctcactggtgtctgttgacaaacaaactagttcctttgtgaatctggatagggcgaggatcttggtgcgtaccatgtggatggagtttattaatcaacatagaagaattcagatcaataagaaggtgtgcaacatcatggtgttagaggaaaatggtgggtacgatgagggtagagagatgtgcgtaaaaggagggtggtggggcaagatggtaaccagtgaggagccatttccagtggtggatggaaagggactatcaaactctatggtcaacctagtcattagggtatgtgatagtgggcaaggatacaagggtacaaacaatgaatttgaatccttcagtagtcaacagggggagcagaatgaaaaggcagacaaatctgatgagggaggagatacatcaaagaagaacgataatgttgggaactcagtagaggctcagagagaccctttgccaaaaggtggtagaccgggtaaagaaagaaacctaaagagtaggggaagttga

SEQ ID NO: 27795 - DNA, 279 bp, Glycine max
  Peptide Sequence Number=SeqID_144573
atgtttgggtatgttgattttgatggaaatgtagatgatgatgaagatataacatcgaagggtgaagatgacgaatatgatgaagatgttgatggctccggtgaccaagtagaagagtatgaagaatatgaagatgacgacgagatgcattcaatgaacattgaagatgttgcgagattgagtttttctgatttggaaatagcatatcaattctattgctggtatggtcgaattgttgggttctttattggagcagttcctggaagccatgaatggtaa

SEQ ID NO: 27796 - DNA, 222 bp, Glycine max
  Peptide Sequence Number=SeqID_144574
atggaagaagatgatggagaatgtcttctccagcctctcaaccctaaatctctctgttttcacgaagcccaaaccctccttgttgctctcaaacctatgagtctcgcttggccaatctgcctcgctaagcgagtcatcaacaactttaaccttctcttctttggcctgcaaactgagttggattcaacattaggtcacaaaaatggagtttctactctataa

SEQ ID NO: 27797 - DNA, 336 bp, Glycine max
  Peptide Sequence Number=SeqID_144575
atggagaacagaatgctaacgaaaggatatccctgttgttgtttatgtagagcgaaggtgcctaaaaacttggatgtggacacttcctcaggggacttcattttgcaaaacaacgtggaaaaaggaccttgggagaccccattatttctatcaaaaagcttgggaaacatgatgatgctaccagagaagatgttgttggtccaagagctgtgcaagcgaataggaaaacaaataagggactttaacttttacaatgttcagactcttgagaccaaagtgcaaaccttgaaggatgccaatatgcaactgaaattgcagttggcgattttggagtag

SEQ ID NO: 27798 - DNA, 684 bp, Glycine max
  Peptide Sequence Number=SeqID_144576
atgtttttcaatgtgaaaaacacgatttccatgccccttctctcaaaattctgccaaaccaccctagaaactccttttccaccacctacgaccatcgctggccaccacgagccgctgttgcttaacgccgaactaccatacggagtggaacattttaatcgaagtggaatcctcagaatccacctcaaggattcggtggaaaacaagctatcaatcctttctttcatagctattctgagggctactactcacacagtttggagagttaagcgccctaaggtagctaatcccattgtctccttcgttgaagctgtgaagtccaacaaccaactgtgtttcaaggaaagggaaaagaacttggctggaaaggcttggctgaaggaatcagagtctaggctagagaagtctgagctgcgggcggctagagagagggaggccataaacgagcttgaagagaatctaataatctacaagaaggaggttggggagcagcatgaaaagggctttaacaaggccatcaggcaagccgagttcttcaccaaggaccttgactttggtcttttttaccctttcaaggatgtgaaggaagctgttttgcttaatgaggaagatattgccgctgaggaggaggatatcggtgaggagcagaatgctaaggagcaaggtaatgctgccaatgtttag

SEQ ID NO: 27799 - DNA, 234 bp, Glycine max
  Peptide Sequence Number=SeqID_144577
atggttggcaaaattcaaaatgatagtgatgacatgacacgatatggtagagagagaaggaaaggagcgaatgctagtctggcaccgaaaccaccagatggtgcttttggtgataagtcgtctagagagaaactcatgggcaagcctgctcaactttcagaatcgagggatctcattaaggagggactgatgactgtgaattatgatggggggaaccgtttgctcaatccctaa

SEQ ID NO: 27800 - DNA, 174 bp, Glycine max
  Peptide Sequence Number=SeqID_144578
atgcctaaaccagggaagcgaacccagactagggttttatccacctttgtctccgaagcagaaaaaacaggtcccaaggatgcacttttagcgagagaacaacaacaaagatatgatgattatggggtgaggaggggaccattaaagaggcatggcatcagacccaaaagttaa

SEQ ID NO: 27801 - DNA, 150 bp, Glycine max
  Peptide Sequence Number=SeqID_144579
atgtctcctctacctctaaaaacctcacaatctctcaaaaaaactccttcaaagctcttcaagatgcctcctttggctttatatggaaatccaatcggtggcctctcgctaagcgccaatctcgcgcttagcctagaagatgacggatga

SEQ ID NO: 27802 - DNA, 816 bp, Glycine max
  Peptide Sequence Number=SeqID_144580
atgaagttccctaccttgatgagagaggttgtgactgtggcaccttatcctcccactagggagcctgctaagcttcaccccacaatggatggtaccactcaggtcatgagcatggacaaaagagacctcaccagccatgagcacagacgcatagctgatgtcttacataggaatacaaacttgtttgcttggaaaccatttgacatgccgagaatccaccccagcattatctacacaagctcaccatttgtccctaggccaaaccggtatcacaaaagaagagaaagatgggagaataatgacataaagcggtcagagaagaagtggactagcttatcaaagccaacttcatcagagaggttaggtattccacctagctcgccaacatcattatgtattgataggctaatcgatggagcatctgagtttcaagtactaagcttcctggatgtctactctgaatacaaccagatttggatgcatactctagatgaggagaaaaagacattcatcactgaagatgacaacttttgctatagggtctacatcgacgacatggttgtcaagtctcatagcatagcccaacacatgatagaactggaagaggctttatgctcacacattcccgacaaatgcacaactatattggagatgcatagtcctactaacatccaggaagtccagatgctgaatagtagactagcatccctgtccacgttcatccccaagcttgttgaaaaggcaaagccattttacaaattgctcaagaaaattgagccattcttggggacaagacttgcgaacaagctttcttag

SEQ ID NO: 27803 - DNA, 249 bp, Glycine max
  Peptide Sequence Number=SeqID_144581
atggtgtcaggggaaacttcaagtttatggaatgtcttccagtataagatgtcagtggagctatcttcgtcgatgagggccttggacaccatgaagttggcaattacgatggacacaactatagggtcgtcctggttgatgaggttgatacccttgaagtctctatcaatgaaggttcattttcctgatgttgccgaggttattgatcgagtcttccttggtggtgtctttgtcttcctcgatctttga

SEQ ID NO: 27804 - DNA, 438 bp, Glycine max
  Peptide Sequence Number=SeqID_144582
atgagaagaggatgcaggacgctttctgtacccacgacacccatagcgaccgcaatagttgacgaagtggtgattgcgaattcaagaaattcggcaatgcaggatgaatcgcgatttccagacgaatcgcgtgattcttcaccggcggctggactcgcgattcttcaccctgcaaagactcatcggagagtagaatcgctggatcgtgaagacgagtgtgtatccgcgtcgctattttctcagccgtggcagggagtcaaggggtggttgggttcagatatgactagggttgttgggtttagatctaggcgggatagcgtgtgcatgcgtggaggagacggggtaggacagtcacatgaggcaaggtggtcaatagtgatgatggttgcacaattcaaatctaggttagaagaaagtgaagggaagaggaaagggtga

SEQ ID NO: 27805 - DNA, 657 bp, Glycine max
  Peptide Sequence Number=SeqID_144583
atgtcgacttgtaatgagctgccaagaaagctcaacaagtctgagaggaaaccacctgtgacaagttttaatgatcttaagcgtcaagctagactgaagaaaaaggagaggcaaaaggtacatgagaatacattacaacctcctgaaaatggtttattggttgatcatttaattcctattgctcatgaagtatatgctgccagatgtgaactaatatctagtgtttcaacacttgtcaactacactgctatttatacatgcagcttatgtggagaagttcatgttggtcatgcaccacataaaattagaacatgcgatgttagaggaagcccatcaagcaaagaacatagttgggccaaagttggtgttgaacatgttctgccacttgtagattcatttcatctgtatgatagaatagggagggctgtttcacacaatgaaatgcttgaagtggaccgaattccagcaattgttgaattgtgtgtccaagcaggtccttcccctgtttacactgttgctggtaggattattgattttgagaaaagatttccaaaagaaatttctcttggcgaagatatagaagcacatgggttttggttaatggatgtaaacacaaattctatggcaatgcaatctgacgatatccaaggtttatga

SEQ ID NO: 27806 - DNA, 342 bp, Glycine max
  Peptide Sequence Number=SeqID_144584
atgaaggttgaacaactctttgattgccatcatattagtgaagagagaaaagttccattggctacctttagctttcaaggggatcctccagtagattattggaatgatcttaaaagtgcccttgggaagaggcacattccatcctactatgaaagaaagcttatggagatccaaaggcgtagacaagggagtatgagtgttgaagaatatagacaacaaatggaactactccttttaagagatggacttagggagaaggaaaaaataagcatagctagtttccctagtgggttaatatggaagagagggacaaggttgaactccttccatatagggacctag

SEQ ID NO: 27807 - DNA, 576 bp, Glycine max
  Peptide Sequence Number=SeqID_144585
atgggattgctcatcgagacagcgtcagcatcagaggcaccatcaaaggtaaagagactcatccacggcattctattcaacatagagaagcctagaatcgagtccaaagactatgtgatgataggggagaaggtaaatctactagaagtcattttctactacaagttgcaagcctttaaagacaaattcagccaaaagagcaagaagaaccccatcccctatggcatgttttttacttatatcaagaggtatgttagagtggcaccatctattgtaacgactcaactgaaaaggataacctttgttaagatagggattgctaaaaatttccctgaatatgttaaacaacacatcaagaagaaggccaagaatgaacctatggaggaaccacaatctatggtaggccaaatcgtaggaactcaggatcaacctgtagattgtaagtctacaactacatctcaacatacaaagggggagcatgcccaacctaaacctgaacttgctctcagactaaacatagccaacccatattcaaactacccaccaaaagaaaagactaacctcctcaacctttag

SEQ ID NO: 27808 - DNA, 375 bp, Glycine max
  Peptide Sequence Number=SeqID_144586
atggcacctcctctcacctcttctcctttatctttcgctgcaactccatggcaaaagaagtcattggttgcaacaaggaagaaggccaagtttgataaatccttagacaagaaggaagccattgatatggagcaaggcattttgcccttggtggaagctctgtctagtgaagaacataggaagaaggttgttgaggatgcaaggcaagttggctttgctagcaaggattctaaagaaaatacaaatgatgttgttttggaatctttgaatactttctgtactaaggaggtgatgagaaaagttgctaaagaagctacgataatggatatggatggtgagccagtgcctgaagctatcattttagaatctgcctag

SEQ ID NO: 27809 - DNA, 273 bp, Glycine max
  Peptide Sequence Number=SeqID_144587
atggttgtagcttatatggatcctgctgagatagaagctttggtagaagcaatgcttatatatgttattgaagcatttcttagagatcaagacaatgatatagtggaggcagacgttgaaaggttttatccatggccagtgtttgaagatgatgaacaaattgttactactgctctatctgatgaaatggatgaggacatacttagaagaatggaagatgaatatggagagaaagagttctatcttttttcagtcataatcttctggtgttga

SEQ ID NO: 27810 - DNA, 549 bp, Glycine max
  Peptide Sequence Number=SeqID_144588
atggctaggagcatgctttgtgaaaaatcacttcctaagaaattttgggtagaaatagtaaacataacatgttattttcaaaacagaatattgatcagacatttgatcaagaggactgcttatgaactatggagaattggttcgtctgttgcacctaaagtggatgaagtgaaaaaatatgatgaaattcttcctcaaactagaagattttctgataaacaaccacaaataagggacaaaaagtttgtacacttccatcctcaagatcataccattggtgatcatgtagaaggagtcaaaactagatcattatttaaagatcttgcatctgatgctcttgtttcaaaaatagaatctaagacgatagatgaagcactgatagatgatgggttgattattgcaatggaagaggaactttaccatttgactagaaataatgtatgggtagttgttctcaagcctaacaacaaaagcatcattggaacaagattggtattcaaaaagaaatttgatgaacaaggtaaaatggtagagacaaggataggttag

SEQ ID NO: 27811 - DNA, 705 bp, Glycine max
  Peptide Sequence Number=SeqID_144589
atgattgcatctaaacctatgaaagctgatgaattatttaaggaagagaacttatgtctgatggctaatacaacaatagaagaattagaatcaaagcaagaagaggaggtagattttaataatcctgagtctttaaaacaagcttatcacgaactactctccaactcttttattctttcaaaagcctacaattgtttgaaaaaagatttcaaaaagttttccagagatcatattgagttccaagaaaaacatgaagctatagtcaataaatctttggcagtaaccacacaagaaaggtggacacttgttaagttcaaaatcataccaaagagaagaagaccctattaccacaacactaatagaagaggacccaaaaatatttgggtacctaaggacatgattcttcctattatagatatccttgacagtagaaaggaaacacctatcatgcttcatccctcaagcatgtctagcaacaatgaagaccttgaatcaaccattcccaaaatcgacaccatcaatattttcaaagaaggagaaccaatgatccgcattgagcacttcttcgacattggatatttggaatatagagggctaagttttcatgaaaccatacttaattgtggtattcagagctacttcattgagcctcaaaccatacatctagaaccgaccaagatgttctggaggaatgctgaattttaa

SEQ ID NO: 27812 - DNA, 261 bp, Glycine max
  Peptide Sequence Number=SeqID_144590
atgactctacaatttgccgatggttctaaaaagaaagcattatggaaagtgctaaacatgacaataaaggatatagaggaccaacaagttccaatcaatcaagggagatccttcatgagaactgctcatgtaaccatcaatgttagtaaaggagtctacacacttaaagagggcaagaaacaaatgctatactacattcaaggcattggagatttccccaatgaatttgctcaccaacaacaccatcatatggcaccttga

SEQ ID NO: 27813 - DNA, 747 bp, Glycine max
  Peptide Sequence Number=SeqID_144591
atgcatactaagaaatcacacgtggagatgcaaatgagcgtatttaaagataagcaggttctggttctgggcggcagtcgcggtattggtgcggctatcgtgcgtcgctttgctgatgagggtgccagcgtgaccttcaccttctccggttcgcccgaggccgccgaaaaactggcgcacgaaaccggttcggctgccgttcataccgacagctcagagcgcgatgcggtgattgccaccgtgcgcgacagcggaccgctggatgtgctggtggttaatgctggtatcgccctgtttggcgatgcgctggaacaggattcggacgcggtcgatcgcctgttccgcattaacattcacgcgccgtatcatgctgcggttgaagccgcccgacagatgccagccggcggccgcatcatcatcatcggttcggtcaatggcgaccgcatgccgattcccggtatggcgtcttatgcgctaagtaaatccgctttgcaggggctggcgcgcggcctggcgcgggatttcggcccgcgcggcatcaccattaacgtggtgcaaccgggcccgattgataccgatgccaatccggaaaatggtccgatgaaagatctgatgcacagcttcatggccattaaacgccatggccgttctgaagaggtggctggcatggtggcgtggctggcaggacccgaagccggtttcgtcaccggtgccatgcacaccattgatggggcgtttggcgcataa

SEQ ID NO: 27814 - DNA, 237 bp, Glycine max
  Peptide Sequence Number=SeqID_144592
atgacggcaacgggacgcgcttatgacagattacgttttttaccgcaaacaacaggttatcgccacgctggaacgatcggatgtggaaccaagatggatgaagaaattaatgcagccagcgcgcaggcggcgctgcggcggctggctgatattcgccatgaagagcacatgaccgaacacgcttttgccaccggttcggtattcagcgcggtggtcagcgccctgttcagacactga

SEQ ID NO: 27815 - DNA, 485 bp, Glycine max
  Peptide Sequence Number=SeqID_144593
atgggcttcaaacacttcagtgaggacaacattgtggtagatgtccttcacaatgcctttgtccttcatcactttactttcaaatctattgaagagaatttggggcaattcaaagggactgccctctatcagatgatacaaaatgaacttggtgccatacttccttggcatgttggcccaattgggtccctagagggagtgcccaatttggtcttcaagttcattgccctaattgtttatgaacttggttcctcgtcgcacacacccaatggctttggcaatggtttcagcatttggcttcactggtataccaacaaccttccctgcaaagtatccttcaataacctcattgtgctagactttggttgttctccaaaactcatggatgagttcaggcaccaccaccaccttggggtcctcgaagaagtggtggatgtcgcacaacataagatagacttctacagcaagaatggacactcgtgcag

SEQ ID NO: 27816 - DNA, 347 bp, Glycine max
  Peptide Sequence Number=SeqID_144594
tggacggaggtggagggtttaacgatggtgactttggtggtgaaggcggaggcacaggcataggcacatggattttagatattgtgggtgtaaaagtaagagccagtggtggcagaagaggttggacgattggaggaaacctctgttgcataagcatacttatgttgaaaagaactgagtcattgaaggatttgagcaaagcttctaatatgtgcaatatttcttgtatcctctctttaaacatactcattgaagcaagggcggtccaaggagttatctctcatggagtactggaagtgttgaccgttgcaagggaatcttcaacaatgggttgggaagagacttaa

SEQ ID NO: 27817 - DNA, 239 bp, Glycine max
  Peptide Sequence Number=SeqID_144595
catccgctaagcacaacactcatgggctaagcgcaaggaagactctggaagaagatgagctgtacaagttcgctaagcgcaccgcttcagtccatccgctgagtgagaagagcgcgctaagcaaaaattcactaatgtttgctaagcagctttgcatgtctagagattctggagagagaaaggttcaagttccaaatagttttgagagattttgctatgtgaagatctgcagagactag

SEQ ID NO: 27818 - DNA, 363 bp, Glycine max
  Peptide Sequence Number=SeqID_144596
atgcatcatcacaatcatctagttaaaaaggacttagtaattggtattccaaaacccaagtttgagaaagataaattgtgtgaagcatgtcaaaaagggaaacaagttaaaaattcctttcaaaattctctcagcaaatttgatgcaaacgctgataaggctatttctcttggttactcattgcaaagcaaaacatatagagtgttcaatagaagaactttaagtgtggaagaatgtgttcatgttgtgtgtgaagaaaataattctattgttcaagataattctttggaagatgaagatacaagttttcaggatagggattctgctcttgaagatgaaaccaaagttgaagaacttgaataa

SEQ ID NO: 27819 - DNA, 273 bp, Glycine max
  Peptide Sequence Number=SeqID_144597
atggggaatcagcagaggcaagggtatactcaaggaagattttcaggcttccagcaaggtccttataatcagcaaggacagtgggggacacaccctgacaaccagttcaataaagaccaaggtggatcctcaaacaccctgacacaccctaacatatttcagaggaggactaagttggaagagaccttgactcagtttatgcaggtgggacaactggccaagcagatagctgacaagtcatccaacagtttttggagcaaatacggaaaataa

SEQ ID NO: 27820 - DNA, 259 bp, Glycine max
  Peptide Sequence Number=SeqID_144598
ggtccgctcttgacggtgaagagtacattggagaatggaggattcaatcgggaaaataacaaagatcacatttcccagtcaagagggtccgctcttgacggtgaagaacacgttggagaatggaggattccaatcgggaaaataacaaagatcacttttcccagtcatgaggggtccgctcttgacggtgaagatcacattggagaatggaggaatccaatcgggaaaataacaaagatcacattttccagtcaagacg

SEQ ID NO: 27821 - DNA, 1116 bp, Glycine max
  Peptide Sequence Number=SeqID_144599
atgcccgagtgtcagaaacaaccagcttctagaccgaagcaaaagcttcactccttgcaagagtccaaggcgatgagaaaactgcgcatcatttgcgacgatcctgatgctactgattcatccgatgatgactccaagaggattcagaacccgagaatagttaaaagaagtatgtgtgagatctctcttctccctcttcttcacacattcaccactcttgaaactagttcttgtgagttgaataacaaaaaaaatacaatgagggttagcactaaaggtcaaccccaaagtaagaagagggttttgactcataccccatcaacgaggaggaagactcctggtaaatatagaggtgtcaggcagagaaaatggggtaaatgggcttctgagatctataacccatttcagaacaatcgtatatggttaggcactttcaacactgcagaagaggcttcccaagtctatgaggccagaaggcttgagttagaagctatggcaaaggctcaagcttataaaactggttctggttctgctggtgaacctttggctacaacttctgataagagtaactgctgtaactcttctgctgctgctgctgcagctgatgtgtctgtatctgagaagttttctactacttctgatgacatagaagagagtgtgttgccacacaattcaccaccgtctgtcattgagaagggtaatgtttctactgaggaagctattgaggctaattatttggtggatgatcttgcagggctagagataccagatttgagtctgttgaacttgccaccaccaccatctgtcattgagaagggtaatgtttctactgaggaagctattgaggctaattatttggtggatgatcttgcagggctagagataccagatttgagtctgttgaacttgccaccaccaccatctactgctggtgctgctgttccatctgggattgagccaaactcggggcttgattttgattggctatcgtttgatgattatgaacaggtttttgatgattttggtggcttggaagatattcatattagtgggtttgatgacaatgagcctagtgagcttcctgattttgattttggtgattttgatgctgattag

SEQ ID NO: 27822 - DNA, 201 bp, Glycine max
  Peptide Sequence Number=SeqID_144600
atggtggttgatggtgacacagaggaaggcttggtaaccttcactagaatagagaagttcaagtccccaaagtggtgtgtgcaaatcagcgagtttgtcaaaagggaatgtggagatcggaagggagtgcggagctcactagagaagaggaaagaaaagatggagattaagaatattttagtcactgcaatacttgattaa

SEQ ID NO: 27823 - DNA, 510 bp, Glycine max
  Peptide Sequence Number=SeqID_144601
atggccagtggagcagatctggtagtggatgtggtgggtcttggtggtgtggcagatcttggtggtggtgcgatagcttcaacgaatcttgacggagggttagagcttgtggggcctacttcgttggcactaaagagatcaccaacggcgatagtggtaggggtgctttgggagttggattccttgcaaccacaacattgctttgcagcattatggagggtgaaagctccatcgaaagttatcatgtttgcgtggaggggatgctacgtgtggctcggttttcaaccatttttggcatcacagtggggcatggcttcacatctaaggtttagggatgatggatggctgtttggtttgttgttctcttgtccatatggttgcattagaacgttgtggtgtttaaaggggaaaggttgtgtatacaggagcttagtccagcttcctctcgtaggtggtgcttttgggttagggtgttggtggttgttgtttgaagatgttggcttggcttag

SEQ ID NO: 27824 - DNA, 651 bp, Glycine max
  Peptide Sequence Number=SeqID_144602
atgctgcaaccccttctcgtcgtcaacttgttgtcggtcgtcaactcgcgacaccatgaactcctccctcttcttcgaactcaagctctctcgcttgcaatttcttcttcttcttctgcggtttctcaagagaatatcgagacacacttgtccttgtggcttgctatcttactctcccgccacaatgagtcagtgcctctcagacaaactaaaaaggatttgatttgggaggatattcaggatgttcgaaagaaggcgcatgcctatcagaaacaaaacactacctctcacgtgttgtctcgtgggggttatgattttctagaacaaaagttgatggaggagaagaaaaataaactattggaggaagcagcccaattcgggagcactaacatagtcgttgatcctccatatcccattagacaacacgattccctggaaaagcaggccttacagggaagctttgccgcacatgaacatcaggatgtagtgactgctaccattgggcaaccagagcaccctggttgtgtccgagctgctggagttgatgtcatgatcaaacactactttggaccggcttcaaggggctcctgcacttcttcgtccatggttcctgatgacctagagcaactgatacaaaagatcagagactag

SEQ ID NO: 27825 - DNA, 213 bp, Glycine max
  Peptide Sequence Number=SeqID_144603
atggctcccatgaggtgtcctccagtgctaggtcgtcctactgcaccaagacctattgggagggagtgtggaagtgtctgcaggaatggacccatgatgagtgttgcaacctaccttatgacgagacgacgaaagaaaataaaaggcgttttcatctcctgtgaagaaaacccgtgggagtcgccaccaacgtttattcaaggaaaacgttag

SEQ ID NO: 27826 - DNA, 900 bp, Glycine max
  Peptide Sequence Number=SeqID_144604
atgaattggagaggcaagttgtcgcgatgcttgatgcttgatgctgatatgatacgcccgagtcatagtccgttttcctcacctgtgctactctttaaaaagaaggatgaaagctggtgttgttgtgttgactacagagccttgaacgccgttaccatcaatgatcgttttcccatgcctacgatcgatgagttgctcaacaaaattggacgcgcgtcatggttttctcaactggaccttcgtcaaggttttcatcaaattcgaatgaatgaagctgacattcagaaaacctcatttcgtacacaccatggacactacgagttcaaggttatgccattcaggctgtgtaatgccccctccatatttcaggcgactatgaacgatcttctccgaccgtttctgcagaaatttgtgatcgtctttttcgatgacatactaaacaccttgaaacaattgtgcggagctttcttcctttgtctttctaagtgcatcttggccaaacaacaactgagttaccttggtcgtattgtctccccacctggagtagccctagacccagataaaatacaggctatggtagattggccaattccggcatcaccctcaaaattgagaagtttcatgagcctcataggattctatcgaaaattcatcagaagttatgccgccatagcagcaccgttaactacgctcttgtgtaaggacaaattttcatggagtcccacggctcaagaagcttttcaacaattaaaaaccatcatgacccaagctcctgccctcaccactccagactttacaattcaatttaccattgaaaccgacgcctccggcaccgccataggagcagtcctgttacagaactcccaccccatagccaagcaattgtgccccaggctataa

SEQ ID NO: 27827 - DNA, 387 bp, Glycine max
  Peptide Sequence Number=SeqID_144605
atggcagcccgtgaagtgattattgagtcaacgacttccactgttgaagagcccggaagttacaatggaagagaggatggtggtttgccatatgtaaatttgaatggagaaaaacccgtgccagcgtgtacaaaggaccctgttaaggacttcaatttggtcgtcggtctatgggtgttctctccagaatgtactaatgaaaatagggtcgcaatcgaacaccaagctgcgtgggaagtcgtggagcttacaaacggtgtccaagaacaacacctcaactttgtgagttgtgaaatctggggtgagcttcggggtgcagatgtatctggtggaaaagttcctgatatgaggaattcgcctgacatgcttgacgaaattgttccataa

SEQ ID NO: 27828 - DNA, 201 bp, Glycine max
  Peptide Sequence Number=SeqID_144606
atgtcggcggagcgaggccaacaattcgattggcgagtcgttcatactcgggatggtgggggatttgggggaagtggggttgatggtaagagcatcaagatgattaaggatggaatccatcttactgtttattgcggtttgggtttgcgcgagggaggcatggttctgtgtaagggtagcttagccttgagtcagtcatga

SEQ ID NO: 27829 - DNA, 405 bp, Glycine max
  Peptide Sequence Number=SeqID_144607
atgaaaactcaggttgatgctcatcgccgagacatggaattcgccatcggcgattgggtttatgttaaactccgtccgtacaggaaaactttcgtccaacccacttactcaaagttgtccaagagatactatgggtcgtccctccacaaggtcgagggatcgctcaagatgatgtttgattgccagcatctggctcgcctaggccatggaatgccttcatccttaagcaatcagcttgcctgggggaagggtttcaggggctggcaattgaaggaacagaaggaaaaatgcaaggagaaagagaagaagaaaaaagcaaagccgaggtgttgcaaaatcaaaccgtggatcgtttcctacatcctttctcttgctagccttgtaccctatgcaacaatcggttag

SEQ ID NO: 27830 - DNA, 642 bp, Glycine max
  Peptide Sequence Number=SeqID_144608
atgtcattccctcttcccataaaaccactgcttccacttttctcctttcaccctcacttccccttttcttccaccatcataacgataagacttccgcaacccgcagctagggctgggccagggcccgcgtgggcctatcctgctgcaccctgcggctatcatcgaggagcgccttgcggcccatatcatctagaagtcaagagttgcggtgtgcaagacaagggtttgtggggaatgctgaagcctatgttggaggaattttataaaatacttatttttattgttatagagtatggtctggatggtggatatgttggttgcttaaaagctgccattgactatgagaagaagggatttgtggaaaactatgaacatggtcatgtgatggagaagaagttggttgcaatggcttgggagatgaagaagcttcgtgcagagattgcaaatgcagaagaaagagcatgggctgttgcaacggctgggaatccaggtcaagggtataatgcaaattatggcaatgttgatgctggatatgctggaaatccttacccttataatatgcatttggtctggatcaaaactgaagagaagtgtattttccactttttgtattctaatcctgaggattaccttgaattttaa

SEQ ID NO: 27831 - DNA, 318 bp, Glycine max
  Peptide Sequence Number=SeqID_144609
atggatcaaaacaaaatagatacaacaaggaaaaaaaaaggaacatctattgttgcagttgaagaaggtttgggtgacgaagataatgaagaaccacttagtgttgtgacctcctccttgttgatggaggcagcaatagtaaaaagagaggagttgcaaccaatcatgttaagggacgacgagctgcgttccattctggagcgtgtggaaagcgagaaggacagtgaaacgttcaggctagtctgcaagcaatggctccaggtgcagagcacggaaaggaagaagctcgccgcatgtgcgggtcctcacatgctctga

SEQ ID NO: 27832 - DNA, 189 bp, Glycine max
  Peptide Sequence Number=SeqID_144610
atgaagatgaagagacatcttaagaaatctcgggttttttcgattgaggacgaggatatggttaagccgaagcaacagaagaagctataccagaagaagcaaccacacccacaaagtgagataagtgtgggttgcattgcatctttcatggtttctttcagagggggcatctgtgttgtgctctactga

SEQ ID NO: 27833 - DNA, 252 bp, Glycine max
  Peptide Sequence Number=SeqID_144611
atgtcttggaagcattatggaagcgcctcggcttggaaattgctctgccctctttcccttatttataggggaaaagagggaggtggttgccgcccagctcgcctaggcgagctggattgtttccaccaaaaggcaccgccttctgttggaacaccctggaaggcccaaaactttacggattgcgcgacaatgctccctttcgtcttccggaatgtcgcggaacttcacggattacctaacaatgggtgttaa

SEQ ID NO: 27834 - DNA, 702 bp, Glycine max
  Peptide Sequence Number=SeqID_144612
atgaataaccaacaaaagaaaaagaagacaaggaaacaatctcaaagggaagagaaagagcataaattgatagctagagaacatagaacgaagaaaaggcacgagcagtctagtgcatccatccctactcatccagctgaagaaaagtcaattccacaaagaaaaaggtcatggcctaacttgctcttgctccaaaaaaaagcaaaggttgccaaaccaacacctacatccaaagaagttgtcattctgtccaccattccaagacgcgttaagacaagagccattaaagccaatcccaagattggtgacaaaaagtggtctatctcttttactgacaccaaggagactactgcctcatcatcattagacaatgattccattgaagacactctatctcccccatcgcaagtgtccatatttagcacccaaacatcacccacctccatcccccattcacttagaaaaattcaagagaccagtgcaacagaaggatcctttaatagatgcttagaggagaaccgatcatcaaagacttcatctatgttcaagctcttgagtggacaaggcatgactatgtgcacacaccatcaaaagccttcaaagctttacaatagaatccatagttcatctagaacctcctcagtggatgcgttcagtattgtctcaagtcatcaagatgcaaccacatttattagtggctag

SEQ ID NO: 27835 - DNA, 306 bp, Glycine max
  Peptide Sequence Number=SeqID_144613
atggcgatagctaccatccacactgataatgaaccttctatccatgttgaacatttcttcgacattcaagaacttgaaaatgttggtctaaaactcaacgagaattttttcttctatggagcaagagatttcttcgatgaaactcatatcatttatcaaaaactcatcagaatgttttggaaaaatgttgagttcgcgaacaataaggtatccaaggtactaggaacaaaggtggttctttccaatggttctattgccaaggccccttggtgtcttcgcgagggaagcatttatcaagaagaatga

SEQ ID NO: 27836 - DNA, 375 bp, Glycine max
  Peptide Sequence Number=SeqID_144614
atgatgatcacaattcgtcctagtggtgttgtgcatgctcttcagctctcaaaaactcttaaggaaaaggtcaacctctgggcacttatcgctaagctcttacctgatcatccagcatatcttgatttcaccttagcatattactctatgcttggtggactacatgcccaaatgtacgttcgtagtcaagcaattacccatccaccaaagttgcacatctcaaaggtcatcgagatcaaagttgttgcagctaaggagtgccctcgtttacccatttgggatgttgctaagaagaagggcttcaaactatactataatgaagaaatgccctcaaggaagatgaaagctgaagtgatgaacaattcaaggaattga

SEQ ID NO: 27837 - DNA, 246 bp, Glycine max
  Peptide Sequence Number=SeqID_144615
atggataagtttgatgaagttatgtctgccattagacatggattgacttcttcttcatcttcatcagacgaggcgagttcatcttcgtcagattcttcatcagaagagtcatcaactttgagagcttttgatgagcttttggaggcttgctctctaaatgatgagaccttcttgtcattttggctactaagagccagagatttctttctctttggtccttcatcctattggagttcttgttcatga

SEQ ID NO: 27838 - DNA, 471 bp, Glycine max
  Peptide Sequence Number=SeqID_144616
atgtcccttagaatagatctggtaatggatatgagggaaatatttatgttcatgatgaaaacactatttttttgttacttctgtggtaaagttggacacatgacgttcaagtgcaaggatcaacttagaatagatgtcattgacaataggcaaaaaacacttatcatgatacctgaacaatggctgctcacgaaacattataagagaaaggtgtatgttccaatgcgtgactcctcatcatggtggaatcgtctctttcagagggaatcaaaatggaagaataaagggaatgggatgagtgtatcgtccaatgtaaggataagtccttcctattctctgctaatagaaaagataacctctataagatcagattgggagagttgtcagatcaaaaagtatcatgcttactgtctgtcaaagaaaatcattgactatggcattaaaaactcggtcatgcaagttggagattaa

SEQ ID NO: 27839 - DNA, 570 bp, Glycine max
  Peptide Sequence Number=SeqID_144617
atgaggcgggttgttacatgtttcaccaaggatgaagacatctactcagtcatcaagcgcttgctaggtcttcctaccattcaacatttcaatgatgtttgtagatgtctcacgaagataaacgaacaagaactcgtagctcatgaacaagctgctacaatcgaagctgaagctttgctaaagctgtggacaacaacattatgtgggaggtcattattgtgtgtggatgatgaagttcgactacactccaagcgggttctaaagtgcgaaggcgaaactgtgtttcgtagtttgcaatctgattctatttcggtgcttcacgttttggttggtgtgttgtggaatgtcgtttgtgacaatggttacgagaaagtgaggaaggtgatgggtctagtatttttgtatctcaaatttgtaactttccttcaagacctgaaaaaaggtaacatggaagcgtggaggtgttgtctttcacggaggctttggagtcgtcacgtgacagcgtcagaagttacagttgttgtgagagagaaagatagggacaatccgggaaatacaaagaaaatataa

SEQ ID NO: 27840 - DNA, 486 bp, Glycine max
  Peptide Sequence Number=SeqID_144618
atgtcgcgttgctttccatttccaccaccaggatatacaaacaagggatatgaaaaagaaggctacaacagaggacgtggaattactgacaaagggtacgagaattcgaatgatgtatttccaatctatattggtgatgatcgaactgatgaggatgcttttagggtagcttttgctagagacatcttggaacgaaattttaagcatgaaagtgccacgttattggagcaactaaggttgcacgggaaacttctactttttgaaacaggtagtattttggttgctgggatgtgcactgatatatgtgtgctggattttgtctcgtctgtcttgttcttgtctgcaagaaacagtggtttccttcctcctctggaaaatgtgatcatatcttcccaagcttgtgctacttatgatttgccattacatttggcatttggtgcaacacttgattatcttaatgttgctttgcttgaatttatatcttaa

SEQ ID NO: 27841 - DNA, 207 bp, Glycine max
  Peptide Sequence Number=SeqID_144619
ggatctaggaacagcaagcaaggggactcgagtttaagcatggagatcgccgatctgtgtgatttttacgagatcagcgaccctggagacaagatcaattgctccttgttgaaaaggcacgaagaggaagattgggcaaagaaaaacagtggccgcataggggagggggtcgtggtggttgggggaggaggagaagaggaaacatga

SEQ ID NO: 27842 - DNA, 210 bp, Glycine max
  Peptide Sequence Number=SeqID_144620
atggcggaggtcgagcatctcattgcggagcttgtcgacattggtgatgacgtgaatgagatttttagtaaggtcttgggtgaggatggttcgtgcgctgaacaacgaaatagcgacaatgaaggagaacatggtgtgcttgctactgcaactgtcgtaggtggaggagaacaaggtggcgacgagtttcgcgggaagaaggacacataa

SEQ ID NO: 27843 - DNA, 513 bp, Glycine max
  Peptide Sequence Number=SeqID_144621
atgtctggtggtatcgcccgtggacgcctcaccgaggagcgcaagtcgtggcggaagaaccatccccatggttttgttgcgaagccggagacgctgcccgatggaaccgtgaacttgatggtgtggcattgcactattcccgggaagactgggaatttagtgcctaaggcacaggcaccagagactgattgggagggtggctacttcccgcttacgctgcactttagtgaagactacccaagcaagcctccaaagtgtaaattcccacaaggtttcttccaccctaatgtttatccttctgggactgtttgcttgtctatacttaatgaggatagtgggtggagaccagccataacagttaagcaaattcttgtgggcatccaagacttacttgatcagccaaatcctgctgatcctgcccagacagaaggctatcatctattcatccaggatgcagcagagtacaagagaagggtccggcagcaggcaaagcaatacccacctcttctctag

SEQ ID NO: 27844 - DNA, 321 bp, Glycine max
  Peptide Sequence Number=SeqID_144622
atgattcttgatggctcagcaagaggtactattatgtctaagagccctaaggaagaaattgtaatcattgactctatagaagccactgattatcagagtcaccatgatagggctctggttcaaaggaaagttataatggagccagatactcagaataatcaaggcatacctcaacagaccttaagaggtggctcaggtccttctaacaactcttatgcaagtcctttaaataggggtccacaacaacaagttcaacttgataaaatgtcaaaaatggaagatactctaattcagtatatgcagatgtccatcactagttaa

SEQ ID NO: 27845 - DNA, 711 bp, Glycine max
  Peptide Sequence Number=SeqID_144623
atgttagaggttgcattaaagtataaaaatggatttgaggagcttgagctgcgagataaacaatacagaggcatagctcccgaatatagtgattgggaatttgtgcgtttgatttttccattcttgaagatattccatgatgtcactttacgcatttctggtttagcttatgtgactagaactatgtatatgtctgtggcctttgggattggaagtaaaatcaagcaaatgtctacttccagggatgtgagtgtgagtgtgagacttatacatgatagtatgaagaagaaatatgacaagtattggggtagtaaaatcatgaattggctaattgttgaaagttttgatggcaaattgagtaaattgtcatgtgagttgagagataaagtggaatttagcttaatatcactttttgaaaagtatgttggtagtgaaaatcagtttgaaggtagctcacagaaggctagacttagtgaaggaggtcatgatgatccttatgataaatacttggaggaagctttagacatgaatctaggagattcagatgttttggattggtggaagatcaaaggaccaccatcaccatttccttcgaatgaaaatgaggaattttcagagtttgagagagttgaagaagcttatatagtagctaaagtggctagatccaagaagcaactagcaactataaaagtcaattccttgcaaacatga

SEQ ID NO: 27846 - DNA, 504 bp, Glycine max
  Peptide Sequence Number=SeqID_144624
atgcgtgtgccagcaccctcgctcgccgcaattgggcctggcctcgtgcttctgcggcacgatggagacttgcccgctgtacaggaactgcagcagcagcaggaacacctcgtaccccaccgagttcaccgggatcacgccggggggacgcgccgccgccccggtgtcgttcgatcgcgacgcgccggcggggtcgaggccggtcggcgggtccggtccgcagaagaatttccggaagaagaggctgcgcgcggccaagatgcagcggtgcccgtggaccagacggccctcgacttggaaagtgacgtcgctgaaggcttggccgttgatgaggaggttgaggtagtccatggagagagatctttgagactcttcctgggacatggcgatgatgatgatgttgctgttgccactgttcgtgaatatttccttttcttttgcgagagagcaatttgggtggctattatgggcggctggggttttaaaaaggagttgtctaattaa

SEQ ID NO: 27847 - DNA, 948 bp, Glycine max
  Peptide Sequence Number=SeqID_144625
atggtagagaaagcctcaatcgacgatgtgatgaaagtgctgatagcgtctcgaaagcaagagatgcagcagctgtggagcacgtgttcccacctggtggcgaagtcgggtctccctccggaggtgttggcaaagcacctccccatcgatgtggtggcgaagatcgaagagctccgtctcaaatcctccctcgcgcgccgctctctgctgcccggccaccaccagcaccaccacgacctcaccccaggcatggaggaccagaaaatccagcgaatgcggcgcgccctcgactcctccgacgtcgaactcgtcaagctcatggtcatgggcgagggtctcaacctggacgaggcgctcgcgttgcactacgcagtggaaaattgcagcagggaagtcgtgaaggcgctgctcgaattgggggccgcggacgtcaacttccccgccggccccgccgggaaaacgcccctgcacgtggccgccgagatggtattgccggagatggtggcggtgctgctggaccaccacgctgaccccaacgtccgaactgtggagggcgtgacccctttggacatcctcagaaccctaacctcggacttcctcttcagaggggctgtccctggactcacccacattgagcccaacaagctccgcctctgcttggagcttgtgcaatccgcggctcttgttttgtcccgtgaagaagggaacaatgtcaacaacgaccataacaacaacgcttctgcttctgctactgccatttatccgccaatgagcagcgaagaccacagcagcggcaattcggactccaggttggtgtatctcaacctcggtgccacgccaccaatgggtgaggacgatggcagccagagggaagccatgaaccgtcatggctcgcaaggtggccgatgtgacccaccatcaatgtaccatcactctcatgacttctag

SEQ ID NO: 27848 - DNA, 786 bp, Glycine max
  Peptide Sequence Number=SeqID_144626
atggatattatgacaacttggggaacctatctcgttacaacacaagtggatataaagcacatatggacaccgactatggaaaaactcagttctcagcatgagatgaaagatgatggtggtgatgtgacaatggtttttatgatgattaagttggatggggaagccaccaacaagagctttgagctcaagaggcctacgacttgtgccttgtgggtggatggctatagttggtacctaaggtatagaggtgagaaccaggatggtccttggggatcaaaaatggcgtcaagttgtgatacctctatgaggctgggggactcacatagccgacttgacaatcttaacaatcatcgagagcataaccgagttatggaatggagaccaatttccagaatgtcaatccgcccactagatggccaatggaaccacgatctctggttcaaggaggaccattttgccaacaattatccaatgcccaattacatgcgtgttccatcgacttcgttttcttcaccttcctactcttcatcattggcatcatctatggctgatatcatgatgatgctcgaggagatatttgctcagccgattttgaaggagtatgttctgccatctcccagcagcaatgagattcccttgtcagcatattttccatacgacctagttacccaaactggattccttttgcccaaactcctgattgattggtcattcttcttagatgactatgttgatggttccagtgacgaggaggaagatccttcttcaggatgtgagcaacattag

SEQ ID NO: 27849 - DNA, 293 bp, Glycine max
  Peptide Sequence Number=SeqID_144627
atgcggggttaccttatggttatccacacctttggtcaaccaggggcaaacgagcctgttgatgcgcggggactaacatcgtcctcagcacctttttccgtcttgacccgtgaaggttaccttatggttacccgcacctttcgtcagccaggggcaaacgagcccgttgacacgctgagactaatatcgtcttctacaccttttgaaaacctcacacgggcaaacgagcccgatgacgcaaggagaattacatcgtcttctgcaccttttgtcgtcctgactcgtgaagtcag

SEQ ID NO: 27850 - DNA, 138 bp, Glycine max
  Peptide Sequence Number=SeqID_144628
atggccaatagtcacaagagtaggagaaggatccttttcgaggtggagatgattcatcctcagatcaaaagccatctcatcatcagaagaagcattaccacaataaggaaattaacattgaaagcatcagaactatga

SEQ ID NO: 27851 - DNA, 231 bp, Glycine max
  Peptide Sequence Number=SeqID_144629
atggtgaaggaagtgatccacgatcgtaattatgttgcgcctcggcttcactcttcctcttctccttcttcttttatgttttcccactgtttcttactctttgaaccttttttcctcttcccctacatggctatttatagaaaaagccatttggtgcaggggaacttgcccaggcgagctgcttacttagggctgaaggtatcagctcacccaggcgagtggcttgcttag

SEQ ID NO: 27852 - DNA, 432 bp, Glycine max
  Peptide Sequence Number=SeqID_144630
atggttcgtaacagaacctactcaaggttacccatctgtgatgaaggcaagaagaaaggcttcaagatatatttcaacattgaaatgcctaacagagaacaaaaaaagaccctgtttagaggtaacaagcttgtctgcaagctcgatagcttcgatgctcgaacttcatggaatcaaattgtttggtttgatactccaaaagcatccactcctagctctaatgttaaggacctatctgatcacaaggattctatccaagtgttatgtccaacaaaggtctataattttgatgacgcagttgaagcctcgaagaaaaaagtggaagcactctataaagttgaaaaagttgctaagaaaaccaagattgttgccaatatgaaagttgaggaaaagaagaagcaacaagctgaagttgctgctaagatcacatag

SEQ ID NO: 27853 - DNA, 210 bp, Glycine max
  Peptide Sequence Number=SeqID_144631
atggcgaaggaagtgatccacggtcacaattctgcagcgcctcggcttcgctcttcctcttttccttcttcttatgcattttccctttgtttcttaagccctgaaccttttttcctcttcccctacatgactatttatagaaaaagccatttggtgcaagggaaactcgcccaggtgagtggcttgcttagggctaaagctttctcttag

SEQ ID NO: 27854 - DNA, 276 bp, Glycine max
  Peptide Sequence Number=SeqID_144632
atggaaggaaaaactaatcctttgagagtcataaggggttggagacccaaacttcttccatgtgcaataaatgcagcatgtgctgcacttgtggatgctggaattcccctaaaacatcttgctgatagtggttgcattatattggacccgaccaaagatgaagaggagaaaatgaaagcatttgccaatttagtttttccaaatacaattgtctcggtcctaccagagagagatcattgcaagtgggtagtgagcctatggaaaatggaatcatga

SEQ ID NO: 27855 - DNA, 309 bp, Glycine max
  Peptide Sequence Number=SeqID_144633
atggcaaacaacaaaggaactatggatgaaaacccacttacactgcacaactcagacaacccgagcattatcttggtctcccaactccttgagccacacaactatggacaatggagttgggcaatgcgcattagccttagtgcaaagaacaagattgggataattgacaaatccatcaagaagttgtcatccacagataaagctttccattcctggcaacgttgcaatgacatggtgctatcctggatactaaattcaatgagcccagtgattgcatccagcattatctgcatggacacaacaacaact

SEQ ID NO: 27856 - DNA, 201 bp, Glycine max
  Peptide Sequence Number=SeqID_144634
atggctgggaaaatcaattggaactgcattatgcaccaacaatttttggataattataaaatttggtatgcccataaatgttggaaaagcaactggtataccctcttccacaacaatgctagaaaagtaggacaagccgctttgcgcaaaaatcaaacccacatttacgcgatgaaacaattatttttggaaatcatttga

SEQ ID NO: 27857 - DNA, 1008 bp, Glycine max
  Peptide Sequence Number=SeqID_144635
atgagtgtcattgtggataatctgcacattttcttgtgctcttggctcctgagaatcttattgtggtatttcaatgaccaggttcaaattgggtcgcatgcctttacatttgattacgtttatggaaatggtggatctccttcagttgagatgtttgaggaatgcgttgctccattggttgatggcttattccaaggatacaatgctacagtacttgcctatggtcagacaggatctgggaaaacatataccatgggaactggctataatgacaattgtcggagtggattaattcctcaggttatgaatgcgttgttcaagaagattgaaacactaaagcatcaaacagaatttcagttgcgagtctccttcattgagattttgaaggaagaggtgagggacttgttcgatagggtatctatgggcaaaccagaaacctctaactctaatggccattctggaaaaataactgttcctgggaagtcaccaatacaaattcgtgaaacatcaaatggagtaataacactggcaggaataactgaagttgctgtaagtacattacatgagatgtcttcttacttggagcagggttctttaagcagggcaacgggaagtacaaatatgaacaaccagtccagtcggtcacatgccattttcacaattacattagaacagatgcacaaactccattctagttctcccaccaatgactcttcagatgaggatatgggtgaagaatacctttcagcaaagctccatttggtagatctagctggatctgaacgagctaaaagaacaggttctgatggtgttcgtttgaaagaaggtatacacatcaataaaggtcttcttgctcttggtaatgtcataagtgcactaggggatgagaaaaagcgaaaggagggtgtacatgttccttatcgggatagcaaactcactcgactcttacaggattcacttggtggaaacagcaaaactgtcatgataggtaatactgctgaatgttga

SEQ ID NO: 27858 - DNA, 357 bp, Glycine max
  Peptide Sequence Number=SeqID_144636
atgaagaaattgaagataggacaatgggtcattgacaagtgcagcaaccttactcatctgagacaaaaggtcgtggaacgtgtcacaaagaaagactcatctaccttttcttcctttgtcaatgcaatgacatattttaatgttggtggaggtaaaaatgtcaaagtgaatgtgtacgggctaggtgcattaagcaaaatgttgacctcaaaatctgtccaaccttctgtcgttcagcccgaggtggtagaccaaatacaggagatgcatcagatgattcaaaagttgaatgttgagcttacaacaaagggagataaaaagaagacactaaaggaacaaatgacacaattgatgtag

SEQ ID NO: 27859 - DNA, 912 bp, Glycine max
  Peptide Sequence Number=SeqID_144637
atggcggataacatcgatagcatgagtatggatccgattacttatgcacggattattccctcccggccagcgttacaagcgcgtctgaatcagtttaaagagttaggtaacagctatacctacttgggttttaacctgaaacgtaaaccgtttgatgatgtgcgtatacgcaaagccattaattacgccatagacaagcaggaaattatcgatggtgtttatctgggtttgggcattaccatcgcctccccttacaagccggggacacgctggaataatccagacctggtgccctacacatttgatccagcaaaagcgaaacagttattgatagaagctggttaccaagacacggatggggatgggattgtcgaccgcgccgggaagaaactgtcattcgaaatcctgacgaatctgggcaataaacagcgtgaaaaaacggcagtcattattcagcggcgtttaaaagaagtcggcatagaaacgcatattcgtaccttggaatgggccagcctgctaaccaattttatcaaaccaggggactttgacgcggtggttatgggttggggtttaggtctggatcctgatcaatacagcatctggcattcaagccagcagaaaccggggcaatttaactttattgggtataacaaccctgccgtggacaaattgcttgagcaaggccgtctcgagtttgatccagaaaagcgtatgcagatttaccatgaatttgccaaagtcctgtacgaagacagcccactggtttacctgtctgcaggttacgggctgacagccatccataagcgtgtacaaggcatcatgaacccggtgccgccagccggcgtcagttatgattcacaaaagtggtatattccacagccattaaggcgcacgcaaatacaggcagaataa

SEQ ID NO: 27860 - DNA, 618 bp, Glycine max
  Peptide Sequence Number=SeqID_144638
atggcagaatcgtcgaagaagggaaagggaacgtcctccaccaccactgctactggccatcgccgccatggaccatctgaagcacccacaacaccaattcatccttccttatcatctccacgatcatctactctattttctttagatgatcaacgtctacggtacaattctcaattttcttctaggatcattctagaccctaagtacctagacacagatttctttaatgatgagacatttgactgttatcaagtatttcaaaactctggattggttgattttatgtccttaaaattgccttactatcctgaacttattaaagtcttttacaacaatttaaaaattcaggatggtattatttcttctgagggcaccattgttgatgactggaaattcgactattctagtcatgatgctcaccgtatggtttgtaatgaccaggctgaaatgaacgatagattgctggctggatcattaacctttgattgtcacatcatgcactatattatcattagaattttgcttcctcgttcttctaatttggctcaagcctctgaggaggacttgatttcgatgtgggctttccttaccggtcgtcagatcgactgggctcacttg

SEQ ID NO: 27861 - DNA, 207 bp, Glycine max
  Peptide Sequence Number=SeqID_144639
atgtgtcgcaacctacccttcggtgggaaggcgaggcgaaaagctaaaggtgcatcttcgaaaaagaaaacgcatgggagtcgccaccaacgtttattcgaggaaaacgttagaaaaaccaaaaagaggtctatgaattttgaaaataagggttcaggagttatttacgcacggggaaggtgcgatgaggaattcaaacccacgtag

SEQ ID NO: 27862 - DNA, 180 bp, Glycine max
  Peptide Sequence Number=SeqID_144640
atgccaaagctcatggaagctgatgttcagtttgaatcaccaacctgcccttccaatacagtagttgatcctgaattgaatggtgaggatcaggtgctttgttctgtaagcatagctcccttaaggcctacaactgagagtcagcttgtattgcctctttcaacaactgaattaacttga

SEQ ID NO: 27863 - DNA, 412 bp, Glycine max
  Peptide Sequence Number=SeqID_144641
gagaacaggcataaaacagctttcaggacacatcaagggcattatgaatggcttgccatgccatttgggctcactaatgcccctgctacatttcagtctctcatgaatgagatcgattacttgggccacacagtatcaggcaagggagtaacaatggatcaagaaaaggttcaagcagtcttgaattggccatatcctataaatctaaagcaattgagaggcttcctcggtctgactggatactacaggaaatttatcaaagctgcaattaccaaggcaccagtactggcattgcctgatttttccaaagcctttacattggaaactgatgcctctgggagctatgcttacagaacaaagcacctgatcctcaccattcaattcaggatcaactactgtattggaagggcag

SEQ ID NO: 27864 - DNA, 279 bp, Glycine max
  Peptide Sequence Number=SeqID_144642
atgtcgctcgagcaaacaaaccaatggcttgcacccacattccagtggaagcaaagatgtaattacgagaggatgagggacaaagatgattcaacaagcgattctcctcaaatttcagccagtccgcctcaattagacttagcaccttacgcttcgaggtcatacagtgctcaatggaatgccctgaggcttttccatgacaaacatatgttgcattcgaatcgtatccttagaaaatggaggttgaggaaacctagcaggggttacggctatcattga

SEQ ID NO: 27865 - DNA, 351 bp, Glycine max
  Peptide Sequence Number=SeqID_144643
atggaaacatgccccgcagtggaagggctacttcaatggctcatggaatgggggcagctcgaagtgtccgagagagcccccccggcagtgcccaagccgatgccattttcctatcaaagcaataaggtcgtcccatggaaatatacccctctcgcttttggagaaggggctgcaaccgaggttgactccttgtcatccaaggtgaccaacattaccagccttagtggcgcaacccacaatggtcgggtgtttgctccccctcactcagaggaattgccctccaagggggaagcacccatgacccaagagtccgcaggcgcggccagcccctcaaaagaagtggatcccccg

SEQ ID NO: 27866 - DNA, 657 bp, Glycine max
  Peptide Sequence Number=SeqID_144644
atggcaatattcgttgacatggtcgagaagggcattgaggtgttacaacgttgtgaggagaccaatctggtacaaaattgggaaaaatgttacttcatggtccaagatgggattgttttaggctacaaaatttctgtaaggcgaattgaggcagataaagcaaaaattgatgttattgagaagttgcctcctccagggaatgtcaagggagtaagaagctttttggagcatgttggcttttataggcggtttattaaagacttctcaaatattgccaaaccactcagtaatttgctcaataaggacgttgtgttattgtttgatgaagagtgtttaaaggcattcaacgccttaaagaccaacttagtgtccaatcctatcattacagcatcggatcggatccaagagtttgagctcatgtgcgatgcaagtgactatgtcgttggtgctgtgttgggccagaggaagagcataatttttcatgctatctactgtcataccctaatttcatccggggataattgtttgtcaacatgtggatttttgccggtcacgttaagctacttaacatcaatcgctacgcaatccatagggtttcgtgacattacggaaagaaatgagcaagatgcccagaatagggggattttgtcaacatga

SEQ ID NO: 27867 - DNA, 1173 bp, Glycine max
  Peptide Sequence Number=SeqID_144645
atggctcacagctgctctgatgaggatactgatattagtgaatctgaaattagtgagtatgaagataaatcctatgaagaactgaaaaatggaagtcaggatgtgagaacatcgggcaagactttcacttgcccctactgccctaaaaagagaaagcaggattatttatacaaggagctccttcaacatgcttctggggtgggtcagagtagttcacaaaagagaaaagcaagagacaaggctaatcatttggctttagtgaaatatttgaaaaaggatctcatgaatgtagatgttccatcaaatgattcaaaaccggaagatgaaagtgatccttctgttaattctaatgatcagtttgtgtggccttggattggagttgtagttaatattccaactagacggacagaagatggacgctgtgttggtgagagtggttctaggctgagggatgagtacagaagcaggggtttcaatccagtgcgagttaatcctttgtggaatttccggggtcactctggaactgctcttgtggaattcaataaaaactggccaggcttacataatgcattggcatttgaaagagcatacgaattagatcatcatggtaaaaaggattggtttactaattctgggcagaagtctggtctttatgcatgggttgcccgggcagatgactacaagatgaacagtatttatggagaacatctgcgaaggatgggtgatgtcaaaaccatatccgagcttatggaagaagaagctcggaggcaagataaacttgtctcgaatttaactaacattattcaggtcaagaataagcacttaaaagagatagaagtgagatgccacgagactacagataaaatgaaccttgttatgaaggataaagataaactcattcaagcttataatgaagagatacagaaaatacagtcaagtgccagggatcacttccaaaggatttttactgaccatgaaaagctcaaattgcaactggaatctcacaaaaatgagcttgagttacggaaagttgaattggaaaaacgtgaggcacataacgaaagtgaaagaaaaaagttggcagaagaaattgaggagatgtttcagagctttcaagaatgcctcgaaaaatacctctcttcagatggctgctttagagccaatgaaagctga

SEQ ID NO: 27868 - DNA, 291 bp, Glycine max
  Peptide Sequence Number=SeqID_144646
atggaactactccttttgagagttgggcttagggaggaggaaagaaaaagtattgctaggttccttagtggaattaatatggaagtgaggaacaaggttgatctccttctatatagggacctggatgacctagtccaactttgcataagggtagagcaacaacttaaaaggaagcctacttcaaaatcttatggctctcactctaatccaaagaaagaccaaggtcaaggcatcttaggggctgcaccttctaagcccaaagatgataagagggataggaagaaaaactag

SEQ ID NO: 27869 - DNA, 591 bp, Glycine max
  Peptide Sequence Number=SeqID_144647
atggctagaacacgaggtttaggtcgtgtcattggtagacttgtaggcagagatagacaagatgatcatgatgcagctgatgttcccgagaggcgtaggcctactgcctcagcccgtaggcaacgggttcatcagacgactgcggatgcacgtgatatgactgaggacattgctaacatgactaacgatgtccctgatgtggctgcggaggcacttgagatgcgtgcggacatacagggtgctgatggtgctgaggggtctgatgctgatgatgctgctgagggattccttggtgggccatgtgacccgttagtgctggcatcatttgcggaccacgttgcacatgctgtttggagtggacaggaacatccttatttgaagttagtgtcacatgggaggaaggtgacactgattgagaggtcagtgcctgagattgaaggcctggtggctgccacaagattaagtccactgattgattgttcagttattattggcgatcctggactgatatccgcattcgtggagaggtggcacggtgagactagcaccttccaccttccggttggagagttgacgatcacattggatgat

SEQ ID NO: 27870 - DNA, 198 bp, Glycine max
  Peptide Sequence Number=SeqID_144648
atggaaccacattcggttcggcgaatcatcgtgttcgtaaccgtaatcgtcttctccctcgcactccttgccgttttgacaggttttggtagtggtgggactcttaccgtagccatggtggtgtgcgtgacgcgtggttcggagaaaagaaccatggctagttcgcatcgcaaactcaacatggaggcaattcattaa

SEQ ID NO: 27871 - DNA, 420 bp, Glycine max
  Peptide Sequence Number=SeqID_144649
atgactcgtcgtttggaagttggaggttggaactatctaactagtcacggcatggaagaggtgagggtgttgcggggtgaagagaagagtctttttagttttgagaaatctttatttggcgcaagatcagagagggtgttgcggggtgaagagatcggagagggtgttgtgggggtggacggcgtaggagcggcggcgggggaagggagcggggttggaggtggcggggttgacaaaattcgaatgtctatgagtatgagtgtgagagtgagtggaggccaacagactagggttcaatgtgaaaggagaaggcacattattcgaatgtcgtcaaccagtggccatgatcatgtggaagttttccttagatttgaaccaatagacaacccaaagataccccatcggagttgtatttattaa

SEQ ID NO: 27872 - DNA, 117 bp, Glycine max
  Peptide Sequence Number=SeqID_144650
atgtctttagaggaattactttacatatttgtttctcatagccaagccatggaatggggtgatcctagaaagaaggaattctacttctacatgaaatcatatttccccgttgataac

SEQ ID NO: 27873 - DNA, 336 bp, Glycine max
  Peptide Sequence Number=SeqID_144651
atgactattctggaaggcattccaaaaggctattttggaatgcctgttccaaaatggtggatccttttggagcaacctatgcaagtagagactattgagcatgttgaccgagtccaggccgttcaggaagtgaagcctgttgagcatgtgcagcctacggaccagcaagagccaaaaacaaatgttgtcttttctggtggcattgaggacacatcactgctaacctcatacgctgatcatgtggcttgggaagtatggggttgcatggaatgtggtgagctaaaattagtagcacatgggagaaagttgcagtcacaaattgtgctacatgactag

SEQ ID NO: 27874 - DNA, 381 bp, Glycine max
  Peptide Sequence Number=SeqID_144652
atggtagactgtgatcatgaagaggaaggtcctagtaaacagagcgaggctattgtgagccttgagagggaaattcagaaccagaatcagaaatttatggatatggagcataagcacgcggagaaagctcttattatgggtgaactcatggttggactagcacagaacattgattccaggcaaagaaatctgttggaaatggaaaaaaaagattctaggcctggtcctgcatatctagtgacactaagacttgtttctcctgcatttgttgatacattcattgtttttcagcatgtaatggaaattacctctctccacattgctgctgtgaaacaacaaaatgattatgaaaatgcattgaaactgggtgatgatttaaag

SEQ ID NO: 27875 - DNA, 576 bp, Glycine max
  Peptide Sequence Number=SeqID_144653
atggagaaccatagtagtgaggagtctatgagcaggcgaagcatagcttttgtgagcctaaaggagctggaaaaacaactagaaagcattccaaagctggaatttgagaatcagcaacttaaagagaaattagatgtgatgaagcacatggaagatgaatttctgaatatggctctgagtaaacagaacgaagctattgtgagagttgagaaagacattcaaaaccacattcaaaattctttagatatggagcatatgcatagtgagaaggctactattatgagcaaactcattcccgagctagttgagaacattgagtccatgcaaagaagtgtgccagaaatggaaaacaagtataaagaatcgttgaacataatcaagaagctgacgagcgagggagataccaagcatgaggaatgtcacaaagaagtacaacagttgaaggtcatgaactctattataagtcatgaaatggaatgtatgaaaaaagagcatgagcagatcagcatggaactgaaggagaataaggccataagtgatctgcagcagaagaactttactgaggtgattcaaaag

SEQ ID NO: 27876 - DNA, 1071 bp, Glycine max
  Peptide Sequence Number=SeqID_144654
atgtgcaaacacagttacaagtgtaaggaggctctcagcaagcagagaatggttattgagagccttcagagggagattgagttcaagaatcataagttaatggagatggagcacaaacatagtgagacacttacatctgtgcgcagacttattgtagggcttgtggagaatattaattgcaaagaaagaagtctgcttcaaatggaatgcaagcatagtgaatcattgaacatggttcagaagttgatgaatgagagagataaattgcaagaaagatgtcatcaagatttacaattgacgaaggtcacaaacgctaatatgaatcatgacatggaatgtctaaagaaagacgatgggcagattatcaaggaactggaggagagtaaagctctacatgatctacaacagaacttcattgaggagattgaaaagttgaaaacagagttaggagatcagagtcatgtaagaagtggtggggatttgaacactcaaatttctactttcagaaataaattaaaggacaaaatggaatatttggaccatgtagaaaccctttatagttctttagtagttaaagagaaccagtatagacaagaactacatgatgctcgtgaagaatctataaagagtttgcgaggtatgttcagaggtcgatctcaacttggaattaagagaatgggagaattagatccaaaaccttttcaacatttgtgcttgcaaaagtactcagatgaacaatggcaggagaaatctgctaagttatgttcagcatgggaggaaaatctgaaggatccaacttggcaccctttcaacaaaattgaggtcaatggcatattacaggaaacattagatgaaaatgatgaaaaattgaaagggctgagaagtgaatgcggtgaagctgtgtaccaggctgtaacaaatgcattaatggaaatagaagaatacaattcaagtggaagatatgcaattgctgaaatttggaactggaaggagggaagaaaagccactttgaaagaaattgttcaacatattattaggcaattgaatagtcacaagcgcaaaagaaagtag

SEQ ID NO: 27877 - DNA, 444 bp, Glycine max
  Peptide Sequence Number=SeqID_144655
atggagaaccatagttgtgaggagaatacgagcaagcaaagcatggcttttgtgagcctaaaggaggtggttgaaaaccagaaacagaaaattattgatgtggaggataataatcttttgaaagctgactgcaagagcgaactcaacaaatccttaaaaattgttatgaagatggttaagaaggaagctatgctggataaggaatgtcagaaagaactaaaacagattaaagttctgaactctaaaatgagtcgtgacattgaatgtattaagaaagagaacgagaagattacaaaggaacttgaagagagcaaagcactgcaaaaaaaatttacacagcaaaatgggctgatcatgaaggaattaggagaaagtagagcactcaatgatatgcaacataaaaatttcactgaagagattcgaaaggttagtaacaataagtaa

SEQ ID NO: 27878 - DNA, 588 bp, Glycine max
  Peptide Sequence Number=SeqID_144656
atgcaaattggctcccttcaggtggctctgaagctaaagaaagataataatgtttcagcattggataaagaactaaaggttgaaaatgaacgactcaatgccaaagtgattcagctggaaaaacaattagaaagcattcaagagctagaattggagaatcaacaacttaaagagaaattagatgtgatgaagcacatggaagatgaatttctgaatatggttggtgctttacatatgaatgtagtggaaaaggagcggtcacttagagactcagaagatttcaaccagtcactgatcattaaagagcgtgagatcaatgatgagcttcaaaaagctcgaaagacattgattaagggcattgcggagatatcaagtcttgatggcaatattgatgtgaaacaaatgggacaaatagacacagagccttttgttaaggctttgacagggaggagaagatataataaagaggaagcagagcaaatagctttggagacatgttcattatggcaaaaggatctgggagacccccattggtatccattcaaaatagtcacaattggtgggaaatcaaaggtgcaactttgttag

SEQ ID NO: 27879 - DNA, 1355 bp, Glycine max
  Peptide Sequence Number=SeqID_144657
gtctctgacggcggtcaacgccatcgacgcctggcaaagtgagctgaaagggcaggacgtcacgctaaacgccaaaaacggtgagataaagatacattccagcgagaaacctcactacttccgccctgacggttcgcgttggttgggcagccttgaggcttcacgcgatctgtctctcacggctggcagtaccattacgttgctgaatacgctgctggcgccgcaaagtcgcaatatcgccatgacggctaacggcagcattgcaatcgtaaaaaacagcgcgttgttggaggggtcgctattgggggggccggtttctccggctaaacggcaggaatacttcaaccagctgttggccagtggccaaatgagggcaacgggttcggttctgctcaatagcggtggctatctggcgctccgcggcgccaagattaatgcggataaggacgttacgctgttagccgcccataacgccgatcttaactaccgtgaacttgacggtcgattcaatgcgcttttccctgtgtcccgcacgcctgaactgggcagccgggtacacgccggcggcaatttgctgattaactcggcccgcgacatcggcacccagggcggcgcgctctccgctaacggcaatatcacgctgctggccgggcagaatctatggttgtcgaacctggcctattccgccattgatgccgccaacgacaacaacaaagacgaccgccatgtggtcacagccctcagcgcgggtaaaaacctgaccgcgtcggcgaataaccaactgctgacttacggcgccaggctgacctccggcgccaacatgacgctgacctccggcggcgatatgcgtttcgaggcggtgcaaaatcacacttaccgcgagggcggcaacgagttcaccgaaactcgcacccagcaaggcaccgagctgaatgccggcggcctgatgacggtgatttccggcggcagcattctgttccaggcgaccaaactggtggttaaaggattaggggcgaactggaaaccgtcggtggcggtgacggattgggggagtcggatagcggcggcggagcaggcggttagaaatgcagagcaaaatgttaatcaaaaacagaatgtactgaacaacgttagaaatacgcctgaaggtttgttactcgataatcctgctcagcatcctatttcatacaagcacagtagttctgtaatgataccgggtacggggacttatcacctcgatatggggaatattgaaataaaaacccgttcagatctggatagattgcttaatgagggagggaaggcatttgacccattcccttatggtgtcgatcctgcggaaacatccggtgatg

SEQ ID NO: 27880 - DNA, 378 bp, Glycine max
  Peptide Sequence Number=SeqID_144658
atgaagctcatggaagatgagcttctgaaaacggtgggtactttacatttgaaagcaatggaaaaggatgggtcacttaaagatgcagaagatttcagccaatcattaatcattatagagcgtgagaggaatgacgagcttcagaaagctcgaaagaaattaattatgggcattgcggagatatcaagtgatcttggtaatattggtgtgaagagaatgggcgaaatagacactgaaccattccttatgaaacgtgaaattattgatgatgaagatgaaacgtcgaagggattgaaagaagtaatgggtgttggagcgtataatgcagtggtgacagctttgaaagaaatgatgaagacaattataacttcattttga

SEQ ID NO: 27881 - DNA, 159 bp, Glycine max
  Peptide Sequence Number=SeqID_144659
atggaaggtgttcggaaggatttagcacttccaaatgtggtggacgattcaagcggcaaggatgactccagcaagcggcaatggcttcttatgacggaaaaaatagttattattgtgaaccttgagtcatgtgataagctcaaaatggatccaaaatag

SEQ ID NO: 27882 - DNA, 102 bp, Glycine max
  Peptide Sequence Number=SeqID_144660
atggagattgaagcttgcaaagggtggtggcgcacgatggaagatggtgacgacagtgaatggagaacttggtcggtgggttatgatgtggaaggcaagtag

SEQ ID NO: 27883 - DNA, 1041 bp, Glycine max
  Peptide Sequence Number=SeqID_144661
atgtggaatacaaacagaattacagatttacttggaattgaataccctatctggcagggacctttcggaggaggcttatctacagtagaactcacttcacgggtaagcaataagggtggattaggtggttttggagcatatacccttagtccgcaggaaatttatgaggtcgatcagaaaataagatctcaaacggctcaaccctataatcttaatctttgggtttccgatacagattttgtcagtgcggaagacaataaaaaaagctataaagaaactgtggaggcttttagaccttattttgaccgactgcaaatagatgttcccgctcttccatcctcttttgaatccaggtttcagaatcagctgcagacggttttggatattaagccaaaggttttcagctttatgtttgggttgctgaatccaactgttgtcgaagaatgccataaaagaggaattcttttggcgggaaacgcaacgacattggacgaagcgatagctctggagaatattggagtagatattattgttgcctcagggtttgaaagcggcggtcacagaccttcatttttggataaggctgaatattcaactacgggcacattcgttcttgtccagttgataaaagataggattaaaataccggtaattgctgccggtggaattgctactgggaccggaattgcagctgcgcttacattaggagcggaaggagtgcaaatcggaactgcatttctggcttgtgaggaatccggtgctttgcctgttcatagagaggctcttttttcagagtcgtcaaaaaacacgaggctgtcaagagcttataccggacgtttaggcagaggaataaccaatgaaattttacaggatctttcagaaaaacagattcctcacttgccttttccattacaaactacttttatgtcatctttgcgtaaggccgctctggaacaagggaaaaatgacatggtatttttctggggtggacagatcgcaccggttcttaagcataaaaagcgcatcggtattgatggatag

SEQ ID NO: 27884 - DNA, 810 bp, Glycine max
  Peptide Sequence Number=SeqID_144662
atgcctgcccgtcggattaaaaccggcagcgacccgcgtaagctgccggattattctgctctgcgtgaagagctgagcaaattgacccatccggcacggccagatatagactggttttacgttgaacaacactgcctttctctgttcgaacaaaacggagtggagttgcagaccgcggcctggtacacgcttgcccgcctgcagctggctggtttggtcggattgaatgaaggtctggcgctagtggaagcgctggtgagtcatcagtggagtgtgctgtggccgcaaccgatccacgcgcgcatggacattctcaccagcctgagccagcgcgtgcagcagcagatgcgcaccctttccctgaattatgacgatctgagtcagctttatcgtgctgaacaactgcttacccgtatcggaacagtgttacagcggctggagcttaaacaccttagccagcttgatacgttgcgtgctctaatgcacaacagtgccgccaggctggaaagccgtgacggtacgaccagcgacatcttgcccggcaccacgatagataacggggcgatatccgcacacccgcatgaaacgaaaactccgcatagcgccagatgggtgtatgtcgcgcagcagcaacatcagccaaagataaagtgccgggatgtttaccatgctgctaatcagcatggccgcggtgggcggctggcaatatctgcaccggcccgatccactgcaggctcagctggtggcatcgctggctcctgtgcccgccacactcacgtcacagcagcaggatgtgctgcggcagcggac

SEQ ID NO: 27885 - DNA, 1132 bp, Glycine max
  Peptide Sequence Number=SeqID_144663
gggcgcgggcgcgctcggtggcggcactgaaggcatcgccggtgccttgcagcgcgtaggcgcgggctacgtgccagcgcgtgcgcagcgcggggaagacgttgtcgccctgttccttcagcagggccagggcatgcgccggctgcttgtcggccagtgccagctcggcgccggtcagctggtagcgctgcaggctggtgccagacagctggcgggcggtgagctggccaagcaggctgcgcgcgcgggcactgtcgccggccaggtgccaggcccaggcggcatcggccagggcgttgctgcgggcgccacctttcagggttgcggccagcgcttccagctgcagggcggcgtcgcgcggtttgccttgttcgatcagcgccagcgcctggctctgggccggcgattcgggcgcgctggtcaggctggtggtggcacagccggccagcagcatcagcgacagcgacagggcggagatccgtgcggcgggcttgttcatgatcgggtccatgcgatgagggcagcggccttggccgggtacacgctacgattctacccttgccccgtgagtaccgctgaaatgagtgtcccaaccctgtacgtcgtcgccaccccgatcggcaacctggccgatctgagcccgcgcgcgcaggaggtgctgcgttcggtggcggccatctgtgccgaggacacccgccgcagcggccagttgctgtcccatttcggcatccagcagccgctggtggccctgcatgaacacaatgaagaggccctgtcgcagcgcctggtctcgcgcctgcaggccggtgagtcgctggcgctggtcagcgatgcgggcaccccgctggtcagtgaccccggtttccgcctggtgcgtgctgcgcgtgcggccggcatcaaggtcagcccgatcccgggcgcctgcgccgccatcgccgcgctgagcgtggccggcctgcccagcgaccgcttcagcttcgaaggtttcctgccggccaaggccagcggccgccgcgaccggctgcaggcgctggcgggtgaagtgcgcacgatggtgttctacgaatcctcgcaccgcatcgccgagtcgctggccgacatggcggcgatcttcggcggcgagcgcccggcg

SEQ ID NO: 27886 - DNA, 186 bp, Glycine max
  Peptide Sequence Number=SeqID_144664
atgggtgccaagtaccttgaagcggtcaagcaaaggttgcatgccatcaaacaatggttcccggacaaaattagggttccccctcttgtcctcctaataaaggctactctccagtcgatgtgcgaagtccaggagctcacattggccacatccaccctaacatgcctaagttccaaattttggtaa

SEQ ID NO: 27887 - DNA, 240 bp, Glycine max
  Peptide Sequence Number=SeqID_144665
atgccggaaaccaaaaggaagcattgttacgcaatccgtgagggggaggagagaagaagaaaagcgttcaaccctcctggtatcttaggatcacttgaaattagtgaaaaaaatcgtttccgtgaagaaaatcctagccgaggcgcttccgtaactcgtctgagacgtttcggtaagcaaatccgtgaagattttccgtcgtctttcgttcattcttcgttgttcttcgatcttcaaccg

SEQ ID NO: 27888 - DNA, 933 bp, Glycine max
  Peptide Sequence Number=SeqID_144666
atgggagtattcccttctatcgccaggcccgggcttcgtctgcaacacaccacaccaaagcaaaaagcccatgagatgtgtatctgcaccatgcttcgcaaccaggccggtttcatgaaagagtgggtaatgtaccacgccaaaatcggagtccaacgttggttcatttacgacaacaacagcgatgatgacatagaaaacgtgatttctttcctacaaagcgttggttacaacatctcccaacacctttggccttgggttaagacccaagaagctgggtttgcgcattgcgccctacaggcccgatcctcgtgcgattgggttgggttcatcgacgtggatgaattcttcaatgtgaaaattaaagggggcatgcacggtgtgatttggcaccatgcaaagcccggaagcaatgtgggtgaaattaggacaccgtgttacagttttgggccttcgggcctacgagaagtgccgaaggaaggggtggcagtggggtacacgtgtcgattggcagcacgtgagaggcacaagagcatagtgaggcctgaggcgctgaaccaaagtttaatcaatgtggtgcaccattttcatctaggtgcaccatttgtgaccgtggatgtggagaaaagtgagatgatgattaaccattacaagtaccaagtgtggaaagtgtttaaggagaagttctataggagggtggcgacatatgtggcggattggcaggaagagcaaaatgtggggtccagggatagggttcccggtttggggaccaaaccggtcgaaccggctgattgggctaaccggttttgtgaagttagggataacgggaagggaccaatcactagaaccatgagcaagaggctccaagaagattgggctagacctgctgaagaaggccctagggttctcatgaaccttagggtagatttctga

SEQ ID NO: 27889 - DNA, 414 bp, Glycine max
  Peptide Sequence Number=SeqID_144667
atggttgaaaagaagttgcttattacaatatttgctggtatccctctagttcagcagaggttgatatttgctggtaaacaacttgaggatggaagaacccttgctgattacaatattctgaacgagttcactctgcatttggtgttgaggcttcgtggaggtatgcaaatatttgtgaagactctgacagggaagaccattaccttggaggtggaaagctctgatactattgacaatgtgaaagctaagattcaggacaaggagggtatccctccagatcagcaaaggctcatttttgctgggaggcaattagaagatggtcgtaccttggcagattacaatattcagaaggaatccaccatgcatcttccacttcgccttcatggtggttggttgctaagcgagtcctcttaa

SEQ ID NO: 27890 - DNA, 1977 bp, Glycine max
  Peptide Sequence Number=SeqID_144668
atggtgttgaagaagagggtagattatggatttaatggctttcgagttcctgttatacctaaagctcctagatctgccagaaggagggttgctttcaacaaagcagttgaggatggtcaagtttgcgctattgaactactggcatctttagctggccaattgttgcaggagagtgaaagttctgcttccagcaatgcgtctgaaggaaatcatcagcctgccttcagccaaggtgtaattgagcaagatatacaagatgaagttaaaccattaaaaatggaggaaattcatcagggaaattgtgcagagagtacttttaagactgaggtagcctcacaaaaaagtagtcagaaacctctttcacataccaagactggacatgtttcagttaataatagttctgactgttgtgagaaagctgaagctgatgtgaagtctgaaattttcgaatgggataataaatttgggaattattctaatagattagtagaaacacgtgaaaaatttagggtgtccactcatggtaacataaagaatggatttaaatgggaacaggaggctggaagttcatgcattcggggatcaaatttagctgataagtgtagtttggaggatcacttagaattgtatgggaatggcattaagttaggttttagagatgatgacgaaaaatttttaaggtgcaaaagggtttgcactaaaccaaaggcttttaggtctccacgacgcattgcacaccgaagaatcaggaatttgatgtcttccaaatactggaagacagctccaaagttgaaggactgtgaactttctgatctaggagtacctcgttatcataagaggaaaacttgttacggttttgaaagatctcagcacaatgccattgttaaaaagaggaaattcgttgaccgggtttcaggggtaacttctgatggaggattcagtagtgagagtgtgtccaattcacctcagaaagggatggatgcagacaagcctagctcatctgcaaaattgcatgtacttaaggctaaggattctcatgtaaagtttagcataaagtctataaggataccagagctttatattgaggttcctgaaacttcaactgttggttcactaaagaggacaatcatggaggcagtgatggctatacttggaggtggtgcacatgttggtgttcttcttcaggggaaaaaagttagagatgacaatagaacacttgtgcagactggtatatcttgcaatgaaaatttggataccctgagtttcatgttggagcccacttcactacgagcttctccaactatttgtgttggtgatccttcttctcaatgtgaaacatcccagcctacatggcccacagaaactcctgtcttagattcaggagttactgataccttgcatgactcacccttgctgacatatccgggcaacctaattgaaagtaaccatgagcccacttcttcactcgccgacactacagttaacaaaataacacctgattccagagcaatagttgctgttccagctaccacagaaacattagctgtggttcctgtgagtcagaaaaccaagcgctctgagtttgtacagcgtcgaaccaggagaccattctctgtgactgaggtagaagcacttgttcacgcagttgaggaacttggaactgggaggtggcgtgatgttaagttgcgagcttttgagaatgcagaccataggacttatgtagacttaaaggataaatggaaaacattagtgcacactgcaacaatctccccccaacagaggaggggagaaccagtacctcaggagctcttggacagagttttggctgctcatgccttctggtctcagcaccaagccaagcaacatggcaagcatcaagctggaccaggaaccttgaagattacagaagcctcagctgaaagaccttgtaaatgtaaaaagaacatagaacatgacagcccaaaggaaagtccttga

SEQ ID NO: 27891 - DNA, 2034 bp, Glycine max
  Peptide Sequence Number=SeqID_144669
atggccaaaaatcttgttttttgctgcctagagtatagacctcggcatttcttcaaggtcctacagaatgaccattcctgggactatctcatagacagtgccatagtggtgccttgcaccaggcaatgccaagttaggtttgatagttcacaggctaagattctggactttggatttgaccggttgggtgctacaggatcagagattgatcatcctgtcctgatcacagaatgtgtatgcaacccagttcagtctcgtagtaaaatgggagaacttctttttgagacttatggagttccatctatagcctttggtgttgacgcggcattcagctataaatataatcaacagcaaggtgtttgtgataaagatggtcttgcaatgtgtcctggattcaatacaactcatgtgattccgtttgtagatggggagcctatttataaaggatgctgtcgcaccaatattggtggattccatgtgaccgattatttaaaacaacttctttcactcaaatatccttatcatatggctagatttacatgggaaaaggttgaagacctgaagatggaacattgttatattgccccagactatgcttctgaagctcggctgtttcagaaaggagctaaagaggccgaagaaaaaaccagatgttggcagctcccttgggttccacccccaactgaggagcctccttctgaggaagagattgcaagaaaggcagcaataaaagagagacaagggcaaagattacgagaaatggctgaggcaaagaggtcatctagaataaacgaattggaaaatgaattgcatggtttggaatttcttttaaaacagcttgaacaagttgaagacagtaatgttccgtctttcctagcagcaactggttatgtctctaggcaggagatagaatctgcccgcactaaagttacacaatccttacggaaagcaaaaggtgaaccaaagaacgagcaagctgaaactgataaggccagccctaatgctaatgaaaagtattctcttataaacatccctgatgacatgctcacaacagaccagctcattgaaaagaagaaacagttatcactgaaatccatgtctgaagggcggcagcgattaaaacagaagcgttatgaagaggaattggagcgagaaaggaaacaacagctagaggatgagaaacgcctagagaatccagagctttacttggaacaattgcatgctagatacaaagacctttcagagaaagttgaccaacgaaaacggctcaagacaaatggaggtcattctaatggaaataacttatccggtggcattggtcgtggtgagagactcaatgctgctcaaagggagagaatgcgcctcttgacaactgctgcctttgatcgcggcaagggtgaggatacatttggtgccaaagatgaagattggcaactttacaaattgatgggcaaagataatgatgatggtgatgaggaaccagatgaggatgatgcagagctagcccgcatctcttcaaggctactggacttggatccaacatttgtgcccaacaagtcagaaacaggtagctctcaacctgccgaggcaccacgtgcccgccctctcaccaaagaagattttcagattgtttttggtgttgaaaggttcaggtgccccgaaattttgttcaatccaaactggattgcggttgatcaggcagggttagatgagatggctggggtctcaataagaaggttatcatgtaaggatgaaagcctggaagagagactcactagctccatacttgtgactggtggaagttctcttttccccggcatcattgaacgccttgaagccggaattcggatgattcggccatgtggagcacccataaaagtagttagagcactggatcctgttatggatgcatggcgtggggctgcagcgttcgcatcagccccacaattccatacacaaactttcagtaggatggattatttcgaaaagggtgaagactggctccgcagttatcagattaaatactcattgtaa

SEQ ID NO: 27892 - DNA, 1473 bp, Glycine max
  Peptide Sequence Number=SeqID_144670
atggaggcgaagaaatcgggtttgaatctcccagctgggatgtccggaacctcactccggctggacactgcagcagcatcttccatctcgaccctcaattctccttcttctctccgttccatctctaatctcacctcgccttcgaaatccaactcggcttgcagcgacaggttcattccgtgccggtcctcctcgaggttgcacacgttcgggctcctggacaggccctcgccggtgaaggaagggagtaacgaggcttattccaggttgttgaaatcagaactctttggatctgactttgcttctccttctctttctctttcttcccctgcaggtgctgctcctccttcgccgctcagccccagcaagaacatgctccgcttcaagaccgaccactccgtcgcgccttcttcgccttattcgccgtccattttgggacagcagaatgcctttccttctgactcttctaccccgcctcccaaacctcccaggaaagttttggatgccccatcacttcaagatgacttttatttgaatctggtggactggtccacacaaaatgttcttgctgtggggctaggcacttgtgtgtatttatggagcgcttcaaacagcaaagtgactaagttatgtgacttggggccttatgatggtgtctgctctgtccagtggacccgggagggttcttttatatccattggtacaaatcttggtcaagttcaggtttgggatggaactcagtgtaagaaggtcagaaccatgggtgggcatcagacaaggactggtgttttggcatggaattctcgcattttggcttcagggagcagagataggaacatacttcagcatgacatgaggattccgggtgactttgttagcaagcttgttggccacaagtctgaggtatgtggattgaaatggtccagtgatgacagggaacttgcttctggtggtaatgataatcagctcctggtatggaatcaacactctcagcaaccagttttgagacttaccgagcacactgctgctgtgaaggccattgcttggtcacctcaccaaagcagtctccttgtgtccggaggtggaactgctgatagggtaacacgtggcattggtctcgtcagtaccaccagcgatttgagcttcatgggactcgccagtgggattggcgagttgagcagcactcccaatctgcggcacaactcgccagtagtcgccagtagagttggcaattcccagcctgctcaactcgccagtccaactggcgagtctcatggagctcaaatcgctggtggtactggcgagaccagtgccacatgtcacccccagtccgaactcgccaatgccttctgcgatttgcatggcttttacgtctgcaaccttgcttggagtaaaaatgtgaatgaactagtaagcactcatgggtactcccaaaatcagatcatggtgtggaaatatccatcattgtcaaag

SEQ ID NO: 27893 - DNA, 861 bp, Glycine max
  Peptide Sequence Number=SeqID_144671
atggagttcaaatatcgtgatggtcaaatccgaaggacaccatcaccattgcggagccctcttccttccaactcctatgtctccaatcgcccattacatgggtgtgactttgcatcaggtggctttcctagcaatgtttcagcgcctagagttttcccaatggtcatgccgatcaatgtcaacgaagtattccaacgagagttggagaaagagcaaatatggcgagagctagagaaggaaaaaatcaggagagaaatcattgctcgtgagatggcttttgcacaacgacgagagttggaagacgaagtgagaaaggaaatggaattagagagaacatctagaatgtcgatgcaaagatcagaggggattgcatttcgagaaccaatttcagagtctattaatcagagtcggttgaataacattaccatgtttggtgggctaccattccatttatcgtcccaagcttctaagcaaattcacacggataatatcctatttgataacaaagaagcttctaatagcaaggataaagtgattatattgaataagccagatgatcattgtggagaaaagcgcaaagcaattacacttgcaattgatgacaatgagagtctacggaagaaagccaagaaggagtggacttgcgagttgtgtcaaatttctacaacaagtgagaaaggcttgaatgatcatattcaagggaaaaaacataaggctaacaaagaatccactagaactcaaaaaatatggctccattcaggaccagagagtgaaacacttcattcttgtttcacacccgcagacacatgcaatctggaatctgagaaaagggccaagttgtccaaaacagcaaagggttag

SEQ ID NO: 27894 - DNA, 192 bp, Glycine max
  Peptide Sequence Number=SeqID_144672
atgaacaaggtgcttgaatttggagccttattagcatcaggaggacagtgtactctctatgcatacaaacacaaacacacggattatcagttgttgctgatatttcgagattttaacatagcattcactttatgtccagaatatcacccacttaatttgctcaccataacagttccaaacacagtttattaa

SEQ ID NO: 27895 - DNA, 609 bp, Glycine max
  Peptide Sequence Number=SeqID_144673
atggagttcaaatattgtgattgtcaaaaccaaagaacatcatcaccaacaccacgcccttttcccacattgacatacaagaattcagatatctccaaacgctcgtcacaagatatgagttttcccaacgttggtgtctgtcaataccaaccaagcattacaccgagaatcagagaaaatgcagatacagtgggagttgaagaaagaagagatcggagagagataatcgccaatgagatgatatggcggcgagggctgaaggagaaagtgttgggaatctcgatgcaaggactggggatgttctcgtttggtgaaccgatttcgatgtctttcaatccaagaatgaactcgattaatcacgttaacaatgctgacaaggataccagacaattttctacactgactaacaaagataaaataatcatactggaaatcaaagtgcaccggagagaagttcctattgagaaaggtacaagtcttcctatggagaaaggtttcaagatcctgttgtttcctatcattgatagtctaggaaaccccttaagaattttttacatgtggtatcagagcatgtgttatgaaatttatgattctccaagaatgatttaa

SEQ ID NO: 27896 - DNA, 291 bp, Glycine max
  Peptide Sequence Number=SeqID_144674
atgccgccagaagaactgacgttgttggagggtgccgccagtcacacaagctcagcatgtcccgcttgtgccactagcgacaccctctatgacacttctgtaacaggttcaactttggccttatactgccaaaggagatttctgccgcgcgcggtccaaatgggactatgggaggctttcgacattagcctcagagatagtctcatctctagaatcccaagttcggagactgagaggataatccattgccccacaatcatagaaaaatctgtgcttgccttttcatattaa

SEQ ID NO: 27897 - DNA, 153 bp, Glycine max
  Peptide Sequence Number=SeqID_144675
atgggcttcaatgttcatgtcgaaagactccgaagagagaggaggagctgccccaaggctcaacaactcttcttgtcccctccccagctctacctaaccatgaacctaaggttagacacatggtgcgctactcagtatgtcaccatgttctaa

SEQ ID NO: 27898 - DNA, 143 bp, Glycine max
  Peptide Sequence Number=SeqID_144676
ctggtgagagaaggcaaattgctatggtaacggtaggagtcgaaactcgaagaagaaggagaagaaagggttgggagcagttatgtgcccttaggcatgagaatgttcttcgtagccaatcacaatccgcaacagtgaagtaa

SEQ ID NO: 27899 - DNA, 243 bp, Glycine max
  Peptide Sequence Number=SeqID_144677
atgaattatgaatcgtcagattttcatcagacggttcttatcatccaactgggtaaatgtgtgacttctccgactacaaggaatccaggtccatttgaatcatgtgaacgaattaatgctaagagaatggagcaaccatgggaggtgatttacgtgtttatgagaatgggaataggccattgtacaagctgggtagcctctgcgtcagttctggctggctggctggctgccacatcagtgtga

SEQ ID NO: 27900 - DNA, 501 bp, Glycine max
  Peptide Sequence Number=SeqID_144678
atggacaaattgcttttcttaggaacacatattcgttaccacaaaaaggataatggtcatcgaaaggatctcgaagacccaccaacgcacgaaagccgggatctttcagaaaatggattccctattcgaagggtgcataaccgcatggataagctcacactaacccgtcaatttgggatccaattcggttccttaggaggtatcgggaaggaattttggaatagtggcagtaagggtgacttatctgtcaacttttccactattacacccaaaaaaccaaactctgctttacgtaaagttgccagagtacgcttaacctctggatttgaaattactgcttatatacccggtattggccataatttacaagaacattctgtagtcttagtaagaggggggagggttacagatttacccggtgtgagatatcacattgttcgaggaaccctagatgctgtcggagtaaaggatcgtcaacaagggcgttctagtgcgttgtag

SEQ ID NO: 27901 - DNA, 726 bp, Glycine max
  Peptide Sequence Number=SeqID_144679
atgactagaaggttgcttgccagttcattggctcttgaaagccacatcctccattatctaattgcccgtatcttactccccagatcttcaaaccttgcacaggtttatgaagaagatctaatagtcatgtgggcctttcataccggccgacaaattgattgggcacatgtagttcggtatcacatgcataaggcattgcgattaaatgctcctttgccctatcctcagttagttaccttgttccttcaacattttaacatccctcttgattttgaaccgtatgttctaatcaagaaatctttcttgatcggtgttgttgtggttgcctcctttggttaccgcaaagagcgtcgtgatgactcttgggtaaaaaagggtgctcaaccaaatgatgatgaaggacacttaccggttgaaggggactcttttcttcttcagggtattttggacaggtttgatggacttaaaacctatgctggtgagaggattgtcatcatcaaaaagggggagattgtggaagcaatgacttccaagattattttgacgatgccaaagaatcaagagtttagcaagtttcaaagaatcaagattcaagaacaatcaagtttcaagattcaatcaagtttcaagaatcaagattcaagaacaatcaagatcaagattcaagaatcaagagaagactcaatcaagataagtactaaaaaagtttttcaaaacattgagtag

SEQ ID NO: 27902 - DNA, 252 bp, Glycine max
  Peptide Sequence Number=SeqID_144680
atggaagagaaagtaaagcggaaaattaatggaggtttaaggagcacctacttgaagctcttgtgctctgataccactggatggaagcttgctttagaagcttctatggaggctggatctttgagcttcaataagcctagcacatgggaagcttccttgagaagcaaggaaggtagattccttgggaagctagaggaagaaagcttccttgagaagctagaggggggctactcacactcgtccaatagctaa

SEQ ID NO: 27903 - DNA, 180 bp, Glycine max
  Peptide Sequence Number=SeqID_144681
atggagaaagatgcatcacacgtaggaccacagaatggaggcttcaatcccttctccttctctctaacgtttggaaaccctaacagagcaaccggaggaggagttctagagagcactaaaaatgccacaattgataacagagaacgcttgagtgactacatcgagttgatgtcccaatga

SEQ ID NO: 27904 - DNA, 828 bp, Glycine max
  Peptide Sequence Number=SeqID_144682
atggctatacctgtttacttatggctcgaggatgattcaggccgtaaaattaaaggctctgtcgatatacaagatcgcgaaggttcaatagaggttattgaatttatgcactctagagaacaaccaatagataaactcactgggaaaaccacagcaaaacgcatttgtaggctgcatcattgctcctttaagtgccagaaggagtatctggaaaagcaacgatacggtactgattgtcaaatgaagcgtttattttatttactgccattactcgttgcagtcagtacgcatgtcttcgcaactgaaatgaccggctttgcaacccagtattacgacgaagacggctcgctggcagaaatttcaacaacattgcccctctctcccgccattaccatcggcaataaaaccgtgctgatggaggttactcatttgtcagacatctccagcactccagttaacaaaggcggttccgcacgctgggtctgccttcatgacgacgatggaacgaattactggttcatttcagataacgaaatgggagcaggattgctaactgcgctagctatagcccaggatggcatccataaagagtgtgcgaaaacaacggagcatgtcagcgtctcagtcgctaatgttccattgttaaatgcgacgcatgggaacttagtcgaattgctcggcaagaaagagatcgccaaaaacaccgcgatgcttttttatcaggagacaccagtacagaatggattcatcaggagtaataccgtctcttattactttgacggcgaaaaagtacgtggcgtcatcatcgggcaaattaccagtaactag

SEQ ID NO: 27905 - DNA, 372 bp, Glycine max
  Peptide Sequence Number=SeqID_144683
atggggctgaccagctataaaggcgaagaagtccgtaaaagcgatgtcaccactgcaaaaaattatctgtctcaggatgaggtcagcgagcttaatcgcgtcgttaatatgtggctcgactttgctgaagatcaggccaaacgccgtaagcaggtatttttacgagactggcaaactaaactcgatcagttcctgcaatttaacgaccgggacgttttagaaggcgcaggcaaaatcagcaagaaagtggctgatgaaaaggcctgctcagaatacgttgagtttgaaaaaaagcagcgcctgctgaaagaagccgaaggtgagaaagatattatcggcttattaaaatgggataagcaggctaagcgataa

SEQ ID NO: 27906 - DNA, 961 bp, Glycine max
  Peptide Sequence Number=SeqID_144684
atggcactggggccgacgatacaatggcaggggatagattgccacattgcggcagaatactttgcaacatccgcggatgtttatcgcgtactcggtgaattatcgcctgcatatgacctggcagataccgcagatgggcaagggcgatcaatatcggacagtatgcggcgtctggcgcgtatggttggccatgattttactaatgcggatgcgtctgtctggcgatcgttggcgagtgcatttaaaacgtcacagttggcatcgctaatgcatgcgattcaggccgggcttgcacgagcaggtaagcaacccgtttgcctgttgggtttaggggctggcagctttctggctgaatcattggcacagtgtctgcatatgccttatcaagctgcctcggctcgcgaggttatggcaagcatggcattgatcgtactagatttaccttatgcggaaggtatgcactggcttaggcaggtgaatcacctgtcgtggccgatgctgcttgaaagcggacgggtagagggatcaaaagaaaacacaattgaagacgaagaaaccgggttaggtgcccgctttgatattgtagtcgcggctcctgtcgccaaaattacccatcgtcgaccatatactcaagtctcggtgaatgactcggtacagcagtcccagcaagatccttttgctgagatccagcaatggttgtcaccgcaccacgtggagcgtgttgccgatattccatttgctggcggcgcgctaggctactttgcttatgatcttgggcgcagtatagagcgattgcccgagctggcgctcgaagatatgcctgtgcctgaactgctggttggcatttatgactgggcgattgttgtcgatcatcatctcgccagtaccaagctggtttcacatctgcggtttggaactcacaaggcattggaagcattacaccaagccttattacagactc

SEQ ID NO: 27907 - DNA, 859 bp, Glycine max
  Peptide Sequence Number=SeqID_144685
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatgcgacgcactcgtcgagcgcatcaagcccctggccaagaaaaccatgcgcgaaggcgtgctggcaggcattggcggctttggcgccctgtttgaagtgcccaagcgctacaaggaacccgtgctggtgagcggcactgacggcgtgggcaccaagctcaagctggcgtttgaatggaacatgcacgacaccgtgggcatcgacctggtggccatgagcgtgaacgatgtgctggtgcaaggcgccgagcccctgttcttcctcgactacttcgcctgcggcaagctggacgtagacaccgccgccgccgtggtgggcggcattgccaaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 27908 - DNA, 390 bp, Glycine max
  Peptide Sequence Number=SeqID_144686
atggcagctcaagtagcacccccaatgatggagagggagttgataacgatgatagtagacatgttaccggtgtcctactatgagaagatgcctggggcaaatggagagaaggagaaggaggaaggaacccatgttgtggctgccattcctacatggccaaattttccacctgctcaacaatgtcattactcagccaatgtcaggccttctcattacccaccacccaatcatccacaaaggtcacccctaaatcagccacaaaggctgcttgtcgcacatccaatgtcaaacaccacccgtaacatgaaccaaaacaccaaccaaggagggaaatttccagcgaaagagcctgtagaattcaccccaattccggtttcatatgttgaatag

SEQ ID NO: 27909 - DNA, 258 bp, Glycine max
  Peptide Sequence Number=SeqID_144687
atgtggaaggccacgctgcagctcaagaaaacatatctagactcttaccatcactcaatccatccttggtgccccctatccattgtgattgaccctggaattggtgataaatacgtggttgaaccatggtatcaattccttgaagagagcgatttcagccatgacgatgaaatttccttctactatagacgcatcgaaaagatttgggagattgtcatcagacgtcaaaaagattgggacgacagtgacacaaaataa

SEQ ID NO: 27910 - DNA, 369 bp, Glycine max
  Peptide Sequence Number=SeqID_144688
atgactccgaaaaagctttccgcaaagagatctaggagggacgccgcggttgaagggaccagtgctgcccctgagtttgatagccaccgtttcaggagcgccgagtaccagcagcgcttcgaagccatcaaaggatggtcgttccaccgagagagacgtgtccagctcagggacaatgagtacaccgattttcaggaagagatagctcgccgacattggacgtcgctggtcactcccatggctaaggttgacctagatatagtcctagagttttatgctaatgcttggcccacagaggagggagtgcgggacatgcggtcatgggtgaggggtcagtggattccctatgacgcagatgccctcagctag

SEQ ID NO: 27911 - DNA, 333 bp, Glycine max
  Peptide Sequence Number=SeqID_144689
ggcctggggtttccggcattgatcacgggcctctgccagtcattcggggttcccgtcactccaagtaaggccgcagacgcaccgccaccacctcatcaggctgatcctgctgggtcattaggcatggagccttatctacaacacttgattcgccagcaggcggccaaccaccgggggcaggtgcaggtacatgagtgtctctaccagcttagcctcagtcagcagggccaaggggaggcgcctacaaaagctcccggcgatgcagaggaggcccgcatggatgaggagatgacggacttgctcggtttcttgggaggaagcggagctacgtga

SEQ ID NO: 27912 - DNA, 282 bp, Glycine max
  Peptide Sequence Number=SeqID_144690
atgcatgctttgttagggtcattcaacagtgggaactggtctgattctaaagcccttggtagtacgggactaagttgttgtgctatcacgagggatcgggtgcacttgccgggcgtgaacacctttgctaaaggcttggagagcatcatctatcacatgatcattttgtctaaccatcactcactatgcatactaggaagtgagaacatggaaggaatacacagaagaaaaagaatagaacaatatcatatctatctcaagttcccactaagttcttcttga

SEQ ID NO: 27913 - DNA, 888 bp, Glycine max
  Peptide Sequence Number=SeqID_144691
atggtaacaagaagattttctggacaactgaaaggatggtgggataattatctcactaatgaggagaaatcaaaaatttacagcgcagtcaaaacagatctcaacggaaaagtcattactaatgacgatgataaagagattcctgacgctgttaataccttaatctttacaatagctcaacattttattggagacccatccttatggaaagataggtcagcagaattattatcaaaccttaagtgtagaaccttagcagattttaggtggtatagagatactttcctaactagggtttacaccagagaagatagccaacaaccattctggaaagaaaaatttctagctggttttcccagatcattaggagacaaagttagggataaaattcgaagtcaatctgccaatggagacattccatatgaaaacttaagctacggtcaactaatttcctatgtccaaaaggtagccttaaaaatctgccaagatgacaaaatccagaggcaattagccaaagaaaaagcccagacgaagagggatttaggttccttctgtgaacaatttggcttaccagcctgcccaaaacaaaagaagaaacaaacttctaggaaagaaatccaggatcataaaccagccaatagaagaagattttcaaaaagaagatacactcaaaaaccctcaactaaaacttcagaagaagaaacaaaaacttcatcctccgcactttcagatgaagatctaaatttaatccaacaagatgaccaattatcatcaacggatgatgaggataggcaaatcaatactctaacaagagaacaagacctcttgtttgaagcaatcaattccatccctcccccaggaaaagaaggtttttctggaaaaacttaa

SEQ ID NO: 27914 - DNA, 297 bp, Glycine max
  Peptide Sequence Number=SeqID_144692
atggataaagttgatatctttgtccctcatcctctcacaaacgcatgtttgcttattcaactttcaccggaatgtgggtgcaagccattggtctgtttgctcaagcgacctgcgctcctgggtgttgacttccaagactgttcaatcagagattactcgtcttgcacgttggtggggagaagtgagttatcaaggataggatgttggataaatggcctcagttatcttgagaaagggggggttgaattaagatacgaagactatttcccaattaaactttcactctctccggattaa

SEQ ID NO: 27915 - DNA, 522 bp, Glycine max
  Peptide Sequence Number=SeqID_144693
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaagggaagtcggcaaaattggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 27916 - DNA, 1238 bp, Glycine max
  Peptide Sequence Number=SeqID_144694
gcaatcctggccaagcaactctgcctcatcaaaggaagaagtccatcacatcagccatgtcatcatcaccctatgctccatctccatctccgggggtccttgcgggtcctgcccctgccaagggaaagggttggggtcttggctctactgatgcaaggtgtaccggtagaagctctctatcagctgaaccaaacccctatgattatccgtctgctagtcggttacatgttgcatatatgcatgcatttggagctccatccgcggaggtggctgttgtagaggtggtagcggtccatccgcggctggctgctgcggatcctcctcttgctactattgtgcctgaccctcctgttaactggcagaggcccgtgatcaaagccagaaaccccagggctctgttggacttctccgggtccactgggtgtcaaggaggccacatgaacactcacctgggtcaagatggcatagaccagctggcacttgagtatggggaggtcggaatctgtgtcagggtggtcatgctagtgggcatgatccgcacccatctccctgccacgcttcgggcaaagtcctaccctggaactctgttcgtgtgtgactgggcgcgcttagcgcaagaagagacaacgacctcgctgggcgggctagctgcacattgggccagcacatctctgactgatcctcttctagggtttcccaacccgctaatgctgggtcatcctgaggtgtggaaggggcctcctgagctggcgttggaatatcctgagctgatgtgggacaagtgtcccagcgccgtctccctccttagtggcctccaaaggcgtgaagtaggcgcaacctctggagtctcctccagtgtgtcttcaggtgtcgcctctggctccggctatggctcctggggtgtaggagcctcatcttccccgataggagaaggctggactcctggtcaggccacttgggccatgaaatcctccatgctgatgatgggccgatgtgcaggaacaaaagttggtggtggtgctagtgtagaaatagaagctggagcagtagcaggggtgtcagaagtggaagcatcagagggtccccgagccctagtcttgcgggtccccggaaaggtgatcgtgggatcattcagggactcgaaagtcaatgaatctgggactactcctctgtcgatgcataaggcggtaatcagtgcagggaagccaagcctggaggagttggaatgggtcatctga

SEQ ID NO: 27917 - DNA, 207 bp, Glycine max
  Peptide Sequence Number=SeqID_144695
atggcattgcaagaattgcctatggtcacttggcatcgatgtagagggatttgtgagaccacggtttactattggaaaaaccggtgcagaattttgatatgcgatcatatccccacggtgtggaaattcataggattgttagcaattgcgacacttcttgttctcatcattgtgcagaccttttattcatcccacaatagtagttga

SEQ ID NO: 27918 - DNA, 690 bp, Glycine max
  Peptide Sequence Number=SeqID_144696
atgtcttctaagcttagtcatttgggtccgttcgatttaataaaaaaaattgaatggaccatacttgatgatggcaaccggattgagaggttgcacctaccatcactgttcttccctcctccttccccctctacctgtggtcgaagaggttacgaaatctcgccgaggctcgtcggaatctcgccagaggccaacactaccagcactgccaccataggaggcggtagtgctttttctatcaaagagcatcaagtcaagcctctgatcccaagattccaggaacagcggcggcgaagaggatttcctcctagaacagcgaagaaggtcgagtctacggtactgttttttgatgagatcgaggtcctagcacgtgcgatcaacctggagaatagcgtaccaatcgaggtggtcgttggtgattggcttctcagcagcgaggaggacgtcgaagatggccaggatctagttggagcctttgaggagcatttacggattgtggcgaagattgcagcggcggcgtgggctgaggttttgtgtggcgaaggtcaaggacttcaagatccggttgtagggtgcggcgaaggggaggaagaggaggctggcggtcacgacgaagggtcggaggtcactttctcgacgaagacaacggaaggggagggccgataccccaaacagatctccaccgtttga

SEQ ID NO: 27919 - DNA, 105 bp, Glycine max
  Peptide Sequence Number=SeqID_144697
atggagtttcatgccaccaattcgatcatcacgattattcccaattttgatcctagagaaacatgggtcgtgctatcagtagcactaccgtgctcaaatgcgtga

SEQ ID NO: 27920 - DNA, 306 bp, Glycine max
  Peptide Sequence Number=SeqID_144698
atgggattcaatcttcgttctcttctcgatcgagttccacgctgggccaacatcaacaacaatctccctcgcaaactgttcgactcggccgagttcagcctcaggctccgactcaccgcaccatcttctgcaacgatcgcgaggccaatattcccatccgattcaagtaccattgcgtcgcgactcacggctatgagctgctccattgaagctattgcagtgcagctctttgttgcacctgaagcggggcaaattgtggtgcggccacatttgtggatattcatggcattagatggcacaacttag

SEQ ID NO: 27921 - DNA, 276 bp, Glycine max
  Peptide Sequence Number=SeqID_144699
atgttccctccccttgagccttgttcagtggccattctacggttgagtaggcagaggcttaagagtagaagaaacaaagaaaagcacaaccacaacatttgccagagagggtcatcagtaaagtggggcatgccgatgttcggtggcgtcaagaagtggtgcgcattgcctttgagcttgatacaatgtttggttgtgcattgtgcgcccatcttctgccatggccatggacgacataaccgcaacacaaatagcgtctgccttggcacgccatga

SEQ ID NO: 27922 - DNA, 888 bp, Glycine max
  Peptide Sequence Number=SeqID_144700
atgattgtcttaccttcttcctcccgctatgcgcaatcaatggttgccattgtggttatcatttttttgctattccaacagccttcctctgctaagcatcacccgtcctgtcctccttcctcatgcggcaaaattcgcaacataacttatccatttcgactgaaaggcgatccacgcggttgcggcctctcagggtatgagttagattgcgtgaataacgtaacagtgttaactctgttttcagggaaataccacgtgcaggaaatcaattacaagaaatatcagatccgactcactgatgttggtattgtggaggacgcttgctccgttcctcgctatttcttatacgaacaaaattttagttctttcgaaattccttactatagtacaccagatgcgctaacttttggtgatatggagatagcaaggtttgggtatccaagcatagggttcttaaactgtagtaatgcagtgactaatgaccctcgatatgtggaaatggatacccatcgttgcgattccggagggcatatttatgccattctgatgtgtgacttaattggctttaatctgatggacatcaaggttgggtgtcatcttaaggttgccacctttgcaaacttgttcaaatcaatcaaaaagattgatgatgattactatggtgcagaatatgttgattacataaacgcttcctctgctgatatccgcaagtggctgaacggtggattttggctgtcttggttggcaccggttatttgtaggaagcaatgtggaaaggacatcaaatgctttctcaacgaaaccgcacaagttcaatgcgatcggcatcgttactgccattacgtcacaactaccagtaccaactgtgaatcggtagagttgtcatga

SEQ ID NO: 27923 - DNA, 324 bp, Glycine max
  Peptide Sequence Number=SeqID_144701
atgaggaccattgttgaaacggaacggcaaagtccttttcccaccccctcaaccaagaccaggaaaaacaacagccaagtaagccaaatagccaagccaggagaaggtggcattggcaaacaagagcagggggctggatccaaccagagacaactaaaggtggcacaaaggataaaaagtgacagcttgtgctcccagaccacgcgaaagactaaatatacagaaccactaactagagtgtcctgttctagagatttgataccttgtttgaaagaaattgtagggattagagaaaagatgagggaagaagacaataaactctga

SEQ ID NO: 27924 - DNA, 372 bp, Glycine max
  Peptide Sequence Number=SeqID_144702
atgaagcttctcaatcgcccaatgcctccaacacttttgagattttcttccatctacatcaaccatgacctcaactccgctggtcgtgcttgggaaaaccgcatcaacgtcgacgacatgatgtacacaagtattgagattctagagcgagatcgtggtggcgaggaacatcgacaacgtctgaaacaaagtcacaatcggacttggcaccaacacactatattggacgacaaagggtataatgacgatcggacaagtatgccctcatcgtctaagtggttcaagacatctctccttcaaggagacaacggggattcaacttccactagggtaggatgctacgaaagaagattgatcatgaattttcaataa

SEQ ID NO: 27925 - DNA, 291 bp, Glycine max
  Peptide Sequence Number=SeqID_144703
atgttgagtacatcagggcgtttgcgagctcgatatagcttgcaaagagagtgggtatggtcatgcatcgtaacgcaaactgcatgttacacctgccatactcgagttcacgtagtgccagctgatagaccagatatagcgtgcatcgagtacacccagtggaggttacagaggaccaaggtgaccattttgacatgtcatctaggagatggaagagtaccgggaactaatcaggcatttggaactgacgtctgggaggagagtgaagattctcccgaggacacatcttag

SEQ ID NO: 27926 - DNA, 330 bp, Glycine max
  Peptide Sequence Number=SeqID_144704
atggctatttatagaaaagagccaagaggtgctgagaaattcgcccaggcaagttgtagctcgccaaggagaatttgtgacttagtgctgaaggcactaattcacccaacccaggcgagctggatgctagcctgggcgagtggatgtttgaaatcttggaaaaatgaccatttttcccttccttttgactttatttatggatctaacaaacaaccatcaaaacctacaaaatcatgggatagaagactccaagaagattgggccaaagatgcaagagaaggccctagggttctcatgagccttagggtagatttcgagcccatgggctaa

SEQ ID NO: 27927 - DNA, 510 bp, Glycine max
  Peptide Sequence Number=SeqID_144705
atggactttctagtatcccctttccaagctagtttcattctaggaaggcaaagtgctaatattgtagtgatttcccaagagatttttcatttaatgaggaagctaaaagagagattatcacatctcattcatatggaagtctatattcacaattggaagcatgttccactttttagagtgggcctcagatctcgcatcctttctttgcaaacaatttgttgctctttgatgaggcttcttgtgatcaatgaattgtttcctcagatctcgcatccttttcttgggatggacattatgctagagggtggccacaagggtgcatatggtggcattcttagagacaagaatgggtgttggataggaggtttctccaaaaattttggcgcttgcagtgttttgtttgtaagacatagtgttattctcttgaccttggagttagcttggcaaaaagggatttcaaaacttcatatgaagggtgaatgtgagattagtttccatcttataaaataa

SEQ ID NO: 27928 - DNA, 726 bp, Glycine max
  Peptide Sequence Number=SeqID_144706
atgaagaagaaaggaaagttcatgcattcctctagacaaaaagatacaatattcaaaaataaacacaagggggaaagtaatgagatcatctgtttgaaatgcaaaaagcctggacatatgaaggtggagtgtcctcagttaaaaagaaagatacactctggtgataagaaaaagaaaagtctgatggtcacttgggatgactcatacagtgagaagagtaggagttcagatgatgagcaaaccaacatctgcttgatggtagatactgatgataaagttgagatatcctgggtaggaaaaggccagggtttaagttggtacttagacaatggttgctcacgacacatgacgagggaaatatctatgttcctcgacccaaagccaattgaaggaggaattgttgcctttggaggcatgagtaagggaaaaataactggtatagatcaagttgcaaagtttgattcaaaggtggataaaggtatcttcctaggatattctgacacatctaaagctttcaaagtgtttaactctagaactatagtcatggaagaatttatccatgttaagttcaatgatggtctaataactgatgagaaactatcaaaccttgaggatgattttgcaaatatgcagattggtccatttgttgcacccaagatagacaaagtaaaacagtctgacgaaactcctcctcagtctagagaatcatcaagtcaacaactttag

SEQ ID NO: 27929 - DNA, 1998 bp, Glycine max
  Peptide Sequence Number=SeqID_144707
atgaagagggtaaagaagctatacccattgttgtcgctcctacccaacaggcctaaacctcttcaaattttcatggctgtgatgttcctctacttgctcttcaccaccttcgaaatcgaaacttttcttggtttcagaactaggtttgtgtcagtgacttcattgctggggaatgaagaccaacagcaacagcaacatacccatttcagcaaagcctcaaactttccctcacaaggagtgttccaaggttcggttcatcgaaaagccttgcaggggttgcagaaagtttccaccttgagtttcatggaggctttgaacgacaccactgtggaagaaaatatggtttctgaactccacaatgctgctaggcatgcttggcttgaagggaagaggctctgggaacaagttgagagtgtgaaagaaaccatggatgatgtggcaaggttcaaggctgagaacctttctgattcgtgcaagaattcgatttcattatctgggtctgaattgaaggagaagaaaggggtaatggtgatggtgcttccttgtggtttgacattggggtctcatgtgactgttgtggggaccccacgttgggctcactgggaggatgatcctaagatagctgtggtgaaggaagaggaggggaaggtgatggtgtcacagttcatgatggagcttcagggtttgaagagtgtggacaaggaagagcctcctaggatactgcatttcaatcccaggttgaagggggactatagtgggaggcctgtgattgagcagaacacttgttacaggatgcagtgggggtctgctctaaggtgtgagggatggaagtcccgggccgacgaggataccgttgatggacaggtgaaatgtgaaaagtggattcgtgatgacgatagccacacagaagaggcaaaggcaacatggtggttaagtagactgatagggcgaactaagaaggtgactatagattggccatacccttttgtagaggggagattatttgttctcaccgtgagtgctggcatggaaggttaccatgttagcgtggatggaaggcatgtgacgtcttttccctatcgcacgggcttttctcttgaggatgcgactggtctatccataaaaggagatgtttatgtgcactctatatttgcagcttccttaccctcatcacatccaagttttgctccacagatgcatcttgaattacttcctcaatggaaagttccacctcttctccatgtgaatgtggagcttttcattggaatactttctgctggcaaccattttgctgaacggatggcagtaaggaaatcatggatgcaacataaactaattaaatcttcaaatgtcgtggctcgattctttgttgccttgcatggaaggaaagatttaaatgtggagataaagaaagaaacagattattttggcgatattattatagtcccctacatggatcattatgaccttgttgtgttgaagacgatagctatcactgaatatgggattcgctcagtggctgccaagtatatcatgaagtgcgatgatgacacatttgtcagaatagattctatcatcagcgaagcaagaaaagtaggaagtggtagaagtctctatcttggcaatatgaattaccaccataggccactacgttctggcaaatgggcagtaacatatgaggaatggtcagaggaagagtatcctacctatgctaatggtccaggctatataatctctgcagacattgcccggttcattgtatccaacttcgagaagcacagattaaaattatttaaaatggaggatgtgagcatgggaatgtgggtagagcaattcaacagttcaaggccagttgagtatgtgcacagcttcaagttctgccaatttgggtgcattgaagattacttcactgcacattaccaatctccaagacaaatgacctgtatgtgggataagttgcaacaaaagggacaacccctatgttgcaacatgagataa

SEQ ID NO: 27930 - DNA, 1605 bp, Glycine max
  Peptide Sequence Number=SeqID_144708
atggattatgattatcagctgctacatgtagttgcactgttgacactgatagcctttggaggcacaagttggactatagaagcttgcagccccaacgaattggaagctttgatgagcttcaagaatggaatacaaaaggacacgtctggtcgcgtagctaagtggattggtcagagctgctgcgattgggaaggaattgtgtgtgaaaatgcaacctctagagtgacacagatcaacctcccaggtttcatttccacagatacagatttatttcaaacacaaatgaaagggttgatttctccttctataacacttctcacctttcttgaaatcattgatcttggtggcttagttggtcttagtggaacaattccacaaaccattggtttgcacctgccaaagctacaaaagctctacctttatggcaacaatttaactggtccaataccagaaagcattggagagttgccaaacctccaagaactggctctgcaggaaaataggctatccgggttgatccccgtgagccttggaagcctaaagagtctcaaaaggttgctgctttattcaaatcagttttcaggtacaataccagactcacttgggaatttgatgaatttggtagaattggatgttcatgacaatgctcttattggtaatattccaaatagtgttggtgagatgcaggctttggaaaagcttgatctttcaaacaatttgttaagcgggaagataccttcttcattaaccaatttaactgtcatttctgtcttgtacctgaacaccaattatcttgagggaaccgtaccatttccttcaagatctggtgaaatgtcttctctgggcttcttaagactacacaataatctccttgttggaaatataccttccaatattggctatttggtatctcttcaaagagtttcattatcaaacaacaaacttgaaggggcactgccatctagtttaggcaatttggtagcactgactgagttatatctcagtggcccgttaccccaagagatgtcttcccttcaaaatcttcaaacacttgatctttctttcaaccatctgaatctctctgccattccaaaatggatagaaaacatgtcttcactttccaacatttactttgctggctgtggaatacagggccaaattccagattttttccaaagaaccaatagtccaatacaggaactggacttgtcagtgaactttctcagtggaaacataccatcatggataggaagcctcaatcaactctacaagttaaatctctcaaggaactctctttattcagacatccctgactcctttagaaatttgcaagatttagggatccttgatcttcactcaaataggctagcaggcaccatagcttcagcatttgacatacaacagggtgttttggggggatcattgaaatttgttgatctttctgctaacaacttctcaagtggaattgaggaaattggtggagggcaatgtggtattcagtttctgaatttgtctcataaccttctgaaaggtgctgggaaatttaacctcattggagagattgaagctgcagcaaaatcacttcactggcaaaattccaaatga

SEQ ID NO: 27931 - DNA, 186 bp, Glycine max
  Peptide Sequence Number=SeqID_144709
atggaaaagtgcactttcatcttcattcatcttaattataaaagggacgatggctggcactcaagccaactactagaagatctacagtactcaaatccttatcagaacacagggagtggtagtaccaatgacctttatgaagggcgagaacatcctttggtaaaatacgcaggaggtgggagatga

SEQ ID NO: 27932 - DNA, 174 bp, Glycine max
  Peptide Sequence Number=SeqID_144710
ggagaaaattactatgagattgatttggacatgcatagattcagttatatctccaggaaaggtttcgatatgttcttggatagattaaagatctgcattctagatgttggtctcactattcaggcaagggaacaaagcagaggagctgccagagcaagttttatgttgtattag

SEQ ID NO: 27933 - DNA, 2229 bp, Glycine max
  Peptide Sequence Number=SeqID_144711
atgaagagagtagctatctcctcttatttccattgttttcactatcactatcattgtcatcataatccctttctgggttttggtccaagaagatgtttgagtgtgaaattttccacttctttgggttcaagcaatgcaagaccttttcctgattactccccgagaaagccctcagtcacagacactgactttgtgcaccacatttccaccaccattaagcagcgccgcgccgagccttttcgccggattctcaagccctttgagtcaaagttcaggcctgaccatctcatttgggttcttatgagcatcagggatgattataaactcgtgttggatttcttcgactgggctcgcctgcgccgggacccttccttggaatccctttgcattgtggttcagattgctgtggcttctaaggatttgagaatggctcacaggctggtttttgagttctgggaaaagccccatttggatgttggtaactcgtttgatcgatttactgagaggttgatttatacttacaaggactggggtgcacatccccttgtgtttgatgtgttcttccaagttcttgttgaggcagggttgcttctggaagccgggaaactgtttgataagttgttaaattacggtgttcttgtttctgtagattcttgtaatttgtttctagctaggttatctaacagttttgatgggataaggacggcatttagggtgttcagagagtattcagaagtgggtgtttgttggaacactgtgtcgtataatattattcttcatttgctttgtcaattgggtaaggtaaaagaagctcatagtttgctcatacaaatggagtttagggggaatgttccggatgttgttagttatagcgttatagttgatggatattgtcaggttgaacagctaggaaaggtcttgaagctcatggaagagttgcagagaaagggattgaaaccaaatcagtacacatacaatagcataatttcttttctttgcaagactggtagagtagtcgaagcggagcaagtcttgagggtgatgaaaaatcagaggatttttcctgataatgtggtgtatacaactctcatcagtggttttggcaagtctgggaatgtttccgtggaatacaaactctttgatgaaatgaagcgtaagaaaatagttcctgattttgtgacatatacttccatgattcatgggctctgtcaagctggaaaggtggtggaagcacgcaaactgtttagtgaaatgctcagtaaagggttgaaaccagatgaagttacttatactgctcttattgatgggtattgcaaggccggggaaatgaaagaggcattctctcttcacaaccagatggttgagaagggtctgactcctaatgttgtcacttatactgcattagttgatggcctgtgtaaatgtggagaggtagatatagcaaatgagcttcttcatgaaatgtccgaaaagggccttcaaccaaatgtctgcacatataacgcattaatcaatggtctttgtaaggtaggaaatatagagcaagctgtaaaacttatggaagaaatggatctggcagggttttttcctgacactattacatatactacaatcatggatgcttactgtaagatgggtgaaatggccaaggctcatgaattgctgcggattatgcttgataaaggacttcaacctacaattgttacatttaatgtgctaatgaatgggttttgcatgtcagggatgttggaagatggtgaaagactaatcaaatggatgttggacaaaggtataatgcctaatgccacaacattcaattctctaatgaagcagtactgtattagaaataatatgcgtgccactatcgagatttataaggggatgcatgctcaaggagtggtgcctgacacgaatacctataatattttgattaaagggcattgtaaagctagaaatatgaaagaggcatggttcttgcataaagaaatggttgaaaagggatttagtctaactgctgcttcttataattctcttataaagggtttctataagaggaagaaatttgaggaggctaggaagctatttgaggagatgagaacacatgggttcattgcagaaaaagagatatatgatattttcgttgacgtaaactatgaagaagggaactgggaaaatactcttgagctttgtgatgaagcaatagagaaatgtcttgttaagaaaacttag

SEQ ID NO: 27934 - DNA, 273 bp, Glycine max
  Peptide Sequence Number=SeqID_144712
atgatagtcaatatgaatatcttcgattgggtctcaaaagtgaatcatgggaaaggatttatcatactttttttttccttgccttttcttcatgtcgcactcttggaatgtgttttctcttccttgtccttggaatgtgttttctcttggctccctccgaggaaggacaacacctattttctgacgacgaccatcatagccgtggtgtatgaggttcgcattttggctattgaagacgaaggttctaagagtccttccctagagagaatgtga

SEQ ID NO: 27935 - DNA, 615 bp, Glycine max
  Peptide Sequence Number=SeqID_144713
atggagttcaagcaacttgatatcaaaattgcctttctttgtggaaggctagagaaagacattctgatgcaacaacttgaagattttgagcaaggtggaggatggttccatatttatctactactctatgtggacgacatgctcatagcatctcaaaatttgttggcaattaagaagctgaagtcaatactcagtagtgaaattgagatgaaggacaagagagttgttgaaaagattctaggcatggagatcaagagggatcgagtccaaaagaagctctttctatttcaaaaggaatacattaaaaaagtgttgaattgttttgagatggaatccgcaaaatcaatatatactcctctgacaacatctatttgtccatctgaactcaatactactcagtcagaatcagagaaggaatacatgtctcgtgttccttatgcaagtgttgtagaaagtctcatgtatactatggtatgcaccagactggacctagcacaagaaggtacaattgatattggactcgcctaccatggagacacgtcctatgctcacactagttactcagattctaactatgttaaaaatttggatgcatgcaaggagatttgcaactgg

SEQ ID NO: 27936 - DNA, 378 bp, Glycine max
  Peptide Sequence Number=SeqID_144714
atggaatctcacccattcatgagtctgccacagtttggggagcctcctagacatccacccatggtccatgatgatacatatattataccagatccacctgtgttgcccgttcactcagtagctatgcaacaaccacctgcacctgcaactattgatgcagacatgtctcgacatttagtggttgttgcttgccaaaagataacagaaagcttagaatacataatcagcatcaggatggtcattgttggaactgatgcatacgctttgactgatcattatttaagattagccaaaggtgtcactcaacaaggaaatgtttatgttcgctctagacaaaggagggatacacaagacagaaatggtggtggacgacgatga

SEQ ID NO: 27937 - DNA, 219 bp, Glycine max
  Peptide Sequence Number=SeqID_144715
gaagatgttgcaattgaactccacaatcttgcagcggaggaagatgctacaaaaggtccatggtggtggtgcaccaacgacgacctaaggtctgacagcgtatttcaagatgtcaccactgccagcggtgaaggcatttcaagatgtcgtcattgttgctggtggctgactagcatcgggaaatggcgtcgtgagggacgtgaagaagaggatatgtga

SEQ ID NO: 27938 - DNA, 267 bp, Glycine max
  Peptide Sequence Number=SeqID_144716
atggcgaagagtgatgagttgaagctaatgggtaaatggtcgagtccttatgcgatgagggtgaagattgccctcaacatcaaatcccttgaacatgaacactttgaagaaaccatgataagcattataattgttgaaggagaggaagaaaggaagccatactttgaggtgttggaagaagtgcttgagaggatagaggatgcttttatgaaatgcagcaaaggaaagcccttttttggtggagacatgattggatggattccttga

SEQ ID NO: 27939 - DNA, 2310 bp, Glycine max
  Peptide Sequence Number=SeqID_144717
atggcgtgcgagatgccattggatctgataaagcacctacgaatacttctccgcagagaggccaatctctcgtggtacgaccccgagaaggaggaaaatctcgcgctcccaaagctcccttcggtggccgaaaccatagcgaagctcgatccctcgccgaattaccttcgctgcaagaattgcaacggaaaactcatccgcgacttgcaatcttcaatatgcgttttttgcggcacgaattcccagaacgaactccctcccgaacccatcaaattcaagagcaccattggatatcggtggctactcgagtcgcttcaactcgatggatcggtgcttttggtattgttctccaatcaaaattggagttttccagcgggaacctgcatcatagaggacatggtggcaccagtagtggatgaaaatgaatggaagagggggaggagtgaattgaaagatgagattcccttatctgaactgctagatctggaaattagatggccttctgaggccgagagagctcagacaagtacttcggatctggccgctcaggggaagagctcattgaatttggctggagttgatcttgatagttttttcgaccggagggagtctgattctgaagtgtatgaacagaacttggcttctggaaaacaagttggtggtgcttcagataagagtttccaggctaatgaaaatcttagtttgtttcagaatgtccaagctttggaagcggctgcagggtctgcagaaaatcagagtggtgattcattttccagttgggagaccagctttatgtctgctagttctggtcctgttcatgaaatgcccaaatcagtttatcattctaaagttgaattggatatgacatctggattcttgaaagattctgttggtgtaaagaagaatgacgatttcaatccttcagcatccacggaagacgattattttcagggtggatggagaactttcaactcagaggtacatgaccagactgggaaatcagaatcaaccatggatcctagtggtataaaaacagcagaaaatgctaatggttctagtagaaatcttgattggatgcaagatgatctatggcaagggagtgataacaagacaactgatactgtgcctactgcggaagataaagattcatttgatgaatggaatgattttactggctcaggtagcacacaagatccttctagtactatttccaactcaaagacaactgcccagactggaaatgttggatattctgttgattttaatgatacaaaaacatcacaggatgctaatagctcttctaacaaggattttgactggatgcaagatcagtggcaagataacaataacaagacaacaaatgccatcagtggtaacgaagctgctgacgcatttgatgcatggaataatttcactggctcagccaatacacaacattcgtcctttggtttatccaactcagagataactggccaggctggtaaattcgaactttcccaggatcataatgatacaaaaacagctgaaagtgctaccggttcttcaagtaattttgactggatgcaagataaccaatggcaggggagcgatgacaaggcaactggtattgtgactactaatgaagcatctgatgtatttgatacatggaatgattttactggctcagctatttcacaaaatccttccagtggtgtttctgactctgcgattactgcccagactcggaagtctgaagttactgctgatcttgatgacatgaaaacagaagagggtaccaatgcttcttcttgcagaagttttgatcggatgcaagatgacctatggcaagttagcaataataaaacaactgttaccaggactactaatgatattgattcatttgatgtttggaatgactttactagcttggccagtacacaagatcattccagcaatgtttggaaacaaacagtaaacctgacttcagcagaaatgacctctgaaacgaatttactcagttcgtcaaacagctcacatgataaagattttagtggattttcacagcatgatctattttcaggacagtttggtagttcacttccagttacttcttccaacagggtggatgaagtggatatcactagaggaaactctggagatgtttccagtgcagaatgctactactgtatattagctagcagttgtggggagatgaatctgattatgattttttgtgtaaggttcgatttcagagctgcctttaactatgttgagttgagagttgagactgttctgacattactagctccactgccaaataatctgcagtag

SEQ ID NO: 27940 - DNA, 1456 bp, Glycine max
  Peptide Sequence Number=SeqID_144718
atggagcatttcaacaaagccaaagccgtgaagctccgcagccacctcggcaagtacctcatcgccgacgaggacaaactccgtcaaagcaaacgaggctcaacaaaaaaggcaatatgggaaattgaactaataaacggaaagaaccaccacgtgcggctgaaaagctccaacggccgttacctaacggcgacggacgcgccgtttctcttaggcatgacggggaacaaggtggtgctagcgaatttcgacaagggcacggattggaagttcgagtgggaacccataacggaggggttccacgtgaagctgagaagctggtgcgggaagtacctcagaggtaacggcggcacggtgccatggagaaactccgttacgcacgatgaccctgctagctccgttactcacacttggatcttgtgggcttcggaacccgtgcaagagtttcctgagaaaatggtttctttcgccgagagcgacttttcgtcgttggattcggaggatgagcttctggcctcggaggaagagtcttcgagaagtcacaagtccatgctcaagacaacaagttccaacacctccggcgccacctcgatccgttccggcatggagctcttccaccgcgcgaaggcggtgcgcctccgcagccaccacgacaagtacctcctggccgacgaggacgaggagtccgtcacgcaagaccgcaacggatcctcccgcaacgccaagtggacggtggagctcatcccggagttcgacaacatcatcagactcaagagctgttacggaaaatacttgacggcgtccaaccagccgttactgctcggcgtgacggggcgcaaggtggtgcagagcttgccgcggcggctcgactcctccgtggagtgggagcccgtgcgcgacggcgcgcaggtcaagctcaagacccgttacgggaactttctgagagcgaacggtggggtcccaccttggaggaactccgtgacgcacgatatcccgcataggaccgccacacaggattggatcctgtgggatgtggatgttctcgagattcatgtggtgtcccctgctccgcctccgattccgcactccgattcgcttgatttcgaatcgaatactccttctgctgttaacatcaaatctactaccttctccagacaagagtcgacggattcgaatgtgggttcgccgccaaagaagatggaggggaggactatatactaccacgttgcagaagataatggggatgtggatgatgagaatgtgcagggttattctttgaatttcaaagggaatggggttgagcagttagctcgaaagtttgaggaagagactgggcttgagggagttattgtgtgcactcgaagtcctttgaatggaaaactctaccctcttcgcttgcagcttcctccaaacaatgtcaccatgcaggttgttttggttcttccctcatctaaag

SEQ ID NO: 27941 - DNA, 261 bp, Glycine max
  Peptide Sequence Number=SeqID_144719
atggtagtggtggcttcaagagatggtggcgcattagatctgggcggtgatggtattttgggaggtgtttgggtcacagttggtggtgttgggttttgtgaaggtggcattgtggcttggaggttgtggatatatgggcgactaaggttggtggtggctatgatgattgggtgcaaagtggttgatggtggtgatggtgataatgatacggggaagactaggggagaagaggagaaggaagaagaagcttgcattttgtga

SEQ ID NO: 27942 - DNA, 1923 bp, Glycine max
  Peptide Sequence Number=SeqID_144720
atggccacaagcccaccttctctgcttttatccacaaccaccagcaccaacaaccaaagccaacaccttatccacttgctgaacgaacccaccactatcactatgcctcagctcaagcaaattcacgctcaaacgcttcgcacagttaacagcaaccacccaaatgctatctttctctacaccaatattcttcaacactactcctctctgactcagcccaatctcacctacgccactcgcgtgtttcaccactttcccaacccaaattccttcatgtggaacactctcataagagtctacgcaagaagcaccaacaccaaccacaaacacaaggccatggagctctacaaaacaatgatgacaatggaagaaaaaaccgcagttcccgataaccacacgttccctattgttctaaaggcttgtgcttacactttttctctctgtgaaggaaaacaggtgcatgcccacgttttgaaacatgggtttgagtcggatacatacatctgtaacagtttggttcatttttatgcgacgtgtgggtgcctagacttggcagagaaaatgttttataagatgagtgagagaaatgaggtttcgtggaatatcatgattgattcttatgctaaaggtggaatctttgacactgccttgagaatgtttggtgagatgcagagggtgcatgaccctgatgggtatacaatgcagagtgttattagtgcttgtgctggtttgggtgctttgtctttgggtttgtgggttcatgcttatattttgaaaaagtgtgacaagaatatggttgatgatgttttggtcaatacttgtttggtggatatgtattgcaaaagtggggagttggaaattgcaaagcaagtcttcgaaagcatggcttttagagatctgaatgcatggaattcaatgatattgggtttagcaatgcatggtgaggctaaagctgcattgaactattatgtcagaatggtgaaggtagaaaaaattgtgcctaattcaatcacttttgttggtgtcttgagtgcatgtaaccataggggaatggttgatgaggggattgtgcattttgacatgatgactaaggagtacaatgtggaaccaagattggagcattatggttgtcttgttgatcttttcgctcgagccggacgcatcaatgaggctctaaacttggtctcagaaatgtcaatcaaaccagatgctgtaatctggaggagtcttttggatgcatgttgcaagcaatatgcaagtgttgagctaagtgaagaaatggcaaagcaagtctttgagtcagaggggagtgtgtgtagcagtggagtttatgtgcttttgtcaaaagtgtatgcttctgcttgtaggtggaatgatgtaggattgcttagaaaactaatgagtgaaaagggtgtgactaaagagcctggctgcagtataatagagatagatggagtggttcatgaattttttgctggtgacaccactcatccaaagagtgaaaatatatataaggttgtgactgaaattgaagagaagctagaatcaatagggtatttacctgactattcaggggcacctatggttgatgaggttaatgatggaaaactgaatactctgaggttgcatagtgagagactggctatagcttttgggatcttaaactcaaaacctgacgtgccaattagagtgtttaagaaccttaggatggaacatgttcttgtatggattattggtgatagatgcttgtgtcgaaggactaggaagatacaattcattaaagaaagaaagttaattgctcatgctcatgccttagttggatactgtgttcaataccaggacattcccatgtctaaaaggctttccaactcagccaacgatgttcacggagataattggtcttgccgatctaccctttcatga

SEQ ID NO: 27943 - DNA, 482 bp, Glycine max
  Peptide Sequence Number=SeqID_144721
atggcatcatcatcatcctcaagtaatcttgaagaaaggcacgaggtgttccttagtttcagaggtgaggacacaagaaagactttcacgagccatctacatgctgctttcaaaaggatggaaattaatacctacatagactacaaccttgagcgaggggatgaaatatcagggactcttcttagggccatcgaagatgcaaagctctctgtgattgtcttctccaaaaactttggaacatccaagtggtgtttggatgaggtcaagaaaataatggaatgtaagaaaacaaggagacaaatggtagtgcctgtgttttatgacattgagcctacccatgtacgaaatcaaacgggaagctttgcaagtgcatttgctagacatgaggagcgatttatggataggccaaacaaggtgcaaaaatggaaggatgctctccgagaagcaaccaatctctctgggtgggattgctccgttgatag

SEQ ID NO: 27944 - DNA, 459 bp, Glycine max
  Peptide Sequence Number=SeqID_144722
atggcgtcatcatcatctttttcattcattcctcaagaaaccgacgacgtgttcataagctttagaggcgaggacactcgccatagtttcactgctcatcttcttgccgctctgggaaggctcaaaatcagaacctacgttgactacaagcttgggagaggggatgaaatatcaccaacgctcctaaggcctatcgtggagtccaaggtttcggtgatcgtcttgtccagaaactacatatgccacttcgaagtggtgcttggaagagctcgtgaaaattatggaatgcagaagaacaaagggtcaaatcatgtgcggaaccagaccggaagttatgcagatgcttttgtgaaacatgagcaacgtcttaaagacaacgtgcagaaggtggaactttggagagacagtttgagagaagtagccaacctctctggattggattgcttggtcaacaggtag

SEQ ID NO: 27945 - DNA, 138 bp, Glycine max
  Peptide Sequence Number=SeqID_144723
atggtaaaggtttggggagtgatgaggttgtcctgtttcaagaagattttagagattggaaaaattggctactctaccgaggtggaattggtgttaagggagaagaaagctgggaagcttggtgggaagaagaactga

SEQ ID NO: 27946 - DNA, 714 bp, Glycine max
  Peptide Sequence Number=SeqID_144724
atggaatcatgcaatgtgaagaacaagtcaagtggaaaaagaaagatgtctagtgaggacacaagaagttacttcgcatggaacttggaaatggagcatgtgctagctgatgtgcttagagatcaaagaaatttgggcaataaaggtgatggaaattggaaagcaatagcatacagtactgcagctcaaagtttgtcgaagcattttggagttcacctcatggcagataatgttaagaactgttttaagctttggagaacatggtatgaaattgatagagctactggactcggagcaaaaaatgcattagatgcagatgatatcatgagcaaagaaacaaatgaagaggaaacaattcatagtgtgagttttgacttagaaggatcaagtgctgtcacaagaaaaaacattcgcccaagtaagagtggagagaaagaagggatgatttcctcaatgaaagaagtagtcgagtcattgaaagaatttgttgaagtgactaagaagaagatggagaacaaaaaaaagatggagataaaagaagctcaagaagtggtacatgaagtggtgagtgagctagataatatacctaattttaatggtgcacttcgacatagagcaatcgattggttgacagaaaatctgattaagtttgcgattataaaagctcttccattggatgagaaggaggattacatctcgtcttttatgccttga

SEQ ID NO: 27947 - DNA, 174 bp, Glycine max
  Peptide Sequence Number=SeqID_144725
atggcctggaacaatgtcagagatcatcccggaatgatacaagttttccttggtgaaaatggtctttgtgacatcaaaggaaataaattaccttgtcttgtgtgtgtgtctcgtgagaaaagagctggatatcatcaccataaaaaaggtggagctatgaatgctttggcttaa

SEQ ID NO: 27948 - DNA, 465 bp, Glycine max
  Peptide Sequence Number=SeqID_144726
atgggaatgttcaagttgcaatccccagacccaaccctctcaaatcaggcatttatggatgaggtctttttgctcgtagagatatacaagaaggagagatgcataaagtgcgaccaagactacatttttagttgcttccattctcaaatgtggtggaaacgaggagaaagggaaacactatacaatgcatacggatcaaatgggtgtggtgttaggagacagatggatctctccttaagatttggtttttcatgggggcccttgcttgaatacctctcaagacttgacgacaaggagctgcaaatatcaaacgaaagtgattcagcaaccgtatcagcaatgaagctgaaattattcaaagaaatatcaatgaggcaatactccaagcatcttacttcaaccagatattcaattttttgttgtctaacacaagatattttgtatgccttagatcttgggcaatag

SEQ ID NO: 27949 - DNA, 2201 bp, Glycine max
  Peptide Sequence Number=SeqID_144727
gaggaagaggagaacacgtccctaataacaaagtgttacacttgttgtctagttatctgttaggggaagcggggggattgtgtggcgttccggcggtgagggaaggagggaattcgagaaagaggggtttgaaggggatgaacttggatgcgggaggggggaaagtaatctttcagatgagtaggagctcccttgatgcgcgttggtcttgggttgggtgtgtgacggtcgtcggagctgcagtcaccggagatgttgcagtcgtcatcggaggtgctaacactaccgtccgcccccaaaaaccaccttgtcctcaaggtggcgagaatcgaggaaacatagtggttgtcgaaggggctggttatcatggacctgtaaggaccattcgtaggtggcggtgggtggtggaccgtgatggggacggaggagagagcaatgaaacactgggtgtatctgcgacccaggtggaagaagaagacgattggccactgcgccgactgatcgacgtctgccgtcccggccgtaacttgacatacacccactggcctgcgacgaacgtgacgtcgtctcacttggagtcagcactgagcagcttcgttgctggtggcgccggaaacatagtcaaggactgtgggaggtggtttgccataaatgatttcaaatggcgtgaggccagagctggaatggagggacgtgttataactctattctgcgagggcgaggttgatcgtggacgaagcatcggaggtattgctcaacgatgcggttcatcaccttcgtctggccgtcaaactgggggtggtacgcagtgcttaaccggagtcgcaaaatcgtgcaacttacaaaccatatccaggaataagctggcaactttgaaggcggtgaacccggaagctaaggcacctaaatgcacacctttggagaacctatcgaccacgactaggataacggtaaagccttttgagtttggcaggtgggcgatgaagtccatggaaaggtcttcccacaccccctctggtgtcgaccagactagaagaagcttgactcaaggcgatggtgatgacactatgaaggaatgggttatcctgattgagccagattcgacccttgaacagtatcagcccgtgaccgagagtatagtcaggatggtcattagggttatcacgaatggcttgagcaaggcgttggaactccgagttagagtcgagggattgcttgatgtcactgaggaagtcaagctggggaacactaaagacgagcaaggaagcttcaggagatggagctcgggaaagagcatcagcgatcactgttgctctggtgtctgtatgacttgtgtcatcaactcccggagacttttgtggtctgtgagaatggtgaacggccggcctaagaggcatttgctaaagtatgctagtggatggccattctgcagaagcacggcaccaatggcgattccggaagcatccgtctcaatcacgaagggctcggagaagttaggaagggccagtactggggcactggtcatggcgagcttgagtttatcaaaagcatgttgtgagtcttgggaccaggtgaaggcatccttgcatagcagggacgtgagaggagctgcaatggaggcgagatacgcctttgccggaaatgatatggcccagatattcgatggtatcttgtgcgaagagacacttggagcgtttcaggaaaaactcagcgtgatgaagggtttggaagatgatctcaaggtgttgcagataggatgcgttacaaagcccgaagggcatcaccagatattcgaagtggccattgtgggttcgaaaggttgtcttctcgatgtcgctttcattcatcagaatctgatggaacccttgccggagatccagcttggagaaccaagaagcacctctataaccgatacaaagtctccaagtgctgtccttcttcttcacgaggagcactggagaagaatagggactggtgcttggtctgatcagaccggcggcgaggagctcggagacctggttttcgatctcattcttttggaagtggggctatcggtagggacgaacggttattgggggagtggctggcttgagggtgatgtggtggaccacttgtcgtgggggaggtgttccatagctggaatcggatgtggcggtgcgggttgttcgggttcggttacgggtaaaacgtgtagttggtag

SEQ ID NO: 27950 - DNA, 174 bp, Glycine max
  Peptide Sequence Number=SeqID_144728
atgggagaagcttggagcatggagttgtttggatggaagaagatcaatataggtgttacaaccatcatcaaggagaaacatggtggagatggtagtggcttggcatcgcaacaactctgggaagatggcaaggacaagccagtggggatgatgcaacttcaattgagtgagtga

SEQ ID NO: 27951 - DNA, 240 bp, Glycine max
  Peptide Sequence Number=SeqID_144729
atggtggctctgagaccacttgttggtattttaggggatccttataaaataccaatacaaccactaataacacattacagtcatgttcaaaccggaggctatgagtgtggatattatgtgatgcattggatgtggtgcatagttactggtgatttgaaggatgaatggcacaaggtaatgcttgtgggttggggtggaaacaacagctcgaccctcaccggtggtgttattgctaactga

SEQ ID NO: 27952 - DNA, 1569 bp, Glycine max
  Peptide Sequence Number=SeqID_144730
atggctggcgacaatattgcaaagactgcatttcatacccaccaaggtcattatgagtatcgcaaaattcctttcagtttttgtaatgcaccttcaacttttcaggtgacaatgaatgcactccttcaatcattcttgcgcaaattcacgacagtcttctttgatgacattctcatctacagtgatacaatgtactcttacctccatcacttgctattgatcttcgaaactttgttacaaggacggttttacctcaagtgttccaaatgcttgcttgcccaactgcaattggaatatttaggtctcattatctccggtagaggcattgaactggaacaatccaaaatcacggcgatgtttgattggcatgtgccctccaatcaaaaggacttgcatgggttcttgggcctcaccagtttctatcacaaatttatcaagggatacgcaaccattgcctctcgcctgactttgcttttatgcaaagacaaatttgtgtggacatcgaaatcacaactagcttttgataacctcaaaagagcaatgaccgaatccttagtgctgactcttccagacttttctttgttgttggtgttggaaacttttgcttctgatagtgccatgggagttgtgctaatgcaacagaaccaccttattgctttcttcagcaaacaattcagcccacacatgcaacgtgcttctacttacgttcatgagttacatgttataaccaccgctattcacaaatggcgtaactatttgcttagtcatcaattcatcatcctcatagatcatcggagtttaaaagacttgatgttcaggctaactcatcatcctatcattacccaacttcgacttcatggatcaactccatcaagctcttcacgaaagtcttgctttttgggcaatgacaaaacttgccaacaacttaaacgcatcactagacaccctacagaccgcctacaaccattacccatgcctttaggaatttgggaggacctctcactggacttcattatccaccttccacgatcgcagggtttcacaactattatggtaatggtggatttttttcaaaagggtgcattttggaaagagttatttaaactaagtggcacttctttacggatgagcaccgcatatcacccgcagatggacgaccaaacagagcatcaattcttggctctccctaaatggtcctactacacctcccttcattccagcacgagaataactccttatgaggccacttttggcaaacctctaccttctataccccaatgtattatgggaacctctaaaaacaaagcagtggactctcttctgactaccagggaggccattcattcgtccctgaagcaccgcctccttaaagctcaggaaaccgtgaagaaacacgctaatgcaaaacaccaagatgacaagtttgcggttggacaatgggtttacgtcaaacttcgcccgtattgcctaggatcagttacaggtgttgctcaccataagtttgccaagtgtttctatggtcctttcgagattacagaatgtattggaaaggttgaatatcatctttaa

SEQ ID NO: 27953 - DNA, 903 bp, Glycine max
  Peptide Sequence Number=SeqID_144731
atgaaggagcttcaccacttgtttctcgattttgaacttttggaaataagggtaccaatagagacgggcgttcattggttcaactatgggagtaaggttgatatggtggatgatttggcgaggaggggggcaattgagttggcttgtggaagatatgggagaatctgctggggtggatcgggtctggagaagtcacgtgacttgcgacatcggcgcagagttccactaggaggtccaagtgggccgtggagagacactgtgaacatgtggccctggagaagcaaaggggtggtgagacagagttggcgacagtccaagacggagctattgccaaccatgacacacaaagatgaagtatttgtagttgggaggtctgttgcagggtttgtgggttttaaaggtgtggattcaggggttgtattaggttcttcggggagttcggtgaataaaatgggctttgggtgtgtggtgagaagcttagtaagggcagtgacttggggaagagaaataggctgcaatgcttggacctcacggcgaatgtctgacgagaaaccgaaaataaagaaactgagaaggaatgttggtgggaggccaatgatttggttcgtgaggcgctcaaattccatgagggtcgtcgtagaacgatggggcaacccgcgattccgaagcttgaagaagaccgctctaggatgtgatgaacccattgcggaacatccattggagagtagtgagctggttaaggcgatccattatggaatcgaccttgttggccaggtcggcgtgtctatcggaaagggaatcatggtgaatggtgaggtcgaaccaattgatacgagcaaaggagaagggtccttgatttcgaggacaaggcagcctccattgtacactaataagctaagctga

SEQ ID NO: 27954 - DNA, 108 bp, Glycine max
  Peptide Sequence Number=SeqID_144732
atggggagaagagaaactatatgtgacggatcggccaggccaggcgaggctttgaaaggcttgagcctagcctacgatgaatctttgaggcctgagcctggcctatag

SEQ ID NO: 27955 - DNA, 288 bp, Glycine max
  Peptide Sequence Number=SeqID_144733
atgttccctaagcgttttcgggaccccaaaacagtacttggggctctgtggctctacaataacaattcatcactggggtgggggaaactgaagccacaactgaaggagcatgaagaagcattgaaggagttcattgccaagggaaagatgatcggaacaactaatagtccaaaagggaaggctgagagtgataaggagaattttgatgaggaagctcagaagctgtggttgaggatgaagaatgagctcaaaactgaacttatggagaatggttttgatgttgaataa

SEQ ID NO: 27956 - DNA, 894 bp, Glycine max
  Peptide Sequence Number=SeqID_144734
atgacttccaaaacggacggtttcactacctgtcaccgtcacccttccacacccgtaaccggtttctgtgcctcctgtctccgcgaacgtctcgccggcatcgattcctcctcccgccgactccgccggaactccgccgcaccaagtcctttctccggccgcaccgccgacgctccatcctcctccgccgccccggagccccgccgcaggtcctgcgaggttggactgccgccgctgggcggcttgctgtctgaccccttcaacgttgccgacaagaacaagaagcctccgaatcggacagctgagatctgttccggccccgccggcgtcggaaccggagagaacgagggcggcaacgcggttagagtttctggcgatgacgacggagaggggaagacgatgaaggagttcatagatctcgaattgcgggacaaaaagaacacagggagagatttcagagacatcgctgcgagttttcgagatgcggcttccgttttcagcaagggattgatgaaatggcgacggaaagagaatccgaagagaaaccgcaacaacgacggcgccagtgccggcgttggttcggtcgaaaagctagggttgaggacattgcatgagacgcaatcggaggtcggagaatacggtttcgcgttaggtagaagatcgtgcgacactgatctgaggttatccgtggacgattcgcggttttcgttcgaagctcctcgagcttcttgggacggttatttgatagggaaagcgttccctagggtttccccaatggtttgtgttggtgatagggttttgcttgaagaagaggggagaagagagttttggagaatgattggcataggaggagaaggagtttcgataggtcgaattcgcgtaagaagccgttaa

SEQ ID NO: 27957 - DNA, 1020 bp, Glycine max
  Peptide Sequence Number=SeqID_144735
atgacactgttgacattgtctgcgtcagttcctggcataaaaccaacatgtcatggacatggagatgaaaactgtcatgctactactctagagagtgcagtgtgcttcctagctctttaccttattgctcttggcaccggcggcattaagccttgtgtctcatcctatggagcagatcagtttgatgacactgaccctgctgagaaggaacacaagagttctttcttcaattggttctatttctcaatcaacattggtgctcttattgcatcttctctattagtttggatacaagataatgtgggttggggatggggatttggtattcctgctgtagccatggcaattgccgtggtgagtttcttttcaggcactaggttgtataggaatcagaagcctggaggcagtgccctcactagaatctgtcaggtggtagtggcatccataagaaagtacaaggttgaaactgctgaaactgagtctgctataaaaggaagccgaaagcttgatcacacagatgagttaagattttttgacaaagcaacagtgctagcacggtcagataaagtgaaggaatcaacaaacccttggagactttgcactgtaactcaagtggaagagctgaaatccattttaagattacttcctgtatgggcaaccggcatcatattttccactgtctatggtcagatgagcaccttatttgtgttgcaaggacaaaccatggacactcgtgttggcaactccactttcaaaatcccaccagcttcactttcaatctttgacaccctcagtgtcatattttgggtcccagtgtatgacaggatcattgtgccaattgctagaaagttcaccgggtacaaaaacggcctaactcagctccaaagaatgggaattggcctcttcatatccatattttccatggtagcagcagcaatattggagctcataaggcttagaatggtgaggaggcatgattactatcaacttgaggagataccaatgacaatattttggcag

SEQ ID NO: 27958 - DNA, 240 bp, Glycine max
  Peptide Sequence Number=SeqID_144736
atgacttctcaaacatttgattatggtcaaaacctagatatcacggtgttccaagaaacaagatttggaagagcagttgtatcaaacagcttgcaggcaacaaccatgtcagtggatttgaagtacaaatcaagcaaagagttcatcaagaatatattagactgtaaatcacgagttataagcaaaagggcatgcaaggtttttgtgttcctggaactacattaccttgaaaacttgtaa

SEQ ID NO: 27959 - DNA, 788 bp, Glycine max
  Peptide Sequence Number=SeqID_144737
acactgaagagctattccctgttgcaagctcaacgagattttttaccgatatgcattatattctaaaagttatgtctattgggaatgttcgcacttcatgctaccacaggctacgatttcttgaggaaaaattccgccttcatctgttactaaatgcagatagggagtttctggctcagaagggtgcaccccaccgagatttttacaatatcagaaaagttgatactcatattcatcattccgcttgcatgaatcagaagcatcttgtgcgcttcatcaagtccaaattaagaaaagaatctgatgaggttgttatctttagagatggaaaatatatgacccttaaggaggtttttgagagtttggatttgactggtcataatagcttaaagccaccaaaatttacaggaaggtttctggctgaagtaacaaaggaagttttgacagatcttgaagcaagcaaatatcaggtggtgggatttgatcttgtagatgatgaaagtaaaccagaaaggcgtccaactaagcacatgcctactccagctgagtggacaaatgaatttaatccagcatactcttattacctttattactgctatgcaaacttgtatacactcaacaagctgcgtgaatctaaaggaatgaccacaataaagttgcggcctcattgtggagaggcaggtgatagtgatcatttggctgctgccttcctcctatgccataacatttctcatgggattaatttgcgtaaaactccagttttgcagtacttgtattatcttgcacag

SEQ ID NO: 27960 - DNA, 804 bp, Glycine max
  Peptide Sequence Number=SeqID_144738
atgagttcctcgaggtttccaatgctcataggagaacctcggagatcatcgaccttggatttgtcctcctcggccttctcctcctacagcttcaacctctcctgtattaagatcctgcaaatcagagcctggatgttgacgaacacgtggttgcagatcgagagcattctttgcagtgtcttcaggagaatctcaccattgaccctgaccgcgagtctgaacccgaaccgagtcttgttctgcttcggcaccaaaagccgaggacattctcccagcagtggcgggtgtgcaattgcacctgctccctccttcattgaacatattgccaatacaatacaatatataacacatggtacaatgccaaagattgcaacattaggatggccacttgcaaactttggacacagactagtgactgtcgctaatagccaaacaacactgactggcacgaaaaaaacagctaagaacaccactacaccagctcttgaaatacccactggctgctacattctccacgtccagggaaacacggttgctgctatgggttcattcaaaggcttgaagcaagtcagaagaattgttgaagaatgcatgctgaataaattgcctttgtggtgtagattttggccgaagaaaatatgtcacttcttttcacattgtcaggttcttatgatgaagaaagaacttgaaaaggatccagcacttgcccaggagaactgggataggttccttccaaaattcaagaagtatgccttttatttatttgacaaattgtatattcttttattccaaaattcacattag

SEQ ID NO: 27961 - DNA, 449 bp, Glycine max
  Peptide Sequence Number=SeqID_144739
taattagttgccagtataatatacggatagtgtatggagagagtgttcaggttttgtgttcatataagaggataggttctgttggtagaattatgaccccgcggtcaccgggacgtaccacatttgaaagtgctgaggattctgatgaggaggaaatacagcttgctgatgacaatcgcattcctttctcaaatacttacggactagattcaaatgtgtgcaatttgcccgctgttccattcagagttgaggatgcaaacaatcagatgtatggagaggcttcaaaggaagtgaaagctggtgcagatatgaatggtcatggaataacagattcaactccagtacatgtagctggggatgacattgtgtttgccaataatgtcttgcctacaagaaatactgcgcatggtactttcacattgctatcacaatctttactgttattctga

SEQ ID NO: 27962 - DNA, 165 bp, Glycine max
  Peptide Sequence Number=SeqID_144740
atggcgcaatggacaaagacagagtggcaacaatatgtttcaaagagtgacacagagagtaagggttacattccagagagtaaaagagaaagagagaatgctaagtttgtcatagtaacatcgatttttcaaaaaccaatgttaagaatgcccatttatttatga

SEQ ID NO: 27963 - DNA, 276 bp, Glycine max
  Peptide Sequence Number=SeqID_144741
atgactagagaagctcaactggtgaaccttttggagcaacctatgcaagtagagcatgtcaagcatgttgaccaagtccaggatgaaaatgttaacccagtacaagtaacaccaacaatctcaagcaaaggtggtttatacctattggttttgtacgtactatccatgaagaacactatgctaaatgcattcaacaattttaccgcatcaggatatgtccaaaaaatgtcatgcacaacttcttcaattcaaaatgtttctcttgcgtattcttga

SEQ ID NO: 27964 - DNA, 318 bp, Glycine max
  Peptide Sequence Number=SeqID_144742
atgatcattttggaagcaaaaagagtttcaagaatgagattccagaaagggtgttccagaacggtcttttggcttccgaaaaaggtgtttcagaatggcttatggaaaacccactccaaaagaaataagtgcactttggaacaggcttttcggaatgatcttttggcttatggaaaaggtggtttggaaagaccttttcagaagcaacaattggagaaggagaggcacttctgcgctagaagttttggcattgagagttggaagaatactttagttggagaagaagagaagaactcaaaagtggatgcattacaataa

SEQ ID NO: 27965 - DNA, 390 bp, Glycine max
  Peptide Sequence Number=SeqID_144743
atggagtaccttccccaaggaaatttccctaagtggcaagcaacggtggctcgtggtggccaccgatggtcgagggtggtggagaagaaggtgttagggtttgggtgggcgtttggagaggagaagagtgaaaaaatcatgtttttcacgctgaagaacgtatttataatatgtagatctcgtttagtgagtttgtctcgctcagcgggagtccacttttcatgcttagcacgacaatttgtgttgagtgaaactccctttgcgctaagcgcgacaattctcgctcagcgtaattccctctcgggttggaattgcgcttatcgcactaattctcgcttagcgcaattccctctaaggttggaattgcgcttggcgcgcttctcatgctaa

SEQ ID NO: 27966 - DNA, 1773 bp, Glycine max
  Peptide Sequence Number=SeqID_144744
atgctctcgttgccctcatgcctgaccctgagaaggattcgggatcgcctagaggatgccctgcttcgcctcacaaaccaggatatgtacctcggtgaatctgtgcatgccctaaccctccaaatcaaagaactccttcaacgcacaaatccttctccacactccacccccacaccgattccattgtcccttccgccttctaaccctgcatcaccacaccgcatgaagttagatatgcctcgattcgacgacaccgagcctcagggttggatctttaagatcaaccaattttttgagtaccatggtactccaaaacaagacaaactcattgtggcttcgttttacatggaaggacgcacgcttgcttggtatcagtggatgaacgcgaatggccatttcacctcttggtcatcctttcttcaagtcttgcgtgcccgctttgctccgatgtcgtacaaagatcccaccggagccttatttaaacttacacagaagggcactgttgcccagtatctggccgagtttgaagatcttgctacccatgttgttggcatttcccctcctcttttgttgagttgtttcatatcgggcctttcccccgagactcgtcgggaggtccaaccccatcagccgctatccatggtgcaggccgccgggtttgggcgattacaagaggagaaggtcctcaaccaacgaccaccacaacaccctcggccgccaaccccaaatccctttccttcacactctcgcactaaccctcagattgcagctttcccccttccccccttgcttaacccaccacctcgtacaaccccaacccctaccccaaccctcaaacgcctttccccagaagaaattgccctccgccgcgagaaggggctttgtttcaactgtgaagaaaaatatcacagaggacacaagtgctcttctaggttttttgttctcatctctgatgagcttgacccgaccccctctcatataccaatacctgacccgccaaaaaacccaccacccgacctgcccgatagctcagacttgtacccgacccaaatttccctaaattccttggcaggccatatcgcctcggagaccctctgccttttcggtcatctcaccggccatccaatgatcattttggttgatgggggtagcacccacaacttcattcagcatcagcttgttactgaattgagtttatcataccgcaaaatgaaccctttgcaggtgctagtcggaaatggccaatatctaacatgcaattgtgtttgtgcagacatccctatcgagatgcaggacctcaccttcaccattaatttatatgttttgcctattttgggcacgaatgtagttttgggggttcagtggctcataaccttggggcctgtcctcacggactatgccaatctgagtatgcagttcttttatgatggtcgattgggccctagcctctatttccacattatggtcattccggaagataccacccttgattccattgcagacttgccggcagatatttgcacattactcatcaagttcggtgcgttgttttgtcccctccatgcaatgcctctggccaaggacaccaaccaccatatacatttgctgcctcaggccacaccagtcaacgtgagaccctatcggtacccgtatttccagaagaaagaaattgaagcacaggtcacctgtatgcttcaaaagggcttgattcagcctagtaccagtccgttctcctcgccgattttgctcgtgaagaagcacgattggtcctag

SEQ ID NO: 27967 - DNA, 411 bp, Glycine max
  Peptide Sequence Number=SeqID_144745
atgacatcaaaggagtgtgctcagtgtgctccggcaatcgggataaagcatcagcagcttgattatgggacccagaacgatactggatcgtgtagttgtatcccatcaaacgagccaagcgtccatttcgatagtgaatggtcgttggaagttgggcaaggcgaggacaggagttgtggacagagcgtgtttgagatggttaaaagctgcctatgcctgaggagaccattggaaggggtcaagcattgttgccttgaccagaggatctgcaatcatggcataaccctttataaagcgtctgtagaacccaaccaagcccaagaagcttcgcaaagctctagtggacagaggcaccggccactaggatacggtggcaaccttggaagcaacaggttcaaccccacgggatga

SEQ ID NO: 27968 - DNA, 381 bp, Glycine max
  Peptide Sequence Number=SeqID_144746
atggaacaagcgatattgaccttggaccgtacaatagggaaaatggaatacaagtcagatttagagcaggttcaaaatgataaaaactctattatagataatgatatggttagatcatttcacctgaaaaattcaagcttcattgatttgagagaacttgagcacacaagaaagctagcggtggaacttgagcttacaatcttttgctttctagtggaggatctttcagaggaactactatcaggatgcaattgtggacattatcaaaagaatgggtgttggaatgacaaaatttatttgcgaggtacccataattttttccacttgttgacaccgttcaagaagggtatactggattccacctgggagcattcaacgtag

SEQ ID NO: 27969 - DNA, 327 bp, Glycine max
  Peptide Sequence Number=SeqID_144747
atgggtttgttttgtaattatttactctacaggtctctttttttactacaacgcgcctacccgggaggaagcggtggtctgtcaggcacgaccactagtggtggcctgccaggcgcgaccactagtgcgcaaataaaacgaaggaagaggggttttataaggaagaaggaagtgtcaggctggccaccactagtggtcgcgcctggcaggccaccactagtggtcgtgcttggcaggccaccacttcctcctcctgtcccacctcccctatcacctagtcacgtcatgccacgtgtcagcttctcgtggaacacgctccttgggtag

SEQ ID NO: 27970 - DNA, 258 bp, Glycine max
  Peptide Sequence Number=SeqID_144748
atggagtgggttcttacactcaagatccatttttgtgaagatccagcattagagagagagagagttaggttctccagcgtggcacaatggatcttgtacaagaaccctcaagatcccaaaagtagcttaacggatttgggagagaatcaacaagaaaaagatgcaaaggaagaaaaatacctgaacgaacggatgcatgccatccaccgtcgcatcgtggagaggaacgccagagagaggaagagggaaggaaggtga

SEQ ID NO: 27971 - DNA, 531 bp, Glycine max
  Peptide Sequence Number=SeqID_144749
atggctggtgagaagctgcatgagggttcaagcatgacacttttgctccaaaaagaaaggcttacatgctcccctgaacttattcgatctttttgggttcaaaactctgaatcttcttttcaaggttcaaaatccttggctaatgttgtgaatgtcacgcaaaggcccttctttcaagggcttgagaaagaagagaacggtgaggatgaggactttggggtgtgcctaaatcaacccggtaagaaaaggaggctcacaagcaaacaagtgcagttccttgaaagtaacttcgaggttgaaaacaagcttgaacccgaaaggaaggtccaacttgccaaagaacttggcatgcaaccaaggcaagttgccatatggttccaaaaccgtagggcaaggttcaagacaaaacagcttgagaaagactatggtgtgttgaaagctagctatgacgtactcaaaagggactatgacaatctccttcaggagagtgataagttaaaggaagaggtaacaattattagacataaataa

SEQ ID NO: 27972 - DNA, 663 bp, Glycine max
  Peptide Sequence Number=SeqID_144750
atgccgacaagtgacaacgctggaaacggaaatgggctggcaaagattcaacaacttggtgacaatgaagaaggtcgtccaacggtgaaggctcaaaccattgatgagcttcactctttgcagaagaagaaatctgcaccttccactcccaagggctctctgcctacgtctgccagcgtttttaccgaggaagaacgcaacaaacagcagcttgagtccatcaggtttccgaaatctcgttctcgaacttgcgactcttacttcacacctgatgaccctcttcttcaagaaatatcatttaagttcgcgaagcgtcgatcaaggtgtagacatagggggacatgtagaactgtacccaccaatcaggggagcaactctcgttgcccatcacgcggcagaggtgctcgttggcacgaagggtctgagtcatgtcttgcgtcattgacgaaatgttgtggggtcggcgtggtgattgcatctttggcgtcactaacaagagaaagtggaccaaaggtagtgaaaggggatccagcagctaggaaatacgaagcctcaagggttgaacacgtgccgcaccaaattctcacacctaccattgctgtcagtgacagtgccttgaagtttacacatgttctctataacctctccccagcagagaattag

SEQ ID NO: 27973 - DNA, 141 bp, Glycine max
  Peptide Sequence Number=SeqID_144751
atggagctaaaagagggtgctatggaggatttgggtggtggtcgggaagtttcaaggtggtgggtgccattgtggggtgcaagatggaagagaagggtctcaagtgttgaggatgattctctttttatcttttactattaa

SEQ ID NO: 27974 - DNA, 528 bp, Glycine max
  Peptide Sequence Number=SeqID_144752
aactttatgaacaagcgatcaagtatgagaaaggatcgttcattacttccactggggcattggctacgctttctggggccaagacgggtcggtgtcccagagacaagcgcgtggtgaaagatgaagttactgagaatgaactttggtggggaaagggttctcctaacatcgagatggacgagcacagtttcatggtgaatagagaaagagccgttgattatttgaactctttggacaaggtctttgtgaatgaccaattcttgaactgggacccagagaacaaaatcaaagttaggattgtctctgccagagcttaccattccttgtttatgcacaacatgtgcattcgaccaactaccgaagagcttgagaattttggcacaccagacttcactatttataatgctggacagtttccttgcaatcgttacactcactacatgacatcttctactagcattgatcttagtcttgcaaggaaggaaatggtgatccttgggacacagtatgcaggggaaatgaagaaag

SEQ ID NO: 27975 - DNA, 216 bp, Glycine max
  Peptide Sequence Number=SeqID_144753
atgttggagagaatgctccaaccatatgagatcagcatagacttaaaggagcactcaaacccggtgacccccaaggcctacactccgaagagtccgtcagggcctctccggcctgattcagacactgctcatgaattatacaatacccacgacctttacactcgtgttttaaacacgttcaacacaatggcgctacgatttaacactggttcctaa

SEQ ID NO: 27976 - DNA, 306 bp, Glycine max
  Peptide Sequence Number=SeqID_144754
atgggatgttacaataatcatcgcctaccttcaaagattaaggagggggattgggtgtatctcaagataaggccgcatcgacaagcttcaatgcctacaagattaaatcctaagctatcagccagatactatggcccttaccgggtagttaaaaaagttggagcagtgacatttcagttgcaattaccaggcactgctcgaatccacccagtttttcacgtttccctattgaaacttgcagtaggagaacatcagattgaggcagaattgccaaaggaactacaagatgaagaacaagggatataa

SEQ ID NO: 27977 - DNA, 468 bp, Glycine max
  Peptide Sequence Number=SeqID_144755
atggattcaaattcacatggcaaatacaccctagagaatggcagattatactttaaaggcaagttggtactgcctaccaattcaagttggatccctaagctattcaaggaatttcactcttccttggcaggaggccactcaggggaagatattagcctagactttattgtgggattacctaaatctaaggggcatgatgctattcttgtggtggtggataggctaagtaaatatggtcatttcttactattgaagcatccttttactgctaggagtgtggcagatatctttactaaggaagtaataaggctgcatgggattccttcttcaataatgaatattgcttatcactctcagtcagatggccaaattgaggtactaaatataactgtggagacatatttgagatgcttttgtgcagagcaacccaaatcttggcctgagtttatcccatgggcagaatactag

SEQ ID NO: 27978 - DNA, 602 bp, Glycine max
  Peptide Sequence Number=SeqID_144756
aaaatactcgtgcagcttatccaattgactacattccaaatgtgaagttaccatgtgttggtcctcaccctaagaatgtgatccttttggcatgtgatgcatttggtgtgcttccacctgtggctggcacagaagagggcataaaggagccacaggcaacattttcagcttgttttggtgcagcctttataatgctacaccctacaaagtatgcagccatgcttgctgaaaagatgcagaatcatggtgctactggatggcttgttaacacaggatggtctggtggaagctatggttgtggaagtcgtattaaactatcttatacaagaaaaattattgatgctattcactctggaagcctcttggatgttgagtacaagaagactgagatttttggacttgagatccccactgaagtggagggagtcccctcggaaattctagaacctgagaacacgtggtcagacaaacaagcctacaaggagacactattgaagctggctggattgttcaagaacaattttgaaacattcacctatggagagaacaaccaagtgacaaaggagattcttgctgctggaccaatcattcatgatgcttaa

SEQ ID NO: 27979 - DNA, 1695 bp, Glycine max
  Peptide Sequence Number=SeqID_144757
atgggcctgcgcgtgccattcccaccgcacagcctcacgagcctggaccagctccgagtcctcagcctccgcaacaactccctcttcgggcccatccccgatctaagcccactcgtgaacctcaagtcactcttcctcgaccacaacaacttctctggctccttccctccctcccttatcttcctccaccgcctcctcactctctccctctcccacaaccgcctctccggtcccctccccgtaaacctcaccctcctcgaccgcctcatcgcgcttcgtctcaactccaaccacttctccggcacgcttcctttcttcaaccagaccaccttaaaagtcctcgacctatcctacaacaatctctccggccctgtgccggtcaccccgactctagccaagttcaacgcaacaacatccttttcaggtaaccccggtctctgcggggagattgttcacaaagagtgcgaccctcgttcacacttcttcggccccgccacgtcatcctctaccacacccttgagccagagtgaacaatctcagggtattgtagttgttccttcttctacgaccacaacaaagcatgataaaaaaacaggacttgttgtcgggtttgtcgtcgcggttgttcttgtcgctgctttcactctcacgatggtttctttggtgagaaagaagcaaaatggtaaagcttttagagcaaaaggcgtggttttggagagtcctgaggtggagggtggtggtggtgtcgttgtggtggaaggtgagagggaggtgaagatgagaaagatggaagaggcgcacaggagcgggaagctggtgttctgctgcggggaggtgcagagttacacgctggagatgctgatgagggcttcggcggagttgttagggagggggagtgtggggaccacctacaaggcggtgatggattcgcggctgattgtgacggtgaagaggttggatgggaaaagtgcggcggcggggagtgatggggaagggtttgagaggcacatggaggttgtggggaggctgagacaccccaatttggtgcctttgagggcttattttcaggccaagggtgagaggcttgttatttatgattatcagcccaatggcagcctcttcaatctcgttcatggttcaagatcagcgagggcaaaaccattgcattggacatcatgtttgaaaatagcagaagatgtagcacatggacttgcttacatccatcaagtttcatccttaatccatggcaacctaaaatcctctaacgtccttcttgggatggactttgaggcttgcatcacggactattgcttggccttgtttgcagattcttcattctccgaagaccctgattccgccgcctacaaagcaccggaggctcgcaactctagccgcagggccactgctaagtctgatgtgtatgcttttggggtgcttctaatagagcttttgacgggtaaacacccttcccagcacccttttcttgcaccagcggacttgcaagattgggttagagcgatgagggatgacgatggcagcgaagacaaccggctggagatgctcacggaggttgccagtatttgcagcgcaacatcgccagagcagaggccggcgatgtggcaagtccttaagatgatacagggaattaaggacagtgttaccatggaggatactgcacttactggactctcatag

SEQ ID NO: 27980 - DNA, 1069 bp, Glycine max
  Peptide Sequence Number=SeqID_144758
atggatcgtgacgaggctcgattcactgcactggaatctttggttgcagcattgaaaacaacaaccagcgaattgaaggtgatgaccattgagttatttgcgcaagatgatggagatgctcatggaaaagaaaggcaaacgtttaatgacgctaagaatgcatttacggagcacaatagtgggttggaggatgaggagtccgcaacggaacccgagccttcatcaacatcggaggacgaagaaagcgatgcaacatgtccaacagagtgtgaaagtgagattggcctttatcagcatggaaggaaatgccttgcactggttccagtattggaagcaaaagacgaagcggaaaagttggaattcgatgtgctagtggctcaagtctcgggtacaaaggaagtgcaattgaaaggatattttttggcgggacttcgcaaggagatccgggaaaaatttcatccctacaaaccaaaggatctatcaagtgccatggagttggcggctaatttcaaggaagctgagaaagaagggaatccagaggttgagttgtgtagtcgtggttttcattttcaacccaagggaggaacgtggatacacaatgttggaggatccgcaacgaacacttttcacaacaacaaccgtcagaatcagactctaacaggggaggcgtgtagctctgcgaacgatgaatggattaacattgagggagagattacaagaatggagggggagcttgagaagacattttacaatataggagaaacaaagcaactgggtttgaaagtgactcctactcaaacctatggagtgagattgggtgatggaaacaagaaaaatgctcaaggctgttgtgagcagatggaggttcagttgggacaaatgaccatgacagagaaattctttctatttgatttaggtggtgtagatgccatgttgggggtagcatggatggaaaagttaggagatgtcaaggtgactatccctgataagtttcccattcctgtcattaaggagttactagatgaactaaagggagctcagtacttttccaagattgatttgaaggagg

SEQ ID NO: 27981 - DNA, 195 bp, Glycine max
  Peptide Sequence Number=SeqID_144759
atgacaatcatgatgacaaaggtggtggcagttgatgacagtggtggtggcggcgaccacaatcattgtggtggctatattgatggtcatggtaatggtaatgacaacaacaatcatggtgatggttgcaacgatggtcatgatggtgtcgtgctcatagtggtggcaacgataatcataatgatggtgagttaa

SEQ ID NO: 27982 - DNA, 381 bp, Glycine max
  Peptide Sequence Number=SeqID_144760
atggtggtcggacatactcctcaaactataggtgtaaattctaaatacaattgtagcatatggctcaaagattgcagaatgtgcagtggagttttgaattcaagaccaaagtgcttgaatcaacttcactaccccatgagtcctatcactcaaaaaacaaacagaaagaatcataatcacttcaccagctcagggatatcatggaaagaggatcagcaaacacctaggaacaacagcaagaaacttcaatgtggcatagatggtttccctgtcacttacagaaaagacaacgagcatattggatggtccatccactcagctgaatttttcaatccaataaaccaaaacttcactaaaatcagtcttcatgcttttcattag

SEQ ID NO: 27983 - DNA, 1119 bp, Glycine max
  misc_feature (1109)..(1109): n is a, c, g, or t
  Peptide Sequence Number=SeqID_144761
atgaagtccgtgaaaaggattgcaaagcaccccaccatttcactgctaaattcatgcacaacactgaaagagatgaagcagatccatgctcaattggttgttaagggcattcttaacaaccctcacttccatggccaatttgttgctaccattgcccttcacaacacaaccaatcttgactatgccaacaagctcctcaaccacaacaacaacccaaccctcttcactctcaactccatgatcagggcctattccaaaagctccacaccctccaaaagcttccatttttacgccaacattctccactccaacaacaacaacctctcccctgataactacaccttcaccttcctggtccgcacgtgcgcccagctccaggctcacgtgactggcttgtgtgttcatggtgcagtcataaagcacgggtttgagctcgacccacatgtgcaaaccggattggttttcatgtatgctgaattgggttgtctcagctcgtgccataatgtgtttgacggggctgttgagccggacttggttactcaaaccgccatgctaaatgcttgtgccaagtgtggcgacattgactttgcgaggaagatgtttgatgaaatgccggagagagatcatgttacgtggaatgcaatgatcgcggggtacgcgcaatgtgggcggtcgagggaggcgctggatgtgttccatttgatgcagatggagggtgtgaagttgaatgaggtgtccatggttttggttttgtctgcgtgtactcacttgcaggtgttggatcatggaagatgggttcatgcttatgtggagaggtacaaggttaggatgacagtgacgctgggaactgcacttgttgacatgtatgcgaaatgtgggaatgttgatagggcaatgcaagttttttggggaatgaaggagaggaatgtttatacttggagtagtgccattggtgggttggccatgaatggttttggtgaggagagtttagatctttttaacgatatgaaacgagagggtgttcagccaaatgggatcaccttcatttctgtcttgaaagggtgcagtgtggttggcttggtggaggaaggtagaaagcattttgactncatgaggaat

SEQ ID NO: 27984 - DNA, 766 bp, Glycine max
  Peptide Sequence Number=SeqID_144762
ctccctggttgtagtgtcatagaagttgatggtgaagttcatgagttcattgttggggacaagtctcacccaagatatgatgagattgaaatgaagctggaagagatatctaagtgtcttagactatcagggtatgtggctaacactaaccctgtgctttttgatatagaagaagaggagaaggaggatgctttgagtaaacatagtgagaaggtagccattgcctttgggttaattagtttgaaagccattgacttgtccagatgcatggatatggtccacaatgtaggaattaacgaggtatggactctgttgtacaccattaaggcttctccagactcatggttgagtcacgcacacacggtggtttatgatgaagatgctaatgcggcgaccatggcgcactactttgctaatagtggggaaggcaaagaaattggcctttctgtggtcgcaaagattcaaccatctaatggcaaattggatataacagtggagggccctgagcaagaccctgctttagcattattatgcatgtttgaagaagtgaatagaaccgaggtttggaagcctagcatgtgccctcattgtgacagagatattggcaccaggcaccacgttgtgacaatcagccgcaaaatcaaatcaagaaggtttaagggaaatagttacagatcaacgtttttgcagcctgatagtgaagacagcaatagtgatgaagacagtgatagtgctcccatcataccaacaagtcttggcatccaag

SEQ ID NO: 27985 - DNA, 318 bp, Glycine max
  Peptide Sequence Number=SeqID_144763
atgctcttcatgcttttttgcaaacttgttccgttgacaggggcggaagaaatcttccatgggactccacggaagatttcttccgcccctgtcaacggcagaagaactgcggaagaaccttcttccgtggagtcccacgaaagaaggttcatccgtgggactccacggaagaaccttcttccattgagtcccacgaaagaaccttctttcgtggaaatgacaaacaaggccaaaggaaaaggcaaggaggtcaccggaaaaggttctgccggcaagcgtaagggcgccttcgacgatgacaagatcggtggcggctga

SEQ ID NO: 27986 - DNA, 735 bp, Glycine max
  Peptide Sequence Number=SeqID_144764
atgagtagcttgatgctgaggatgttaagcatgtggatcatccagctgacgaggttcatgagcagcctcaggagccaactattaatgcccagggaacgtcatgagttgaagttgtcctctgatgagatgaaggtacaaaaatttggaaggcatgtactagagattgaaggcatagtggttgccacaagattaagttctctgattgcatattccttggacactggtgacagggaacttatatctgcttttgcgaagaggagatgtcatatcacctttgatgatgtggcatcgttgttacatctacccattacaggcgccttccataccttcgatgctcttgatgtagaccaagtcgcggacttgatagttgagttgcttgaagtcagtacacaagaagcaaaagatgagacattgcaaaccaaaggggcatcgactagcctagctgcgagacatttatcccaatctgaaagctattcatggggtgcggctgcactggtccatatatatgacaatttgaatgatgagtcaaagaaatctgccatgctacttgcaacatatatcacattgttacattgttggatctacgagcatttccttattgttgctttgtgtgttgctgatgaggattatcatgagaggaaaccatgtacatgtcgatggaagtctgggaatgcattatcggtgtcgacgtatcttaagtggttggatagattgatgttagatgctgtcagctag

SEQ ID NO: 27987 - DNA, 282 bp, Glycine max
  Peptide Sequence Number=SeqID_144765
atggaggcacaaacggcggcggtgcggcgagaagaagtgaagaacaaagaagagggaagcacaatagcacattattggtataatccatacggattgctaatccttatgcattatatggattggctatgcaatcccatttcaatcaaggagtggaaaagagagacttacggtgatggcggtggcgaggacgggcggcaatgtgcaaacggaggcacaaatagcggcggtgcagcgagaagaagcagagaacaaagaagagggaagcacaatagcacattgtag

SEQ ID NO: 27988 - DNA, 477 bp, Glycine max
  Peptide Sequence Number=SeqID_144766
atggcatctttgaagaaaagtggttgcacggataatgatgctaggcttaatgcatatgccatttggaaggaagacgaaggaaccgattttgatcaaccgaattggttagaacagtttactgaaaattgctctaaaaggacgatgatttcggcatttggggcatattcttcatcatttaatccagaaacaacattcgaagatgctaaagctgacacaccatctctaattgtccgtccaatggggaaaaaggaagccaaaaggaagagcaaggggaaaggagtaggaacatctaccaatcctgttgatctgactggtgtgaaggaagcaatgagggaaagaaatgttgtcaacaccaaactagcagccttaagggagaaagaattggaaaatgagtattacgacattctaatgaaggacacttctacaatgtctggaactcaactcaaagaccataaagccttttgtaaaataatttga

SEQ ID NO: 27989 - DNA, 192 bp, Glycine max
  Peptide Sequence Number=SeqID_144767
atgtgcaggaatgtgaagtggaacccttcatcaagctcaataccgatgggagttcacatggaaacccaggaaatgcgggctatggtgctgcgtgctattctaaatggtctcaagttggctcgtcagtttggttattctcatactgtttgtgagacagactctaagattgctattgatatgatttctgattga

SEQ ID NO: 27990 - DNA, 177 bp, Glycine max
  Peptide Sequence Number=SeqID_144768
atgaaaaagaagaagattgcaagttacgggagtcgatttgatgaagaaatgagtaaaataggaaggtttggaggtttgggaatggaggaacgtcgcaagggggaaggggttgcgcaggggtttctggaaaacgtgatatttatagagcaggacgcatggccatctgttctagtgtaa

SEQ ID NO: 27991 - DNA, 493 bp, Glycine max
  Peptide Sequence Number=SeqID_144769
gcttgaaaacgagatcaggaagctaggagggcttctggtaatcaattaccaagggatcgtgatggcggcgcaactaatccatgatcgagtggagatggagtgcctagagggagcttgggagaccctcgaaggcaacacgaggtgccgatttcggggcacaattcgattcacggctacttcattggtgcatccagatgaacccgcgcacacgcttcagcgtactgtggagtggatactacccacgcctacaccataccgtctagtggagccagtccaagtgatcgaggtgatgtcatccgaggaagaccctgaggaggatcctgaggagctacctcctaagcctgctgtggatgctcttgactttctggagtgcgatgaggacccactccctgaggtggattctctcgaggacgtcatgtcggcatctgaggcagactctacggaggatagtggccctggagagatggcgatcagtggaggctcttcatcatag

SEQ ID NO: 27992 - DNA, 1467 bp, Glycine max
  Peptide Sequence Number=SeqID_144770
atgtccatggcctccacgaccagggacgagtcctccgacaacgacagcacctgctcctccataaccctcgccgactccacccgcagctggctcagcaccttcagcttccgccgcagcagcagcagcaacagcagctccctccccctctgcgccgccgcccctgacaccacaaagtctgcatcatgggaggccatgcggcgcctccgcctcgacaccggcggcatcggcctcgacaacttccgcctcctgcggcggctcggcagcggcgacatcgggaacgtgtacctctgccagatacaaaactccatggtgggacggccgcagagcctctactacgccatgaaggttgtggacagagaagcgctggccgtaaggaagaagctgcaaagagcggagatggagaagcagattctggcgatgatggatcaccccttcttgcccaccctatacgctgcgtttgatgcctctcattactcttgtttcgttatggacttttgccccggtggtgacttgttctctgcgcgccaacgccaaccagggaaacgcttcaccatctcatccaccaagttttatgcagctgagacactagtggccctggagtatctccacatgaagggcatagtgtacagggatttgaagccagagaatgtgctgataagagaggacgggcacattatgctttcggattttgatctctgcctcaaatgcgacgtcgttccgaagctgctgagaagcaaaaccagttcagaaagcagtgtcaagacccgaaggagttcagcaccatcttgtgttgcagcccccatgcactcatgtttctctgcctcaagcaagagaaagaaagtggtcacaacagcaatcataagggaaaatatggatgtttatgaagatcaaagtcagcacaaaggccatgattattgcacgtccggccttggcgaacatgacacagagatagtggcagagcccatcaatgcaaggtccaaatcctttgtgggaacccatgaatacttggcacctgaagtgatttcaggaaatggacatgggagtgcagtggattggtggacttttggggtgtttttgtatgagatgttgtatgggagaacacccttcaagggtgagaacaatgagaagacccttatgaacattctcaagcagcccttggcatttccaagggtctcttcagtgagtagttctagcaaggagtttgaggagatggtgaaggttcaagacctcatcagcaagctccttgtgaagaatccaaagaagagaatcgggtgctgcatgggctcagttgagatcaagaggcatgagttcttcaaaggggtgaattgggctctcattagatcagttaggccacctgaggtgcctgctgaattgaacaagattaggagtagagtttcgttacagaaattaagcaagaaagacaaggatcaaccatatcagattactcatcattttgattacttttaa

SEQ ID NO: 27993 - DNA, 411 bp, Glycine max
  Peptide Sequence Number=SeqID_144771
atggagagaaataacgaggattcaggttcactcggtctcgcgtcatggcctcactactgcctccctacactcgtgctgtcgactctgtcgcgactttgcctcatgtcaagaccaaagcggcaagccactaagttcatccccaaccacaccaccctccaccacccccccggtggtagcgccgatcaatgtggtggaccactgcctcccctacgagaagcacaacttctacgacgtcaccttcaacaacaccgtcctctacgaccaccaccaccacgtgctcaccatgcacacacaagttctattgcaaaagcaggaactgaagaagctattcgtaaatccaagatttctgagtcccaatttgagaaaggactgacgttatgtgatggggatctgggttcaatgaaaatctaa

SEQ ID NO: 27994 - DNA, 207 bp, Glycine max
  Peptide Sequence Number=SeqID_144772
atggtagttattactactaccttgggagaatttggatggatactgatggaaatcctattcaagctcatggagggggcattctatatgatgaaagataaagaacatactattggtatggtgaatataaagatgggcccacgtaccatgctcacaagagagcatctgctcgggctgattatcaagcaggtctatgtttataagaaataa

SEQ ID NO: 27995 - DNA, 234 bp, Glycine max
  Peptide Sequence Number=SeqID_144773
atgacagtttccaaactcagaatgatgcaaagccgcgagccaagttggaagattccgcttcggttgaagggttcctctcgatgtgggatttcaatggagaacaatggcggtttatggtggctactggtggctgtgggtgatggagaaagtgtttgggacgttggaaatggttttggaagaaaggaagagaaggaaatgacatttttccaaggctacacgaaaagcaaaggctaa

SEQ ID NO: 27996 - DNA, 585 bp, Glycine max
  Peptide Sequence Number=SeqID_144774
atgggtacatccgaagtctctatgactcatgtttatcatagcatggtggacgatggttcccacatctatctagtgctctatgaggacaacaagctcataacatctcaaaatttgttggcaattcaaaagttgaagtcactacttagtagtgaatttgagatgaaagacaagggagctcctgaaaagattctgggcatagagatcaagaggaatcaagtccaaaagaagccttttctgtgccaaaaggaatacattcagaaagtgttgaatcattttgggatggtatccacaaaaccagtatgtactcctctaatagtgtccattcgtctatttgaactcaatactaagtcaggatctaagaaggaatacatgtctcgtgttccttatgcaagtgttgtaggtagtcttatgtatgctatggtatgcgccagactagacctagcacaagaagtctatgttgtgagtaggtatataggcaatcctaggaagaaacattggcaggcatgttctaagaagcaagttcatgcactaattggatctagctacttaacgtcgattgttggaaacgaattgaatcacttgtaa

SEQ ID NO: 27997 - DNA, 833 bp, Glycine max
  Peptide Sequence Number=SeqID_144775
gctggaacatctctcgtgctgaagctgaagcttctgctcttatggaagccatcttatgggtgccagaattaggtctcaacaatgtcacttttgaatgtgacttgtcctctgtgtttaacttaacggtgacaaaggttgttgagccatttggtgtgtgctaccctgtgggtgacctcacagagaccagagtgggactcgtggtgcccaccattaatctcgtgatgcacaacgaggacatgttctggagagtcttcgggggaaattcaatggtgagggtcgccaagggagaaatggatgtgtgttgcttgggttttgtggatggtgggacccgtgagagaatgcccgttgtgatcagagggcatcagttgaaggataatctcatgcagtttgatcttgactccaacaaattcagtttcacctcaactatgttgctccagggtaccaatgtgaggaagttatccaagatgacagaaaagctaagcaaatttgtgcttaatggtgttggtatagttagtggatcaatgatggctcatgtgcctgctctgtcaattggcaatgtaaggcagctagttgaagatcttttcatttcatcaatgggttcagagagagttgggtatttggatgatcctaacattttgccttgtgttggcaatgatgcttatggatcttttccttttcctcaaggagaccttgcccttcctcatgaagcttatgattccctttctaatgctctcactatcatccaacagagatcgccagtggttaaggtatcacccgagtcatttgcaatgtgtggattgttccttataagcttagttgttggtactcgatag

SEQ ID NO: 27998 - DNA, 489 bp, Glycine max
  Peptide Sequence Number=SeqID_144776
gagcaagagcctcgcatttgtcggccgccccacaatctctgtcatactgaccctggggtcatgtggcacgcagagacaaattatggtcattctgcgtcttttgtcatccagaggcggtgggcccggcagagacaaattgtggtcattctacgtcttttgtcatccagaggcggtgggcccggtgacattcatgttcgatggcacgcagagactaacatcgtcttctgcgccttttgtcatccagaggcggcgggcccgatgacatgcggagccaaattatggagcagcaaaaacgcgcagagacaaattatggtcattctgcgccctttgtcattcagggacagtgagtcgagagagacaaattatggtcattctgcaccttgccacccaggctcgattgtgtccgaggacacgcagagacaaattatggtcattctgcaccttgtgtcaaccaagaggaacgaactcggcagtatcaggatgatgttg

SEQ ID NO: 27999 - DNA, 264 bp, Glycine max
  Peptide Sequence Number=SeqID_144777
atgcttctagcggggaaggagagtctgctgatgaaatctcccataaccataaatgagatttcggatgttagcatttcgtttctaaatgaccatttagaggaaacattgggttcgacaaaaatagaagaaatccactcaaagtgtatcaatctcgcacagtgcggggcgaaaaagtcgctagcgcacgggatttcggttggtaatcaaaaggagaagaccattttaggtcgtggtttcctttccttctttttgttcatttggtga

SEQ ID NO: 28000 - DNA, 294 bp, Glycine max
  Peptide Sequence Number=SeqID_144778
atgggcgcagaagacgacgttagtctctgcgtgctatcaggcttttcgtcttacagacagcaaaaaagaatgtttatacggataaccactcgggaatttccgcccgtcagcgtgactcaaatgtcaacagcaaaaaagaatgtttatacggataaccactcgggtatttccgcccgtcagcgtgactcaaatgtcagtatgacagatcttgtgagcgcagaagatgacgtaaatctccgcgtgtcaacgggcttgtcggccgcgattgacgaagggcgcagaagacaacgttag

SEQ ID NO: 28001 - DNA, 721 bp, Glycine max
  Peptide Sequence Number=SeqID_144779
atgggaggatacgtaggagcaaaagcctcgcttttgtcgaccgcaccgctttctgttaccatgacccaagagttggtagcccgcggagacaccttacggttatccgcacctcgtcatttagtgaccccaagtgtgattgatgagcagaggccaatgtggtcatctgcgccttttccgaagatgtcagcattttccgatggagacttttcaagtctcacaagttatcaagactacgtagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaaagaccaagtttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaa

SEQ ID NO: 28002 - DNA, 343 bp, Glycine max
  Peptide Sequence Number=SeqID_144780
gggaggagcttgccacccagctcgcccaggcgagctaggttgcttcctccagaagcaaccgccttctggaggaacatcttggaaggctcaaaaccttacggattacgtaatcatcccttttttgccttctggaaagttacggaactttatggattgcgcattaacacttccttttaatttctggcatgtcacggaatttcacggattgtgctacaacgcttttcttttggcttccggcatgtctcagaacttcacaaatttcctaacgatgggtgccaaattcctcgaagtggtcaaacgagggtcgcatcccaacaacggatggtccccggacaaaattagg

SEQ ID NO: 28003 - DNA, 639 bp, Glycine max
  Peptide Sequence Number=SeqID_144781
atgctcggcctccagcattggcctagaattgcccctgcagctgctctgtacaatgtcctcatgtctgctactttatctctgcctatagccgctgcaaggctctcaggcgggaccgtggatggcattgttgccaatccgaagaaaaaagagcttctcaatttcctggccatgggtattctcccagctatcctttttctattggtttccattcccgctaggggagtatttactcgtgtggctgcttctatgctgcccgaggaggatgacccgatcgtgcccttcgaccggcggtttggcggcaaggtgaaatccgcaatggtgggtggcagcggcgagctcagccttctggatgcctggactagctttgattgggctgctcgcattcattacattaaaattatcctgaaggctcttgttattgaggttgctctgggtgtagttgggggcctattagtaatgggcgagttggaattgaaaagagtcatcccaagactttccaagaacaacgaattttacatgtgggctggagatttccagcgtagtgagttcgatataaccatgaaacagtgtgctgtggaccgtagcgcagtaatatctgggcctatcggactagtagacaaaccaactgatcgggtctag

SEQ ID NO: 28004 - DNA, 551 bp, Glycine max
  Peptide Sequence Number=SeqID_144782
ggctacgcgccctcaccttcagagggctacacgccctcacctttagaggactacacgtcctcgccttcagagggctacacgccctcgccatcagaggactacacgtcctcgccttcacagggctacacaccctcgcctttagaggactacatgtcctcgccttcagagaactacacgtcctccccttcaaagggctacatgtcctcaccttcatagggctacacatcctcccctttagagggctacaccttctcgccttcagagggctacctgtcctcaccttcagaggactacacaccctccacttcataggactacacatcttccccttcagagaactacacgtcctcgccatcagagggctacacgtccccgccttcagagagttatacgccctcgccttagtagggctacacgccctcaccttcagaggactacacgtcctcacctttagagggttgcacgccctcgccttcatagggctacacgctctcgccttcataggactccatatatgctccttcagagaactcaaggtcctccgcccttaa

SEQ ID NO: 28005 - DNA, 288 bp, Glycine max
  Peptide Sequence Number=SeqID_144783
atggccttccttcactctttgtcagcagttgagctgggccgatgtgaccgaatagttcagcatgcacgacgaccgcctggtggaatcatggacctggtttgcggtcaccagtgtcgtggttatctggcgatagtaagcggtacccttcgcttggttgctcggtctgacatccgttcccagtatctccaggggtatgctcctgggtggattgaaaggtctgatggtggaggattatatcatgctattgacttatgtatgttcaccgtggttgatagatacttatcttaa

SEQ ID NO: 28006 - DNA, 753 bp, Glycine max
  Peptide Sequence Number=SeqID_144784
atgggcatagatgcagcagttttaatgtgtctaagagatattaggcataatcaatttgaagactccctaattggaacagtcgaaaccagcctaggacaaggtccaatatattttaattgttatccaaacaaaatagtgagtctgatggacagaaacattcttgactctctgttcttaaacatccactttcatggccttgacatgaaagaaggatcaatcccagcagccttaatttataggatccagtacaaggtcatgaatacttgtgcatctagagtcctgttaaaacctcaaagaggagaaacaaccttgtttatcactgatatgacaaaggctaacgtgtctctcccaagaaaaataaaatgggatgaagtaactcttcccgaaagatgggttatggataaggccacaccgtctattccccgacccgctccaaccatagagcatattaagcaagataactccggaaaggtagagataaccttcaataggagaaattctttttcatcaagaatagaagcctctaggtctgaatatgagtcagccagaaggtctttttcagttagaacccgttcaattccagtaggactaaccagatctgagtcacataaccagttccctactgtaaacctccaaggattagacactacttctagcatacctagaacaacttacaaccaagaacaggaggacgaccaaaagtcgatccaatccccaacatactcttctatggaaccttatgatgttatttga

SEQ ID NO: 28007 - DNA, 970 bp, Glycine max
  Peptide Sequence Number=SeqID_144785
atggaactgagcctgcagcaacatttgcatcgcaaggcgacggggttcgcgcaggagtcgatcgccacgctgatcctctccggcaaatacgtcggctttttgccggatcactacgcggcgtttttcgtggcgcagaacctgatgcgggcgatcaaaccggcgctgttccgctatcactgcgaatactccagcgtgctgcgccgctcgccggtgccgcagcgggtgtcattcgacgcgaaacgcctcttcgatcatccgttgccgctgcgccggcgcatagtcgatccaggaattcttgctgttggatttctccagcgccaccgccagttcctggccggaaatcggcaaatcgtcccgccagaacggcgcgatggcgtggcgggtgatgaaatcggtcaggtagctctccgggctgccctgccagtgcggatacaggcgcgcggccagctcggccatcagcgcgcgttgctgcggctgttcgctgctttccaacagggcgaggaacggcagcagcagacggccgcagacctggccgtggtggtagtcgcgcagcgcgccaatctcgccggcgatgccgtggatcacccccagcccggcggcgctcagcgtcagccccccgaggtaggaagcctgcataatcgcttcgcgcgccgcatcgctgcggttgagcgccggccaggccgcaaggaagtggcggatgccgctcagcgacatgtcgcgcgtcatggcgccggcggttttcgacagataggcctcgaacaggtgggtgaaggcgtcgatggcgcagtaggccagcaccttgtccggcgcgcccgccagcagctgcggatcgagaatggcggtgtgcggcacgaagttattgtggcgcagcgaggccttcactttgctgacctgagtgtcggtgatcaccgcgttctgcgtcacctcgctgccggtgccggcggtggtgggaatggcgatcagcggcagg

SEQ ID NO: 28008 - DNA, 837 bp, Glycine max
  Peptide Sequence Number=SeqID_144786
catcttgttggcgcgcaccgagcccatggcggtgcgcaccgtgatgcgcgacccatactccacgttgagcacgctgctgttctcgaagattttcaccccgtagccgctcagcgccttggcctcgcccagcagcaggttgagcgaatgcacgtggccgccgcccatgtgtttcagcgcgcaggtgtaggcgtcggagcccaccacctgcttcacctccgccccggtgtagagctcaatctcctcctgcggcgctaccgccctgaactccttcagccagccgcgcagggtcttctcctggcgcgcattgctgccgagatagccgtagccgaagcagaagtcggcgtcgatgtcatatttcttgatgcgttcgcggatgatgccggcgccgaggttgctgattttgaagatggtttccagcccggccgggccaacgtggcgcttgatcttctccagatcgtggccgatgccggccatcacctggccaccgttgcgcccggtgccgccgtaacccagatagcggccttcgagaatggcgatgttggtgatgcccttctccgccagctccagcgcagtgttgatgccggagaagccgccgccgatgatcaccacgtcgacgtccagatcctcttccagcgtcgggaagcgcagatcgctgaacagttcggcctgcgagccgatgttcagcttgccgtagatgttcttgcggtgattttttaccgtgccgaggctgatgaacagccggtcggcaatctgctgcgaaccgcagccggcgaggataagatcgacgatctcgcgctcgcgcggcgtcagcagatagcgcgcctgcgcgccatcgtc

SEQ ID NO: 28009 - DNA, 488 bp, Glycine max
  Peptide Sequence Number=SeqID_144787
gtcaaggcatcttaggggcggtaccttctaatcccaaagatgataaggggaagacaatagaaaagcaacaccctaaggctagtatgcaagagaagactagctctataaaatgctttaaatgtcttggaagaggacacattacttctcaatgccccaccaagaaaaccatgattatgtggggccaagacatttatagtagccaagatgaggcttctacttcaccttcttctagtgaaagtgaagaagcaaaaggagaagaatctagggttcccacgcaccgtaggagaataaaggtcattcatgattggcctactccaccaacaccactcattgagttggtgaggaaccaagttccctcgtgggaagatgcccaggataggggtgtcgaaggaaggagcccagagtatcaagaacctcgagatttgaggtcaaatcctttccaagggggtggggatgatgcaatcctaccctccaagggtattggatag

SEQ ID NO: 28010 - DNA, 249 bp, Glycine max
  Peptide Sequence Number=SeqID_144788
atggattcatgccccgttgcaactttcgaggttcatgagtatttgagacccaagattgtgcgtagcaactggttcttacaggtctctgatacaaacttaatatgtggttcagttgttcttggaattgtttatcctgcatcttatgattttgtttcacttgttgacagcaatctttttcgtgtgtttggttgtgaccctggaagtgctgacgctacaaatctagaagccaataaaaatccaatgagctaa

SEQ ID NO: 28011 - DNA, 177 bp, Glycine max
  Peptide Sequence Number=SeqID_144789
gatggcatacaccagctgacacttcggcagagggaggtcggagttatgatcgctgggcaggatgttgctgagcagcaacatcatccacatctgggtcaaggtggtcatgctggtgcgcatgatccgcacccgcctcccggcagcggtccgggcaaaatcctgacccggtatgcataa

SEQ ID NO: 28012 - DNA, 846 bp, Glycine max
  Peptide Sequence Number=SeqID_144790
atggcctcagaatcacacgatgattctaaagtagacctccaaaaacaaatccaaaagacaaaacaaaccaaaacagtttgtaaccagaaagaaaaacgaatgttggctcaacaagacccaacaccacaacccaccaacaactatatttcaaaaaacaaattctttaatgtcctacaaatggagccagaatattgggacaagaatcctttcaaagcaaccgccaaagtcttcccccaagggtttcattatagaccaacagccctcaataaaactagaaaattctatgagttcattctagtggatacaaattcagtatccatcaaacatttcaaggactcaaaagatccaagcctaaacacccactccaaaatccaaattctgaaagtaatgcagccacggcattacggaaccaatcttaaccaacccaagaagttttctgcaccttttgacctagcaggatacacttattgggattacattgatgcctggaccaatgtattttggcaccagaataataaattcaagcatccatcgttgatttacttcaaaaatagtattgtttaccattttccaaactggtttctccaatggtggaattattttggaccaataccacaaatattcccagaagaagtccaacagggatttcaacagttcaataaattattcaacagccaggaattaagaattctagccgatttaaagtatgggaaaactgaaaacaacaagcaatatccgccgttgcaaagacatgcttttgtaaaatggtggtcacaatttgatacctcaaacactactccaggccaagtcaagaactggttcccgagccaccctaatccattgtaa

SEQ ID NO: 28013 - DNA, 195 bp, Glycine max
  Peptide Sequence Number=SeqID_144791
atgttgaacctgcggtgtctcgcgattgtgttcgatttggacgagaagctcatcgtggcgaacacgatgaagtcgttcgaggataggattgaggacctgaggggatttaggcaacggaggggccgtgatggacatcggaactatcgtcacgaggcttccgacggtggcttacagacacctttctgttttgcataa

SEQ ID NO: 28014 - DNA, 624 bp, Glycine max
  Peptide Sequence Number=SeqID_144792
atgatgctattgcaccccaaccacaggcgtaagaagtttggagaggagggtgagaatgagtgtgatcaaaatggggagtttagcttcagaagaggctggaagaagaaaagcactcattccattggaagtgacatgtggagtggagatcttttcagccgtgagctcagtagcacaacaagcatgagagggacactgtgttatgtggcaccagaatatggaggctgtggattcttaatggagaaagctgacatttatagttttggagttttgattcttgtaattgtgtcaggtaggagaccattgcatgttcttgcatcacccatgaaactagagaaagctaacttaataagctggtgtagacacttggctcaagctggtaacattttagaacttgtggatgagagattgaaagaagattacaagaaggaacaagcaagtctgtgtatcaacttggcactcatttgcttacagaaaattccagagctgcggccagatattggggatattgtcaagatcttgaagggggagatggagcttccaccacttccatttgaattctccccttctccaccttccaaattatacagcagatcaaggagaaaaccgaagggcactgcagaatag

SEQ ID NO: 28015 - DNA, 201 bp, Glycine max
  Peptide Sequence Number=SeqID_144793
atggggagagtcgttaaggcgttggaccttgaaacgatctcaagttggaccttggaaccctttactcagcctccctcacgcctatttatagcaaacaatggcataggagtcatggcagctcgcccaggcgagttgttgcttcaacctaaagtaaccttgctcgtccaggcaagctcagctcgctggttacttcacccctaa

SEQ ID NO: 28016 - DNA, 621 bp, Glycine max
  Peptide Sequence Number=SeqID_144794
atgagtgaaatagaagaggtgcaagaacagatgaaggccgacatggatgccatgaaagaccaaatggcggccatgatggaggccatgttgagcatgaagaaaataatggaaagcaatacggctgcagttgccactacgagtgctgccactgaggtagacccgacttacccatcgggcctcaatcaagtaaatcctctagtctcgaatatagtagggcagggaggcaaagtgttaggaaaacaaactttccttcctactatatggcttgcctcccaactatacacacccaatgttgcacacactcccgatgagaatgtcgacaactccgcacctatacccattgagagccaacaaccccaatctgatcatgcacatgtctctcaagccataggggagacacatgaagcaccccgaaaccacaatctagccgacttcaaacctcacctcagatgttccattgaggggcaagtagttggtggtgtacccctaccaaacacctcggggggccctcagtatcacccacaaccacaacccttgaattttgtggtgggaagagtctttcctgctatggtggaaagggagaaattcagtcatatagaggaaagactgagggccatttaa

SEQ ID NO: 28017 - DNA, 366 bp, Glycine max
  Peptide Sequence Number=SeqID_144795
atggctcaggataggatgcagctacagaacatgtgtaaaaagaagcatgagttgttcaaggaatacgcccagagggagatgataacaatgatagtagacaaattaccagtattctactatgagaagatggtgggttacacgccttcaagctttgccgatttagtttttgccggtgacaagattgaagtgggtatgaaaagatgcaaatttgatcatcctgctttgatgaataggaagcctggggcaaatagagagaataagaatgagggaggaacctatactgtgactgccattcctacatggccaaattccccaccagctcaacaatgtcaatattattggatcaagtggcctcagaataattaa

SEQ ID NO: 28018 - DNA, 579 bp, Glycine max
  Peptide Sequence Number=SeqID_144796
atggaggatctgacagagaggtcctttgtgtccactttcatcgagctgcaagtcttacggtggcaagtggtggttgtggtggtggttggtgtggctgttaacggcgaagtaagtaacttacagattgtcaatccgtatgttacttacggattgacaatctgtaagttcgtacggtttcattattcatttatggacgaagataagtggatgcatgatagtataatgtttgaagaagttgatatgaatgaaaaaaatgaagatgaagctggtgtgaatgaagaggccaagaagaaagatttagtaagaacaattactaggagtagaaaatgtgagtgtccctttaagctgcgtgcgaaactagtggttggaggcgaaggatggataatgaagttaatgtgtgggagtcaaaatcatgaattggccaagtcattggttggacatccatatgttggtccattgactaaggatgagaatattattattactgatatgacaaagtcaatgatgaaaccaaaaaatattcttctagcattgaaggagcacactgccaatagttatacaacaatcaagcaagtttaa

SEQ ID NO: 28019 - DNA, 144 bp, Glycine max
  Peptide Sequence Number=SeqID_144797
atggctcgcgtgaggggaccaaagcttttgatgctccgccagccactccgtaaggtactgatcgaaactccccaggatagattaggcatcgaacaaagtagcgctttccgcttgtcccgggctaggttaaggacgacgacctaa

SEQ ID NO: 28020 - DNA, 309 bp, Glycine max
  Peptide Sequence Number=SeqID_144798
atggccgactctggtgacaaaaactttctcttgtatgatattcacgaacggtatggcccattttcactaaccctatatagggagaagtgcaggaaccaatgctttttacataacttcggtctaccagataaaatgaaattatatatgaccataccgtgcaagaagaatagttcgaaactgtgtggatcggagttcttactttatgtccaccaaaagttggcgatctgttctgttatttctgtgatatttggggcaataccatgtgatgatagagtgggagggagtaataattcaaccgaagatatataa

SEQ ID NO: 28021 - DNA, 189 bp, Glycine max
  Peptide Sequence Number=SeqID_144799
atgaccaaatttggtctctgcttgtcatcgggcccgccgcctctggatgacaaaagggtgcggataaccgtaagaatgaccaaatttggtctctgcttgtcatcgggcccgccgcctcctgatgacacaccgggtgcggataaccgtaaggtatctccgcgtatcatcgggcccgccgcctctggatga

SEQ ID NO: 28022 - DNA, 222 bp, Glycine max
  Peptide Sequence Number=SeqID_144800
atgaagccctctgaaggtgaggacgtgcagtcctctaaaggtcaggacgtgcagtactctgaaggcgacgacgtgccaccctctgaaggcgagggcgtgcacccctctgaaggcgaggatgtgaagccctcagaaggcgaggacatgcaaccctctgaaggcgagggcgtgcagccctctaaaggcgaggacgtgcagccctctgaaggcgagaacgtgtag

SEQ ID NO: 28023 - DNA, 487 bp, Glycine max
  Peptide Sequence Number=SeqID_144801
atggcgcacgttcctggacaaggaagtgaccccgcgcttcccggatggcctgaccgtgttcgatgcctacggccagtggctgttccgcggcgatgccgcgcccaaccgcctgcgcaccaaggtgctggtggtgctgcacgaagacactccgcagcgccgtgccgatatcgaagcgatccgcctggcgtggaagcagcagaccaagcatcaatcggtgctgtggtcgcggcagccggtcgagggaacgatgatgaaacacagggagtgcgtgctgggcctggtgctggcgggattgctggcaccgtcggcgcaggccagtggcgacgacggcgaaacgctgcggttccaagtggccgctcacgtgcaggcgcacgccgatccccagcaggatggcagcatcgccgtgcagctgtcgccgtcgggcaagcgccagacgctggcgggcgcggccgatgccgacggcaattcgcgctggggtctggaggac

SEQ ID NO: 28024 - DNA, 507 bp, Glycine max
  Peptide Sequence Number=SeqID_144802
atgcttggtctgctgcttccacgccaggcggatcgcttcgatatcggcacggcgctgcggagtgtcttcgtgcagcaccaccagcaccttggtgcgcaggcggttgggcgcggcatcgccgcggaacagccactggccgtaggcatcgaacacggtcaggccatccgggaagcgcggggtcacttccttgtccaggaacgtgcgccattgcgcctcgctgatggtgtcggcctgcgggcggttgccggcaccctgctcctcgcccacgccgaagtacagctcactgcgcacccagccatggccggcggacggccgtgcggcatcgcccttcagttcggcggtggtggccgtggcataggcgctgggcgcctgcgaagaaaggctggcgcagccgctggtggccagcagcacggcgaagacgaggccaaggtgtttcatcggtacagctccggggaagggggacaaggcgagccggcagcgtacagcgccaccggcccggcgtgctga

SEQ ID NO: 28025 - DNA, 649 bp, Glycine max
  misc_feature (641)..(641): n is a, c, g, or t
  Peptide Sequence Number=SeqID_144803
aatgcaacaaccaattccagggtgtccttcgcaacccttgaatattcatggcataacgctgaaaggcaaacaagatgaaaattgggagcaactgttcaccccaatgatcggtcaatggaacaagcaagttgattttagggtcgacggttatcctcgacaagagggcttattgaactttaactccaactacatgagaatcactgagcctgtgtcacatggtccagcatcagagcatcaatttccagcacaagagtttcacattctccaatcaagtgttgaaactcaaggcatagacaggcgaagggtggttgttgaagcggaagaatattcccaacaaatggcagagcgtggccatggaatgtattacacaccaccaacattttctcagtatccaacacagatgtatcagtatcctttcaaaggtcatcacactgatatttctgcaagcaaacactcgtttggtggtgttgcggaaacacatcttcatttttcatggccaactatgaccccttcacagcaacatgatgccccaattccaacacctaacgccccattaggtacgcaatggaatgtacccagagcaattcctgatataggtgacttattaggtgctgatttgcatcaccaattttctgttgagnctgaccaa

SEQ ID NO: 28026 - DNA, 521 bp, Glycine max
  Peptide Sequence Number=SeqID_144804
gattcttggaggagcaagccacacaaggttcctttttcgcccatggacgtcaggatgtactgactactgccattgggcgactagaacaccctagtcgtatgcgtgctgctggagtcagtgtcacgatcaaacgatactttggatcggctccaaggacctcctgcacgtcttcatccatggctcccgaagacctggagcagctaacgcaaaagatcagggacaaactggaggagtcgatcacagaaaagtcgaatgatccagacacaggtgactcagagaaatatgggttgtacatcgaagaaaatcctccccacctggttgccctaggaagactttatgaggggtcgacaaccgttcacaacatccctttgagctatgatcaagtcaaggttggtgttgaggaatttagagatgcagatgctcacattcctttacccactaaagaggttcagttagtggggcaggcacttaacaccttcattgcatggctgacacatcttgtcaagcatttatcagaatag

SEQ ID NO: 28027 - DNA, 735 bp, Glycine max
  Peptide Sequence Number=SeqID_144805
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatactgccacaatgttatttgctaccactttgccattgccaaacttgtatcccggaggaaatccgcacactgtgtttcttgtaacaaacactctcggtatggccaatttgtctgcaaaattcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 28028 - DNA, 234 bp, Glycine max
  Peptide Sequence Number=SeqID_144806
atgtccattggatttaatgatgaaacatgtgcaatttcagctcatcaatggtctaagcacgcatccaccgctaagcgcagcttcggtgtgcttagtgcaacagaagaatctggcagagcatcaatatcaaggttgcacgctaagcacgagatcagtgcgctaagtgtagcaattgtcttcagccaggctcagcgcacgactggtgctaagctcaaatccacttactcgcgctaa

SEQ ID NO: 28029 - DNA, 324 bp, Glycine max
  Peptide Sequence Number=SeqID_144807
atggagcccaaacatattgatgatgcagtgcaagatgacaattgggttaaagaaatggaagaagaacttgatcagtttccgaagaataatgtttggaagttagttgaattgctaaaaggaaagaaagttgttggagcaaagtgggtctttcaaaacaaactcaacgaaaatggtaaggttgtgagaaacaaagcaagagccttatatgggcttaaacaagatcctagagcttggtacaaaaaactaagttcatttctcttgaaaaatggttttgaacgaggaaaggttgacacaacaatcttttgcaaaacctatgattcttag

SEQ ID NO: 28030 - DNA, 630 bp, Glycine max
  Peptide Sequence Number=SeqID_144808
atggggaagatgaatgaagcgcctcgagaccacactctagccaactccaagccttgcctgaatatgctattgaagggagagcatttgtaccacccacaaccacaacccttgccttttgcagtgggaagagtccttcttgccatggtggaaagggaaaaattcaatcatatagaggaaaggttgatggccattgaagaaggtggagattatgcctttgttgacatcgaagagttatgcctagtacccaacatggtcatccctccgaagttcaaggtgccagatttcgataagtacaagggaactaactgccccaagaaccacctaaagatgtacagcaggaaaatgggggcatactcgaaagatgaaaaattgttgatgcatttcttccaggaaagtcttactggggcagtcgacctaacggttgccttcattaggcagtatgagtacaattctgatatggctccggatagaatgcagctacaaaacttgtgcaagaaggagcatgagtcgttcaaagaatacgcccagaggtggagggacctagcagctcgagtagcgcccccaatgacggagaaggcgatgataacaatggtagtagacacattagcagtgttctactatgaaaagatg

SEQ ID NO: 28031 - DNA, 291 bp, Glycine max
  Peptide Sequence Number=SeqID_144809
atgaaagatgaagagaaaagaaaagagcaagatgatcaaaaagctaaaagcattttaacttttggtttatcttctaatgaattctttcgtactgcaaggtgcaaaaatgcaaaggaaatatggaaaatgctgaagccactcatgaaggcacaacggatatccttcctccagaaggctgttgcttctggaggaagcaaccttgctcgcctgggcgagctgggtggcaagctcctcccctattttgctataaatagggggaggagtgaagaagaaaggggttcagcttcttag

SEQ ID NO: 28032 - DNA, 645 bp, Glycine max
  Peptide Sequence Number=SeqID_144810
atgataagcacagaggggcaactgtcagaccctaatttcgtccgaggactatcatttgctgatgttttgattctcgctaaccgaaaggttttgttcgacaccagtttctgcacaaggcaccttggctcgcccaggctagcctctagctcgcctgggcccccaaatagcttagggctgaagaaaccagctcgtttgggcttgagggaggctaaagaaagggttcagccttcaacattgagaggtttcagtgaaaaattggggagaagaagaagaaagggtttagccgtcaacattgcgaccatgatcgatttctacattgttcttcgttcggtgttcttcgttcatcatccgaaacttgaatgctgtcatcttcttgttgacaagctcaacattcctctagaaggttctgatgagttcaagacaaacactgaacataatatcattgttctgtactatgtcccatccacctttgttgattcctcgtctggtccaagaatcatgctcatctcaaattctgtctacatcagctcttccatcatgctcatctcaaattctgtctacatcagctcttccatcatgctcatctcaaattctgtctacatcagcttagaaaaaatcttcacaaagatttcatcagtagcataa

SEQ ID NO: 28033 - DNA, 135 bp, Glycine max
  Peptide Sequence Number=SeqID_144811
atggcatttgtgccatatgcccttagacttgtcaagtctagttcccagggccctgaggatgactttgttagctgcctctgtctgtccgttagtctgaggatgtttgacagaggtgatcaggtgcttgatgcctag

SEQ ID NO: 28034 - DNA, 252 bp, Glycine max
  Peptide Sequence Number=SeqID_144812
atggctggccatatgggtagagatgtcatagaggagcaggtatggaggaagggaccttggactgctgaagaggacaggttgcttgttgagtatgtcaggttgcatggtgaaggcagatggaactctgttgctaggcttgcaacaaacaagaactctgagtacttcgacatccttaccttgacagtagcaaggtcgcgacaccactccaaagagcacgacttcggctatggcggtggtgggaacaataggtag

SEQ ID NO: 28035 - DNA, 207 bp, Glycine max
  Peptide Sequence Number=SeqID_144813
atggaagataaggatactggaagtaaacgagatgaagatgaaagcatacaaagcaagaatggaccactaaagaatgaacgaagaacggcgaagaacggtaaagaaacttccacggaatcgatcacagaaacgtctcggaagcgttacgaaagcgtctcggcttggattttttccttccttcttcttctcctcactaattttaagtga

SEQ ID NO: 28036 - DNA, 123 bp, Glycine max
  Peptide Sequence Number=SeqID_144814
atgactaccaagtctatggagaatcaactagctatgcttttgggagtaaaggtgttggatcgagcacttaccattgggccaaaagttataactgatagtcagggcacaactctttctacttaa

SEQ ID NO: 28037 - DNA, 432 bp, Glycine max
  Peptide Sequence Number=SeqID_144815
atgcaatggcggttccaaagtcagaaaagatgcaaggacaagctgaaattaacaagaaacaagcgtagaaccatggttacctcgaaggaaaatgaaaggtcaaacttgggtttcgttctctaccgaaaccgcgagccaagttggacgattccgcttcgattaaagggttcctctcagtgtggggttgcaacggagaacaacggcggtttgtggtggctaatggtggctgtgggtgatggagaaagtgcttgggacgttagaaatgactttggaagaaagaaaggagaagaaatggtgtttttcctaatctacacgaaagcaaaggctgaaaacgctcaagtgagaaatggtctcagacacgaaaacgttgcgcacactccatacatcttctcaaagatcccaacggtcagatcgtggaaatgtgtcttgtga

SEQ ID NO: 28038 - DNA, 801 bp, Glycine max
  Peptide Sequence Number=SeqID_144816
atggagagggagatgataacaatgatagtggacacattactagtgttctactatgagaaaatggtaggttatatgccttcaagctttgcatatctggtatttgcgggcgaaaggattgaagtgggcttaagaaggggcaagtttgattacgccacttcaacgagtactagcaataggaggactagaacatgtggagctaagaaaaacacaaacacaaacccaaggaggaacttcccagaaagaaaactcgtggagttcaccccgaaaccaatgccttatgctgacttgctaccatctttgctcagcaaccatttggttgtgtgtgtagccttcaagcacaaggtaaaaagcttgatcaatgctgtatggctggcatttcaagaggatagtccgaatgctggtatgattcaccttaatggtgacaaaggagcttcttgtttaatacatttggggacatcgcacaatgtggagacatgtccaatggcagaggagctgctacaaggaatgatgagtaggggacatattgaagtttgcagtgcgaagaaaggggaggaagacatactggtaagttgtccatcctctacgctttatgttgaggctgcagaagagtcattggaaacatcattccaagcactgggaattatgagcaatgcttatgtggaatctcctttggcggacaaatatgagcccggaatgggtctaggccaaaatgacgacgacacggcaagcttggtggagttccctgagaatcgtggagttcgatatcgaacgatacatcagagacaaggaatacccgcctga

SEQ ID NO: 28039 - DNA, 498 bp, Glycine max
  Peptide Sequence Number=SeqID_144817
atgtatgatttgcatctttacatctttaagaacatgcattctcgttcttgctcacttattctggagccattcgacacgtttagcagaggtgccgtaagcgttaacccttacccatggcctactccagagcagttcagggccactattgcatggcctgggggcaggcctaattttcaggcaggggcaggtcccaccgaggccccaggaggcgaagacgaagctgaggaaaatggtgacatgaaccctgacctaggatggaagtttccaaccttaccctgggataagaaagaaagggtatcttccaagggggagttccatcaccttttggggtgcgaaaaggccaaaatagatgggtcgaaaacgtttgtcttcaagggagaaaatgagtggagttgccaccaacatttatttgaggaaaacgttagaaaaaccaaaaaagaatctgcggattttgaaaataagggttcgggagttgtttatgcacggggaatgtattag

SEQ ID NO: 28040 - DNA, 102 bp, Glycine max
  Peptide Sequence Number=SeqID_144818
atgggagtgggctttgtggctgatttaggggtagcctttgtggatgatagagcattcttggttgataggtggtgggtaatgagaagggttgatattggctga

SEQ ID NO: 28041 - DNA, 855 bp, Glycine max
  Peptide Sequence Number=SeqID_144819
atgcaatttctgcagcaacacgaccctaaaatccctaaacttcagaactcgatttctccctcaattcttgaccaaatcacgtcccacaaagcccaaaattcatcatttttttcattctcgttcatctccaccgatcaaaacttccaaaaactccctcaaatggcagaaccattgaagaagcgaaaaggtgtttcgacttcatccgcagtcaccggaactcgtagccacggagcattcaaagcacagacaacacaaattcctccctccatatcatctcctgcgttgttttcctcggaagaacaacatatccggtacagttcccatttctcttctcgttccattatcgaccctaagtttgtagacttagctttctttgatgatgaagtgtttgattgttttcaagcatttcaaaattctggaataatccaatttatttccatgaaacttcctttctatcctgaattagttagagccttttattctaacttagaaattcaagaaaattccttgatttttgagttatccagtgatggtgtaccctttgaaggtacacttgatgatgattggaagtttgacttttctatttctgatgcccgccgattggtttgcaccaatctagcggatattatcggaaggtttcttgtcagatcattggcattcgaatactgcatcatgcattacttgattgtgcacatcctacttcctagatcttccaaccttgcacaggtttctaaggaagatttgataattatgtgggttctatcaaccggtcgtcaaatcgactgggcccatcttgtgagatatcgcatgcataagtgttcggcttccagcaagtgcaccggatcgcacaagtag

SEQ ID NO: 28042 - DNA, 509 bp, Glycine max
  Peptide Sequence Number=SeqID_144820
atggtttacatggatggggacctaacttgtgagctgaacagcgacctcaaggcggtggtggtggctccaaatggctccatgacggcggagcaaccagccaatggcagactccagcaaattccggcagcaatcatcattctagttcttgaaccttcctcagttgaccctcacactctcatactcattcgctcactcgctccaagtcctgctcccgccctgccacctccgaccccgctccctccccctaccgtcgcccctgcgccgaacacatttgctgaagacattggtcactcagagaccaataaagagatttatggtgttttgtctttggtgttctggactctctcattggtgcctttggtgaagtatgtgttcatagtgttgaaagctaatgacaatggtgaaggcagcactaacgcaatggagcaaccacccaccgaagccgtggaatccttatccgtctccgaccctgagatcccccaatcatccaatcccaatccaactcattt

SEQ ID NO: 28043 - DNA, 524 bp, Glycine max
  Peptide Sequence Number=SeqID_144821
atggggacaaatcaaaacggcaaaaggttttatcaagtcaaggttaaaagtctagatgtcaccagcctcaaggaattgggacgattgatgggacctctccaaaggcaagctttccgcaaagtgtatgggaagattctagatttgaccacagcagaggtatttacgggagctgtcgtatccctcgcccaatactatgaccatccgttgaggtgcttcacgtttggggacttccaaatggtaccaactattgaagagtttgaggaaatactaggatgccctcttgggggaagaaaaccgtatcttttctccggttttcttccctccttgagcaagattgtagctgtggttgaggattcggcaaaagagttggatcgcatgaagcaaactcgcaacggcgtagtaggcctgccacggaaatacttggaaggcaaggcaagggatatggcgagccaagagaagtggggccccaaggagagtccagtggtggctatcttggcagatttgtttgacacctttgaccagag

SEQ ID NO: 28044 - DNA, 312 bp, Glycine max
  Peptide Sequence Number=SeqID_144822
atggagggctatcaatacacttgggcaagacatagcggaaagtatgatgatgtcaaagggaagcaagaacttgaagccatttgccattcccattatgcaaatgatgttgttcgtttttctaaaattcaaaagcaactaaaaatgttgatagctcaagaagaatcatattggcgtcaaaaggcaaagatgttgatggggacatcaattctaaatttttccacacaacaacaaggaaagcctctaacaacatctcatctctcactcgtgaagatggtgccttggtctatgcttaaaaagatatgtctgatgtag

SEQ ID NO: 28045 - DNA, 240 bp, Glycine max
  Peptide Sequence Number=SeqID_144823
atgaaaaagaaatttggaaccaagaatgagagttttgcacgaaaatggcgaggaaacaaaaagagaatgaatattaagaatctctcttaccaaagctttaagggaagaaacctcaagaccacttgtatgaagcttggaagaagaagaaaatggattcctctcctccccttgaagaactcgtgcataacaatggagaatgaaggttccaagtttgatatttttggagaagtgaagagataa

SEQ ID NO: 28046 - DNA, 171 bp, Glycine max
  Peptide Sequence Number=SeqID_144824
atgggatcttcgttagcgatgggattttcatttcggtttgatgtttgggtttatggttgttgtgaaggtggcgtaaagggggatgaaggatggttttattggtcaaatgaggcggtagttgtagttgtggacatgagggttgtggagacgatggttgtggttgaaaaataa

SEQ ID NO: 28047 - DNA, 360 bp, Glycine max
  Peptide Sequence Number=SeqID_144825
atggatgtcgaaatcaatgaaatgccaactcttgttgcagatggtaatgatgcactcactggtcacataatctcaaccacaatttcaggcaaaaatggcgaacctaaacaaaccatcagttacatggccgaacgtgttgttggctctggatcattcggaattgttttccagatctttaggggactggcgtatatccatactgcaccaggaatctaccatagacatgtgaagcctcaaaatcttttgattgatcgactcatacaccaagtcaagctctgcgattttgggagtgcaaaagttctgatgaaaggtcattggttggggtcacatgctaatttgcttttagtgatttgctcataa

SEQ ID NO: 28048 - DNA, 186 bp, Glycine max
  Peptide Sequence Number=SeqID_144826
atgactagcaaattatactcagaatggttacatgatagaagcatccacaacaactcttcccctcaccaacctcatgttcagcgaaccacttgggaacctccaccaacaggagaagatggaatcttcattaaaacaagaaattgtatcttcaatggcagtccaacaccagctcaagcagaagagtga

SEQ ID NO: 28049 - DNA, 318 bp, Glycine max
  Peptide Sequence Number=SeqID_144827
atgattggtcttagtggaaagactataggtgaaccgccaacatgtaaacatgcaacaagaaatcattttttctgctctccccattccttgacgcctgagaaaagagaggaaaggaagacgaagcttgctccaaggcttgttgttggaagaagaaagctagctttgatggaaattagacgtaggagaggatgggttaaggtggtgtcgtggtatgttgtagaggaagtgagaaaaatggaaaccaaaggaacttacaaggtgtatgtgtgttgtatgcgagaagatgaaaatggagttgctgaatggttccataaatag

SEQ ID NO: 28050 - DNA, 147 bp, Glycine max
  Peptide Sequence Number=SeqID_144828
atgggggattgggttttgagatgggaaagtggggcagaagatgaaccattgtggacaacaaagctctccttccgagacctccggttaagcaggaagaaccctacactagttgacccatgtgctcatgaaagacaatataatagatag

SEQ ID NO: 28051 - DNA, 1980 bp, Glycine max
  Peptide Sequence Number=SeqID_144829
atgaagactcttatgcatcccactacacatcttggactgaacgaggaatcaacgaaggtggacgggacccagtacagagcaatgatcggctcactacagtatcttactacgtttaggcctgatataacggaaagtttcaggctcataagctattgtgatgcggactatgctagtgataaagtagaaagaaaaagtacaagtggaagttgccttttgatagaaggaaacctagtcacatggatatgcaagaagcagggatcaactgtattatccactactgaagcaaaatacatgaccttctggcaacatgatgagttcatcaacaaaaagaccatagcctccaaggttttgggagtgaaggtcatattgtcaagtgacaccattgctaaggcaacaaggtgtttgtgcgagggcaatacctacatagaaggttgggaaaagaactacgactcccacgtcaccagagctctctactgtgacaatgttgacatggctaatgatccgaagatgatctacaacttgatgtgtgaaaaggaaaaaatattactacacaaggctggctccaagatgaccctttttgacctccacaagttcatgatgtctttcttgatggagaacctaccatttgaccttccacacataatatatatcaacattgtgagaaacctcaaggacttaggtggtctggatgacgtctactattcaactctcgccaacaagcttctattggatcaagaagtttatcatgtgttcaacaagatggataaggactcaaaacataccttaatagttcacggttcagtagtcactaaacaacaaaagtttagcaaagctaagctgaaggctatgaaagtggccttggaacaaactttgaaggaggctccaaaagtggacatggaagccattagcaaagaagaagaaaaccaagaaatagtcccaagggatgaagaagaaaaggaaatgttggcaaaggagcaccagagcaaaagaaggcatgagtttgccgtgtttgctcctgctcgtccacccgtagtaaacctagttgcacaaagcttgaaaaacctaattgagactaatgatgatggtgaaggattggtacgagtggccctccaaaagcaaaaagttattgctcctaatgtacttgcttctaagaaagcaaagaaggctcaacctgcaactgaaccacgagcgtccattcttccttgggccattccacgacgggtcaagtcaagggctaccaagaccaacccaaagatcagtgacaaagaatgggcagtttccttcacaggaaacaaggaagatccaacctcttcctcatcaaatagtgagttcactgatgacactcccctcatgccactacctccaagggagccattggaggatgctcaacatttccctctagcctacattcacgataatcctacaccactctctccctattctaaagtcattttcactgaaccagtggtaatggaaaccatatctactgaagcacccatctggacatgcctccttattgactaccacttggcactcaacaatgggttcaaccctccactgagggcaactgacatcaagatggttgctgataaggtttgccctcatttaccagtatgggatgctgccaagaagcaaggattcgagctgtattacaaggcacaaatgccctataggcatatgaagatagtgtggatggattctaaaaaatcctcaacccctacctatgatggaagtgatgttgttgtgccacacaataatgtgcaattgttacgacctcttccctccattccatatagaggaaactacaacttgaagaagatgacggaagctcaaatgatagcccatgtgactccaatccatgaggctcaaaagaagaggagagctgaagctactgctgctaagattgatgagcaagaagctgtcactactgttcaagttgaagcatctgctaaagttatggatgacaccattgtgcgttga

SEQ ID NO: 28052 - DNA, 267 bp, Glycine max
  Peptide Sequence Number=SeqID_144830
atgggttcgaagatagaaaaattgaagaacattattgtcagtcttaagaaggcagtgctggcagaggttgggaaggtggtggaaaggatggaggtggtggtggtatcggagccaagggttgtggtgggggttcaagagacgaaggtatggagagtggtggagaaacgggtgcaggtgcaggtactgcaacaactccaagcattgatagctaagcttgttggatgttttgtaaaagggcaacaccaagattggagaactgcgttgtaa

SEQ ID NO: 28053 - DNA, 378 bp, Glycine max
  Peptide Sequence Number=SeqID_144831
atggctttgaagaagcttcatgctaaaagggctaggaaggccatcgcagggagggatccagcgggtccaactaagagaatgagagtacacaaaattccaagcagaggttgccaggaggcaatggacccagctgacagagcccatggcaaaggccaatggatcccctatgatgaagatgctatcaaccaattccaagggcatcctttgatcctagaggaggggcaacattgtgaatacaccgaaagaagaagccaagtcttaggttttgatgaagaggccataggccagctactgtgctccctgaaacaggattttgcatggagtgtgatagggaggcaagtgcggatcatgcgcactagcatgaccaccttgacctag

SEQ ID NO: 28054 - DNA, 219 bp, Glycine max
  Peptide Sequence Number=SeqID_144832
atgcagcatttggctgaccaacagcgccaggacctcaacccttacccatggcctactcctgagaagtttagggccactattgcatggcctggggatgggcctaattttcagcttctcactaagctaatctgccagcttagcgagccatccgctgagcgcaccactcttgtggctgagcgcaccactcctgcggctgagcgtgagaaagaatctggatga

SEQ ID NO: 28055 - DNA, 444 bp, Glycine max
  Peptide Sequence Number=SeqID_144833
atggagttcaccccaataccaatgccttatcccgacctgttaccatccttgctcagtaaccaaatggtcgtggtgagcccgggaaaggtctatcaacctcgctttctccaatggtacaatcccaacgccacatacgcctatcatggtggtgtcccagggcactctatcgagttgtgtgtagccctcaagcacaaggatagctcgaatatgaggactaatccacttgccaatcatggaggcctggcagtgaacacggtggaaggatgggggtctcgagggctaaagcgaataggggatgtgtcgacttcccgacagttcatattggaagcattgcatgaagccgatatagttgaccttgacggtgacagaggagatctgtgcttaatgcatccaggggcatcacacgatgtggaaacatacccaatagttgaggagctactgtag

SEQ ID NO: 28056 - DNA, 419 bp, Glycine max
  Peptide Sequence Number=SeqID_144834
gcaaggataagatagatgctagtcatgacgagtctcaagattcatacagggactctgaaatagatagtcaagaatcaaccaaaagtgaaacagacgaagaagttgaacaaagagaaacacttcagccagagtcctctaaagatcaacaatgcataaacaaagatcaggaagaaagccatgaaaaacatgaaattgaagaagaaaaggcttatgagcaggtagacgaagctgatcatgaagactctcaaatgttagaggagaaaaaagaatgtgaagaggaagccactgaagggaagaagaacgaccaaaaaagatcaaagaaactgttcgtttctattatcatagctggatcagcccttcttgcttctggaatatttctctttattcggcatagaagagccagaaaaggtggtaagtga

SEQ ID NO: 28057 - DNA, 288 bp, Glycine max
  Peptide Sequence Number=SeqID_144835
atgggggcatgcgcaagagataaggaatttactgatacattccttccaagaaagtcttactgggtagctgttacctgcaaaaagatcgatgtggatctgaaaagaggcaaatttgatcatcctactaggatgactgagaaaactggggcaaatgaagagggtgagaaagagggagaaacccatgttgtgactgccattcctatacggccaagtttcccaccaacccaacaatgtcattactcagccaataacaaacctcctccttacccaccaactagttatccataa

SEQ ID NO: 28058 - DNA, 384 bp, Glycine max
  Peptide Sequence Number=SeqID_144836
atgcaatcacaggtactcgcactacctcttgagcctgaggatggtcgttcagctactcgtgtcagcacaaaggaaaatgttgtcatctggttttgttcgttgcataataggctagacaactacctgaaaggaattattatcaggttaattatatttttcaatacatttacattagcattagttggtaacatcaatattttaattgtgcaatacacatccatgtttgtattgaacaatgccttgaaaggatttgacgatactccacaaagtaaatccaaggctactgttaggtggattgttgttaaaacaaaaaggaagtactgcatgcgagtattatgtcatgcaccagatgtcaactataatcttaggaagtttcaagaataa

SEQ ID NO: 28059 - DNA, 294 bp, Glycine max
  Peptide Sequence Number=SeqID_144837
atgaaagcaaaatgcaaccaaaggggttgctcgcccaggcgagctaacctgccatttttttttaggggaacattaaccatgtcccctccttcttcatggacaatagtaaaagaaactgtgaacgcaaaggatactgggctgtcttgcagcgacgtcctctgcttgtttagcgccgggaaggggcaacgatcagtcggtcgtgaccctagccctacttgcatccgtccctatgtacctgcaagtaagaaacaacaaggtgtggcaaatcttgaccgcgtcgttgtcttaccttga

SEQ ID NO: 28060 - DNA, 276 bp, Glycine max
  Peptide Sequence Number=SeqID_144838
atggagctaaactcatatctcacttatatgagtcctgaggagatagaagttatggaagaagccatgcttcaatatgttattgaagcataccttagagaccaagaagatgatattgttgaaacagatcctagtgcagaatgttcttatccaaagctagtgtttaaagttgatgaacaaatgatcgatgttgcacagcctaatgtcatgcatgaattcaaacttagaagaatggaggaagcatatggagtactaaagtgtttatctatgaggctatga

SEQ ID NO: 28061 - DNA, 327 bp, Glycine max
  Peptide Sequence Number=SeqID_144839
atggtacatggaccatgtggaattctccaacctaagtctccatgttatgacagagtcactgctgttgttattcatgatgctaatggtacacttgagaatgctatcaatcaaaatgatgagattaaagaatatgtggattgcagatatatttctccatgtgaagctacttggagaatttttggttttccaatacatgctagaaagcctgttgtggagagattacattttcatctgccaggacaacacagtgttctttatgaagatgatgatgatatagatgatatcctgtcaaagccaagtatttcagattcaaaattcttagcctga

SEQ ID NO: 28062 - DNA, 2178 bp, Glycine max
  Peptide Sequence Number=SeqID_144840
atgatttcattttcaacatcgtgcctcttgtggcaaaacacagccgccccaggtgttttggcacagtctctgggacctgtgccattgccggacagcgtctgcgacctttgctgtcgatggacagccgctgctactgaccttccagtcatccatcttcaatttctgccattggggggaattgtcaatttcaaatttaaagagtttgatgcagctgttgaagacctttcagcttgcgtgaagctagataaggataatacgtctgcctacacatatttgatctcttatatggaaggtctcttcagtctttcactgaacaaattgactttacagggtttagcattatcttcaattggtgaatataaggaagctgaggaagctcatctcaaatcacttcaacttgacaaaaatttccttgaagcatgggcacatctgactcagttctatcaagatttagctaagccaacaaaggctcaggaatgtataaataggatgctacatattgatgggaggtttgcaagagcttatcatttgcgtggccttctgttccatgcaatgggtgaacacaggaaggctatcaaggatttgacaatggggttgagcattgatggcagcaacattgaatgtttgtatttacgtgcttcctgctaccatgctgttggacaatacaaagaagcggtcaaggactatgatgctgcattggatttggaactggattcaatggacaagttcgtgcttcagtgccttgtcttttatcagaaagagattgccctgtacacagcctcaaaatttaatggtgatttttgctggtttgatattgacggggatattgatgctctttttaaggaatactggtgcaagaaattgcatccaaagaatgtatgcgaaaaggttttcaggcaacctcctttacgcgagtctttaagaaagggaaagcttaaaaagcaagagtttactattaccaagcagaaggctgctcttctacaggcttcagactccattggcatgaaaatccaatatgattgtccaggattcctacctaatagacgccagcatcgaatggctggacttgctgctattgaaattgcacaaaaagtctcaaaggcttggcgttccctgcatgctgaatggaaatattcgaataaaggaaattcaaagaatgggagaagggccaggagaagggaaagaattaacatgcccagtcaaaatagaggaggtgctggttgtagtacaagcagtacctcagtaacatcttcaaatggaactgtagatgatagattatccagccgtacattttcgtggcacaatgtttactcattagctgttagatggagacagatttctgagccttgtgatcctgttgtatgggtgaacaagctaagtgatgagtttaatgctggatttggttctcacacacctatgattcttgggcaagccagagttgttcgttactttcctaattatgaaagaacgttagaaattgcaaagactgtaatgaaagagagatcatttgtccgcagcaaaacagacaagatcattcatctttccgaagatgggaaattagaagagattatgcatgcaaaatcatgttctgatctttataaagttattggtgaggatttttggttggctacctggtgcaacagtactgcatttgaagggaagcagcttgaaggaactaggataaaccttgtaaaaatgggagagcatggttttgactttgcaatcaaaacaccttgtacccctgctagatgggaagattttgacgaagaaatgacagtggcatgggaaactctctgcaatgcttactgtggtgaaaactatgggtctactgacttcgacacgcttgaaaacgtgcgagatgcaattttaaggatgacatattactggtataactttatgccactgtctaggggatcggcaggggttggatttatagttatgctgggtttgttacttgctgccaacatggagttcacaggaagcatcccacagggtttgcaggttgattgggaagccattttgaacttggatccaaactcgtttgtggattcggttaaaacgtggctgtatccatctctgaaggtcacaacctcatggaaagactaccctgatattgcttcaacatttgcaacaacagggtcggccattgctgctttgaacttttcttttgatgattga

SEQ ID NO: 28063 - DNA, 243 bp, Glycine max
  Peptide Sequence Number=SeqID_144841
atggttgtcgcccagctcgcccaggcgagccaggttgcttcctccagaagcaacagccttctggaggaatcttctggagggcccaagtgggcctggttgctatttgcacccctatttttactaattacggaaacttacgaatttcgtaacgatactttttttctttccgtaatgtttacggaaccttgcggattacataatcatcccctttttgacttacggaatgttacggaacctcactaa

SEQ ID NO: 28064 - DNA, 201 bp, Glycine max
  Peptide Sequence Number=SeqID_144842
atgttcaaggagttattgaactatgtggtgacaaaggtgttggatcaagtagaggagttgggtggtgtagacgtgtcgacatttgtgccaccatggctcgacgaaggcccaggccagggtgtcgcccaccgtggattggtcattcttttggaggatttcttgggccacgatgggggagaaggccatggctacagtcactga

SEQ ID NO: 28065 - DNA, 600 bp, Glycine max
  Peptide Sequence Number=SeqID_144843
atgggcttagaaatctatcctagggttcatgagaaccctagggccttctttagcagctctagcccaatcctcttggagcctcttgctcgtggctctggtgactggtcccttcctagggaggattgcatcagtctaagagctggaggcagtgctacatgtcctgttcttatggagagagaaagagtaaaagagatttgcaagaaaagttgcaaatcaatcgaagaaccaaagaaaagaagaaatagagggaggataaagaagaaagctcagcaggtagatcaagatatccactatgccaacattgtggaaagaaaggccaccctccatttagatattggagaagacttgatgctaagtgtagtgagtttaatcaaatggggcatgaagtttttatttgcagaaacaagaatcaaccacatgatgaagaggcaaaggctgttaatcaagaggaggaagattacctatttcctaccacttgtgatgcaatcctaccctgcaagggcattggatagaaaactccaagtagattgggccagagatgcaagagaaggccctagggttcttatgagccttaggatagatttcgggcccatgggctaa

SEQ ID NO: 28066 - DNA, 1242 bp, Glycine max
  Peptide Sequence Number=SeqID_144844
atgaaaaaggaattagaagatcaaggtcagtgttcctctttaccaatcgataccaaaaacaacattcaaagctaccaagaacacctccttcaacaacagatgcaacaaaacagtgacatctttgggggtggtgcttcaagagggctaatgttcccacctgaagtctctccaaccttgcaacaacaatcatggtccatgcctccggttcactccttcaactccaacccggttcactacatcaacaacaacaacacaaacccggttcatcatcatcatgagcaagcaccatttcttgtccctcctcccacaacaccttcaccctatgcaagcttcttcagcagcagaagggttgtcccttctcttcagtttgcatacgagggtccctcttctcatcttgatcaccaccaccatctgaggatcatttctgacacccttggacccatggttcaacccggttcagcagcaccctttggactccaagccgagctgggaaagatgactgctcaagaaatcatggaggctaaggctcttgctgcttcaaagagtcacagtgaagctgaaagaagacgtagagagagaatcaacaaccatcttgccaagcttcgcagtttgcttcctaacaccaccaaaaagataacaaaatttgacaaaacctcgtataagatcacgcctaacatgcacatgtctggtgaaattccgaggaggttattagtagaaaaagtgattaaagatgaaagaaagacagacaaagcttcgttattggcagaagtgattcaacacgtgaaggagctgaagcgccaaacctcactcatagcagaaacgagtccagtgccaaccgaatcagacgagttaaccgttgatgcagtcgacgaagacggaaagttcgtgatcaaagcctctctgtgctgcgaagataggtcagatctcttgcctgacctaatcaaaacactaaaagcgttgagactcagaaccctcaaagccgaaatcacgtcccttggtggacgtgtgaagaacgtgttagtcataaccggtgatgaagataattcaaattcaaacacccataatggagaacaaagcatgcaacaacaacaacaacaattctgtattagctcaattcaagaagcactcaaggcagtgatggagaagagtggtggtggggatgaatcagcttctgggaatgttaagcgccaaaggactactactaataataatatcaatatccttgaacaaaggtctttatga

SEQ ID NO: 28067 - DNA, 214 bp, Glycine max
  Peptide Sequence Number=SeqID_144845
atgaagaagatcctaggcctacaagctccaatggagcttgcatcaacttgtttctctagcattgaatcaattggaaatggaaagtacactattgtgaatggaaaagcaacaatcacaatctcaacctacttaggtacaaagttcatttatgatgtgttgtatgttcctgaaattgatcagaatttgttgagtgttagaaaacaagttgaaaaag

SEQ ID NO: 28068 - DNA, 873 bp, Glycine max
  Peptide Sequence Number=SeqID_144846
atgggaagagaaagcatagcaaatttgcaagaagtggtagagagtttgtgtaatgtttcaagatcctcagatgaaaggcaacgcatggttattgaaagtcttgtgcagcttctcatagacccagttacaaggtataaagtgatggacaaagttgctcctgtgcttgctgatttggttgaactaagagacatcaaagggaaacacaaagtaattggaaaagcaatcatgaaggttctcttacattatttccacagaatcaagatttgcaaggtgagtttgtatagtgaaaggacaagaaggttggaagagttgtggaatttgaaggtggagagagtgaagaaagagaaactattgagtgtgcaagaattgagagaaaaagaagccttatcatgtgttctgaaaaaggaaggacgtaagagtttttttgctggggagattgagaatgctgtggtgaagtactcagaggctttaaatttgtgtcctttaaaactaagaaaagagaggattgtgcttcatagcaatagagctcagagctatttgcttcttagagattcagaatgtgccatcagtgatgccacaagagcactgtgcctatcgggtgcggcgcgtcctcacggaaagagtttgtggagaagatcacaggcttttgacatgaaagggctcaccaaggagagcttgatggattgtttagcgttcattgacacagaggggttcaagataccatgctatgcagcagggcacgagttacattgtagaagaacctttcactgggagaagagcatgggagagaagaaagtgtggaaggatgagtctagtgactgcaaatgttggaagaaaactggcagtgtcaaaaacaaaaagggtaaggcatga

SEQ ID NO: 28069 - DNA, 324 bp, Glycine max
  Peptide Sequence Number=SeqID_144847
atggttatttatagaaaaagccatttggtgcaggggaagctcgcccaggcgagccagttgtttaggcttgaaggtatcagttcgcccaggcgagttggttgcttaaggatgaaggcattccatggcctaggtgagccagatgctgacctgggcgagctcaagcatagaaacatccagaaaatggccattttgccccctttccttgtggtagggttggcaaaaagacctccaaatgttaataatggtacatgtctagggccaaatgttacatggagaggtgttttcatgacaagttctacaggcctcaacatgaagtacctatag

SEQ ID NO: 28070 - DNA, 399 bp, Glycine max
  Peptide Sequence Number=SeqID_144848
atggacgaacacggtagcgaaagtgtgctagagttaaagagatgtttatgttgggggtttgaggttatgaccctatactcaatgggaaaacgtcctctatcatctattcacatggcagttttggttaattcaggggacttacgagtctcacttgtcattcctgactacagtggagtcgtattcatggttggtgagagcatcatgtcatgtactgacatgagacatgtccatccaatcgtcatccatatgttgggatggatctccgcctttgggttcgcatctttgactgtaggaggatcccttcgagagttcttcatcgggttcttgttggtgggtttactttcgtctagcatataccttcttgatggtgtggttattccgcagggcatggatagatga

SEQ ID NO: 28071 - DNA, 186 bp, Glycine max
  Peptide Sequence Number=SeqID_144849
atggtggtggaaatgaatagtatgagcaagatgattttggttttttcttgtgttggtggttcacggagggggagggtggcgctgagtggtggctctgagtggtggctcgtggtggctctgagtggtggctctaggccgatggtggtggttcgcggagggggagagtggcggttgagtggtggctag

SEQ ID NO: 28072 - DNA, 213 bp, Glycine max
  Peptide Sequence Number=SeqID_144850
atgtcattttcttgcacagtgagttccttcaccacggcatcgatatcattggttcttctttatggagagcagattgtttcttggaagaatcatcgaaaggaagaacttctttttatgagcactaagttgatgtcatctatggagatttttctactggacaggctaactagaaacaacataaagcaatcagaggaggaatatcagcttgcctag

SEQ ID NO: 28073 - DNA, 480 bp, Glycine max
  Peptide Sequence Number=SeqID_144851
atgttctacgactatagtacaacattggtgcttgggtcaccgttgttgaatatagcacggtggcgtttttgtaaataccacgagatgaacgacaacgttttcagccaaaagcgaagtgggatcagcgatgatccagctggcgatggttccaatcggaacggtgccgtcaaacgtgttgcgggactactactctatgctgctctcgctgcacacgatctcttcatcctcagcggcgagccaccgagtccatgggaggactcccagtcgcatcgcaaaaccctcgtcggtgaaggcgccggcaccagagtgattgaggctacggaggctatgacgggtacatcctttgtggtacaagtagagggtatatctacttgggttgttgtactgagaacaagagagggtacatctcttgtggatcagttcaagtggagggttgaaagaaatctcaagaaccggtggttgcttggggactggatgtag

SEQ ID NO: 28074 - DNA, 294 bp, Glycine max
  Peptide Sequence Number=SeqID_144852
atgcaaactgccagccccattggcgagtttgttgtggttgtgacacgtggtatgtcatcactgccactagcaacacagccagtggttgtcgccacttctattggcgagtccagcgtggagagaacccgctggtttgactggcgacttgaaggcagcagcggagctgtagcctttgacggagaagtcaccattgttgctggcgacttgggctacgaggatatcgccatccctgctggcgatttaagcttggtggattataaaatccccttcaatgagagtgaaagtgagctttga

SEQ ID NO: 28075 - DNA, 648 bp, Glycine max
  Peptide Sequence Number=SeqID_144853
atggccccatcaaaaggttcgaagcttttgcttgctaaggagttcccatcattcactgtgccatgtgaaatcgccagccccattggcgagtttgggctggcgtcgacatgtggcaatggtctcgccagtcatattggcgatttgaccatgaggggagtagctgctcatattgatgcaacttttcagaggcatagctttttcagggcatatagccagtggtactggcgagatgacaaggaaatagccagtgctactggcgagatcactgatatagccagtggcactggcgagatcatcagagatgtgagcaacttacatggtgatgaagatgataatgatgatgatgattatcttgtgtctaactcatacgttgaagagtctttagacgaagataatagtgttgatgatatatctgatacagacgatgaagccaccgacatgattcaaccacgttatgccatggatattgagtggttgcgaaggacactcgggaataggttgttgcatttcaaattgtcgcaaatctctatcgggttgttgaggtgccactcaacaacatggaaacaaatgagtggcaccactgcacaccatgctacacttccaaccaaacaaattggaggcaacgctgacataacagttgctttgtaa

SEQ ID NO: 28076 - DNA, 1147 bp, Glycine max
  Peptide Sequence Number=SeqID_144854
atggtgactatgcccaattgcttcaaccactcaattcctaaaacaacgtcggcttcacttatgggcaatacatggacgatcaccgtaaaagtatggtgttggatttgtagtgtcgtcgttgggcaatccagcactgaaccattgcccaccatgactcgcagaggggagacgtgcctgattgatgaagccatatatgcgaaagggtttcggtgtgtggtatctaagttggggaattcgtggaaggcattgggtttttcggggtctgcgatgaagagaagaacacgacctttgcaacagtggggtggtttgggtttgggaggaactaaaatgggcatcgtggtgtttgggggaaaaagtttaggcctaggccaacagttaatgagcttatccttttgcaatttagctagagcagttgcttggggtaaggagatgggttatagagccaacccctcccaactcgtgttgagacagcttgaagagtgcacccttgggatcgttgtagaacgaaggggcaaaacccaattccagggcctagagaaaacgagtccaggaggtgataaacccattgcagtacatccactggtaccaactaagggcgggtccgtccatgtagaaggacgtgattatgatgtgctcctcatcatgcgttccctgggagaaggtagaggaggtatggtggtaatctggttgaggcggttgagcaatgagtcaaccttgttgacaaaaacagagtggcggtctgcgagggagtcgtggtggagggttaaacaggtcagaccagttgttaagggctgggaacccttccttgtatttgaggacaaggtgatagatgaatctcaatcaacatttctaggaggacagaatatgatggatggagtggttatcactaatgaggttatccaagaagccaaagaaaagaaaaaaccatgtttcatattgaaggtttcgaaaaagcttatgattattctctatgttggttctgataaacgggagtcctacttaagaatccacaatgcaaaaaggtttgaggcaaggggattcagtaggcccttttttattccttttggtggtggaaggactaggaggtatgatgagagcgacactggagaaatcattaattgcgggatgcaaaattgggaacagagag

SEQ ID NO: 28077 - DNA, 255 bp, Glycine max
  Peptide Sequence Number=SeqID_144855
atggggtccatctattgtcatacatcgactagagagggttgtgcgatagtttggtgtccagcagactacatggagtggttctacatgatttctcattccttcatgagtccggcccagcctggagatcctcctagacatccacctgtgttgcatgatgacatattcattgaaccagatattcttcagcacctggtggcgacaacgattatggaagaagcacctacagatgcacttattcatgcagagcagccttga

SEQ ID NO: 28078 - DNA, 936 bp, Glycine max
  Peptide Sequence Number=SeqID_144856
atggacaaagatcagtggatgcatgacagtataatgtctgaagaagttgatatgaatgaacaaaatgaagacgaagctggtgtgaaatcagagcatgtgtttcctatccatgatgatgttttgaattgggctcaagctgttacttatgaaattgattctgtggcggtgattataaggccagacacaaatattggtatgagaggaaggacgtcatttgttttaattggttgtgaaaggagtggtcagtataagaccaagaagaaagatttggtaagaacagatactgatagtagaaaatgtgggtgtccctttaagctatgtggaaaactagtggttggaggcgaaggatggatgatcaagctaatgtgtgggagtcacaatcatgaattagtcaagtcattagttggaaattcatatgttggtcgattgaaaatggatgaaaagattattattgatgatatgacaaagtcaatggtgaaatcaagaaatattctgctaacgttgaaggagcacaataccaataattatataacaatcaaacaagtatacaatgcaagaaatgcacaacgttcttccataagaggtagtaatattgaaacacaacaactaatgaagtttcttgaacgggatcggtatattcattggcatagattgaaggatggagatgttgtacgtcaagctcctgttataactaatggagtcatcttgatacttgatgtcatccctggagttattgttaccaatagagatctagcattgatgaatgcaatgaaaactatattccctaagtgtatcaacttgttgtatcgatttcacattgataagaatgtgaaggcaaagtgtaaatccctggtcttcatgtgtcttccatacactgccttcgtcgtgactgcacatatacactgcattccacagtcacacctcggcgatccttag

SEQ ID NO: 28079 - DNA, 599 bp, Glycine max
  Peptide Sequence Number=SeqID_144857
gtccagaggtgaaggattggggaaaaaggagagaaaagaagaagaaagaagagaaaaagaagctaaatcaccgtcgaaccgtgactgcaatcgatttctacatcgttcttcaatcgttcttcattcttcatccgatgcactttttagttttgcctcgccctcccgccgaagggaaggttgcgacagatgctaatggggattttggtggcatttgtcagcatgtgtggtatctaacagtagtgaatagtgcaccacaagttgctagaagacaattgctatgggatgatttatttgagttgtgtagtgatgttgttgatgattgggaaatcattagtgattttaatagcaccttgtctcccaatgagaaggtgggtggcaatgataatcacgggcataaggatatgagtgcttttaggaatatccttcatgaaggcaatcttattgatatgggagtaaccaacataggagcccttttgaataagtggagcaaggggcctggtcacacttcatggtcagttgctttgaaatctaagttggataggattgatgctagaaagggtgctcagtttgatctaggtgtggatgttgagtacagatga

SEQ ID NO: 28080 - DNA, 1288 bp, Glycine max
  Peptide Sequence Number=SeqID_144858
atgccttttgtagctagatacagacagaaaaagtttcatttgccagaacactttcactatgtagcaccatcattctgggcatggaaagaaggtgaagcgagactcagaggactagcaaaatttgtggattatctattaagcattaccggatatgagattggaatatttgatattgctcttaccagctttaccatagagcttgtggaggataagttagaaggttttgggaatagttcacttcatgtagcccaaactataggtagtgagtttggaggtgttatttccaataaaggaaccaaaaagaaacctgggaagtatgatgtaaaaaataggccgatgttgatatcaccattcaagtataacttttttcgtgctaggagaagaatgaaatcccataaagaagtcaatgttctaagagaagatagccaaagaagggataaggagggagcaaggaggcttttcatggtgacaagcaagacaactcctagggttaccgcaaaggaagaagaagcggtcaatagtatggcctttttagaagaaagggacattaaggaaaataagaaatttgctggtggttcacagaggggaaacattggggttgatcaacaaaggaaattgaggaaaattatggtgccagagggtaactctgaggttgagtatgaatgttgtactgctattaatagggctagagggggagttaatggacttgcaagtggaggggatatggagatagaagaatttaatgaccttttggccaatatggaggttgttgatgttcctatggtagggagaaagttcacttggtatagaagtggagcattgccaaaattaggttggataaaatcattatatcagaaggagattgattggggtcctaagccttttagggttcttaatgctcgacttttggaactgccttttagtaattttgtgagaagtgatggaagatggctagatgatcccaaagttctgaaaaaggaggtgaagtctttttttatgagagatttaatgaaagaggagcagtgtaggagtgtggaggttctatgtgattttcatgctcatggaaaaatccctagaggaacaaatgcatcattcatctctcttattcccaaaaatgagaacctcggaggcttacgacttcgtgaggttggagtttctctattacatgatgagaaggatgagtttagcgagtttgtggtggagaagggtcttagacaaggggatcctcatgctccattcttatttcttattgttgctgaaggtttaggtggttttatgagagaagcat

SEQ ID NO: 28081 - DNA, 1023 bp, Glycine max
  Peptide Sequence Number=SeqID_144859
atggaagctcctatttgggcttctattttacgaaacaagtacagatgtggtgcagattcgttccctacagttgatagtaaaagggccgtgaatttttggcgtgattgctggatccctagaagctttcctctgattgatagctatgctgaggctattcctgaatcaaagatggagaagaaggtctccgattatgtggggattaatggaaactgggttgttatattttatggtgcaggcgtaatagggtcatttttcatgatgatcattgaactgctcaggagattattcacaaagcttgcaattggtgtgacagacatcaaatgggattttcctagtgaaggggaaattgctcttaattgtgatggtgctgttacggatggtgggaataaatctgcttgtggaggggctatttatttggggttgaagttggccggtcaagaggctttcgcaagatcagagtggattcatgctcgaacggaggaagtcgttgatgaggttgatagcaagggacccagatcaaaacgcggctaccatcgaggaggtgttggtgatgtggatgaggatgaagtgggagttttagctccgattgagatggctgcaagagatggggaactgagggtcttccttgttgcaagtgaagtttctggagactccaccgcttcctgcctcatggcttcgcttaagattctctcccctttcgctattcactttgctgcgaaaaccggtggagactacgcgtctccgctgtcatcgaagttgttctgcacatcctcctcaaacgaaagtcagtcatacaatgggttgttgaatgatgcagaaatcacgaacattgtgcccagaacgaggagcctctcggtgacgatctacccctgctgtctggaaagggacaccgcgaaggtgttcgggatcactgctagagaaccatggtggaggaaggtggcagacatggagaggatatcaaagcagccatggaaagtgacgatggcgacagtggcactaatgggagtgaaagaaggttggtga

SEQ ID NO: 28082 - DNA, 576 bp, Glycine max
  Peptide Sequence Number=SeqID_144860
atggccttggaagtaactcatatatgcaaaagaactgtggtgagcaccaaggcagtggagccaggaaagtacttccccttgtctgttttggatcgctacatggagaacaaccacattaggatggtgtactattaccaaacctcaagagaagtggaacttggaaaagtgaccaagaagttgagagagaccttgtcagagatgcttacccattttcccatagtgagtggaaggttggtaagagatgatgagacagggcattggaagatcaagtgcaatgatgctggagttagagtggtggaggccaaagccaaagggagtgtaggagggtggctagctaaccttgatagggaaaaggaactccaacttgtgcattgggaggacatgtttcacaagccctattattggtccaccttttatgtccaggtggttgatatcatcatagtaagagaagatttaagaatgaagctaactgaattcgaagaaggtggattagcaattggcctaagctgctttcatctcttggtagattccacttgtgcaacattattcatgaaagcctgggctgacatttcaatg

SEQ ID NO: 28083 - DNA, 396 bp, Glycine max
  Peptide Sequence Number=SeqID_144861
atgtgtctgatgactttggaaacaagctggtccattagccaattgagcgttgacatgtatccagaccataacccttactctctccaaattctgtaccccaaaccaaacctcatctctctttctctcttcaacgctgacggcttatgggttgcaaatctgtgggagaggaaacaccgatgggtggggtggcagcgactaaaatgccgatgggtgggagtgttaacccaagagttctttgctccacgtggatatggttctcgtatgggtgagggggcgaaagtagaagagtctggaggcgacggcgaggctatcgacgatgatggcgttgttcaagtgtgtctacgtgtctgtgtccgtgtcgtgttcagtgtccgtgttggtgtcagtgcttcatag

SEQ ID NO: 28084 - DNA, 417 bp, Glycine max
  Peptide Sequence Number=SeqID_144862
atgggtgaaataaaagaggtgcaagagcagatgaagactgacatggaggccatgaaagagcaaatggccacaatgatggaggccatgatgagcatgaagaagataatagaggtcaatgcggctacagttgcctctactggcgtcgttgctaaggaggacccgattcccccatctggcctcaaccaaataaatcatccaacctcggatatggtaggtcagggaggcaaagagttgggaagtacggacggcccccattttgtgcaagttcagaacaagcatgtcttcccgccatatggcttgcctcccaactatacaccacccaatgttgcacacactcccaatgagaatgtcgataactctgcacccatacccattgagagccaacaaccccaatctaatcatgcacatgtctcttag

SEQ ID NO: 28085 - DNA, 228 bp, Glycine max
  Peptide Sequence Number=SeqID_144863
atgaggcttcactgtgatcaagcgagtcagagacccagcatgaccacagatcgacctccactccttgtggctcgcatagacccagataagggttcgggagttgtttatgcacggggaagggttgacaagggtgttgcccttgtttctatgcatcctcaggttgattacaaacaaaactcgtttaaggcgttggaccttgaaacgatctcaagatttttgatgaaatga

SEQ ID NO: 28086 - DNA, 342 bp, Glycine max
  Peptide Sequence Number=SeqID_144864
atgacccttcgctcaacgaatatgcatagctcatccttcttccagattcttccttacgctcagccgagatgtgttgcactcagcggatggctcgctaagccagaagattggcttagtaatggaagtgggtcaagaggttctggaggtaagaaccaaaatatgatatcacctgtcgcaacctacccttttgcgggagagcgaggcgaggctcacgggtgcatcttccaaaggaggaaaatgcgcggagttgccaccaacatttatttgtggaaaacgtcggaaaaaccaaaggaaaccgatcataaagaatattccaagttcgggagttgtatttacgtttga

SEQ ID NO: 28087 - DNA, 216 bp, Glycine max
  Peptide Sequence Number=SeqID_144865
atgacaatttcgatgactgatacttccacaccctatcatagaggaggtatgatgaatgcatcagggcatgtttatgctatgcatgacaaatgcgtttatctatggacacaagagctcaaaagaccatatcttcttacccacaatgcattgggtatcatgtttcatttgcagtcattaccatggtgcccaatgcatgcaattaagaaggcgatgtag

SEQ ID NO: 28088 - DNA, 609 bp, Glycine max
  Peptide Sequence Number=SeqID_144866
atgggggccatgaaggaccaaatggatgccatgatggaggccatgttgagtatgaagagaataatggaaagcaatacggctgcagttgccactactaatgctgcagctgaggtggatccgacccacccatctgacataaatcaaaccagtcatccagtccctgacgtggtgggtcagggaggagaaggattgggaagtacaggcggtccccatgttgtgcaaagcaagaactccttcccaccatacaatttgcctcccaactatgcaccacctaatgttcatcgtccgctgcaacccttgcatttctcggtgggaagattgcctcctggcgcagaagaaagagagaaatttgatcttatagaggaaagactgagggacattgaggggattggagattacccttttgctgacatggcaaaattgtgcctagtgcctgacttcgtcatccttcccaaattcaaggtgccagactttgacaagtacaaggggattacttgtcccaataaacacttgaaactttactgtcgaaagatggggacatacgtgaaagatgagaaactcttgatgcatttcattcaagaaagattgtccggggcagaaattacttga

SEQ ID NO: 28089 - DNA, 150 bp, Glycine max
  Peptide Sequence Number=SeqID_144867
atggctaccattgcattattgagtagatatgggagatggtgtttggcctcgaatgtgcagcagatgggttttatggttgatttagggacgacctttgtggatgattgggtgttcttgattggtaggatggtgggtaatgagaaggactga

SEQ ID NO: 28090 - DNA, 336 bp, Glycine max
  Peptide Sequence Number=SeqID_144868
atggtcatctgcccccattcaaagacttcaatgtctttcaatcgagactattacagtctccccttgccttccagagacaactatctccagaacatttccattggatttaatgatgaaatcagtgcattttcaaatgaaaaagaggctaagtcaggaagtgctaaaaacttgtgcacactattccagagtgcctatttcgggaaaacaaccctagaagatgcaagaggaacaacttgtgcattgaagcctaggttttgtaaattgagagggattaatgagttggagattgagtgtgagatgatgagaagaggaggaggaatcccccttcttgtgtaa

SEQ ID NO: 28091 - DNA, 642 bp, Glycine max
  Peptide Sequence Number=SeqID_144869
atggatcgcaacggcgttctctctctcgcattcatctgcattgtagtcgccggcgtcggaggacagtctcccgccgcagcgccgtcaaacactccggcaactcccgccgccgccactcccgcccaagcaccttccacagtaccgaaatcaccagctcccgttgcttctcccaaatcatctccaccagctgcaacccctgcatctactccggcggcatctcccaccaccacccccgccgcgcctgctccggtgaccaagccacctgcagcctctcctcctccggcgactcctccaccggcaactcctcctccggcgccggttcccgtgagctctccccccgctcccgtgccggtgagttctccacccgctcctgttccggtggcggcgccaaccacccctgtggctccctctccggctccgaagcataagaagaagggcaagaagcacggtgctccggctccttcaccgttgttaggacctcctgcgccacccaccggagctcctggacccagcgaggatgcttcttcccctggacctggcactgctgccaacgatgagagtggagcagagaccaccatgtgcttggagaaggttctaggaggcctagctttgggttgggctacccttgttttggtcttctag

SEQ ID NO: 28092 - DNA, 381 bp, Glycine max
  Peptide Sequence Number=SeqID_144870
atgccggttgagggtcagtttgcccggctgggcggtgaggagtttgccgcgttgcttcctggcgacagtgagcaggcgcagcgcatatgtgagcgtatccggctggcgacacagctgtcgctacccaacgacatcggttatacggtgagcattggctttgccactgccagccagcggcatcaggcgtttcccgccctgctggcgctggctgatgaagctttgtatcgtgctaaagccgccggacgtaaccgcgtcgaaggttaccagacgccgcaggcggcaatggcggaagccgcgtttgtcaccgtagtgacgcagccagtaatagcggtcttccaccctctcccgtccgctgacgcgtgcgccgaccagccacagtag

SEQ ID NO: 28093 - DNA, 342 bp, Glycine max
  Peptide Sequence Number=SeqID_144871
atggtgttgggctgtttcggtagctctgtttgggtcaacttggttgggagaggtaggggtatttctgtcagatcaagtcttttaggggttgtaagaagcaaaataggaatgcagaaaatagaatgtggtctttcgggtcgggttccgtactggcccaattcagaaaatagaatgaccctagtcacttccaaaaacaacacagaaccatcgaaaacccctctccgctgcgaagacgtactcactctcttcctctttgtgccaagggtttggcaacttaacaagctgattgtcagttattgcaactggggcggaagtagcagaggcttaatctttgttctttga

SEQ ID NO: 28094 - DNA, 1932 bp, Glycine max
  Peptide Sequence Number=SeqID_144872
atggcgcgggcactcacgcaccacctatcactaatcctaatcctcatcgtcgccgtcgccggcgacgccaatctcctccgaaaccgccaccacggctctcgccctgccatgctccttcccctgtacctctccgcaccgaattcctccacgtcagcgctcgatccccgtcgccagctcaccggatccgagtctaaacgccaccctaacgcgcgcatgaggctccacgacgatctcctcctcaacgggtattacacgacgcggctttggatcgggactcctccgcagatgtttgcgctcattgttgatacggggagcactgttacgtatgttccgtgctccacatgcgaacaatgtggcaggcaccaggatccaaagtttcagccggaatcttcaagcacctatcaacctgtcaaatgtacaattgattgcaactgtgacagtgacaggatgcagtgtgtgtatgagagacaatatgctgaaatgagtacaagcagtggtgttcttggtgaggatctcatatcctttggaaatcagagtgagcttgctccgcagcgtgctgtttttggctgtgaaaatgttgagactggtgatctttatagtcagcatgccgatggcatcatgggtttgggccgcggtgatcttagtatcatggatcaacttgttgacaaaaatgtaattagtgattcattctcactatgctatggtggaatggatgttggtgggggtgcaatggttctcggtggcatatctcccccatcagacatggcttttgcatattcagatcctgttcgtagtccatattacaatattgatttgaaggagatacacgttgctgggaagcgactgcctctaaacgcaaatgtttttgatggaaaacatgggactgtcttggatagtggtacaacttatgcttacctaccagaagcagcatttcttgcatttaaagatgctattgtgaaggaacttcaatctctcaagaaaatcagtggtccagatccaaattataatgatatatgtttttctggtgctggaattgatgtctctcaactctctaaaagttttccagtggttgacatggtatttgaaaatggtcagaagtacacactgtcacctgaaaactacatgtttcggcattcaaaagtgcgaggtgcatactgtctgggagtttttcaaaatggaaatgaccaaactactctgttaggaggtatcattgtccgaaacactcttgtagtgtatgatcgtgagcagacaaaaattggtttctggaaaacaaactgtgctgagttatgggaaagattacagatatctgttgccccaccaccattacctccaaattctggagtaagaaattcaagtgaagcattagagccatcagttgctccatctgtgtcacagcataatgctcggccaggtgaactcaaaattgtgcaaataacaatggtaatttcctttaacatcagttatgtggatatgaagcctcacattaaagaattggctggactctttgctcatgggttaaatgttaatacttcccaggttcacttactgaattttacgtctactggaaatgattcgctcagtaaatgggccataaccccaaaaccagattctcattacatttctaacactactgcaatgaatataattgcccggcttgctgaacatcgcatccaacttcctggcacctttggaaattataagttgattgattggagtgtcgagcctccatcaaaggctaggctttatctaaaggtggaattggtggcagcaacacttcttggtcgtgagtttagctattttgatcacattgcttctaggattgtcgatattaggaacgttcttaatttggaaaaaaagacagcaaagctcgcattcatacaagccagtggatgtggttgttccagagcaagaacttcagccattatgagctaa

SEQ ID NO: 28095 - DNA, 252 bp, Glycine max
  Peptide Sequence Number=SeqID_144873
atgaggatttttacattggtgttgtctatgttctgtttctttttgttccccatgattgtaagtattccttcactattgacattgttattctcagttggaggattgagatgctatgagagtccaaagaataagattactgcagtacctactgaggaagaagaaatctggggtgcattcttcaaggtagtcgtagagcttaagaagttagagttgaaaatctattatgtaactaggattgcccgtcgcaactaa

SEQ ID NO: 28096 - DNA, 1758 bp, Glycine max
  Peptide Sequence Number=SeqID_144874
atggtcgaggacggtttgaagagggaggtgtttttgaccattaaatggtcgaggaaggtattaagagggcggtggtacctggtaggctgcgtgaatatgggtgtcgaggatcaagacgagaaaattaatgtacagtctgtgatagagcagctctctcaggcatttcttgaattgaaagctcagaagggggagactgagaataagattcagtgggttgaaattaagcaacatttccatgaccttgagacagaattgaataagaaacttgaagagctggaagctaaggagaggcagtacgaagcaaaacaattagaagtggatacactacttgcagaaaggaaggctgtggttgcttcaaaagagcaagacctcttagatcggttgcaggagcttaaagatgctgctgtagcttccattgtagaggctcatgcaaatcactggaatgccactctggagtctgtgtatgatgggaagaacaaagatcacaaggtaagcagctctcttggcgatacaaattcctcagaggacgattttcctcataagtcaggcgaaaagtctaaaggtgtggctgttgagggcaggccacatccagaactgacacaattttgtgagcaaatggatgcaaaaggtcttctgaattatattatggagaataaaaaaaaactgtctgttaattgtgaagaaatttctgtagcattacaaagtgcaactaatccagcacgtttggtgctggatttactggaggggttttaccccaccagtgaaacttcccaactaaaagataaatctggtgctgccctacagggcatgcgcaaatcctgtattataattttggaagccatggccaccttattggcaagggctgatccaggtgcagatcaccttctgaaccctcaaaccaagcagcaagccaaagcaattgctgatgagtggaggcccaagttagctagagcagatactgatgctgccaatggaaattcattggaagcaaaggcattctttcagcttatttcaacttttaggattgcttcagagtttgatgaagaagaactctgcaagcttgtacttgcagttgctcagcttaggcaggcacctgagctctgccgctctattgggttaattcacaaaatgccagttgttgtagaatcattaatcaataatgggaaacaaatagcagctgtacattttattcatgccttccagcttcaagaaagcttcccccctgtgccccttctgaaggcatacctcaagaatcgaaggagaaactcacaagttaagactggaaatgtgcgtgacattgctagtgcaaagaatgatgccaatgcgcaagagctttccgcactgagagctgtaattaagtgtattgaagaatacaagcttgaatctgagtaccctcctgatacacttcggaaaagggttcttcaactagagaaatcaaaaggagatcgaaagagaagtggaggagaatttattaaacgccctcaatcaaagaggccaaggccgaatgagagacacttttcactccattcatctggtagtgctgcttcagctgttattttgggtaggcaggttccccctgttagggcgccatatgcagcaaatcctgatcggtatccccatgctggcgcaatcccatacaattatcaagttcctggccaatctgtatacactgcaccatctaatgctcctccttctaactatggtcgttatatgggtactagtactagtttgcaatcctcacaccagccatacatgtga

SEQ ID NO: 28097 - DNA, 582 bp, Glycine max
  Peptide Sequence Number=SeqID_144875
atgtccgcaggatcttctgcgagaataaaaagtagcctgcggaagaagcttcagcaggttctttcgcgacaacaaaatgtagcctgcggaagaaggttctgcaggatcttctgcgggtccgcggaagacaaggttcttccgctggatgacgcgaaagatcttgcagaaccttcttccgttggatcacgcggaagatccttcagaagcttcttccgcaggaatccgcagaagaaccttccacacttcttccacgggagttccagaagcccctttcctacgcgcagaagaaggttcttctcgtggaagaaccttcgtcttcaacctccagccattaatgtcgtctatcctaaggttcctacagccatttacaccattcacgctattgaaacagttacgaggagcttcttctccaaatttcaaattcagaacgaaatgagggcgaggaggaagaagctcaatgagggcgaggaggaagaacaagcacaaatggagattgttgggtgcacggggaagaaacaagcgcggaagcaaggtattttcggtacttcattgaattgctggatgcaccagcaattttactag

SEQ ID NO: 28098 - DNA, 528 bp, Glycine max
  Peptide Sequence Number=SeqID_144876
atgtatccagacaaaaatagaggagagaggcaaagagggcagcgacaaagaaggaaggtgcggagaaggcagactccgatgctgccaagtgttggcgggccactacgagcgtgcaatgcaacagccatcgtcgtgcgggctcgtgaccttcacacggcgccttatggcaacatcaaatacaatgatgacgtttgtctagaaccgcctttgatcagtgtgcgggatggcaaagtcgtaatttggaccaagctagctgccgctcccgtgacattgtcgcatcgtgccctccgtgaaccccaggccactccatccgtctcctgtgtcgatattcctaagatatgtttctaccgactgaccgttgggatcttgaaaacaataacttttggtctcccgcaaagcgaggatagcgcgttaagcacaatcccaaccgaggggaattgcgctaagtggcccaaagccgcgctaagcccaattccaaccgagaggaagtgcggtgagcgcccagaaggtgcgctaagcgagccttag

SEQ ID NO: 28099 - DNA, 1422 bp, Glycine max
  Peptide Sequence Number=SeqID_144877
atgtctgggagccaccaagagcagccactgttagagaactcgttcatagaagaagacgagccgcaagaaacagcttatgattcgtcggagaagatagtggtggtcggagtcgacgagtccgatgacgaggagaattgggggagagtgccccgattctcgtggaagaagctatggctgttcaccgggccgggctttctgatgagcatagcgtttctggaccctggaaacttagagggggaccttcaggcgggtgccattgcagggtactcattgttgtggcttctgatgtgggccacagcaatgggcctcctgatccagctcctctcggcacggctcggcgtggccacagggaagcacctcgccgagctctgccgagaggagtatcctccgtgggcccggatagtgctctggatcatggcggaactcgctctcattggctccgatattcaggaggttattgggagcgctattgcaatcaggattcttagtcatggggttgtgcccctttgggctggggttgtcattactgctcttgattgttttatttttctctttcttgagaactatggtgtgaggactttggaagctttttttgctattctcattggtgtgatggcaatctcgttcgcatggatgtttggtgaagccaagcccagtggcaaggaacttcttcttggagttttgattccaaaactcagctccaaaactatacagcaggctgttggagttgtggggtgccttattatgcctcacaatgtgttcttgcactctgctcttgttcagtcaaggcaggttgaccgcagcaagaaaggccgagttcaagaagctcttaattattactcgatagagtccacccttgcccttgtagtttcctttattataaatatttttgtaacaacagtgtttgctaagggattttatggctctgaacttgcaaacagcataggtcttgtaaatgcaggacagtatctagaggagacatatgggggtggactatttccaattttatacatatggggtattggattattagcagcaggccaaagtagcactattactgggacttatgcaggacaattcatcatgggaggttttctaaatttaaggttaaagaagtggatgagggcgttgattacccgaagttgtgcaataattccaactatgatagttgctcttttattcgatacctcggaggaatcgttagatgttttgaatgagtggcttaatgttcttcagtcagtccagatcccctttgcacttattcccttgctttgtctggtgtcaaaggagcagataatgggcactttcagaattggtgctgtcctcaaggtattttgtcattcaatcttgcattttgatctcactggtcacttattgggtgccattatgtatctgataaaggactttgtgatgacaacttaa

SEQ ID NO: 28100 - DNA, 252 bp, Glycine max
  Peptide Sequence Number=SeqID_144878
atggtgaacatgcaccaaagcaccacagaagagcaaggatacttgtactctatgctcaatgacaactcttatggttcttttgcaccagagaccttagcagaagaagttttgtgggatggtctgtggaacatagacgatgttcatggaaatttcagtgaaaactattcttgcaagtcattatatttcattgaaaatggaggaggcataactgggcagtcaaccaacttgactgaaacatcaagtgatctatag

SEQ ID NO: 28101 - DNA, 354 bp, Glycine max
  Peptide Sequence Number=SeqID_144879
atggtttttcatgatgaagataatattgaaaagggtctcacctctcactttgaagcaacctctaaatgttgtgatccaaaaactataaatgaggtggctgaactagtagagggaacactggatgatgagatgagggagatcatgaacaaagattttactaaggaagaacaaaagaagaaagggacgaaagggattatggctctaaagttacacgacttaaaacactatgatagggtggagtgggattttatctccacaatgcttcaaaatatggtttttgataagcatgaagacccaaatgacaggcccaaaaggaggaccaaaccacatcaaaatttgaaggattatttctaa

SEQ ID NO: 28102 - DNA, 534 bp, Glycine max
  Peptide Sequence Number=SeqID_144880
aaagcatacataagtaaaccagtgcctcagaaagatactgctcctggtcttgcatatttccacatccctctgccagaatatgctacttttgactcatcaaacatgagtggtgtgaaacaggaaccggatggcaatggcattagctctccttctgtgaactccggcttcttcacaaccttgcttgcagcaggagatgtgaaggcagttttcactggccatgatcacatcaatgacttctgcggcaatctaatgaatatacaactttgttatggtgggggatttggataccatgcgtatggaaaggcagggtggcctaggagagcaagggtggtggtagctagcttggagaaaacggggaaaggaagttggggagatgtcaagtcaattaaaacatggaaacgccttgatgatcaacatcttactggaattgatgatgaggtcttgtggagcaagagcactggtggtaagatatcctttgatacttgtagtcctattcttgttttgaacaaagcaatgttaaaaatgaatatgtaa

SEQ ID NO: 28103 - DNA, 199 bp, Glycine max
  Peptide Sequence Number=SeqID_144881
atggataaccattcatggtgttatccagcctgtgctcaatgtcataggaaaactgacatccaaacaggaccattcacatgtggatgtggcaaggataatgatcagagtgttctgaggtatagagttgaagtgatggttacccaaaacaatgagagtaacaaatttttgctctgggaccgtgaatgtgctgaattgattg

SEQ ID NO: 28104 - DNA, 354 bp, Glycine max
  Peptide Sequence Number=SeqID_144882
atggttgttccaaaggtctccggtgccttctttgacgaagtggttagcaagggctttgacgtggtcattgggggaaaaaggacggtgggtggcaacgacagcaaagcagtggttagggaagggcaaagcggatgtgggagcgaatgtgagcttagtagagctacttctccacttgttcatgccaccggtaaaggttcaaggaccgccacccatgcttcgaagcaaaacccatttccagttgcacgctttgatgcggtcgatggtggtggcgtggcatggtcaacggtggtggcggttttcgttggagaaggagaagaaagggagaagggggaaaaggagatgacgtggcaatga

SEQ ID NO: 28105 - DNA, 288 bp, Glycine max
  Peptide Sequence Number=SeqID_144883
atggagtttgcgagcaacagtttggccattgtcatgaaggggaagaaggagaagaggaaggcgttgttttctattgacggtgcagtggtggcggttgatggtggtggcgcagggttggacgacagtggtgacatggtggtgatggtttttgttggagaaagggaagaaggagatgacgtggcaatgatgtcgtccgctaagcgcaacactcatgggctaagcacaaggaagactctagaagaagatgagttgtacaggttcgctaagcgcatcacttcatctcactaa

SEQ ID NO: 28106 - DNA, 294 bp, Glycine max
  Peptide Sequence Number=SeqID_144884
atgagctctaagttggatcacgtgcgggcagacatgctggagcttgtggcggagcagaaggagctcgcggcgcaactgcatgccgtggagagcgagcttgcaaaggtgagcacggaggctcagtttgtgccgacgattaaggccaatatagaggccatgcgccatgagattcaacgaggaaggatgagggtgcagcaatgtctggcatttcaccttgagttgctaaatgaagcagaagtggcagcggttgcagaagagaaagaaactcattcatttgaaattgatccttcttag

SEQ ID NO: 28107 - DNA, 594 bp, Glycine max
  Peptide Sequence Number=SeqID_144885
gtggttaggagagacgaatgtgacattaaggaggcagtgaagcatggttaccttaacacagattctgaattcttgaaggaggatcttaatggtggttcttgctgtgtaacagcattgattaggaacggtaaccttgttgtttccaatgctggtgattgtcgtgctgtgattagcagaggggatatggctgaagccctaacatctgatcacaagccttctagggaagatgaaagggacagaattgagactcagggtggctatgttgatgtgtgccgtggtgtttggaggatacaagggtcattggctgtttctaggggaattggagatagaaacctgaaacaatgggtcatagcagaacctgagaccaaagttatcaaaattgagcctcagcatgacttgttgatcttagcttcagatggattatgggaaaaggttagcaatcaggaagcagtagatattgctcgtcctttatgtgtagggaacaatagacaacaaccattgctggcttgtaagaaactcgtggaattatctgtgtcacgaggctctctggatgacataagtgttatgattatcaaattgcaaaactatatttga

SEQ ID NO: 28108 - DNA, 1440 bp, Glycine max
  Peptide Sequence Number=SeqID_144886
atgacctacctacaactgtctctgtcaagctggatagagataactatctcctatggaagtcactactacatcctaggaacaaaagaatgccctaaacagtttgttaacacaaatgacacaactgtgaaaatcaattctgactatgaagaatggattgctcatgaccaagctctcctagggtggctaatggccattgacattgcaacacagttgctgcactgtgaaacctctaaggaactttgggatgaagctcaaagcctagcaggtgcacacacaaaatcaagaacaatctatcttaaatcagagtttcacaacactcgcaaaggagaaatgaagatggatcagtatcttctcaaaatgaagaaccttgttgacaaattaaagctggcaggatcaccaatctccaactcaaatttgatgattcaaacattgaatggcctagatgctgattacaatcctgtggtggtcaaattatctgatcaaatcaatcttggttgggttgatctacaagctcaactattggcctttgaaagcagaatagaacaactgaacaatttcagtaatctctcaatgaatgcttcagcaaaccttgtaagtaaaacttattctagaggcaacaaacctggaacacgaggcaactggagaggctctaacttcagaggaggtagaggaagaggtagatctaaaccaacatgtcaggtatgcaacaagtttggtcacactgtagtgcaatgtttttatcgctatgacaagtcatacacaagctcaaatgctgagaataacacgcaagaaaatcacagtgccttcatagcctcaccctaccatggccaggactatgaatggtactttgatagtggagctagcaatcatgtgactcatcaaaatgagaaactccaagatctcagtgaaagcaatggtaagaattctctattagttggcaatggtaaaagattgagcatattggcctcaggctcgactcaattgaataacctcaactttcataacgtcttgtatgtcccagaaataaccaaaaacttgtttagtgtatctaaattaactgcaaacaataatgctcttgttgaatttgatgcaaactgctactatgtgaaggacaaactgatagggaaggcactactaaaagggaaacttagagatggattataccaactttcaagtgtcaactctcaagtcaataaagacccatgtacctacatgtcagtcaaagagaataggcatagaaagcttggacaccccaacaataaagttctggaaaaggtgttgaagaactgcaatgtgaaggcttcatcaaatgatcaattttcattttgtgaagcttgtcaatttggaaaacttcacttgttaccatttaaaccctcttcctctcatgctaaagaacctttagatttgattcatagtgatcccaatcttgtctccatctaa

SEQ ID NO: 28109 - DNA, 1491 bp, Glycine max
  Peptide Sequence Number=SeqID_144887
atgcgtaccaggagtaaggctgggatctacaaacccaaactgccttatatagggttgacagtgacacacaaagaggacaaggaaccagaaaatgtcaatgaagcacaaggacagaataatatcatagactcaaagtgggttttaaaaaccaagtacaaggcagatggctcaattgaaagaaggaaagcaagattggttgccaaaggctttctacaaactgcaggtctagactatgatgagaccttcagcctagtgatcaaatccagcactgaagttaggcaattagacataaataatgcattcttgaatggtaatctcaaagaaactgtgtttatgcatcaactagaaggatatatagattcaaccaggcctcatcacatatgcaaattaactaaggcaatctatggcctgaagcaagccctaagggcttggtttgacaggttgaaggacacactactagaatgggggtttcaaaacaccaagagtgattcatcactatttgttctcagaggaactgatcatatcacactccttctcatatatgttgatgacataatagtaacagggagcaataagaagtttctagagacctttatcactcaactaaatattgctttctctctaaaagacttaggtcatctacactacttcctaggagttgaagttcacaaagacactagtggaatgtacctgaaacaaacaaagtacattaaagacctgctcaagaagtttaatatggaaaaagcctcatcctgccccacaccaatggtaacaggaaaacaattcactgttgaaggagaacctatggccaaccctacactatacagacaggctataggtgcattacagtacctaaccaacactaggccagacatagcattctcagtcaacaaacttagccaatatatgagttgtccaaccacagatcactggcaaggaataaaacgaatactgagatatctccatggcacaacaaatttatgtcttcatatcaaaccctcaactgatcttgatattgctgaattttctgacgcagattgggctactagcatagatgataggaaatccatggcagggcagtgtgtgttccttggtgagacattaatctcgtgggcctcaagaaaacaaagagtggtgtcacgatcaagtactgagtctgaatacagagctttggctgacttagcagcggaagtagcttggattagatcactcctagctgagctaaaactccctatgcctaggaaaccaattttgtggtgtgataacttgagtgctaaggcactggcatccaatccagtgatgcatgctcggtccaaacatattgagatagatgtccactacatacgtgatcaagttcttcaaaaccaagtcacaatagcctatgtgcccacagcataccaaattgcagattgcttaaccaaacctctcacacacacaaggttcaacattttgagagacaaacttggggtgattatgtcaccatcagtttga

SEQ ID NO: 28110 - DNA, 348 bp, Glycine max
  Peptide Sequence Number=SeqID_144888
atgtcttgttccgtggcagttccaacttcccccgtgttctctttctacaacaacaacgttaactctaattccattccctctacgacgccgtcttgctcctctccaccctcctctcccttgttgaagagaaggagaccggccaaactcgacattcccgtcgcttctctcgcttttggtctctcgccggcggcggcgccatctccggcgagggacgccgtcgtggaggtcgacggacgcgggttttccgtgttctgcaaacgaggaaggaggcatcatatggaggatcgtttctccgctgccgttgatcttcacggtcaaccaaaacaggcttttttcggtgatatttga

SEQ ID NO: 28111 - DNA, 381 bp, Glycine max
  Peptide Sequence Number=SeqID_144889
atgttgtttctgttacgaactgcaagtgatttactgcgttgttcggtttggttaggtgaagtgaagttgtatttgatcacttcttcttctcttgcttttgcgtttcgcttcttattggttgttgggacagttaaggtgtttcacttggttataaagactctttatgttgccaaactttatgacataaatgcagagttagttgaggacaagggatttttggaatccttgaaggatttgatatctgataataatccaatgatggtcgctaatgttgtggcaacacttgtcgatgatcaggaaaatagttgtagtcccatctttgagatccccagtcacacactgtccaagctccttactgctttaaatgaatgtacagagtaa

SEQ ID NO: 28112 - DNA, 297 bp, Glycine max
  Peptide Sequence Number=SeqID_144890
atggctgaagaaaaaagaattattacggtgtttggcgcaaccggtcatcagggaaagggcgtggtgcaggcattaaagcgtgccagccagttcagggttcgggcattaacccgtaacccgcaaacctataccggagaggctgatgaagttcagtatgcggatcttgaaaagcctgaaacgctccacgacgcgctgaagggggtacagggcgtatttctggtgactgattactggcaacagggtacagacgagagaaagcaggcggcattcgccatcgaagccgcaaaatcggctggg

SEQ ID NO: 28113 - DNA, 843 bp, Glycine max
  Peptide Sequence Number=SeqID_144891
atggcgcttgcaacagaaacctctgagctcattgcatttacgaaaactgccgaagcaaaatcactttcccgtgctgcggccgagttgggccttccccgtgcaaccctgagccgacgcattgctcagcttgaaaaaaagctggacgcacgactgctcctgcggacaacccgaagtctggtgctgacggagccgggcaacatcttttatagagaggccatcatcgcgcttgaagcaataaggcaggcagagcaaagcgtgtcgagagccggaggacatttacgcggcgacttacgcgtatcgctgcctcccggtatgaaaaaaagcttccgtgcgatgttgtgtgaatttatcgcccagcatcccatgctgcacgttcatattcatacctccagtcaacatatcgatttccgacaaggaggttatgacgttgcactgagagccagtagtcagatgcagcccggattgattgcccgtacgctttttcgtgatccggtcattgccgttgcctcgccggcctatctgtcaaaaatgggcgtgccagttaccgctgatgaccttaaaaatcatcaatgcctggtgggattcgcgcgcggagagatgcccgatatgtactggccgttaatttccggagaacggatgaaggtggagggcgcttttttctctgacgatatcaccctgctttgtgaggctgccatcaacagccttggcattgcacttttgcctgaagatttaatgcgtgaacacctgcgacagggcgctcttgtcccggtactgagagatgtattaggtactgaaatgcagattgcagtggtatacccggatcgccactttctcatgcctcag

SEQ ID NO: 28114 - DNA, 290 bp, Glycine max
  Peptide Sequence Number=SeqID_144892
atgccaggttaccatctggtcggttcatgtaatgggttgcactgtggggttagcgaagtaccagaaggatactgtgtttgtttatggaacaaggcgacaagggtgatatccagagaatcgccaacgctgtctttttccccgggcattggtcgtagaataatgattgggtttggctatgatccgtcaagtgacaaatacaaggttgtagcaattgcgttgactatgctctcactagacgtatctgaaaagactaagatgaaagtttatggcgcggaaaccagtagttggag

SEQ ID NO: 28115 - DNA, 195 bp, Glycine max
  Peptide Sequence Number=SeqID_144893
gtaatccttgtggcgtctactctgacttatcttccttcactggaagtggcgtcatccaaaactccgtagcatatatcaaacgatccgctcctagtcagaaaattgtggatcaaatccccttatctagattctcctctgaatttggaagatgcagccactggatgacaatcaaagagaaaatattttccacaccag

SEQ ID NO: 28116 - DNA, 366 bp, Glycine max
  Peptide Sequence Number=SeqID_144894
atgaggagaaaaaacgtgttgctgagcattgacatcgacaaaacggataaggtggagctgcacaacaccatggagaacgcctccgtgctattgaagaaggagttcgagacgagcggggtggattacacgagcttcgtggacatgaaggtgatcctagggcattacgtgatatactgtgaactgttggtgaaggatgcgtccaacactcccacgagtgaagcgttggagcaatgttgtttgagaatggaagagtcactgaatgcagtgtatcgacaatgcagggttgcagaccatactattgggccgttggagattattgtggtgaagaatggaacctttgaggagcttatggactatgttatctag

SEQ ID NO: 28117 - DNA, 186 bp, Glycine max
  Peptide Sequence Number=SeqID_144895
atgaaagaagtagacgagtcattgaaaaaatttgttgaagtgactaagaagaagatggagaacaaaaaaaagatggagataaaagaagctcaagaagtgaaaatatgtgaaggaattcctgtgctgaagcaaatgcaattagaaaattcagaattattttggaagttggacttattttgtgactag

SEQ ID NO: 28118 - DNA, 198 bp, Glycine max
  Peptide Sequence Number=SeqID_144896
atggtgattgttgcagtagttggttcggttgttaatagacattggtcggagataaacgaagatcaatggatgtatgacagtataatgtctgaagaagttgatatgaatgatgaaaatgaagacaaagctggcgtgaatgaagaagaacatgttgattgttctaaggcattcaatacttctcaggtatttgctacctga

SEQ ID NO: 28119 - DNA, 376 bp, Glycine max
  Peptide Sequence Number=SeqID_144897
atggatcgagatcacatggttgcaattgcagcacttgacacaatacctggcttttcttcaagcgcaacctcaacaccatgttcttgtagtcgtggacacgatcatccaaccagggataatgattgttctaacattgatgactacccctttaacgtcttccttcaaccagatcattattgggaagcaggatttgaatgggattcaaggttgatatatatgattgattttggtgttgacattggacctattattgcaactaatgatgacattgttatggatgttaatgaagaacccatccatgttgagagtttggcattaatgctttgttgtacctctcttagctctcattttccagaagatggtttgcatcatactg

SEQ ID NO: 28120 - DNA, 1680 bp, Glycine max
  Peptide Sequence Number=SeqID_144898
atggcaattgctaattgtgatgataaaaacgcaaaaactttgcagttcattgaagatatgacacgaaacactgatagtgtccaagagagggtccttgctgagattctgagccaaaacgcccaaaccgaatacctgaaacggtttgagctgaatggagccacagaccgtgacactttcaagtccaaggtacctgtcgtttcatacgatgatttgaagcatgatatccaacgcattgctaacggtgaccgctctcctatcctatgcgctcacccaatcaccgagtttctcaccagatacgtggctgatttggacaagggtaaggctctcctcttcctgttcaccaaagccgagacgaaaactccaagtggcttagtggcacgtccagtgtctgctagcatgtacaagagtgaacagttcaaaaacagaccctatgatccatacaacgtgtacactagccccaacgaagcaatcctctgtcttgattccttccaaagcatgtacacccaagtgctatgcggcctcatcatgcgccatcaagtcctcagaatcggagccaatttcgcttcgggccttctccgagccattcgcttcctccagctcaattgggctgaactagcccacgacatctccaccggaaccctaaaccccaaaatctccgacctccccatcaaacaacgcatgacccaaatcctcaaacccgacccggaactcgctgatttcattgtgaaagaatgctcgggagaaaactgggaaagcataatccccagaatctggccaaacaccaagttcgtagaggtgattgtgaccggtgccatggcgcagtatattccaactcttgattattacagcggaggcctacctatcgcttccaacatatacggatcctccgagtgcttcttcgggattaacctaaacccattttgcaacccctctgatgtgtcctacaccatcatgccaaacatgggttacttcgagttcttgccccatgatcacgatgatgacgacggtgctttgtattcaggttccgattccagttcgcgattaaccgacctggctgatgttgaactcggaaaatcatacgaaattgttgtcaccacgtactccggtatatgccgttaccgtgtgggcgacattctccgagtcaccgggttccacaactccaccccgcagttcagcttcgtgaggagaaaaaacgtattgttgagcatcgactccgacaaaacggacgaagcggagttacaaaacgccgtcgagaacgcctccgtgctgttgaaggagttcaagacgagcgtggtggagtacacgagctttgcggacacgaagtcgatcccggggcactacgtgatttactgggaactcttgatgaaggactcgtccaacgctccaacgagtgaagcgttggagcagtgttgtttgagaatggaagagtcgctgaatgcggtgtatcgacaatgcagggtcgcggagcattcaattgggccgttggagattcgtgtggtgaagaacggaacttttgaggagcttatggactacgctatctcacgcggcgcgtcgattagccagtacaaggtgccgcgctgcgtgagcttcacgcccataacggagttgcttgactctagggttgagtccgttcattttagccccgctgaaccgcactggaccccggaacgacgtcgttga

SEQ ID NO: 28121 - DNA, 261 bp, Glycine max
  Peptide Sequence Number=SeqID_144899
atggtggggtacgtaccttcaagctttgcggatttggtcttcaccggcaaaatgatcgaagcgggtctgaaaagaggcaaatttgattctcctactttgatgagtgagaaagctggggcaaatgaagaggatgagaatgagggagaaacccttgctatgactgccattcctacatggtcaaatttcccatcagcccaacaatgtcattacccagccaatagcagtccctctcacccaatcatccacaaaggccatccctaa

SEQ ID NO: 28122 - DNA, 555 bp, Glycine max
  Peptide Sequence Number=SeqID_144900
atggtttgtgatgaccaggctgaaatgaccggtagattgctgaccggatcattaacctttgattgtcccgtaatgcactatattattgttagaattttgcttccctgttcttcaaatttggctcaagcctctgatgaggacttgattttgatgtgggctttccttactggtcgtcagatcgactgggctcacttggccaatgcacctctcccttatcctcaattggtcactctgtttctctgtcattttcaaattcctcttgatgatgaaccttttgttcaagtcaagcgttcctttactataggtgctggtgctgtaacttcatttggttaccgtaaagatcgtgatgatcaatggctgaagaaggacgcactacctcaacaagacgagcgtactccctctcctcttccacagcgtgatgattcctcagcccttatgaatgaagttctttcagagttacggggcctccgcacatatgttggtgaacgatttgattccttggatggtcgctttgaaggcatggatacccgcatcacccagcttgaagagatgtga

SEQ ID NO: 28123 - DNA, 342 bp, Glycine max
  Peptide Sequence Number=SeqID_144901
atgccccagcaccatctagcggactttgagccttgcctcgaatatgccactaaagggcaagcagttggtggtatacccatgccaaacactttggaaggccctcagtatcacctacaaacacacctcttgcattccacaactggtaaaaaccctcatgctatggcagaaatgggaaagttggatcatctagaggaaagactcaaggccattgaaggaggcgaagattatgcctttgctaatcttgaggggttgttcctagtacccgatatcatcacccctcccaagttcaaggtgccgaactttgacaagcacaaggggactacttgccctaagaaccattaa

SEQ ID NO: 28124 - DNA, 924 bp, Glycine max
  Peptide Sequence Number=SeqID_144902
atgggattaataatcccacaagattatgctgaagaagttgcgaatcgctcgatcgaaggccagagagcacttcgattaacacccaagaccttagatcaaaacccacaaaagctgttcctaaagtacatgaggatttttctgagctttgacaagtttcttccccaacatgctccattcattagtcgagaggttggcccagcctggttcactgactattttcctgctgtcgatccagacaatgaagaagaagtgaatgaaatatggtcattttacttgaatccacagatcctgtcttgtcgtacaggtgttcaatcgaactatttaggcctggttggataccagcctaatttggtttcaagacaatttggcctctcgcaaatccgtcctaaaagcttgttcgaagatcctcgagacgtcataagaggggccaatctttcggaaaagactttcaagaagtttttgaagatttctcttgatgaaaactataacctgcatccttttgagttcaatcattcccacttctgcaccatggggtttgttacctggtgggagaaatattattcgacccgttcagttggagacactactatcatgatctccagacttgagagtggttttatacaaccaacggtcgaaaatatccgctcaaaccttcaagctcgaggcaaaacaatcatgacgaagaaaagtgctgaaacgtctcgagctgatgtgagacccaagaaacccactggggtgaagatccaagagtggaaacaagaagagaagagtcaaaagaaagatgatagcattgatactaccactacttcaaaacgttcgaagcatgcggtcgtcgaattagacgaagagaaagatgcaagaagaagaggaaagacctcttataagaaaaagaaagttaccttcgacttcgaccaagtctgctga

SEQ ID NO: 28125 - DNA, 1134 bp, Glycine max
  Peptide Sequence Number=SeqID_144903
atggccaaggaaatcgaacggaagtttcttgttgcaggcggtgaatggcgcgatgaggtaacgcatagcatggctttccggcaggcctatgtcgcctccatggaaaatcgttcggtcagggtgaggatcgtcgacgggcgtgacgcgacactcaccatcaagatcggcgcaagcgcgctcgtccgtgacgaatatgaatatcccatcccgctggaagatgccgaggaactgatggccagcgcgcccggcgtggtgatcgagaagacgcggcacacggttgatcacggcggcttcacctgggagatcgatgttttcgaaggccgatataaggggcttatcgtggcggaagtggagatggatgacgaaaatgccgatccggatcttcctgcctggctcggcagggaggtaacgggcgacaggcgcttttccaaccaaattgatccgaaaaagccctttgacgatgaaatccgccgcgccggcctggaattgattgaagacacggtcaccatcctgcgtaaccgtccgtccggcccgcacgaggccgtgcacgatgcgcgcaagcgcttcaagcggctgcgggccctctaccgcctcatccgaaaggcggcgccggattttagccgagaggaaaatgcccgcttccgggatattgcccgttcgctcgccttcgcccgtgatgcgacggcattggtggaaacggcggaatatctggaggctttcgcgctctccgatacacagggtgaggcgctgcggtccatcacggcgatgctgcgcgcgcgtcgggatcatgcggtgaaatacgaggccgctctcgacgaggcgatttctgcggccatcaccggctgcgaggcgggacgtgaacggctgaagacgctatcgctgccggatgagctcaaggacagcgcccggctgctgaggacaagctgggcgcggcagaggaaacgggcgcgacaggcgctggccgattgccacgagcaggccgatgtcgagcatttccatgagttgcgcaaggccggccagacctactggatgcatcttggtctgatgaggcgtatctggccgtccgccatgcgcgccaagcgagccgataccaagcgactggtcgacattctcggccacgaacacgatctctcg

SEQ ID NO: 28126 - DNA, 633 bp, Glycine max
  Peptide Sequence Number=SeqID_144904
atgcctcgacatcaaagccggggcaggctaatcgataaacgggatttcaatcgtttcaatcgcgcaaggaggctcatcttggcccaggactccgaaaaacttctctccatcctgaaacttcagccggtcgtgccggtgctgatcgtggatgacgccgcctccgccgtgccgcttgcgcgtgctttggtcgctggcggtctgaaggcaatcgagatcaccatgcgcacgccggccgcgctggacgccatccgtgctgttgcggcggaagtggaaggcgccaatgtcggcgccggcaccattctcaatgcgaaggatttcgaggcggctgccgaagccggttccaccttcatcgtcagcccaggcatcaacaagagcgtgctggaagccgcgcgcagctccagggtgccgctgcttccgggcgccgccactgccagcgaagtcatggcgctgcgcgacgaggggtacaaggtgttgaagttcttcccggccgaacaggctggcggcgcaccttatctcaaggcgctgtcttcgccgctcgccggcaccgtcttctgcccgaccggcagcgtatcgctcaagaacgccaacgactatctctccctgccgaacgtcgtctgcgtcggcggctcctgg

SEQ ID NO: 28127 - DNA, 230 bp, Glycine max
  Peptide Sequence Number=SeqID_144905
agttaaacttcaaagtcaagacttctttagaggcactaaatttctgtagaagcaaggcttcaagaagatgttttgatgatgccaaaggaatgcgcctcaatggaagttattggaagttgaaagttgaaaatggaagttggaagttagaagttggaagtggaagttactggaagttggaagttggaagtagaagttattggaagttgaaagtggaagttactggaagttga

SEQ ID NO: 28128 - DNA, 438 bp, Glycine max
  Peptide Sequence Number=SeqID_144906
atggtgcttagtgccaattgtctccaaaagttgactcttacaaacaatccttctttgatttccttcccaactgatgattgtaagaagctttcatcactttcagaacaaattgatctccctctacttaaagtcttgagcctttcaggccttccacagctagcattgttttccccaagctttttgccttctggtttagaagcacttgttgctgaagctgcaatgctatcatctatgtataaacatgagttaggtttgctattccaatgtctcactcctctgacacatcttgcactttgtggtttgggggaggaagatcttctcaacaccttgttgaaggagctgatactgcccacgtctctctgggtgttgaccctatggtgtttcaatggtttaaagttgttggaaggaaaagggcttcaacatctcacttctctctga

SEQ ID NO: 28129 - DNA, 333 bp, Glycine max
  Peptide Sequence Number=SeqID_144907
atggcccagtccaactcctcttggcttggttttcctgcacttatcacagcattgtgcatagccagaggagtcatccctgattctctcacctttgagtccctgagcccgaccattaacttggcctacatcaagaaaaactgttggaacctagatgatctgacgatcacctttcctgggtctcgcaaggccagggctcggggcgcctcaaatgcttctacttctactctagctcccacaccagcacttgcacctgcaccagtccctcctccagcacccacaacaccctctggaccctccactttgagcacaaatgcgataatgctaatgttgtag

SEQ ID NO: 28130 - DNA, 132 bp, Glycine max
  Peptide Sequence Number=SeqID_144908
atggtaggagacaaggctttggtgaatatatccgcgagttgtagagaagatgaaattggaaggagcttgatgagacccatgggtagctggcttgataaatgtgatgcggaaatcttggaggagatacgttaa

SEQ ID NO: 28131 - DNA, 487 bp, Glycine max
  Peptide Sequence Number=SeqID_144909
atgaaagaacagaacttagagggtaacgaacaatcgtcgaagcactggtattgtgtgaagagacatcatgatgatagtcctgcaaatatgttggggcgtgtctcgttcgcgtggaacgtctgggttgtgaggaagaaggttccgttaggtgttcgttgtttgagggttcctgtattgtgggttgtgatgatgtgggttctacagatgagtcgtattggccactggaaaaagaagctgggaatggtgatagaggccatgtctcgcttcaactataccaatcttcatacgattgttcgtatcctgcaacatacacgaagtggaagaaaatatcaatgcacagttagtggacgacacaagtttggaaatggaaatgatactgaagaggttcacgattctggaatgggtggcatggacatggtggccgttaggaagctttattacgactgggctaatgtgttcataggaatgaagattatcgagggaggag

SEQ ID NO: 28132 - DNA, 321 bp, Glycine max
  Peptide Sequence Number=SeqID_144910
atggaacaagaaggtggattatgtgatgggaaagaagttgatcagtttcatcaaccgtctggtagtaatgaggttgccattgctaatgaggatggtatttcatatggatcagagctcatagaggttgacaaagtaaaaataaatcaaggtgatttgttgtttgggggggatgcttcagatggtgctctctgggatattttttggagacaggatgtccctaagttgcaggaatatctgaagaagaatttcagagagtttaggtatgtccattgctgtcgtttaaagcaggattgggtgaaggatcaagctgctaataaatag

SEQ ID NO: 28133 - DNA, 885 bp, Glycine max
  Peptide Sequence Number=SeqID_144911
atgaacaagagaaagccaaagaagatcagcttcattccaatattggtatatggcagcaattgctttctaattcctcaacagaaagtggttttcgagcagtgcgtgacgcggactctgtctccggcgttgacattggaggagggacttgagaaactgaaggaggctctccaaatcttgaattatccttccccttcttcccctactgtcctaagaccttcactttgttttgctcccaaccccactcctcctcggtctttcctctcatttatgtatccaagaacgacgccgactctaaatcactctatgtcaatttggatgataattttttacacctttgtgaatgaaaaaagggaatctttcattatgaagatagatctattccaagggtacaagctcatttctttcctaagaatatcatattgggtcaacattttgtctgagttagtgtgtaaagcaaaagaactagtgcaagcatacaagcttcaaaatgtagttaagactgcagacaacttctgttcatgtttgaagcttgatagaaacacagatgttagctatagtaatatgaggaaggctgcttcttgggaagatttgactgacaactatttattctgttctaaagctgtagatcctcagtacaaggatttaaggcattttcagtggcattgggaaaagggggagcctgtcattgtcagcaatgtgcttgaatgtacatctggtttaagctgggaaccgcttgtcatgtggcgtgcattacatcatgtaactaataccaagcatggccaacatttggcggagaaaacaattgattgcttagattggactgagttattgaattccatagagtcatcagaacagaatgtccttgaatattttgtgaagtactga

SEQ ID NO: 28134 - DNA, 285 bp, Glycine max
  Peptide Sequence Number=SeqID_144912
atgactggagtgtcattgggtgtgcgcacagggagctatgggacgctgctgcagcagcaaaacggcaccgtttcgccgaagccgttgcttgtgcgtagaccttcaaagacgctcctctacaaccccagagagaaagagaggggtttctttttcgtttgccggctactcggaagagggaaggtcgcaatgctcctcatgctcgcccttggcctctgtgttttcgtttttggttgctttactgtttacagagtaatcaaagtgtttatgattgatactcctcgttga

SEQ ID NO: 28135 - DNA, 504 bp, Glycine max
  Peptide Sequence Number=SeqID_144913
caaaaagtttatacggataaccacttgggtatttctgcacgtcagcgtgactcaaatgtcagtatgacagatcttgtgagcgcgaaagatgacgttaatctccgcatacagcaaaaagtttatacggataaccactcgggtatttccgcccgtcagcgtgactcaaaagtcagtatgacagatcttgtgagcgtggaagatgacggcgcagaagacgacattagtctctgcgtgctatcaggcttttcatcttacagacagcaaaaagtttatacggataaccactcgggtatttccgcccgtcagcgtgactcaaaagtcagtatgacagatcttgtgagcgcggaagatgacggcgcagaagacgacgttagtctctgcgtgctatcaggcttttcgtcttacagacaacaaaaagtttatacggataaccactcgggtatttccgcccgtcagcgtgactcaaaagtcagtatgacagatcttgtgagcgcggaagatgac

SEQ ID NO: 28136 - DNA, 1227 bp, Glycine max
  Peptide Sequence Number=SeqID_144914
atgattacaagatacaaagatggcatagttcaaccaaggattcatccatccttgcttcttgcccatgctgaacctaaatctgtgaaacaagctcttcaggattccaagtggcatactgctatgactggtgaatttaatgcccttcagagaaacaacacatggactctagtccctcttcctccaaatagaaatgccattggctgcaaatgcgtatttagagttaaagaaaactctgatagcagtgtaaaaaagtacaaagccagattggtggctatgggttctgatcagaagtttggatttgattttcatgaaaccttctaccctgtgattaaaccagttacaatcagactgattcttactcttgctatcaatcataagtggcccttacaacaattaggtgtgaataatgcctttcttaatggttttcaagaagaggaagtttatatgactcaacctccaggttttgagtcatctgataagtctcttgtttgcaagttacaaaaagctatttatgggttaaaacaagctcctagagcttggtttgagagactcaaatccactttactgcagtttggtttcactgacagcaagtgtgatccatccttgtacaagacttcatccacaatcatttacatcttagtctatgttgatgatattatcatcactggtaattcatcttcattggtggagaagttgattcagaaactcaatgctactttctctcttgaacaactgggttctctggattattttttgggaattgagatcagtgttgaagcacttcagtatctgactattactcatccagaattgagttttgctgtaaataaagtttgccagttcatgtcctcatctcttgaatcccactacacaacagtaaaaagaattctaaggtatcttaagggtgctttacactcagggcttgttctgtatcctgtcttatctcatcaacctctttccattggagccttttgtgattctggatgggctttagacccagatgatagaagatctaattctggtgcagcagtgtataaagcagttgtttctagatccagcacagaggcagaatacacaagtttggctgctgccacagctgatattctatggattcagactcttcttcaggaacttgcagttcctcattccacaccccttgtgctctgtgacaatccagttctgcatgctagagccaaacacatggaattagatgtgtttttttgttag

SEQ ID NO: 28137 - DNA, 159 bp, Glycine max
  Peptide Sequence Number=SeqID_144915
atggttctgggttcgtattgttttggtttatgccggttcggtttccgtggtctgtgcgatgattgggtgcttgtggttggtggtgttggttcacggaggaggagaggggcactgagtggtggttcacggaggaggagaggggcactgagtggtggctag

SEQ ID NO: 28138 - DNA, 231 bp, Glycine max
  Peptide Sequence Number=SeqID_144916
atggcgagacctgaaatcaagatactcgtagggagatcttctgaggatttccgatctccaacaagaagcctcaacactgaaacaaggagcactctcggtaacggaatacttcactcgactgcatactcgattcagtctgcacttgcaacgttagatgttcttgctccgccttcaccatcattgcacaaagaaagcttgaagatcgagccatgcagttcttgcgtggcttga

SEQ ID NO: 28139 - DNA, 216 bp, Glycine max
  Peptide Sequence Number=SeqID_144917
atgcaaaggcatccgaaaggtccccttaaaaactggttcataagggggtggcctacccagctatataagcacttatcaagtttgttaaacattcgatgtgggactattctcaacacgccccctcgagccagggctcgtcaccacaaaacgagggctggcgacacccaccggacagaatatagctctgataccatgttgaaggagatattaggttaa

SEQ ID NO: 28140 - DNA, 1418 bp, Glycine max
  Peptide Sequence Number=SeqID_144918
tcgatgtaggacttgagtttttctcaacaccaaccatcaatgaactattggatgaattgcatggttctcattatttctcaaagatagaccttaagtttgggtattgccaaatttgtacgaaggagcaggacgtgcccaagacagcttttggtacccatgaggctccacttggcatgatcacttatctcatcttgctgaagctgtcttttttataccatcatcaacttgttgctaaccataagaagtgtctctttggcttgacctctattgagtatttgggacacatcatttctgctcggggagttaacatggatccttcgaaagtacaagctgttctggattggccaattcctcgtacagcaaaagaagaaatcatggcgttggcactctcggttcagcattggcgccattaccttttcagtaggagcttcaaggtgatttacagacttggcccagagaacaaagcagcggatgctctgtcctgtcaatttaaattagccgagcttaatgttgtttctataagcccatattgggtggatttccctaagcttcgtgaagaggagtacactccagatttaccaagactaacaaacggatggcagcaaccttctgttggaaagatatctctaaggattttattactggatttccccttttatagccaaaacagttgcagagagtttcatcagaggcttcagggcacagttctgcgcatgagcaccacccatcacccccaaaccgatgggcagacagaagctgtgaatcacggtttggagaccattcttcgttgcttcacgtcggaacaaccaaccaatggtattcctagttatcttgggcaaaattctggtacaaaacttcttcccattcagctacctccaaatctccctttgagagaaacacaagttgaatctgttgcctctgttctcatagactgcaatgaagcattgtgtcaattgaaataccatctaaacagggtcctacaaactatgaagaaacatcttgatgctcaccatcaacaggttacatatatcgtagttgattgggtttatgttaagcttcgtccacatcgtcaacattcagtagcccgacgtatcaatccaaaattctatccccaatacttaggcccctttctggttatctcccaaattggtgaagtagcttataagcactctctcaatcgcggttatgtgcctgttgctttaccacctggaatggaagtagaggatcctgaaatccctcaacctgaggctgtaattgcaacgcaattgagctccactttggagtggtcgatcctatggaagctccaaccagttgaagaggcgacttgggaaactgcggcttcaatcaaggacaagtttccttctttctggcttgaggacaaggcagattttgtagcggatgacattgatgagaactag

SEQ ID NO: 28141 - DNA, 498 bp, Glycine max
  Peptide Sequence Number=SeqID_144919
atggataacatgggtgtagagaggggatatgattattgtccagccaaaaagggtccctcagtgatgaaaaccaaaaaaccttgttccaagggcaacaagaaggactgccacatcaaggtgaacgggagagaccgtcgagttcgtgtatcaacaatatgtgccgctcgtatcttccaactcacttgtgagctaggcaacaagacaaatggtgagaccattgagtggctcttacgccaggccgagccatcaattattgccgccactggcacgggcattatgccttccaacaccacagtggccaacaacacctcctcgattatatcggccacttgtgccaactttttgccttctaacaacaccaccttggtgccaccaaacacaattgttactcaagattccaatttggtcaccaatgttgcgagtgcaaggatagagcaacaaatcccacctttcgatttcgactttgattggttgcaacactctgatttagggttttaa

SEQ ID NO: 28142 - DNA, 438 bp, Glycine max
  Peptide Sequence Number=SeqID_144920
atgtcctcatacaggaagccagtacccagagaaatatactttcaaaggcataactcgtatatccatttgaaggttcgtttcattattggagttgatggacctaagcatgtgcggttggaagagatgagagaaaagcattctcttcaagatcgagttgaaatgttgggagctgtgcaacatgttttgcccgatgaaatgattgttttggcagaacctgatcctggtgatatggtgcatgcaattcaaaaggcaatatctatgctgccaaaaattgatccgcaagccatgcataatcgaatgagagaactctacaactggcatgatgttgccaaaaggactgaaattgtatatgatcgtgctttcaagtgctccaatcaaaatctacttgaacgtctctcacggtactctctaaacatcattggtacaatttacttgtaa

SEQ ID NO: 28143 - DNA, 672 bp, Glycine max
  Peptide Sequence Number=SeqID_144921
atgtctttaggtgatcatgcaaataaacttataggtggacattgttatatgaaaggacttcctagtggggagagaaggcttgttagcattgccagggagcttgtgatgagaccacagccatttttgttaaatgtttgctatttatctatttttctcaagtgtctcagcacttttaatgatggttacattgaagagacttgcaagcactggttacactctcatattgaccatctatcagagcagcacagaagtctttggccttttttaccacatatgtctactttcaaatggaaacaccctcttctttggagaaacattagcttgcttgcagattttgacaggattattgcaatgtgtaaaaactggcaggatgacaatggagatttttcttcagtgaacatggacactgctgttgctatacgcacgcttgaagcaacttataagtcatcagcagatgcagctgctgttgaaactatgattctgaaacttgctgagaagacaagagttgcagcaatttttgtatttgcatcattctcttcccttctaagcattgccagggtgcctgcacttaagaaagaaatcaagtttgttcatttggcaagtatttttatatggttgagccatgatctcctgaatgcggtcctcaattacaacagtaggagtagtagttga

SEQ ID NO: 28144 - DNA, 621 bp, Glycine max
  Peptide Sequence Number=SeqID_144922
atgtctattcaggtggtggttgcaactcatgcttatggaaatcgatctggggtccgatatatgaccggtggtctgaaagtctactatattccatggagtccatttgttatgcagaatacattaccgaccttctatgggttactaccaattattagaactattcttattcgagaaagaattacagtggtgcatgggcatcaagccttttcaacattttgtcatgaagctcttatgcatgcaagaaccatgggatacaaggttgtgttcactgatcattcactttacggttttgctgatgttggaagcatccacatgaacaaggtgttgcagtttaccttggcagatgtgagtcaagccatatgtgtttcccatacaagcaaggaaaacactgtgttgcggtcaggtttgccaccagaaaaggtttttgtcgtacccaatgctgttgacactgccattttcaagccagcagtggatcgtccaagtggatcagaaattgttattgttgttatcagccgattggtttatcggaagggagttgatttgcttgttgaagtcattccagaagtatgccgattacatcccaatgaaatttgggccctgacatcttggaagaaatgttaa

SEQ ID NO: 28145 - DNA, 690 bp, Glycine max
  Peptide Sequence Number=SeqID_144923
atgccctcatacaggaagccagtaccaagagaaatatgtaatgatataggaatgatttggattagtttctttttggtaattattgactttcaaaggcataactcatatatccatttgaaggttcgtttcattattggaggtgatggacctaagcgtgtgcggttggaagagatgagagaaaagcattctcttcaagatcgagttgaaatgttgggagctgtgcaacatgtacaagtccgatctgttctaatatctgggcacatcttcttaaacagttccttaacagaagctttttgtatagccatattagaagctgcaagttgtggattattaacagtgagcacacgtgtcggaggagttcccgaggttttgcccgatgaaatgattgttttggcagaacctgatcctggtgatatggtgcatgcaattcaaaaggcaatatctatgctgccaaaaattgatccgcaagccatgcataatcgaatgagagaactctacaactggcatgatgttgccaaaaggactgaaattgtatatgatcgtgctttcaagtgctccaatcaaaatctacttgaacgtctctcacggtactctctaaacatcattgctattggaattatggcagaatatcaaaagaatacaagtgctgttaacactaacccaagttcccagatcttgaaatggagataa

SEQ ID NO: 28146 - DNA, 1029 bp, Glycine max
  Peptide Sequence Number=SeqID_144924
atggcgttggcactctcggttcagcattggcgccattaccttttcagtaggagcttcgaggtgatttacagacttggcccagagaacaaagcagcggatgctctgtcctgtcaatttaaatcagccgagcttaatgttgtttctataagcccatattgggtggatttccctaagcttcgtgaagaggaggacactccagatttaccaagactaacaaacggatggcagcaaccttctattggaaagtggcataagtatcaggccatgtcaccaaccgatctgctgcaatccattcccatcctagaggtggtttggacagatatctctatggattttattacaggattgccccttttacagccaaaacagttgcagaaagtttcatcagagatgtggccaaactgcacgtcaccacctataacccctaaaccgatgggcagacgaaacaaccaaccaatggtattcctggttatccgggcaaaattctggtacaacacttcttcccattcagcttccaccaaatctccctttgaggtggtgtatgttgaatctgttgcctccgttctcatcgactgcgacgaagcattgtatcaattgaaataccatctaaacagggtcctacaaactatgaagaaacatgttgatgctcactgtcgacatgttacatatgtcgtaggcccctttctggttatctccaaaattggtgaagtagcttataaggtgaagctacttgattcagcacggatttatccagtgtttcacgtatcccagttaaagcgctctctcaatcgcggttctgtggctgctgctttaccacctggaatggaagtaggggatcctgaaatccctcaacctgaggctgtaatcgccatgcaatggagctccactttggagtggtcgatcctatggaagtcccaaccagttgaagaggtgacttgggaaattgcggcttcaatcaaggacgagtttccttctttctgccttgaggacaaggcagattttgtagcggatgacattgatgagaactag

SEQ ID NO: 28147 - DNA, 507 bp, Glycine max
  Peptide Sequence Number=SeqID_144925
atgccaatctccccctgcagatgtatcgggatcgcgcccacaagacgcccagtgggcccgaagaagtccaacagggccctggggtttccagctctggtaaggggcctctgtcagtcctacagggtgcctgttcccccagcgaggtcatgccatcgtgacataggaatcgcacccacaaagacacctagtggatccggagaagtccaacagggccctgggggatcgcgcctgcaagacacccagtggacccgaagaagtccaacaaggtcttggagttgtcaagctctaattacgggtctctgtcagttctacggagtgcttgtcacctccggcaagggcatcaggccccctactaatcgagctttcatcaagaagtactgcgtccccaggcaggcgcagggcgaaacaccacagcagcctgggcgaaataccatcacctctagagttcacctcagctcatccacaaaaaggttagagcgttgcttacgacccatggccgaccaatag

SEQ ID NO: 28148 - DNA, 642 bp, Glycine max
  Peptide Sequence Number=SeqID_144926
atgaagaacacattggagaatggaggattccattgggaaaataacaaatatcacatttcccagtcaagagggtccgctcttggcggtgaagaacacattggagaatggaggaatccaatcgggaaaataacaaatatcacatttcccagtcaagagggtccgctcttgacggtgaagaacacattggagaatggaggattcaatcgggaaaataacaaggatcacatttcccagtcaagagggtccgctcttgacggtgaagaacacattggagaatggaggaatccaatcgggaaaataacaaagatcacatttcccagtcaagagggtccgctcttgacgatgaagaacacattggagatggaggattcaatcggcaaaataacaaagatcacatttcccagtcaagagggtccgctcttgacggtgaagaacacattggagaatggaggattcaatcgggaaaataacaaagatcacatttcccagtcaagagggtccgctcttgacggtgaagaacacattggagaatggaaaaatccaatcgggaaaataacaaagatcacatttcccagtcaagagggtccgctcttgacggtgaagaacacattggagaatggaggaatccaatcgggaaaataa

SEQ ID NO: 28149 - DNA, 324 bp, Glycine max
  Peptide Sequence Number=SeqID_144927
atggctcaaggtggagaaactcttcatgatgaaatcaatttgcaacaagttgcttctgaaatgacaatgagatggcctctgaatgagaaaaggaaaaatgctatcattttctgtgacagttcgagtgcaatctatttagccaagtatcaaatccatcatgaaaagactaagcacattgacatcaaatatcacttcatctgtactgagaagagggtcaaagtccagaaagtttataaaagggataatccagttgatatgttcacaaagcctattccaagaagcaagttcatgcactatctggatttatttaacatagattgctag

SEQ ID NO: 28150 - DNA, 1141 bp, Glycine max
  Peptide Sequence Number=SeqID_144928
agggcagcacgtcctcgccttaagagggctacaccctttagccttcagaggactgcatgttctcaccttaagaggaccgcacgtcctcaccttcagagggcagcacgccttcgccttcagaggactgcacatcctcgcttccagaggacaacacgtcctctccctcagaggactgtacatcctcgccttcagaggactccacgtcttggcttttagaggattgcacgtcctcgccttaagagggctacacgtcctctccatcagaggactgtacgtcttcgccatcagaggactgcacgtcctcgctttcagaggactacacctcctcgactttagagggttgcatgatcgggccttcagagagctacacttcctctccatcagaggactgcacgtcctcgccatcagaggactgcacgtcctcgctttcagaggactacacctcctcgactttagagggttgcacgtcctcactttcacagggctgtacctcctagcctttagagggctacacgttctcgccatcagagggctgcaagtccttgcctttagaaggctacacgtcctcgcctttagagggttgcacttcctcgctttcagaggactacacccccttgactttagagggttgcacgtcctcaccttcacagggttgtacctcctggccttcagaggactacacgtcctcaccttcagaggacttcaagtccttgcattcagaggactgcatgtcctcgccttcagaggtctacacgtgctcgactttagagggctgcacgttctcgccttcataggagggctacacatcctcgcctttagaggactgcacttcctctcttttaaagggctgcacgtcctcgccttcagaaggctgcacgtcctcgcctttagagggatgcatgtcctcaccttcagaaggttgcacgtcctcgccttcagagtactgcacgttctcaccttcagaaggctgcacgtcctcgccttcagagtactgcacgccctcgccttcagaggactacacttcctcacctttagacggctgcacatccttgccttcagagggcttcacgtcctcgcgtttagaaggctagatgtccttgccttcacagagctgtacgtcctcgccatcagagggctacac

SEQ ID NO: 28151 - DNA, 4221 bp, Glycine max
  Peptide Sequence Number=SeqID_144929
atggccgatcagcctcacagcacctcatcctctccgctcgaaaccgccatcctcaagcttaccaccctacaggtctcccttggggaaactgttcattccatggcccagaaattcgatgagctcttactcaggctaccctccacttccccttccccatcacctcaacctccaccttccatctcccctgtacctgcgcatcaccacagaatgaaattagacattccacgctttgatggtactgaccccttcgggtgggtattccagattaaccaatattttcagtatcacgcaacccccgaacacgacagacttaccattgtgtccttctacatggacgcccgggctcttgcctggttccaatggatggccacgaacggccaactcacttcctggcctgcctttattcaagctcttcagacccgtttcgcaccctctcattatgatgaccccactggtagccttttcaagctcactcaacgtggttcggtgactcaatatttgtcggaatttgaggaactcgctaaccgtatcgtcggtcttcctccccaattcctcctcagctgcttcatatcgggcctgactcccgaaatccgccgcgaggtgcaatcgttgcagcctctgactttggtgcaggccgccggacttgcgcgtcttcaggaggagaagctcctcgacacgcgttcatccttccgcaaccgcgctcctctggtcctttcggttcctccaccgcgacagagctccacacctgctcttctccaagccccttcgtctcctgctacatcctcacgacctcctccggtgaagcgtttgtctccagctgaaatcgcttctcgccgagaacgcgggttgtgctttacttgcgaggagaagtaccatagaggtcacatatgtgcctctagggttttcctcctggtggctgctgaggacgacaactctgaccctcttatagaggacttggacccaggacccaacccacccgacagtccgaacccaaccgcggcccaaattagttttaattcactctcgggtaatctagcacccaaaactctccgtttattgggcctggcttccggccaccataccaccacccctttacgggtcttagtgggtaatggacagcatttagcctgctcaagctggtgtccgcgtgtcatcctcaccattcaggacctcacttgtgacgtggacctttatgtattacccattgcaggagccaacattgtccttggggtacaatggttaaagacattgggacccgtgcttactgattattccctcatgactatgaagtttttctatgaccaacgtttaattgagcttcgcggtgacactgacctcatcattaacatgctcactccacctcagcttcgcagatttttgaaactcaatgaacatgcatcctgcttccacatcgcggtcctcacagaggcagttcctgacgagccttcacaatcactggaccctcaaattcaagcattaattgatcattttgggcctttgttccagacacctacatcccttccgccggcgcgaataaccgaccaccacatccatttacttccccaggctactcctgttaatgtaaggccctacaggtacccccattaccagaagcaggagattgaactccaagtcgaatccatgttgcagaagggcttgattcgacccagcaccagtcctttctcctctccggtgcttcttgtccgcaaacatgatcattcatggaggttttgcgtggattacagagcccttaatgccattaccatccgtgatagatttcctattcctacaattgatgaattgttggatgaattgggccacgcatgttggttttcgaaactcgatttgctccaggggtatcaccaaatacgaatgcattccttagacattgcaaagacggcgttccgcacgcaccacgggcattatgaattcaaggttatgcccttcgggctatgcaatgctcccagcacttttcaggcgacgatgaacatgcttttccggccattcctccgccggtttctcattgtcttctttgatgatatattaatatatagcatcacttttactgatcatgttctacatttacaacaagattttcaggttctattggacaatcaattcgtcctcaaactttccaaatgcactttcgctcagccagaggtagaatatcttggccatgtggtgtctcagcgaggtgttgaaccagtctcttctaaagtggatgcagtccgacaatggcccttgcctcagtccgccaaagctctccgtagctttctgggtctcgccggattttatggaagattcattaaaggttacgccaccattgcggcccctttagttgcggccaccattatagagccctttcagtggaccccttcagcccaggtggcctttgaccaactgaaacaagccttgtctgaagcccctgtgcttactcttcctaactttcagctgccattcacggtcgagacggatgcatccgacattgggatgggcgcagttctctcccaaaagggacatcccatagcctatttcagtaaacaatttccacccaagctccgccattcctccacctatgttcgtgaattatttgcagtgacttcaacgacccctgagcaacacacatacctggctcgtctaatggggtatgacttccaaattcaatttcgttccggcgccactaatcaggcagcagatgcgttatcacgaatctccgaggaagatatttcaaacaacctcatcttacgcaaaggccgcatctggcttcctcctcacctgccattgctccctacactcctcactgagtatcatgctactcctacaggcggccaccttggcgtcacaaagaccatagcccgactaacggacaatttttattgggacgggttgcgagatgatgtagcacgatttatctctacttgcttggactgtcaacactccaagtatgaaaccaagcgcgccgccgacctcctgtgccctctgccggttcctcaccgtccatgggaggatctctctctagactttattactggtctgcctgtctttcaggggaacaccaccattcttgtggttgtcgacaggttctctaaaggcatccatttgggaatgcttcccacctcacacacaacctataccgtcgcagctctatttatgaacattgtcggtaaaattcatggtctccctcgtagcatgatttttgatcgtgatcccctgttcttgagcaggttttggcaggacctcttccgtctcagtggcacccatttaaggatgagctcctcttaccatcctcagagcgatggtcagacagaagccctaaatcgcgtcattgaacaatacctcagagctttcattcaccggcgaccaagctcatggggcaagttattattgtgggtggaatggtcccacaatacttcttggaatgctgctactggttccactccatacgagatcacatttggaaaaaagccctttaactaccctgactatcttgccggagattcaaagctcgacgttgttgatgatatgctcacgaacagagaggacacttttcgcttgattcgtaaaaagcttctcaaagctcaagaattgatgaagaaatatgcagatgctaaacgcagagatgtggaataccaggttggtgaatgggttatggtcaaactccgaccccatcgtcaaacttcggccaagccttcttctagctccgggaaacttcagaagcgcttttacggtccatttgagatcactgaacgaattggtcctgtggcctatcgtttgaaactccctgagggtgctcgtattcaccccgtgtttcattgctctatattaaaacctttcaaagggtcaccagcatctgcagattctgtttttcttcctgaccaatttgctcacgatcaactcactgtatctcctttggccattttggattaccgctacaattcagataacccagagtccccgtgggaggtactggtgcaatgggaaggcttagatcttgatgagacatcatgggaatcctggacccagttaagtcgtgactatcaccttgagggcaaggtgaatttccaaggcccgtgggatgatagagaaagaggggtacagcaagtaacagaggtgcaacaagcaaacccaagacagggtacaaacagcaacacagagacccaaacagaaggcagagcaaagagggtgattaacaaaccttcatacctgaaggatttcgtgtga

SEQ ID NO: 28152 - DNA, 666 bp, Glycine max
  Peptide Sequence Number=SeqID_144930
atgacctgcggaatgccgctgccccgtgtgggcttcagcacgccagaagtgagccacgccaacaacgcgaagatgcccggtgtgagcagcagggcccaccacggcgaatgcgaggtgatgcgctggaacaggtggaaggccgcgtcgctggccttggcgaacaggatggccaccagtgccacggccacggcgccgccccagagtgcggcgcggcggcgccaggcctcactgagaaccagcgcggtgatacggccgcggaggcgatggagatcggtcatgcggggcagtctggacgctgcggaggaaggcggacagcggctactgtggctgaaggccttgcaggatgcggtgaaatgcccggccatggatcctgctgacagcctgccccgtgcgtgcaccgctagacgggcaggcgctcccgccaccggcgcttttccacgctgcgcacgttgggctgctgccgcagccactccagatagagcggcagatgtgccaactcatcatcgttcgcatcaccggtcagggctgctgccggatgcgcacttcgccatggcgcatgcgcgccaggtcgccctgcgcttccagtatgccgcgcacgaccagtttgcgcacgcgctgggcgtagaagacatcggcaatgccggggcggcgctgcgggtccagtga

SEQ ID NO: 28153 - DNA, 216 bp, Glycine max
  Peptide Sequence Number=SeqID_144931
atggaaggtaaaggaaatttaagcaagttagacggtttcctatgtgaagacttggatgaccctttggagatattccaatacacccccgaagaatgtccaaatacaaggaattgcaatagaaaaaacttagcactcaattgttctattacaacaaatttaacagagcaattaaggtcttcaatgcttgtttgttttctcaagttgagcatgtgttaa

SEQ ID NO: 28154 - DNA, 675 bp, Glycine max
  Peptide Sequence Number=SeqID_144932
atgaaactggaacacggctggatcacgagcgcacgcaaggtgccgtcgccgcacttcaatgcgcggccggataacgaagcgccgtcgctgctgatcattcataacatcagtctgccgccgggcgaatttggcggtccgtggattgaccggctgttcaccggtacgctaccggctgatgcgcatccctattttgcggatatcgcccagttacgcgtggcggcgcactgtctgattcgccgtgacggtgagctggtacagtatgtttcctttgaccagcgcgcctggcacgccggcatttcgcagtttgccggacgggaaaactgcaacgatttttccatgggtattgagctggaaggcactgatacgctgccctacaccgatgcccagtacgctacgctgcagcaggttacccgcctgctgatgcagcattatccgctgacgccgcagcgtatcaccggtcacagcgatgttgcgccggaacgcaagaccgatcccgcgcttctcgttgctgcgtacgctgctgatgaccgtgatcgccatgctgctggtctggctggtggtgtggagcctgaagggcattctgtttggcgtggcgcagctgctgttctggattgtggtcggtttgctgtgcattggtgccggctcggtgcggctgcattaccaccagtatcttaa

SEQ ID NO: 28155 - DNA, 196 bp, Glycine max
  Peptide Sequence Number=SeqID_144933
atggtgtcgcgtcgttataatcccgaacatcgtcgtcaggaactgcttaaacgtattcagctggatatcccggaaaccgtggcgcgcgcgcttcaggaggatttaggcggtgacgttgacgcggaccgcgacatcaccgcccagctgttgccgcaggcggcgcaggctgaagcgcgcgttatcacccgcgaagccg

SEQ ID NO: 28156 - DNA, 990 bp, Glycine max
  Peptide Sequence Number=SeqID_144934
atgggcgcgattgccgaccgcacgcagagccgctggggacgctttcgcccgtggctgctgtggatatcgctgccctacgtgctgttcagcgtgctgatgtttaccaccccggactggagctacgacaacaaggtgatctgggcatttgtcacctatttcctgatgtcgctgacctacaccgccatcaatattccttactgctcgctggggggcgtcatcactaacgatcccggtgaacgcgtctcctgccagtcataccgctttgtcatggtgggcatcgccacactaatcctttcgctgtcgttgctgccgatggccgagtggtttggcggtgacaacaaagcgcgcggctatcagctggcgatgagcgtgctggcgctgattggcctggtgatgtttctgttctgttttgccacggtgcgcgagcgtattcgtccggcggtaccgagcaacgatgatctgaagaaagatttgcgcgatgtatggaagaacgatcagtgggtgcgcattctgctgctgacgttctgtaatgtctgccccggttttattcgcatggccgccaccatgtattacgtcacctgggtgatgggccagtcgacgcactttgccacgctgtttatcagcctgggtgtcatcggcatgatgctgggcagcacactggcgaaagtcctcaccgatcgctggtgcaagctgaaggtgtttttctggaccaacattgcgctggcgctgttctccagcggcttttactggatcgatccgcacgccaccgtcaccgtggtaattgcttatttcctgctgaacatcctgcaccaaatcccgtcgccgctgcactggtcgctgatggccgatgtcgatgactacggcgaatggaaaaccggtaaacgcatcaccgggatcagcttctccggcaacctgtttttcctcaaggtcggactggcggtagcgggtgccatggtcggcggcgaagcagcagtctgccagcgcgcttaa

SEQ ID NO: 28157 - DNA, 540 bp, Glycine max
  Peptide Sequence Number=SeqID_144935
atggcctacagtaaaattcgccaacccaagctctccgatgcaatcgagcagcagctggaatccctgattatggaagggacgctccagccgggtgaaaaactgcttcccgagcgtgaactggccaaacagtttgatgtctcacgtccatcgctgcgcgaagcgatccagagtctggaagccaaaggcctgctgctgcgccgtcagggtggtggcaccttcgtacagcagaatctctggcaaagcctgagcgacccgctggtcggcctgcttgctgaacatcctgaatcccagtttgacctgctggaaacccgccatgcgctggaaggcgttgcggcctactacgctgcgctgcgcggcaccgacgaagatctgcagcgtattcgcgactgtcacgtcaacatccagcaggcgcaggacagcggcgatttagatgctgaggccgatgcggtcatgaagtatcagatcgctgtcacagaagccgcccataatgtggtgctgctgcatttgctgcgttcgatgggccctatgctggaacagaac

SEQ ID NO: 28158 - DNA, 210 bp, Glycine max
  Peptide Sequence Number=SeqID_144936
atggcttacaaatccaaggttttcttaaacaaagaaaccgaagcggcggcagagctgcacaggatcggtaaagagggagaaggaagatggatgaaaaatagaaatttattaaaacttgaaagaagtgcttacaaaagttgttctttcagagcacctcgtctcagaaacctgaaaatggctaaatggaagggtgcctcactagatggttga

SEQ ID NO: 28159 - DNA, 528 bp, Glycine max
  Peptide Sequence Number=SeqID_144937
atggataaccattcatggtgttatccagcctgtgctcaatgtcataggaaaactgacatccaaacaggaccattcacatgtggatgtggcaaggataatgatcagcctgttctaaggtatagagttgaaatcatggttacccaaaacaatgagagtggcaaatttttgctctgggactgtgaatatgctgaattcattggtcaaacagctgatgatgtgaatagggtcaagattgaagatggtgatcttgatttgaatgcttcccctcaagcacttgacaaattgttgggtcatgtgcttgcttttaaggccaggattcaatcaagattcaaaaatgcagttgtacttagatactcaaaagacctggatttgatcaatgcagttctggagatgctgcctgatagtgaggtgttcttttctgatatctattttagtcgttattgtcatgatgatatgattcatgagtttgactatcatcaacttatatatggtgcaagcatgttccaaaatagatccttccaatgttga

SEQ ID NO: 28160 - DNA, 261 bp, Glycine max
  Peptide Sequence Number=SeqID_144938
atgggcctcttagcaaaccgccattggcaatggcgagtttgctgcactgaggaacccaccatccccattggcgatttcgccatgcatgggggaaccgccagtcaaactggcgagttcgtggcaggagaggcacagcctacatgcaggctacgtgtgcaggctacatgctgcagcagagacaggcttggcgcagaggggaagaactcaccattggtgcaggcgagttgtagctttggtgcagggaagaactcgccagtttga

SEQ ID NO: 28161 - DNA, 432 bp, Glycine max
  Peptide Sequence Number=SeqID_144939
atggctacttcgttggtacatccagaggaaccagcacgcacgcttcagcgcactgtggagtggatattacctacacctactccatatctactagtggagccagtccaagtgattgaggtgacgtcatctgaggaagaccccgaggaggacccagaagagctacctcctgagcctgttgtggatgctcttgactttctagagggtgatgaggacccactccctgaggtggattctcccgaggacgtcatgtcggcatctgaggcagactctacggaggagagcggtcccggagggatagcgactagtggagacctattgtataggaatttgatgaatgtatacatgtggctgaagccaccacattggacacctttgctctggatgacactatgtattttgcaaaactcccatattttggacaactttagataa

SEQ ID NO: 28162 - DNA, 222 bp, Glycine max
  Peptide Sequence Number=SeqID_144940
atgacatcaagaaagagggctagaactgatgacatcccttcatcatccatcctagctcctcagttatcagccattggaccagatgtccaacactcacaaaccttagtctcgatgctacaaagcttatttaaaggacaacttcttatcatgtacagcctgcaagagttggctcataacaggccaatcatacctatggagcattttcttgagcaagtagcctag

SEQ ID NO: 28163 - DNA, 387 bp, Glycine max
  Peptide Sequence Number=SeqID_144941
atgaagaaagtatgcagtaatttccaaggcaaggacaatgcacctccacctccacctcaatggattgaggctaagtttttttttaatggaacaccattagacactgacaccatcacgacactacgcaagaaatgggcagcctattttctagaagatggaaaatggatttatattcaggtctacataggcaaccacaaggttggtgttcactccgacggtcatgcggttacttcactatcaatgaaaaccacggaagggcccttttctactggttttttgaagctcaatctgaaccatcgaagaagcctctccttctctggctcagtggaggacccggatgctcctctattgggtatggtgcaattgttgagattggacctcttatag

SEQ ID NO: 28164 - DNA, 198 bp, Glycine max
  Peptide Sequence Number=SeqID_144942
atgcaggcaccggtggcggtgaataaagctcgtaaagctcgccggatatttcccgcaggaaccgggagggagggttggccctcgcctctccgtaaagacgcctttcctgactgcggacgagatacaggcgctcttttgctcggctgtgcaaagttagcagcacaccacttgcctcacgcagagtatggcgaaagaaag

SEQ ID NO: 28165 - DNA, 309 bp, Glycine max
  Peptide Sequence Number=SeqID_144943
gaggtgcaagagcaaatgaaggccgacatggaggccatgaaagagcaaatggccacaatgatggaggtcatgatgagcatgaagatgataatggaagccaatgcggttgcagttgttgctaccagcactgtggctaaagtgaacccgacgcccccatctggcctcaaccaaatgaatcatccaacctcagatatgcacgccttcccgccatatggcttgcctcctaactatacaccacccaatgtggtgtacactcccggtgaggatgtcaaatctgataatcctgctttgataaatgcaaaaaactag

SEQ ID NO: 28166 - DNA, 489 bp, Glycine max
  Peptide Sequence Number=SeqID_144944
atgtctccttatcaggttgtctttggaaaggcatgtcatcttccagtggagattgagcacaaagcatactgggcagtgaagacctgcaacttctctatagatcaagctggtaagaaaaaaaagttgcaactgagtgagttagatgagatccgcctagaagcctacgagaatgccaagttctacaaagaaaagaccaataaattccatgattgcatgataattaagaaggacttcatggttggacaaaaagtgttattgtataattctaggcttggactcatgagtgttgagatcataagtgactccacaaacaagagcttcaaggtcaatggacaccgacttaagtcattcctcacaaacccttctttagtagacgtagtggtggaaaagacttccttacacttcctccaccatgacttagggagttcttcttttcctatcttcttctttgcttttattacatttgtccgattctatttgatggtttaa

SEQ ID NO: 28167 - DNA, 546 bp, Glycine max
  Peptide Sequence Number=SeqID_144945
atggcacttattgtgaaaggtgatagattcaatttgaatcaatgtcctgaaaatgagcttgaaagggaacaaatgagaaacattccatatgctttcgttgtaggaagccttatgtatacggaagtgtgtacaagacctgacattgcttttgtggttggaatgcttgggagatatcaaagtaatctaggaatagagcactcgacaactacaaagaaaatgttaagatatcttcaaggaaccaaagattacaagtttatatatcaaagatctgacaatttagaaattgttggctactcagactcggattttgctggttgcattgactctcgcagtcttcactttgatggcaagactatcgagatcgaggttagtggagggagaagggcggtcctcgagccatgtcacttgcgcaaccagataagtgtagatgatgccaaagtagaggttggtgtggaggagtgtgtgcatcatgatgtgatagcgaaacttgaagatctgcaaggagaggatggggctcaggaagaggatcagagggagagggaatag

SEQ ID NO: 28168 - DNA, 480 bp, Glycine max
  Peptide Sequence Number=SeqID_144946
atgtcgtccagtatttgtcatctctcgttcaaacaattgatgcaaggacaaaaatattttccatcctcatctgtcaacttctttcagaaacaaattgcaagaactgatcaacgccttcctcatatgcagggctcatttcaatctttgataatctccgatgataaaaatgaggttcccatattgacaggggaaacctataaacaatggaaggaacgagttcttcttcatttaggggttgctgaccttgactatgctctccatagggatgatatccgtggttcaattccggaatgccaaaaggtcaaggattttgtggaagccatagatgaacagtttgaaagttctgagaaggccttggaggaggaagggagacttgctcaagaaattggtgaaggtgctcttagcgagactcaagataagaggaagaaggaaaggaaggaaaagaaccatatacttcctattgccaaaattaagaagtag

SEQ ID NO: 28169 - DNA, 1137 bp, Glycine max
  Peptide Sequence Number=SeqID_144947
atgaaggtagcacaagagtggcctggcttaccaaaaggtgtcaaatttgatccatctgatcaggaaataatttggcacttgcttgcaaaagttggggtaggagattcaaaacctcatcccttcattgatgaatttattactactcttgaagtggatgatggaatttgttatactcatcctcaaaatttacctggtgttaagcaagatggaagtgcttcccacttcttccatagagcaatcaacgcttacaacaccggcacccgaaagcgccgaaaaatactagggcaagattttggtgatgtccgctggcacaagactggaagaactaaaccagttgtctttaatgggattcaaaaaggctgtaaaaagattatggttttgtatgttagcaatgtaaggggaggaagagctgagaaaactaattgggttatgcatcaatatcacctaggaacagaagaagatgaaaaagatggagagtacattatctctaaagtgttttaccagcagcagcaagtcaaattgggtgataaagatgataaagatgttcctgaagccactgaaatcaatgaatcaacaattgtgaaagtggatccagtcactcccaaatttgtgactcctgaaactccttgtaatgaaaggtggtgtgcagatctagaccttggacaagaaacacataacagtccgcagcttcctcagatggattgtttagatgagattcaagctgattaccaagaccttgcaaatgaatcatctatggtagaaactcaacacaatgaagggatggatgataaagaaaaaaataccgaggaaggccaaaaatggtgggacagtgagtcacagaatctgttggattcacaacaactggtcgaggcactatcactgtgtgacgatctactccaaagccagtctcccagtagagatggaaaacatgaagatcataagaaccaacccggtctttctgtttatgctcagctaggaccagaaaatctgaagaaggatattgaagagtgtcaaaatcttgcccttgataaagcaaatatagagaatgatacaccttcagagtttcgactaagtcagctggaatttggttcacaggacagctttatttcctggggctatggcaaggcagtgaactaa

SEQ ID NO: 28170 - DNA, 434 bp, Glycine max
  Peptide Sequence Number=SeqID_144948
atggataagagcttggaagtaggagaagaagaatggagagagaaggagagagggagcatgaaatttgtgcctcaaaagagtcttctatccaatgcccttgggggtaggattgcatcaaaaactacgtcaacactgttagctggacaacaagtatttcatcaggtgaaggacatcataactatatttggcaagactcaaaagaaggatgcatctaacaagaacatttggaagaaaagtcgcgctaagcggaccttgtgggctcagcacgcatccaccgctaagcgcagcatcagcacgcttagcgtgacaagggaatctgaaagagcacaagaatcaaggttgcgtgctaagtgcgagatcatctcgctaagcgagacgtttgtctcttgccaagctcaacgcacgactggcgccaagcccaaatccacttactc

SEQ ID NO: 28171 - DNA, 219 bp, Glycine max
  Peptide Sequence Number=SeqID_144949
atggattccaaagtggtgagggtggggtccaattggtgtctgtctggtgggtttggaggcactgcactccctttcatgccccatcactggccctttactagaccaaggctcaaagaggaggatatcatccaacagaggaattggaggagtcctcagagagcaaagggcaaggctatacattataagaagatgtgttgtcatgctcctctgttggcatga

SEQ ID NO: 28172 - DNA, 213 bp, Glycine max
  Peptide Sequence Number=SeqID_144950
atgggatgttacagcaatggtagtggagatagcagtggtgaaatggtggtggttgcagcaacaacagtggtgcgcagcaatggtggtggttgtggtggcaatgacaatgtggttgtagtggaggcgagaaatgtgatgtgcaatggtggtggaatggtggaggcgataatggttgtaacgacccgtctcatcgctatgatatcactactttaa

SEQ ID NO: 28173 - DNA, 393 bp, Glycine max
  Peptide Sequence Number=SeqID_144951
atgcaacaaccaattccagggtgtccttcgcaacccttgaatattcatggcataacgctgaaaggcaaacatgatgaaaattgtgagcaactcttcacccccatgatcggtcaatggaacaaccaagttgattttagggtcgacgagacattacaatacatggtgtctcctcaagggaggaatacatggacagttgatgatctcgtgccttatgtggagaaaataacgattttaatgaaagagcaagagagaatcactgagcctgtgtcacatggtccagcatcagagcatcaatttccagcacaagagtttcacattctccagtcaagtgttgaaactcaaggcataggcaggcgaagggtggctgttgaagtggaagaatattcccaataa

SEQ ID NO: 28174 - DNA, 900 bp, Glycine max
  Peptide Sequence Number=SeqID_144952
atggcattactggacatgtctgtctcaacaatgaatggctctatgaagttgggaagagctagaaccggggcacttgtcatcgccgttttgagcaggtcaaaggcagccttagaagctacagtccattcgaacgcatctttgcataacagtgtggttcaactcccttgcctaaaaccacgtgccctaaatactccaattggttctgtgcgaataaacacttggcatgcttcaagtagaactggccttgtagcaatgtttgaaagattgtttccagatgctggatatgggatgataggtgttcatggcaacctgaaagttggagggtgcgttgcacaacctgaaaggtctagcttggagaaccatgatgcatgccctaactcatcaagcaactcgtcaatcgtcggtattggaaatcggtcacgtatggtgactgagtttaatgcacgagagaagatcaaaaacttgcttctctatttcggttttctggaagtgcagatagcgggaaaagatttattcgatgaactacttcccgcggcggcggaaggttggtcggagtttggaaaaggtgttggtaatggtggagcaatgcttcgatggctggaattgggtgaggaagatgtggtgttgcccaattgctacgtctacatgaagctcaattgcatggcccaaatgactgaatttcatgataaaagaggtgtagtcaacagttactggcccaaattgcttcaaccattctatgccgaggactgcatcagcgccacttatcggaagcagatgaaaggtgaccttgcagggagagtggagtatttggacaaaggcaatgtggggttggagaaaattgtgggtgctcccactactaataaggatagtgaggcaagcatgataaagcatggagattga

SEQ ID NO: 28175 - DNA, 297 bp, Glycine max
  Peptide Sequence Number=SeqID_144953
atggttgaccatgcaaccaaaaagactacgacggatagactggaggacgcaatcgctcatctatccaacagccaagcttctctcaccaataagtacactaagctttctggcaagattcgacgtgaggtattggcaattcaaccaatctctctacctcaggcaactgcacttgaaaaactccaagaagataagttgcgagatcgacgtccttcgtcacaatgccccaacaactttccatcaccatcaagccaccataccaactcgaacctaagaccgaaaccaccatttgttcaatga

SEQ ID NO: 28176 - DNA, 1122 bp, Glycine max
  Peptide Sequence Number=SeqID_144954
atgactactctacctgtctcgcctcctcctcctcctgtcgatgtgacatatgacacctggaaggaagtccctgttgctcagaaggatttgatatgggaggatattcagaccgaatttgaaatccctgaagcttttgatagtaggacaaagaagaaagttcttcagattgtcggcgagcggtggaggaagtttaaatctgatttgacaaggaaatgggcacttgcagccgacaaggacgaacatatgctcgtggctaagaaaacaaagaaaagactggaggaagctgctcagtccggaagcactgagggcgtcattgaccctccatctcctatcaaacgatacgatctcctgactgctgccattgggcaaccaaaacaccctggtcgtgtgcctgcagctggagccaatgtcaccatcaagcaatacttcggattagctccacgaaactcccacagttcctccttcatgcctcccgaagaacttgagcagctgactcaacaaatcagggaccagctagaggagttgatcacagaaaaaggatttgcaatgcctccggagcctgaggttggtccctcagctacccatgttagcacaaaggggagttgtgttgatccctcaccaactgatccagagatgggtgactcagtcaaatacgggttgtacatcgaagacaatccttccctcctggttaaagatgcagaggctcccgttcctgtacccactgacgaggttatttttgtggggcaagcacttaacaccttccatgcttggccgacacatctcgtgaagcgtccatcagaacaagcagctgtgtctcagcaaaacctccagatatgtgggatactaccgtgttcggggccagacaactatcttaaaggaataattaacagtgttttgaaaggacttgatgatactccacaacctaaatccaaggatggtgctaggtggattattgttaagtgttatagacaaaaaggaaccactgagtgcggctattacatcatgcactggatgtccacgataatcttaggaactttcaagaataattgggaaacgtattttaatgatgttagaccattggaagcagagagattgaaggtgcttcgcatccaacgggcatag

SEQ ID NO: 28177 - DNA, 1428 bp, Glycine max
  Peptide Sequence Number=SeqID_144955
atgtgcgttgactaccgtgcattaaactcagtcaccatacgtgaccgatttccaataccgacgattgacgagttgcttgatgagttagggcatgcatcatggttctccaagctagacctgcgacaagggttccaccaaatccttatgcacaagctcgacatcgagaaaacaacatttagaatgcataacagacattacgaatatcgcgttatacctttcaggttgtgcaacgcaccctccaactttcaggttgccatgaacaccctactaagcccgttcttacgctgttttgccactgcattctttgacgatattttattatatagtgactcactatcatcccatatccagcatctggaaacaatctttcaaacattgctacaaggccagttctacttgaagcatgccaagtgtttattcgcacagaaccaattggagtatttagggcacgtggttttaggcaagggagttgaacctgagccatccaaggtccatgccatggttaaatggccttctccaacttcggtcatggaactaagagcttttttgggcctcattgggttttatcgtaaatttgttaagaactatgcctccatcgcaatccctcttaccacactgttatgcaaagatgcgttcgaatggactgtagcttctaaggctgcctttgacctgctcaaaacggcgatgacaagtgccccggttctagctcttcccaacttcatagagccattcattgttgagacagacatgtccaagaaacattgctacctctctaagttgctagggttcaactataccattcaatacaaagtcgacacttctaacaccattgcagacgctctctctcgtgtgtcgttcgactcagaccagatgctcttactatccgtgccccaccttgatttcatcgatgaactccgacgaacgttacaagctagccccgaattccaagctctactatctaaggttcccaccaatctttcggctcaccctaaatatcacatccacaatgaactgctactattccaagggcgcatttggttagataaagccaatccttacatccccattctcttactcgagtaccatgctacacctttgggtgctcacctgggcgtcgcaaagaccacccatcggcttgaatccagtttcttttggtcgggcctatggcaagatattaggcgttttgttcgggagtgcaaggtttgccaacaaacaaagacaagcactcatcggccggcgggacttctgcaaccattaccaatcccgaaaagagtatgggaagacctatctatggattttattactcacctaccgccatcccatggatcactattatcctcgtcattgttgatagatactcgaagggtgtccacttcggtgcactacccacaagcttccccgccttcaaggtcgcatctctattcctag

SEQ ID NO: 28178 - DNA, 582 bp, Glycine max
  Peptide Sequence Number=SeqID_144956
atggatcactccattttttacctttaccttcttgtttcatcttttttttttcctttgtttctgaatgttgtctatgccagtaaaaagtgctacattgtatacttgggagctcattctcatggtccaaccccttcatttattgacctagaaactgccacacattttcattatgattttctgggttcaatcttgggaagccatgaaaaggccaaagaagcaattatttattcatataataaacacatcaatggcgttgtggcagcacttgaagaggaagaagctgcagatattgcagaaaacccaaatgcagtatcagtgttcttgagcaaagagcataaactgcacacgactcgttcatgggagtttcttggactgcaaagaaatggtaggaacacaacatatggcaaaagggaagatttggtgaaaatacaatcatcagtaacattgatacaggctttccagcacctccgtggtgttattttcattttgcactaccctttctccctcttcgtcatagtcgatcgtcgtgaaggctttccagcacctctgtggttctcgtgtgtggttgactaccgtctttga

SEQ ID NO: 28179 - DNA, 226 bp, Glycine max
  Peptide Sequence Number=SeqID_144957
gggtggtcatggcattggtggaagcatgcttgtagaattgttgatgcttaagttcaacacttggaagcagggcctaatgacccccgttggtttggtggtattggtggagatcctgcttttcctggaggattgccgtgctaaggtaggggaagggaaggttccaagttcttgctctctgaagcaatgtaacttcaatgaggtgtacatcacatcacttgttccttga

SEQ ID NO: 28180 - DNA, 246 bp, Glycine max
  Peptide Sequence Number=SeqID_144958
atggttggagcattctcgcaaaacatcgtgaccctgactggtctccctatgatcttacttagtgagagtgacctgacaaacccattgtgtgtacgaaaaggctgcaaaattgatttcaaaccagctaagtatgcggcatatatgattctgacagttttggaggagacagcaagaaatggagcaacaatgaaatttttgcacgagtttaggtttgaggctttgaatcataagatcctttacacatga

SEQ ID NO: 28181 - DNA, 435 bp, Glycine max
  Peptide Sequence Number=SeqID_144959
atgattcgcgaaagaacgtccgcaggatcttccgcgagaataaaaagtagcctgcggaagaagcttcagcaggctcttccgcgacaacagattgtagcctgcggaagaaggatgacgcgaaagatcttgcagaaccttcttccgttggatcacgcggaagatccttcagaagcttcttttgcaggaatccgcggaagaaccttccacacttcttccgcgggagttccagaagcccctttcctacgcgcagaagaaggttcttctcacggaagaaccttcatcttcaacctccagccattaatgttgtctatcctaagaacacgaacaacaacttcaatggaggatgtgaacttcaatggaggacacgaacaacagcttcttctccaaatttcaaattcagaacgaaatgagggcgaggaggaagaacaagcatga

SEQ ID NO: 28182 - DNA, 465 bp, Glycine max
  Peptide Sequence Number=SeqID_144960
atgagggcccctacagcagtgattaataggctatctgccattcaaaggcaatttgtttggggtggtagctttgaagggaagaagattgcttggggggttggcaggggcccaaggaatccaaaattgaatctgcagtatggaaggacacctccaaatgaggtcctttctaaggagttgtgcaggaattataatattgcatgtcctagcctagcctttagcttttcaattaaaactaaggataacctatctaggagacaagttgagattgacaatgatctatgtcccttctgtcaaagccaacctgagtctgcctctcatctatttttcacttgtggtaaagtcttgcctttgtggtgggaattcaattcatgggttagggaagacagagtcctccactatagcccgatggataactttctccagcactcaactacagcaagaaggaaggaaatcaatagaagatga

SEQ ID NO: 28183 - DNA, 1626 bp, Glycine max
  Peptide Sequence Number=SeqID_144961
atggcaactataggaattggagtaggagtgacgaagctccaaccccacaaaccaaagtctaagtccttgtttcttggccagaggcttaggattagaccattttggggggagcctcaatgcagtgaaagaagattattcagtgtctcaaaccccccaagagtggttcaagtttttgcactagcgggtggtgaatggcttgacactgttcacagcctctttgtgggtgttggggttggacttccttgcagtgtgatgcagtgtggtgatgtgatatataggagcactcttcccaagtcaaatggcttgacactcactgtccctggggtgattttggctttggggaccctatcttacctttgggccacacctggtgtggcacctggtttctttgacatgtttgttcttgcttttgttgagaggctgttcagacccacttacaagaaggaatcgaacacaggtgccaggggtttacaacaactttggcaccctgctcaactatttttgtataatattgtttctagtgttgttgatttaatgattttagtagttgttgctaaggaaggtgacttagtcttgaagaaggcaactgaatatggtgctgtagaaatttggatgaatgagcgtagctcttcaaagaaagctgcggaatactggcttatatggcggtttgaaggggatgccaccctagctgacttgatgcagagtagagactttccatataatgttgtttttgttgagaggtttatccaaatagattctatatcccctttccttgtggatattaagccacagaacattattttctcagaagagtctcgtacattcaaaatcattgatcttggagctgctacagacctgcgagtcggaatcaactacattcctaaagagtttcttttggatccaagatatgctgcaccagaacaatacatcatgagcacacaaactccatcggcaccctcagttccagttgcaactgcactttcgccagtcttatggcagttgaacttgccagacagatttgatatctatagtgctggtttaatcttccttcaaatggcattccccagtttacgttctgataatagcctcatacaattcaaccgtcaactaaagaggtgtgactatgacttggtcgcatggagaaaatctgctgagcctcgatctgaacttagaaagggctttgagttgttggatttggatggtggaataggatgggaacttctgaaatccatggtaaggtacaaagcaagacaaaggttgagtgcaaaagcagcattagctcatccttactttgtcagagaaggcttgttggcattgtctttcatgcaaacactgagactgcagctctttcgcgcaactcagcaggactattcagaagctgccaggtggattattcagctaatggcaaaatccgggacacagaaggatggtggattcaccgaagctcagcttcaggaactgagagaaattgaacctaaaaagaaggctagtgcaccgagaaatgctctagcttcagcccttagacttcagaggaaaattataagaaccttaaatgagagtatggatgagctcacaagacgccggaaaagcttttggtggagcagatggatcccaagagaggaatga

SEQ ID NO: 28184 - DNA, 297 bp, Glycine max
  Peptide Sequence Number=SeqID_144962
atgcgcttaccggggaaggagagtctgctgatgaaaccccccataaccataaatgagattttggatgttagcatttcgtttctaaatgatcatttagaggaaacactgggttcaacaaaaatagaagaaaatcactcagagtgtatcaacctcgcacagggtcaaggatactcattacatgcagatatacagtattttgatgctagatgggaagttcttgttgtgcttcctctgcgtgattgttttgcccaagagatcaacatgctatgccgccttgatgggtttgtagtcctctag

SEQ ID NO: 28185 - DNA, 231 bp, Glycine max
  Peptide Sequence Number=SeqID_144963
atggttgatagtctgcttgcacaatttttggcagtgccacaaaacgtcttaaagaaagcgacattgtccacgactcggccaggtgaagccccactgcctaggtcattgttgacactcggcttgcatgtatctgatgctgaagtagaagtcactactcttatactcggaccaccgggttcggagaaggaagcaatcgagaaggaaaagctggatttgcatttgaaaatctag

SEQ ID NO: 28186 - DNA, 315 bp, Glycine max
  Peptide Sequence Number=SeqID_144964
atgcctgatttaaccatcgtaaaaagtcttttttccagtagtgccaacatcgtcttcagactcctagcccctacagattccaagattgacgactctacatccccaccaacccgattggttcttactcaatggatggggcaacctccggaagacaccacctgggaaccatggctcgaactgcgcgacgcttaccaccttgaggacaaggtggtgttttgggatgggagtattgatagagatccacaggatcccaacatagcaaggcccagaagggtagtcactaaaccaaaatacctgagtgattatgtaacctaa

SEQ ID NO: 28187 - DNA, 216 bp, Glycine max
  Peptide Sequence Number=SeqID_144965
atggagaacaaaaacaacaacagtggcgagtcggagctgcgggtgctggttgtcatcttcctcttgaagggcagatcgatcctcctcggtcgctgccgctccgctgtcggcaatgccaccttcacccttctaggcggccacctcgaattcggtcactcccttactctctctcatattatgttttttttttcgtcaaacattttgaaaacgaaataa

SEQ ID NO: 28188 - DNA, 300 bp, Glycine max
  Peptide Sequence Number=SeqID_144966
atgtggaacttgaaacttttttttcttcttttttttcctttcttttttcaaactttcatcctttgttctaacaatgatggtgatgacaacacagaagtgacgctatggtcgtctaaaagtattaactttatggtttcactcaacgtggtagagttgtcgtcagtcattttggttgtgatggattctcaaactacaagtgctacaaacttaatgtgttgggagtgcaaacttggccaaagagcagtggatgtgtttggggttctagtcactcaaaacaaccttttattgtcatatatatag

SEQ ID NO: 28189 - DNA, 219 bp, Glycine max
  Peptide Sequence Number=SeqID_144967
atgattggcgatagaacaaagtataactccaacgatatcccagtgttaggggtcacgtgcaactccttgagtggagctaggtcaccctacgagactgtggtggcaactacagaatctccaagagaagcaatgacaaaaaaagatgcaaagaagatggcggatagggtacctgggaatggccgctttgatgacggcgacggaggacatcagtgtaggtga

SEQ ID NO: 28190 - DNA, 612 bp, Glycine max
  Peptide Sequence Number=SeqID_144968
atgtcgttgtgttgtgttagagtccgtgcttcaaggctctctctctatgcatatgtaaagggcagaaaagtggaatcgaaagggctccactctgttcctgtttcaggagctccggtgattcttcaatctgggattccattgcctgataagaggactctggaattgatacttgacaagcttcataagaaagacacttatggtgtgtttgcagaccctgttgatccagaagagcttcctgattatcacgatgtgatcaagcatcccatggactttgccactgtgaggaagaagttgggaaatgaatcttcttatactaccttagaacaatttgagactatcagccttttcctttccaccccacaatctccttgccattggtctctccacagtagtaccacttctgttggtcttggtttgaacttggaagtttccaattttgaaccaataatggtggtgacaatgatgagttggcctccatggccacctctctcatctaagaaatttgaagtagttttcatagtgcgcaggcttgaagggtcaacaagtatggagaaagctgaggaggtgaagtccaaggtggttgaaattaagtggaaggaaccactttgttaa

SEQ ID NO: 28191 - DNA, 1350 bp, Glycine max
  Peptide Sequence Number=SeqID_144969
atggcttccaacaatgttccattagtagcacctcctgtattcacaggaaagaacgacgaaatctgggttgtgaagatgagaaggcagttgaaagcttttgatctttggaaagcaatggaaaaaactgaaccaccagctttggaagagaatccaactgttgctcagatcagatttcatagtaagcaagttgccaaaagagccaaggctcttaccatcttgcactcagttgtggatgatgatgtttttatgagaatttccaacttggatacagcaagggagatttgggagaaacttcaagaggagttctttggaaatgagaggaccaagaaaatactgatgaaggttgtgaatcaaatcaagttgttagcggagaaatttctatacagtgggatagttgagaaagagatgaccaccattgaagacaacaatacatggcagctggttgacaaactggaagacaaaaattctattggagttaaatgggtctataaggtaaagctgaatcttaatgggtccattaacaaatacaataccaaacttgttgttaaaggttatgctcagcaacctggaattgattatgtagagacgttttctccggttacaaaaatgaacactattcgcattcttgtagctttggcagctgaaatgaagtggaaaatttggcatttagatgtcaaatctgcattcttgaataggaacatgactggagaaatttatgtagctcaatctgaaggctttgtttacaacaacattgatgcttactttagcagtcaaggttttaggagtgaaaatgatgcaactctttatgtgaaaaggttgttggatgtgcatcaaagtgaagttggtatttttctgaatcaagaaaagtatgcttatgaaattttgaagaagtttagaatgaaaagttgcaaatttgtccctactccttcggtgcagaatatgaaactatccaaagatgatggagctgaaaagatgggcgattctctttatagaaatgtgattggaagtttgctttatctcacttcatctagaccacgctcacacatgttctcttggaactcaaagaagcaggacattgtaactcaatctactgctgaagctgaatatgtagcagcagctgcagcaacaaaccaagccatttggttgaagaaaattatgtttgatttgggagtggagaagatggacgctactgagatttattgtgacacatggaaagacaaagcatattcaagtgatttccatgttgttcgtgaggctgttaagaattgtgagatcaagcttattcaatgggtgactgaggaaggtatctttggtgctgccggagaagtattgaaagttcagtataactga

SEQ ID NO: 28192 - DNA, 516 bp, Glycine max
  Peptide Sequence Number=SeqID_144970
atggcgagaaagaaggttgatcttgcatacataagcaatcccaagaagaggaaggaagtattgaagaaaaggaaaaatggtttgctaaaaaaggttgatgaaatcactaccctttgtggcattgaggcttgtgctatcatttatagtccagacgaacctgagcctcaggtttggtcatctgaccaaggagtggaaagtgtgattttcaagtttaggggagtttctgaattgacacgaaacaaaagaatgttttgtcaagagtcacttttaaggaaaaacataatccaagtgcaagggcagctcaagaaactcaggaatgaaaataggatgaaggagattaaccttttcatgtgtcaatactttgttggtggtaaccaccttgacaagtccaatattattgatctgaatgatatcacattcttggctgataaaaagttggaggagattacaaagaaaatagaaatgctccatgtccaagaggtgacaccaactactgaaaatgaggagaaaccatga

SEQ ID NO: 28193 - DNA, 222 bp, Glycine max
  Peptide Sequence Number=SeqID_144971
atggataatacaaccacacctccaacacctatggttctaattcaatggcaaggaatctcacccaaagaagcttcatgggaaccatgggagatagtctatgacaagtttcaccttgaggacaagaacccaagcttacctgatattgatactgcaaaggaagccaaagctagcatgcccaaaaggagtgcaaacagagcaacataccttgaagattacgtgtag

SEQ ID NO: 28194 - DNA, 1164 bp, Glycine max
  Peptide Sequence Number=SeqID_144972
atggcgttccggacacaccatgggcattatgaataccgtgtcatgccttttgggttgtgtaacactccttctacctttcaagctattatgaatgttgtccttttcgtagctgtgttctttaacaatatactcgtctactgtgtgtccttatcgacacacctcgagcacttagacatggtgctacaaacgttgttgcagggtaagttctatctgaagcattctaaatgcttgttcgcccaacgccaattggaatacctgggccatattgtttccagcaaagggattgaactagacccgtcaaaggttgccacaatgttacaatggtcacctccaacttcccaaaaggacctttgtgccttcttgggactcacgggattctacatgcgctttataaaaggatacaccatcgcaacccccctcactaccctcttgtatcgcgacaaattcctctggtccccagaagctcaacacgccttcgacaacctaaaacaggccatgacccaagctcctgtactcattgctcatgacttctctatcccattcattttggtaactgacgccggccatccgcaagtggcgtcaatatttactaggccattcgttcatcatccttatggaccaccggagcttaaaggatctcatgaatcaaaccctagctcgcctaagctagcctctgcctcacttgggccaccaaatagcttcatggtgaagaaaccagctcgcctgggcgagctcactgttgcagggaagtggagagaaataagagagaataagaagaaagaagaggaaatgaagttgaggcactgccgaatcgcgactgtgatcaatctctacatcgttccttgttcggtgttcttcgtgcgttcgtcggaactattcaaattgagcagcacatctctacggatgagcacggcctaccatctgttatccgatggccagactgaagtcatgaatcacgttctcgaacaatacctcaaatcattggttcacgctcgacctacagaatggaacaagccactgccatctatacctagttatatcctaggttcatcatctatcgaggttgtggattccatcctcatcacgaggaagacaatgcatgaggatctgaaacgacatctcctaaaagcacaggaaaccatgaagcagttcaccgatgcctaa

SEQ ID NO: 28195 - DNA, 1110 bp, Glycine max
  Peptide Sequence Number=SeqID_144973
atgccaccgaaactcacactcgtgttggtggtgctgtttttcgcccccgttgacgcgcattttccggcaaccggagagcttccaacgttccgcgaggcgccggcattccgcaacggaagagaatgccgcaaccgcgcgcggagcgactccgtgatccacatcgcgatgacgctggacgcgacctacctccgcggctccgtcgccggtgtgttctccgtcctgcggcacgcatcatgtccggagaacatcgtgttccactttatcggcaccacgcgccgaagcacggagctccgccgcatcattaccgcgacgttcccgtacctcgccttctacctgtaccaattcgacgcgaacctcgtccgcggcaagatctcgtattcaatccgacgcgcgctagatcaaccgttgaactacgcgcgcatgtacctcgcggatcttcttccggcgaccgtccggcgaatcatctacttcgactccgacctcatcgtcgttgatgacgtggcgaagctatggagcattgatctccacgcgcgcgtgctcggcgctcccgagtactgccacgctaacttcacgaactacttcacgcaccgcttctggtcgaaccctagctacgcggcgtcgtttaagggacgtgacgcgtgctacttcaacactggcgtaatggttatcgatctatggaagtggcgcgagggaaggtacacggagaagctcgagaggtggatgcggatccagaagcggaaccgcatctatgagctaggttcattgccgccgtttctgcttgttttcgccggcgacgtggagcgcgtggagcaccggtggaaccagcacggcctcggcggcgataacctcgaaggtctctgccgagatctgcatcccggtccggtgagtttgcttcactggagcggcaaggggaagccgtggctgcgaatcgattcaaagaagccgtgtccgttggatagtctttgggctcctgcctcacttgattgctgccacttgctcctcctcgtcgtcgtcgtccagctgaaaggaagtgtgattggaaatgacggaaaaggacacgcgagtgtgagggagattttggatgatgatgatgatgattgggttgcgatg

SEQ ID NO: 28196 - DNA, 219 bp, Glycine max
  Peptide Sequence Number=SeqID_144974
atgcataactgttttaactgtctttttactcagatactagggaaagcatcgggtggaggagttataccagttagtgcagttcttgcagacaaagatgtgatgctttgtatacaaccgggacagcatggaagcattttcttgtctgtagttgtcaaacttttggattatgacgggcatctgttttcatccttaaagccctttatttgtcagatcatgtga

SEQ ID NO: 28197 - DNA, 174 bp, Glycine max
  Peptide Sequence Number=SeqID_144975
atggaagaaaacggtgccggtggaggattgagagagaaaggaatgggaagaaagatccagtgtggagggcctgtatcaggggcttccatgaaccctgcaagaagtattggtccggcacttatcaaacatgtttaccaatggttatggatatacgtagttggtccaattgtttga

SEQ ID NO: 28198 - DNA, 387 bp, Glycine max
  Peptide Sequence Number=SeqID_144976
gatggtggcgaagaggtcggcgtaggcaccgttgcgggcgagggactggggccacggcgagcgccaggagaagacgacggtggcggcgacggcgacgtcgaaggagggagggtgggaccgtccgtcgtagttgtcgtagacgacgaatgtgcggaggaggtagcgggagggaggaagattggggacggtgtagcagttcttcttgccggaggagattgggaagaagcggagggtcttctcgtgcccgtgccggaagcgcagcggctccgacacgatcccagtagcgccgccgctgaagtagcggtcggagagccacgtcgtgttgaactggtcggtggaattcgtcggacttccgcagtcgatgtgaagcgtaccggatgggaatga

SEQ ID NO: 28199 - DNA, 453 bp, Glycine max
  Peptide Sequence Number=SeqID_144977
atggcaactcgagtactcaatgctaaatattattggccgacattgattatcgacaatgttgagtatgtaaaaaggtgcattcagtgccagaaacatggcaacttaattcaccaacctgtcgacgagctactcattcttgcttcctcctggcagttgccatgtggtggcatgcttgggccttttccactagctagaggacaatggatcaactaccgagttagattagtggaacatccccaaaccaacaggcaagccaaagtagccaacaaagtcatcttagctgagttgaagaagaaacttggtttggccaaagggaaatgggttgaggaattactagaagttctatggggaattcagtgcactctacaatccaccaccaaagaaatgccatttcggctaacttatggtactgatgcttttattccagtagaggtgggagagcctttattctga

SEQ ID NO: 28200 - DNA, 576 bp, Glycine max
  Peptide Sequence Number=SeqID_144978
atggtgttctggagttcgaaattgagcgtggacgcgaagctcgattacttggtgtggctgcattttgcagagattgaaggaagggtgagaagggtgggggaaagagtgtttgatgtgtatatcaacaatgataatttgactaggattgatatatacaagcaagtaggaggttttgctgcgtttacttggcatcacactgtgaagaatttaagtagcagcgtgttgagtgtgaagcttgtgggggtggtgggtgcgcctctgatttgtgggattgagaattacgctttggtgcccagtgatccttccactgttccagaacaagtggttgccatgaaagcattgaaggattcatttcgagtacctgaaagaatgggttggaatggtgatccttgtgctcctactaattgggatgcttgggagggagttacctgccgtacgagtaagaatagtaccactctggtgataagtcaaatggtcctaagggagaggggggccaaagcccctgcttgccctcccttggatccgtccctggttagtggtgctgtggtggtcagtgaggtagttatcatgtgctaa

SEQ ID NO: 28201 - DNA, 213 bp, Glycine max
  Peptide Sequence Number=SeqID_144979
atgaaggatgctcatgaaaagttgacaaagaaaacaaagccgtttgacatccttgaggatgcacatgagtgtgtcataatgtctattaatgacatcccagaaaagacccccattcaagccaaccacccattccacctaccaatacccattaccaatgtgacattcgacgaagaagaagaaaggcagctcgatgatgataaagtgaacaactag

SEQ ID NO: 28202 - DNA, 534 bp, Glycine max
  Peptide Sequence Number=SeqID_144980
atggatgatgctatcatatgcaaagtattccctatttcccttaaagggaaagcactaagttggttcacctggctcctgccaaactccatagattgttttgagactttgatggctggatttggaatccagtttacaactagacgaccaatccacttgacatcagtagtgttggtcagtttgcgactgataaagaaggaaacattatggtcctttatgaagagtctttgcaaaaagccagcaacagaccttggtgatcttcattgtcgggcaactaagtacatgcagttggaggagttcattgaatatgatcgacaactaagaaacaaagtacctggtccaaaaaagaaggtggagagagatattcaaaaaggaaaagaatatgtgtgcggaactcctaaacctcgctacaactactacaatccccttaatgctagtaaatcaaggatcttggagcaagcccttgctactgaggttttagcagtgtcgaaatgtgccaacactccaccaagggatcatccctcaaagcattgttga

SEQ ID NO: 28203 - DNA, 522 bp, Glycine max
  Peptide Sequence Number=SeqID_144981
atggattggcctagaaggattctaaacaacatcaccgatggttttggaggtggagaatacacctccttgcccaagaagaaacatttacacaatgttcaatttgtaaacatggtggccacgcgaaatatggttgagatgctcgacataatgttcacaagtgcagacttcaagggtattgatcctgaagaagatgacccatggtcattaccatcgaggcgaccaattgcttgcacctcttataacatattgcttggccagccatcgattaatgccattggagccattgtatccatcctacatcttgcaacgaaattcccatcctatgaggggttgatcatcactattcatgcgaataaaaaggaaacttgggaatgctacatggttagcctgaaactcactggacaatatcacaaaagaagagaaaagtggggaaggaaaggcgaagagccattcaggaagaagttaggaagtttctcacaacccagtttatccgagaaacgtgatacacgacttggctcttaa

SEQ ID NO: 28204 - DNA, 264 bp, Glycine max
  Peptide Sequence Number=SeqID_144982
atgatttttcacttttcttatctccaaacacccactcaaaccctaaatccttcttctccaccacctatggccactggtggccaccacaagttgccattgcttgccgacagacaacctcacagagaggaacattttaattggagtgggatcctcagaatccacctcaaggattcggtagtgaaacaagttctcaaacctttctttcgtagtttctttgaggaatctgcatttggaccagcaaacttgaatgcgagagacctctga

SEQ ID NO: 28205 - DNA, 606 bp, Glycine max
  Peptide Sequence Number=SeqID_144983
atgaaattgtcgctgcaaattgttgttccaaagaagaccaagtggatccaatttcaaaacttggaggtggtgacaccagagaaccaaccagagaaaaagcactatcgaggtgtcaggcaatggccgtggggcaagttcgttgttgagatccatgacccgaacaagtgcgggtctagggtttggctcagaaccttagacaccaccataaaagccaataaggcctacaaccaagtcatctttaggctccatggctccaaggccaacctcaacttcccccttgaagttaatgtcgttgtggagaccgtcttcgtcatcaccgccgacagcgagaggaagcatcatcgtgaggaggaggaagtggtggtggaggaagaaaaggtggtggtgaaaaaagagaaaataatggagcatgatttacttatatcaaaatctttactccttctcgatttgacaaacatatctagcaaatatatcctaaacacaaatactaataacaaggccaggcagtgctctctaaatcacaaaaccattcttatagagctattttcatggaagatcacaattccttccagctttcctatgtattccgtaaacatgtatagttga

SEQ ID NO: 28206 - DNA, 162 bp, Glycine max
  Peptide Sequence Number=SeqID_144984
atgcttaaagtgcttcgtggttgttgcatttgtcgggtgcaagaagaaaagaaagaagaaagggattggggaaggtatcgcacaccaaggaagaggaaggaggtggaccaagacaatgaaatttacccacgagagtatctaaatagagaccgagtgaagtaa

SEQ ID NO: 28207 - DNA, 393 bp, Glycine max
  Peptide Sequence Number=SeqID_144985
atgtataaagaggtagattatttatttccacgtgattctattctatcgaaagcggtggctcaagcgaacgtgaaggctgagcctatgagcttgcaggctgaagctgttgtcggtgctcattatgtaatgaaaatgtctgtgattctcctccatcaccgcaaaaccaatcgattcgcttctcagtctctgaagatctggagagggagcagtgtcctggttgatctgcttgggagagtcttcgaacgcaaagcgaagctggcgactacactcacttggaggtttgctgccagtaatggcagcacccttgctgctaatgatatggaagatgcaacggcatttgtggttgtggagactcctaaaactgcaatattggtagccacaattgcgttgtga

SEQ ID NO: 28208 - DNA, 447 bp, Glycine max
  Peptide Sequence Number=SeqID_144986
atgtcatcatctgaacctttatcatccagagacggcgagtccgatgacatgcggagataccttatggttatccgcaccttttgtcagccagaggcaagcgagctcgttgacatgcaaagactaacatcgtcatctgcacctttgtcatccaaagacgggaagtccgatgacatgcgaaaatgccttatggttatccacaccttttgtcagctagaggcacccgagcccattaacgcacagagacaaacgtcgtcatctgcacctttttcatccagagacggcgagttcgatgacatgcggagataccttatggcaagcgagccagttgacacacagaaactaacatcgtcatcttcacctttgtcatccagagacgacaagtccaatgacatgcggagatgccttacagttatctgcaccttttgccagctagaggcaagcgagccc

SEQ ID NO: 28209 - DNA, 345 bp, Glycine max
  Peptide Sequence Number=SeqID_144987
atgaccggaaggctacttgccgattcattggctcttgaaagccacatcctccattatctaattgtctgtatcttactccctagatcttcaaaccttgcacaggcattgcgattaaatgctcctttgccctatcctcacttagttaccttgttccttcaacattttaacatccctcttgattctgaaccttatgttccaatcaagagatctttcttgattggtgctattgtggttgcctcctttggttaccgcaaagaccgtgatggcacttgggtaaaaaagggtgctcaaccaaatgatgatgaaggacacttaccggttgaagaggactcttctctcctttag

SEQ ID NO: 28210 - DNA, 165 bp, Glycine max
  Peptide Sequence Number=SeqID_144988
atgcctgatgggagattgatcgaaaaaaatgctgcagagaaagatgaccggaaaacaaccataggcgacatcggtcgtcaaatacagccgactgatattcatcgagaaacatcatcgaaaatcatttaccaagaacggttgtttttcggccgacattgtgcaaag

SEQ ID NO: 28211 - DNA, 267 bp, Glycine max
  Peptide Sequence Number=SeqID_144989
atggctctttattctgtttcagcattgctcgttgctaccatgttctgtgttttggctttggtaaccaagttaccccatacaagaggaaaatcaggatatcctagtcaaaagattcttagagagcctaaaagtgagcctcaaattaggcaaaatattccactaggagtgataggtgccattgttgatcctgcgctcattgctggaaagtcaattgtgccgaagcctccaactcaagtttttatatctttgattcaaaaaatactttga

SEQ ID NO: 28212 - DNA, 189 bp, Glycine max
  Peptide Sequence Number=SeqID_144990
atgaggaaacaaaactttcacagggatgagttcctgcgttgcacgagatgcgggaaggagcgcaggttccatctcaagagcagaccagacattaagaactaccatgatgctttaaacaacaaatgctggactctttctctttggccttatcaaaaattatcatccatggactcagagatggagagataa

SEQ ID NO: 28213 - DNA, 135 bp, Glycine max
  Peptide Sequence Number=SeqID_144991
acagtcgaaattccacaacggaagtactcgagaaatttgaatggtcataacttttcacacggatgtccgaatttggctttagcagctggagccacatgtccactagatgttgcaaaaactcgaaggcagatagag

SEQ ID NO: 28214 - DNA, 381 bp, Glycine max
  Peptide Sequence Number=SeqID_144992
ttggtaagctagcaaaagaagtggctgaattaccctttttagtcacaagagaagaaaactttgaagagtttaaagcttatgaggagagtcttgtagaagagcatgattcaagagaaagagatgaagaaaagaagaaaaaggaagaaaggcatgtagaatgtgataaatctttaagtgtcattctctccttgaacaccaatgcttctcttgcaatggtatggaaggcatttttgggatacatgagtttcatggagtctttagctaagaagcgaaaatgcaaggaagatgtgttctataagtcggaggaaaaactagaggaatctcaggaaaacgctagagatgccgctatcgttgtcggaagacatgtgagtccgctcagag

SEQ ID NO: 28215 - DNA, 306 bp, Glycine max
  Peptide Sequence Number=SeqID_144993
ggaaatgttatgtcagtagaagacaatcagtgtgaacatatcatcacaagaattgaggtagataacaagaaagtcaaaggagaaactctcgatttggaatctggtgtgcacaagaatcagactatgtccaaagaccatctctacagattaatggtgatccaagctgatatcactgttgttgtgcttggtagtgtgctagcctcagcaagttcaacatctttgcccaatcctgcgaatcctaaagacgtatatgtagatgtattcctaaccagtggctgctcctctacatcttcagcttcatcatga

SEQ ID NO: 28216 - DNA, 1065 bp, Glycine max
  Peptide Sequence Number=SeqID_144994
ccacacagggacgaaacgaaacgaaacgaaacgatccataacgatgatgatgcacactgtgcagtgcgcacgctcacttcgctaattaacactaatcgttacttaaatcagttacaacgagtcatcggaacaagtgccagtgcgccagatctcgatctcgatctcgatgcagtggcggttgctgcttttgttgcttttggagctaacggctcgcgcaatgccgtatccgatcactttttccgcgcgcctcgttcaccgcttcgccgacgaaatgaaaccggttcggcctccgaccggctactggccggaccagcggagcatgcgctactaccagatgcttctcaccggcgacattctccggcgcaagatcaaagtcggaggcacacgctaccagctactgtttccttctcacggcagcaaaacgatgtcgctcggcaacgacttcggctggaacaccgagtacttcgtttctcgtggcgttggacgcagggagtgatcttctttggattccgtgtgattgcgtacagtgcgctccattgtcatcgagctactattccaatctggtgctccttcacatatggggcatctattatgcaggatagagacctgaatgagtatagtccgtctcggtcgctatccagtaagcatctatcttgcagtcatcggttgtgtgataagggttccaattgtaaaagttcccagcagcagtgtccatacatggtcagttacttgtcggagaacacgtcgagttctggattgttagttgaggacatactgcatcttcagtcaggcggcactttatcaaactcatctgttcaggctccagttgttcttgggtgtggtatgaagcaaagtggtggttatttggatggggttgctccagatggcctattaggtttggggcctggggagagttcagttccaagttttcttgctaaatcaggattaatccactattctttttcattgtgctttaatgaagatgattctggtagaatgttttttggggaccagggaccaaccagccaacagtctacttcattcttgcctttggatggattatag

SEQ ID NO: 28217 - DNA, 213 bp, Glycine max
  Peptide Sequence Number=SeqID_144995
atgtgtactaactacataaacctaaacaaagcatgctcaaaggactctgaccccctaccaagtactgaaagcaatcgggtagtggtgcgaactaatcaccccattcagcaaatcctgaggaagtcagaactagcagaacggatgatagcatggttgttagagttatcagagtttgacataaaatttgagctaagatggcctgttaaagcatag

SEQ ID NO: 28218 - DNA, 330 bp, Glycine max
  Peptide Sequence Number=SeqID_144996
atgtctcctccacctctagaaccttacaatcactcacaaactcatctcaagctctcaggacgactttctcttcaagcttcgttctctgcaggtggccttgttggtgcttgtgcgcttagcataactctggctcgcttagctagcattagtgaatttcgacttatcgcttgtcttttcgctctgcggatggactcaagtgatgcacttagcgggattagccctcgctcatcgaacatgcacagctcatccttcttccagattcttcctcgcgctcaacaaaaggagtgttgcacccagcggatggctcacaaagccagaaaattggcttag

SEQ ID NO: 28219 - DNA, 270 bp, Glycine max
  Peptide Sequence Number=SeqID_144997
atgattaatattcggcttgaactcatgccttgtccccgacaggagcccggcgaggaaaaactaagaagtggagacaaaggtgggataaacaagaccccacagtccattgctatgcctggagagaaaagaaggaaaggttggtcaagtgaggtctgtaactgcaaattaaagctgccaaacaaacaagaaggcatcatgccatcccagaaacaaatgcaaacccctccaacacctctccctttcaattcaccaattcccatactaacataa

SEQ ID NO: 28220 - DNA, 300 bp, Glycine max
  Peptide Sequence Number=SeqID_144998
atggacttgttgttggagtggagaaaagtttctccgttggatccaaagttcatccttttctcctccattttcacaaagctctctttttcttctatagagaaagccttcaacctagttctggaggttgtcgtggtggctaacactgaatgggcctatagaatggatgttatgcaagctccattggagcttgtaggcctaggatcttcttcatcaatggattcctttgcttcttggaagatgaatggcagtggaatggagaaaggaagagagagaggagacgccacttcaaggagaagatga

SEQ ID NO: 28221 - DNA, 2516 bp, Glycine max
  Peptide Sequence Number=SeqID_144999
ccgagacaacattctcatacggctcactcaccttaaggagactgactcttgggcatggggagttgaaaccatggcccgactctcatgatcgaaaaattgaagcgatagttgagtattgtatgggatcaaactctgaagatgtgatgacagggtcagataaataccacgatataacatgcatgatgacacaaggtgttgtgcttctgtcagctggaaatgtcaacgccgggaatgcaaacgggcaccatgatgagtgtccagactcatttgattgtggaagtttgggcagaatttacttccccttcaccacggtacaatacctgaactgtggtgctttggctatccatggttgtgatgatcataaccaaacggcagtgaagcgtgtccagttgaacaatggagggaaactgttccaagttacacaagttaatagtcatcagaggcaggggtggagaactagtatttccattaccgatcatgatttcagaatgcttctggtaaatggtagttgtatggccttcacctacaacattatcttccctcccttctctgctttcggatgtccttcctctgatttttactttgcccctccatactctgattatgagtctttgcgctccttaatctcttcatgttcaatggttaaacttcccgtgagacaagattctcagttcttcaaagatccatttggatttttaactgctgaaattacctttgaattcaagttttcaaatgaatgtctccagtgttaccatggaagaagagatggcaattgccgacttgacagcaagggaaatttttattgcgccaacaggaaagctagagtttggacccggattcggaagctagcattgatgctaggcaccggcgtaggaccatggatcatatttgggttgttcctcacgttacggcactgcaaacggaaatatggccaatccagcagcaacaccagtgatgatccctacccaagtcgtgacacagagagtgacaggatcttctttggggtacccatcttctcctatatggagcttctagaagcaacaaacaattttgactccactagaaagcttggagaaggaggctttggcactgtgtactatggaacactaagagatggaagggaagttgcaatcaagcatctgtttgagcacaattacaagagagtggaacagtttatgaatgaaattgagatccttactcgcttacgccatagaaatcttgtgtccctttatggttgcacttcacgtcacggccaagagctactgcttgtatatgaatacgttcctaatggcactgttgctagtcatcttcatggtgatctagcaagggttggtttgttgacatggcctattcgaatgcaaattgccatagacactgcttccgcattggcctatctccatgcttctaacatcatccatcgtgatgtaaaaaccaataacattttacttgacatcagtttttcggttaaggtagcagattttgggctttcaagattgctcccaaatgatgtaagccatgtctccacagctccacaagggtctccggggtatcttgatccagaatatttccaattctacaggctcacggacaagagtgatgtgtatagttttggggttgtgctcatggagctgatatcatccatgccagcagttgatgcagccagggaaagagatcaagttaacttggcaagtttttgcattaaaaagattcaaaaaggaaagcttagtgagcttgtagacccatcctttggttttgagtcagaccaacaagttaaaaggatgctaacttcagtggcaggattggcctttcggtgtgtgctaggagacaatggattaaggccttctatggatgaagttctggaagcactcaggaaaattcaaagtgggaattatgagtctgagaatctagagaaaggagatgatgttggtggtggtggtgttacctcttccacttcctccaccgaacaagtacacgtacttcaaccaccaccagcttcaccggattggggtcaagctggaatttcaaagaataagttaccagcttcgccaatgtccttgactgagaaacgggaaagtgaatctaccacgcccaatgtcagtgatcattccgccaagtcagcaacggtggaacaagtattttatcgagagaaaagaagcgacatcggaaaacggttcggtcctacttgtgattccatggtgataatccaaagtatgaaaaggaaagtaatgaatgtgtatggaagaaaagatgcaaccattcccaaaatagatcccatgcttgagaacaacagagagagacagatagagagggagagggaaacagataacttaggagatggcagcgttgcagaaattcaagctgttcgcgacgccgtgtggagtggggcaaagcccaaggacgagcccattgattcaattccggcggcaagaacacgtggtggagaagaatccgatgcggagacactcactgaaggccctctttgtgtcctcggcgccaccagagaagcacgtggctga

SEQ ID NO: 28222 - DNA, 3231 bp, Glycine max
  Peptide Sequence Number=SeqID_145000
atgtcaactgatagcaatatacaagtagcagaacacatagagaatgcagcagttccaaacaacacacagatagcagcagacaacaatactaaccgagaggaattcacagttatgaatagcagaagcagcaatgggccaaaacgcaacactctcaggcccaagtaccttgcagatttcgtctatcaaactggtccgacctgcctcgcctccatgcctgagcatcacacgcgccaagtaactctcgataaacttgataatgttgtccaacgtctttcgcagggtcaggtctccctcaccgaaggacaagcttccctgtctcagagcaaccatgccctcaacaaaaaaatcgataacatccatgcctcacttaccacccaaatcgagtccctatttgaccgtctcgccgccatcgcagtccctcattcctcccccatctccgcctcccaaccccctccttccccgatctcgcgccaccatcatttgaagcttgacgtcccgcgcttcgatggccacgatcccctgggctggatatttaagatatcccagttcttcaattatcaggggatcccggaactcgaacgcctcaccatagcctccttctacatggacggcccgacgctttcatggtaccagtggatgcaccgtaacggatattttccctcctggcccgcgatgctccaagccctcgaatcaaggttcgccccatcgttctgcgacgatcctcagggcaacctgttcaaactccaccaaaccggctctgtcatcgactatctgacggctttcgaacgcctcgcaaaccgcacgattggcattgctccatcatcgctcctcagttgcttcatatccggactgatcccggagcttcgccgcgaggtccaggccctgcgtcccatctccctccctcaggccatcgagttggcccgtcttcaagaggataagatgttggaccaccgccgcgggtctccagaagagttagccattcatcgggatcaaggcctttgctaccattgtgacgataaatggtcacatggtcatcgctgccggtgtcgattacaccttctgatcgcagacaaagatgtcgagaacccggatattccactagaccccaacccagacctcactgtcgtttcccagatcagcctcaacaccatggaagcttcagccgtggtggctgctggcattgtagtgctgcagatggtcttggcttgctgctttaggagaaatatcttttggagggagaatccaacacattggattattgaagggtttttgaaggaacacggaccccttcctacagctcggtacagttattcagaggttaagagaatgaccaattcttttaggaacaaattaggccaagggggattcggtagtgtatacaaagggcagttacaagatggtcgtgttgttgcggtgaagattttaaataaatcagacagcaatggagaagaattcgtcaatgaagttgcaagcattagcaggacttcacatgttaacattgttaggcttttgggattatgtttggacagttctaaacgggctctaatttacgagtttatgccaaatggatctcttgacaattttatatatgaagagaagaatcccctaaaggttgctcgccacttggattgcaaagtattgtatgatattacaattggcattgctcgtggattagagtacttacacagaggttgcaacactagaatcttgcattttgacataaaacctcacaatatattgttagatgaggatttttgtccaaaaatatccgattttggactcgcaaaaatttgtccaagaaaagaaagcgtggtatcaatgctttgtgctagaggtaccgctggctatattgccccagaagttttttccaggaattttggtgcagtgtcacataagtcagatgtttatagttttggaatgatggtcttagaaatggttggaagaagaaaaaacattaaggctgaagtagacaactcgagtgaaatatattttcctcattggatttacaatcgtcttgaatcaaatcaagagcttggtttacaaaatataaaaaatgaaggtgatgaccaaatggtgggaaagatgacaatagttggcttgtgcctccatgtcagccctcccacgggcatgcttaattatacaaaatgccccgactacgatctctactacaagcacatcatcacggctgatgatgtgtctcggagttctttggcagcatgtacagaggtccagcttccaattaaagacgtgcctgacgctataaacccatttacctttgtaactgcagatatcatcattcgagtagacttaactgatgaatgtgcagattgcaactatcgccatggagggcagtgtaaacttgacagcacagagacattttgttgtgtcaatgttgtaaagaaagggttgagcttgaagaccaaactgggcataggggctgctggagttgttgttctgctgatggtcttggcttgctgttttaggaaaaacctttttaggagggagaacccaacccatcggattattgaagggtttttgaaggaacatgggccccttcctacagctaggtacagttattcagaggttaagaaactgactaattcttttagaaagcaattaggccaagggggattcggtagtgtatacaaagggcaattacatgatggtcgtgctgttgcggtgaagattttaaataaatcagaaggcaacggagaagaattcatcaatgaagttgcaagtattagcaggacttcacatgtcaacattgttagactattgggattctgtttagatagttctaaacgggctctaatatacgagtttatgcctaatggatctcttgacaggtttatatatgaagaaaaaaatccactacaggttgctcaccaattggattgcaaacaattgtatgatattgcaattggcattgctcgtggattagagtacttacacagaggttgcaacactagaatcttgcattttgacataaaacctcacaatatattactagatgaagatttctgcccaaaaatatcagattttggacttgcaaaactatgtccaagaaaagaaagtgcggtatcaatatttggtgttagaggaaccgctggctatattgccccagaaattttttccaggaattttggtgcagtatcacataagtcagatgtctacagttatggaatgatggtcctggaaatggttggaatgaaaactaatattaaggctgaa

SEQ ID NO: 28223 - DNA, 318 bp, Glycine max
  Peptide Sequence Number=SeqID_145001
atgccaaaaccgggattcccacaaaaaggttgtgggtggacatgcaagaaattttgggtccacatcacaggaggtgtttttggcaaggagatagaagaggatgatgtaggagaaaatcaggggagaagaaaggggtctgaggataaagaagatgttcattttggagggctgtggatagagaacattgaagaagagagaataggattatacccaaaagaagatgcggagtgtgaggtgagaggcgagggtatggccgcctacggaattgatattgacaacttgtctctgcctcttatctttgaatggaaccccgtgtag

SEQ ID NO: 28224 - DNA, 282 bp, Glycine max
  Peptide Sequence Number=SeqID_145002
atgctgaagctgaaagacacaaaggaattgaagtctcacctgagaggaagagtggatagggatggaaccacgcaacgagaaatggaatattggtctccaaacatgactctggagatggcagcgttatgtagtgcattggccatggcatctatcataaaggcaatcttactcgggtcaaaatcagacattgaatgtactattccaacagaaattcaaacctatttcgggactttgtgcgggacaagtaccttgtgctatatgtctatatctaattcacgttaa

SEQ ID NO: 28225 - DNA, 906 bp, Glycine max
  Peptide Sequence Number=SeqID_145003
atgccgcaacacctcgcacccttgccagctccgcttaccagcaaaggagacattgcaagaaagcttatagaaccactttaccctaccttgcctttcgagagcgacaacaacatccaccgtgatacacgtctttcccttaacgtgctcagtgtaggtaacagagtaccacagaccatcctcgggaagattcttaaggactccgcgagccaaacggtgaatcccgagtttcataatgttcagcatgttgtcacacagcaccaccttgtgtcctttggctcctctcttgcctccctcccgcgaccaccgtattcgtcgccgtcacctccaccaccaccaccagagccaccgcctccaccacgaccatggtcggcgcgggtttgtgcttcgtggacaatgaggttcggccgtaaaggtcttgaccgtgtcacccattgttcccaaaaggtggatgctttgacatgctcctttgccctcaagggctgcacacgcacattggctttcttcgaagccacccaaatacattctcagcttttgcgatttgggttcgaagctgatatcttgttgctgaccactttgctggacgtgtacgccaaaatcggtgatcttgacgctgcacaaaaggtgtttgataatatgtgcaggcgagacattacttcgtggaatgccatgatttttgggttggctcaaggaagccgccccaatgaggctatagctttgttcaacagaatgaaggatgagggacggagccctaaggaagtaattgttcttagtgccctattatactcatggaatgttatgaataagagcagaaaacaacaggacacagagcaagaaccagaaccaaagaaggaagaaaggccaatgagggaaatttacaaacctcagtacctcagagacttcgtatag

SEQ ID NO: 28226 - DNA, 498 bp, Glycine max
  Peptide Sequence Number=SeqID_145004
atgacacttcgagtgtccaatgccgcgttttcagtttcacgatcaaacaccaccaattccaaaggttgtcttcctcttcctcttactcagaatctcactcttcctagtacccgcgagtttgatattgctccgaatcaaacaaacattagattgttctacggctgtgggtcattgccttggctggaagagcacaaagttgggtgttttaacaaaacgagttcagttctggcattgtataaagaggataaaaatataagttttgtgtcaaagaattgcaagggcgaggttgtggacacgatagtggaagatggaataataggagggaatgaagaagcgttgacaaaagggtttttgctgacgtggaaggccggtaactgcagcgtgtgccacaacactggagggaggtgcggcttcgatttcgtcatgtacactttcaggtgcttctgcactgacagagttcattctgtcaaatgtggtcctgatgatgatccaggttag

SEQ ID NO: 28227 - DNA, 337 bp, Glycine max
  Peptide Sequence Number=SeqID_145005
atgaggctgctacaacgagcccagctagcagcgaaaactatacgtgcggttagacatagcaatgagcgggtcggatacgggtattgtctccccaatcccttatcccgactcctcaacatattcctataccggtacctgatatccgacgggtttgagtttatcgacgggtttgagtttattgtcccatcctcgtacccgtcgggtacccgtcagacggatctagtaatctcatacccgtatctgtacccgacttttggttatcgggaaaaacccgaacccgtacccatacccgatcaactcgggtattacccgtcaaagtcgggacggattcgggcgg

SEQ ID NO: 28228 - DNA, 249 bp, Glycine max
  Peptide Sequence Number=SeqID_145006
atggagttggcatgggcgtgtgtgcgaggagtgccttcgcagaggaagaagatggaggtgtgggtgaatggtgttaacgggcttccaacacattggttggaggctagcttagttatggcttcttctatgtgttccattctggttttgggtcgagttgttgtagccatggtggcagtgctcaatgaaagcaccaagttattatgttcccagaatttgaggactaggagatctccagaaaagggagattaa

SEQ ID NO: 28229 - DNA, 777 bp, Glycine max
  Peptide Sequence Number=SeqID_145007
atggctccagttgatttgttctgcttcctattttgtttccttgtactcattctctccgctggttatggaaatgggcaccaagattgtccacactcctttacttgtgggaatcttgggactctccattaccctttcaccaaggcagaactacctgactgtggcttgctagccatacgtgattgtgatgatcctcttcaacccacaaaaacgatccagctagagaaaaatggaaatagcagcagcatagtggttaatggcatcactcagcagggtgagatttcaattttggatgaagattttcacaagcgtttacaacaaaatacttgtggagcgttgaagaataattatagtcttccatccccttcttctttgtattctattcacatagaatataatgtaacactattcaaatgcaaacacagcctcaatatgaatatgaaacccccagcacattattttaaataccagtgccatgattatgattatgatatctattatgacagccttccctctcctaataataaggaggcgcatagccttttctcatcctactcagttattcagatatcatcaaaagacttgactgatacctcaaacattctatcgtttctatctgctgagatgactcttgaagtagtattatctaatgattgttacgagtgctataatctcagaggtggccaatgtctacttgacagcaatcaaaagttctactgtgaaaaagtgagttttctagaccagaccattgagattgtcacatacgaagtctcgtcttag

SEQ ID NO: 28230 - DNA, 150 bp, Glycine max
  Peptide Sequence Number=SeqID_145008
atggaatattggtctccgaaggtgatcgtggagatggtggcggtaaatgagaggaagcaatgcaatgcaatgcaatgcaacgttcaaacaacaagaagagataaaggaattgatggggttggtggcagagagttagttggtgcgtgctaa

SEQ ID NO: 28231 - DNA, 2019 bp, Glycine max
  Peptide Sequence Number=SeqID_145009
atggcagcaacactctctcacctcgttgctgttttccattttcttattcttcttcttcttcttctcatggttcatggttttagtaaccctgatttcgacgctcttttgtccttcaaaaccgcttcagacacatcccaaaagctcacaacatggaacattaacagcactaacccgtgttcctggaagggcgtgtcgtgcattcgcgaccgagtctcgcgactcgttctcgaaaacctcgacctagaaggttccattcaccccttaacctctctgactcagctccgagttctgagtctcaaaggaaaccgtttctccggtcccgttccaaacctctccaacctcaccgctctaaaacttctcttcctatctcgcaatgccttctccggcgagtttccggcgaccgtcaagtcgctcttccgcctctaccgtctcgatctgtccaacaacaacttctccggcgagattccggcgacggtcagccacttgacccacctcctcactctccgtctcgacggtaacaagttctccggccacattcccgatgtgaacctccccggcctccaagagttcaacgtctccggcaaccgtctctccggcgagatacccaagtccttatcaaatttcccagaatcctcgttcgggcaaaacccgtttctctgcggagccccaattaaaaactgtgcacccgacccaacaaaacccggatccgaaggtgccatcgcttcaccactggtaccacccaacaacaacccaacaaccactgtatcatcttcaccaagttcaatgccgaaaacaccagcatcagcatcaacaaaaagtaataaaagccacggaaagggtggttcgaagataagtccagtggcgcttatagctattatagtgtgtgatgttttggttcttgcaatagtgtcattgcttctgtattgctacttctggaggaactataagttgaaagagggaaaagggtcgaagttatttgagagtgaaaagatcgtgtattcgtcgagtccttaccctgctcagggagggtttgagaggggtcgaatggtgttcttcgaaggtgagaaaaggttcgagcttgaggacttgcttcgagcatccgcggaaatgcttggaaagggtgggtttgggactgcgtacaaagcggtgctcgatgatggaaatgtggttgcggtgaagagactcaaggacgcgcagattacagggaagagggaatttgagcaacacatggaattgttgggaaggttgagacatcccaatgttgttagtttgagggcttactatttcgcgcgcgaggagaagttgttggtctatgattacatgcctaatgccaccttgttctggctccttcacgggaaccgaggacccggacgaaccccactagactggaccacgaggctgaagatagcagcgggagcggcgcgaggtgtggctttcattcataactcgtgcaagtcccttaaactcacccacggtaacatcaaatccaccaacgtcttactcgacaagcagggaaatgcacgcgtgtctgattttgggctctccgtgttcgcgggcccaggcccagtgggtggcagatccaacggctaccgcgctccggaggcatcggagggtcgaaaacagacgcagaagtctgacgtgtactctttcggtgtgctcctgctggagctgctcacagggaagtgtccctccgtggtggagagtggagggagtgcttacggcggggtggtggacctaccaaggtgggtccagtcagtggtgagggaagagtggaccgctgaggtgtttgatttggagctgatgaggtataaggatattgaggaggagatggtggggctgcttcagattgcgatgacgtgtaccgcgcctgcacccgatcaacggcccaggatgacccacgtgctcaagatgattgaggagttgcgtggggtcgaggtgtcgccatgtcatgactccttggattcggtgtctgagtctccttccttgtctgaagatgcgtgtggaacaaccagtcagtga

SEQ ID NO: 28232 - DNA, 1215 bp, Glycine max
  Peptide Sequence Number=SeqID_145010
atgacgactaagagtgattttgatgacacagacgttgatatttctttgagccacagagttaatgctgtgaagccttccaaaactgtagccataagtgatcatgccactgctcttttacaatctggagttcccgttattcgcttagctgctggagaacctgattttgacacacccgctgttatagctgaggctggaatgaatgcaattcgtgaaggttacacaagatatacccctaatgctggaacattagaattgcggcaagcaatatgtcacaagctaaaagaggagaatgaaattacatacactcctgatgagattgtggtcagtaatggagctaagcagagtgttgttcaagcagtgcttgcagtttgttccccaggagatgaggtgaacatttatctaaaatcatatagaaatattaatgatattgtagaagtcaacgtgaacccaaataaaacacttatgctgctaagtcatttagaagttattattccagctccattctatacgagttatccggaaatggcaagattggctgatgcaacacctgtgattcttccaagccatatatctaataattttcttttagatcccaaactgctcgaagccaatcttaccgaaagatcaagactacttattctttgttcaccgtgcaacccaacaggatctgtctactctaagaaattacttgaagagatagcccaaattgttgcaaagcaccccaggcttctggttctctctgatgaaatatatgaacacataatttacgcaccagcaactcatacaagctttgcatctttacctggaatgtgggaccgaactctaactgtgaatggattttccaagacatttgcaatgactggttggcggcttgggtacattgctggtacaaaacattttgttgcagcatgcggaaagattcaaagtcagttcacttcaggtgcaagtagtatatctcagaaagctggagttgctgcattaggactaggctatgctggtggggaagctgtttcaaccatggtgaaagccttcagggaaagaagggatttcttggttgaaagctttagagaaatggatggtgtgaaaatatctgaaccacagggagcattttatctattcattgatttcagctcctattatggaagagaagttgaagggttcggtataattgagaattctgactccctctgtcgatacctgctggacaagggcctg

SEQ ID NO: 28233 - DNA, 1371 bp, Glycine max
  Peptide Sequence Number=SeqID_145011
atggcatggctaagcctgttaattgtcacattttacaggtttggttttctggtggaatatctttcagatcccacgatcgtggggttcttggcagcagctgccgtgagcattgggctacaacaattgaaaggattatttgggatcgttaactttaccaacaaaactggtttattttccgtggtcaaatctctttggacatcgttcaaaaaccaaggcaaaaggaacaagaaactgatgtggttgtcacacgttgctcctctcctttctgttattgtatcctctgttgttgcatacaaaataaactttaacgagcttcaagtgaaggactacaaagttgaagtcttgggaccaattaaagggggcagctcgaatccaagctcactccatcagttaacatttgatagccaagttgtgggtcatttgatcagaatagggctcaccattgctattatttcactcacgggatctattgctgttggccgatcatttgcatctctaaaaggacacagtattgatcccaacagagaagtggtgtccttgggcataatgaacattgttggatccttaacttcttgctatattgcatcaggatctttgtcacgtactgctgtaaactacaatgctggctctgaaacaatggtgtcgaacatagtgatggcactgacggttctcatgtcacttaaatttttgacggggcttttgtatttcactccgaaagcaatccttgcagcaataattctctcggccgtaccgggactgattgaccttaacaaagcacgtgaaatttggaatgttgataaaatggatttccttgcttgcactggagcctttttgggagtcttgtttgcatctgcagaaataggccttgcaattgggatcacgatatcatttgcgaagataattataacctcaattcaacctgctacagcggttattggaaggcttccaggaacggatgcattcggcgatgttgaacaatatccaatggcggttaacattcctggggttttgatagtctctttaaaatcttcttggctttgttttgcaaatgcaaatcttgtggaggaaaggattgagagatgggtgaacaatgcaaaagctaaggaaggaagagaaagcaccttcacatacgtcattattgatgcctcaagtcttacgaatattgacaccgcgggaatagcttctctggtggagctcaacaaaaatctgatttcacggggagtaaagttagctatcgctaaccctaggtggcatgtaattcacaagctaagattagctaacttcgtgagcaaaattggaggaaggattttcctttctgtgggagaagcagtagatgcatgtgttggcactaaaataatggttgttgtataa

SEQ ID NO: 28234 - DNA, 936 bp, Glycine max
  Peptide Sequence Number=SeqID_145012
atgactaagaagacttggattcagaagatgatgattggtgattcctatctacgaaacttgtatcaccctgacaagaatgccagcaatcctgaagcttcggagctatttaaagaggttgcatattcttatagtatcttgtctgacccagaaaagagaaggcagtatgacagtgctggatttgaggcccttgatgctgatagcatggacatggaaattgatttatctaatcttgggactgtgaacacaatgtttgcagctttattcagcaaactgggtgtccctatcaagactaccatttcagctaatgttcttgaagaagctctgaatggaacagttacagtcagaccccttccaattggatcatcagtcagtggaaaggtagagaagcaatgtgctcatttctttggtgtgacaataaatgagcaccaagctgagtcaggcattgtagtaagagttacttcaactgcacaaagcaaattcaagttactctactttgaacaagatgcgaatggaggctatggtttagcattgcaggaagacagtgagaagactggcaaggtgacatctgcaggaatgtatttcttacattttcaagtgtatagaatggattcgacggtgaatgcgttagcaatggccaaggatcctgaaggggccttctttaaaaggttggaaggtcttcagccttgtgaagtctcggaactaaagcctggcactcatatatttgctgtttatggagataacttctttaagactgctagctatacaattgaggcagtatgtgcaaaatcatatgaagataccacccaaaaactgaaggacattgaagctcaaattttaagaaagaggaatgagctacgccaatttgaagcagaatatagaaaggcattggcacgctatcaggaagtgacagacagatacacaaaagaaaaacaatcc

SEQ ID NO: 28235 - DNA, 183 bp, Glycine max
  Peptide Sequence Number=SeqID_145013
atgcatgaaaatgacagaaaaataaggagaaagcttgaatcatcggatgaggagatcaagagtgctttgcaacattggaggttcttgttcatcaaaagtgcttatgaggagaacaatagtgctttggttcaaatatcggaggttcttgttcatcaaaagttcttatttgcagtgctcttatga

SEQ ID NO: 28236 - DNA, 327 bp, Glycine max
  Peptide Sequence Number=SeqID_145014
atgaaaaattccaacaataataataataaaagaaaaagaaaagaaaaactcaaacgggaatcgaaagaggagaacgtacttaagagcaagctttctaaacagtgtgacatgttactcatcggcccaactgctccaaaaatcgaattcaaaagcaacaaagatgttcccacggaaggaggacggcacgcgattcaaagcggcattggatcggtcgtggattggcttctttccttggaatgggaaaataaggcggataatttacaaggtgggaatttgggatctgggtgggaacagaaaaaaactcgattcagtttcagtcgtatatag

SEQ ID NO: 28237 - DNA, 629 bp, Glycine max
  Peptide Sequence Number=SeqID_145015
gtatctccgcgtatcatgggtgcagaatgaccaaacttggtctctgcgtgccatcggacacaactgtgtctgaatggcaaaggggtgcggataaccataaggtatctccgcgtatcatgggtatcttcgcgtatcatgggtgcagaatgaccaaacttggtctctgcgtgccaacggacacgactgtgtctgaatggcaaaggggtgcggataaccgtaaggtatctccgcgtatcatgggtatcttcgcgtatcatgggtgcagaatgaccaaacttggtctctgcgtgccatcggacacgactgtgtctgaatggcaaaggggtgcggataaccgtaaggtatctccgcgtatcatgggtatctccgcgtatcatgggtgcagaatgaccaaacttggtctctgcttgtcatcgggcccgccgcctctggatgacaaaaggggtgcgaataaccataaggtatcttcgcgtatcatgggtatctccgcgtatcatgggtgcagaatgaccaaacttggtctctgcgtgccatcggacacaactgtgtctgaatggcaaaggggtgcggataatcgtaagggtgcggataatcgtaaggtatctccgcgtatcatgggtgcagaatga

SEQ ID NO: 28238 - DNA, 411 bp, Glycine max
  Peptide Sequence Number=SeqID_145016
atggttacttccgtacttcaacttgactcgatgaaccttttcgtaaaagcacgagcttggttcaaccccataacccagggaatggcaattttgatcgccaatacttcatcaacatttcacagggatgaaagactcgggaatacgcatgggaaaacgcaagggtcacgtatgagcaaacatgaaaacaattggtatgcaatttgtagatcaaaaagcctggaaaatcatctctccttacctgcgcatttgggggcgcagtgccccatgtgtgcagttaagaagacgatatggatcttccgacttcccacgacaaaagacgagacctacatacaacgcatgtgtgacgacatgatgcagatgcgcaaaagcgcaacagggggatttacacagcatggcaatatcctcaaataa

SEQ ID NO: 28239 - DNA, 1125 bp, Glycine max
  Peptide Sequence Number=SeqID_145017
atgtgcttgctgggtgttaagagtaatgagtttaccttccccagtgtgcttaaggcatgttcaatgaagagggatctaaacatgggtaggaaggttcatgggatggctgttgtcatagggtttgagtctgatgggtttgttgttaacattttggttgttatgtatgccaagtgttgtctgctagctgattctaggaggttgtttggtggaattgtggagcaaaatgttgtttcgtggaatgccatgttctcttgttatgtgcaaagtgagtcgtgtggtgaggctgtgggctcgtttaaggaaatgtctagaaaggacggttcgtggattatgctaaagatggggcttaatttggatcagttttctgagaatgtattcgttgacatttattggcttattgctggttgtgttcttcacaatcgtaatgatttagctttgatgctgttggatgagatgaaaggctcaggaactcatccgaatatgtttacgctatcaagtgctttaaaggcctgtgctactatggggttcaaggagttgggtagacagttacattctagtttgataaagatggatgctgactcagatttgtttgctgctgttggagttcaagatgcagatatcaagccagatccatttatctgcagttttcttttaaatgtttgtggaaatttatttgcatatgctgatcgtgccttttctgagatacctaatagaggaatagtctcatggtctgcaatgattggaggatatgctcagcatggccatggtaaagaggctcttcaattgttcaatcaaatgcttagagatggtgtcacccaaccatattactttgggaaattaaatgaagcagtggagcttgtaaactccattccatttgaggctgatggctcagtttggggggcacttcttggagctgcaagaatccataaaaatatagaactcggtcagaaagctgcagagatgctttttgatcttgagccagagaaatctggtacgcatgttctccttgcaaacatctatgcctctgcagggatatgggaaaatgttgctaaggttagaaagcttatgaaagacaacaaggtgaagaaggagcctggaatgagttggaacgagatcaaagactag

SEQ ID NO: 28240 - DNA, 207 bp, Glycine max
  Peptide Sequence Number=SeqID_145018
atggaagatcacaacaatgatggaaaaggagaaagagcaagagacttcgagggaggagtgaaaaacgatgccattaagggacacaagaggttggagagattcaaaaaccagataactactacctataccagtaagattctagcccgtgaggttttagaaggaaaacgagaaggaaaacatgaaaaagtgacagtgagaaagttctag

SEQ ID NO: 28241 - DNA, 501 bp, Glycine max
  Peptide Sequence Number=SeqID_145019
atggctcaagcccaaggttggctagcaaacttaacctttaaaccacctgcacaccttaatccttattgcttgaaatttccatgtgaagaagatgagttggttgtagaccagcaagtgttgatgagttttatcattggaaaatataaagatgttgtgttgtgttatgtagcttccatagaatcatattctttgttcaaggggtttcaagaagagcttccatgcgtagaatttaaaatttcatgttctactttgttgtttgatgatgaagtctctcatgtgaagatggagaatgaagatgaggtttcaatggaggaatccaagactctaattctttcttctaatttgaatgatgagattaattcttattgtaattttgtttgtgcatctaaccatgcaaagtcttttgttataatgcctaaggaagaattgtacatcaagaatgaatgggcaagacaatttggagaagaggtggatgcacatgaggatcaaggcaaccattaa

SEQ ID NO: 28242 - DNA, 222 bp, Glycine max
  Peptide Sequence Number=SeqID_145020
atggaggacattaagtcctatgaaactaaaaaggaggaccttgagtcctatcaaaaggatgttgagtcctatgaaactaaaaatgaggaccttgagtcctatgaaagtaaaaaggaggacgttgagtcctatgaaactaaaaaggaggagcttgagtcctatgaaactaaaaaggaggttgagtcctatgaaactgaaaacggaggatgttcagccctataa

SEQ ID NO: 28243 - DNA, 609 bp, Glycine max
  Peptide Sequence Number=SeqID_145021
atggaggttgtgggaaagatgaagggtttgatgacaaagcacccacatggtggaaacttgaagaaaatgcaagagaggaggataaggaagcttgagatagaaacttggaaagaaatgaaggagcttatgaggaagacattcttaccgccttcttatgagagagatgcttatgacagactacaaaacctcacacaagatagcaagagtcttgaagagtaccataaagagatgataatgactataaggagagccaatgtacaagagcctaaaacttccatgacaacgttcctatgtgggcttaatagagacatccaatgcattgtgaagttgcagcactatgaaagcttggatatggtgcatcaagccaagaaaatagagagacaacttgagaggaagcattcctacaaaaagacctatcagtataactcttttagtggtaaggacaagtccaagaaggagggatcttccccatctaagcaacaaggttcaaagtctccaagtggtaaacatgtttctaaccctagcatttcttctacttctaggaacatttcaattaaatgctttaaatgtttgcacaacattgtccaaacaagaaaaccaaagttttga

SEQ ID NO: 28244 - DNA, 297 bp, Glycine max
  Peptide Sequence Number=SeqID_145022
atgaggaaaaataggaagaatgaaaacattcctttattgcggaatgggatagtggcttcaaataaaatccctgaagcatgtaggctttctgatggtcctactgggtctgttgtggttcactttgttgttatgttctccatgttcctcatagtccaggttgctatcagaaacgatcagcttcatatccttatccgtagaagacagtatgatgttatggaagtgatgaagaacaagcaagaacagcagcaacagaaacaacaaagagctatgtcacacacgcagattgcagcaaaatga

SEQ ID NO: 28245 - DNA, 540 bp, Glycine max
  Peptide Sequence Number=SeqID_145023
atgaagattcgtagctctaagaagatctcagcaaaatgggttcctgttttctctgtattttccttccttattggaatgctcataacaaccaggatatgggaaccacctgaatctaacggggtatttctgtcaaatcaccgacatgagcaagaactgcaagtggtgtcaggggattgtgctcctaaaaagcctgtgcaggataatgatgtaatgaataaagtgtacaaaacccatggagccattcagggtgtcagatctctagacaagcaagtttccatgcttcagatggagctggcagcagcaaggagtactcgagaacacaagatttcggatggttcagctaacaccttggcctcgggggtctccactgaaggccctcccaggaagaaggtgtttgtagtgattggcataaacactgctttcagtagcaggaagcggcgtgattcggttagagagacttggatgcctcaaggtgaacagcttcttcaattagaacgcgagaaaggaattgtcatcagattcatgattggtcacaggtaa

SEQ ID NO: 28246 - DNA, 126 bp, Glycine max
  Peptide Sequence Number=SeqID_145024
ggttgagtttgctcctgtgatctcagatctgcgaagtttgcacatgtctgagcaagtaacaattccagagttgcttatattttaccagtggcatgtctgtgtgtactgctccgattgcatattgag

SEQ ID NO: 28247 - DNA, 153 bp, Glycine max
  Peptide Sequence Number=SeqID_145025
atggtggacacaagcacaactgatgtgatctgttgtgaggtccatcctaatgcaacatcgttgttgtcccaaccttacaaggtcaacttgtgttacagtgtagggcgaaagataatagactggaaactggtgcaaaacaccatcaatggataa

SEQ ID NO: 28248 - DNA, 397 bp, Glycine max
  Peptide Sequence Number=SeqID_145026
gaaggcagagaattgcatcccatcttctcccacttggcaccaccctgaagggtctggaaggagagaaaactcttgggactgctcccaaggaaaatggccagaggtagccacagctgatgtcatggggagaaagcaaaaccccaagatgacagaactgaggtgcaaaggagtcttcaggctcaaggagctaagaatagggggaagaccacccccaatatgcttcattgatgagctctctgagaatggagcttggaaaagaggaatattcttggaaaacatagggaaaaaaaagactttgtataatcaagcttatcgataccgtcgacctcgagggggggcccggtaccagcttttgttccctttagtgagggttaatttcgagcttggcgtaatcatg

SEQ ID NO: 28249 - DNA, 246 bp, Glycine max
  Peptide Sequence Number=SeqID_145027
atgctggctgattcgaagttgaatattgaggtgcagcacgcgtggattcctccaccatttagaacattgaagtgcaattgtgatgcagcatttttcgttgaggaaggcatcacggattttggagcctgtttaaggaatggaggtggtgattttttacaagctagaacttctttgttaaagcaaatatgtcagtcaaggagggtgaagaacaagtggtgtcttacaggctctaatttggctcaataa

SEQ ID NO: 28250 - DNA, 1627 bp, Glycine max
  Peptide Sequence Number=SeqID_145028
atgttggaaaatttgcagatcttacagttcttggagaataggagaaaggtgcaccatgatgcaataaacttttgtcaagccattctgcaaaaaaagtcaattgaatggaaagctgtgcaccgtaacaatttgtcacagcccatcaatgatgttgacctagttattacacttggtggcgatggaactcttctgcaggccagccatttaatggatgacaaaattcctgttcttggagtgaattctgaccctacacaaattgatgaggtggaagagttcggcagtgaatttgatgctcgcagaagcacgggccatctttgtgctgctattgttgaaaactttgaacaagttttagatggtatacttgaaggtcaaattgttccttccgaactaacaaggattgtgatgtctgttaatgcactacacttgccaacttttgctctcaatgatatcttaatttcacatccatgtcctgcttcactttctaggttctccttcagaatcaaagagggtgaccagccatgttctcctctagttaactgcagatcaagtggtctaagagtttcaacagctactggttcaactgctgcaatgcaatcggcaggtggatttccaatgcccattttatcccaggatctccaatacatggtaagagaacctatttcaccgggggcaacctcagaccatatgcatgggttgatcaaacctgaccagacaatagtcgctacatggacttgtagaaaagggtggaacccggaattcggtttggttggggtagagaggatgaagattcagtgtaacgtgtgtgaggctgcggaggccaaggttctttgttgtgctgatgaggctgggctgtgttgggagtgtgatgagaaggttcatgcggctaacaagcttgccagcaagcaccagagagtgcctctttctacctcttcctctcatatgcctaaatgtgacatttgtcaggaagcattaggctattttttctgtctagaagatcgggctctgctctgcagaaaatgtgatgtggcaatacacactgcaaatgcttatgtctctggtcatcagaggtttcttctaactggtgtaagagtaggccttgaagctacagaccctggtgcttcctcaacttctttgaagtcagattctggggagaaagtttcagattcttctgtctctagaaaggtttccacagcgccccagccatcaaattataatgaagtgttacccgctgaagttggaggagttggggagtttccatcagccaaggtgtcctttggtggtggttccacagctggaaatatctcacagtggactattgatgaatttattggcttaaacgagttcagtcagaattatgattacatggaaggatcatcaagggctgacggtggtaagcttggggattctgattctcctgttttaagatctggtgaagaggaaatggaggaggaggatgactatttggaacgcgttccagattcgtcgtggacagtcccgcagatcccttccccacctacttcttctgggttatgctggccaaaagaccatactaatctgtatggttcatctgatagtgttctgtttgttcctgacataagcttctctcacctgcaacaatctcagatta

SEQ ID NO: 28251 - DNA, 483 bp, Glycine max
  Peptide Sequence Number=SeqID_145029
atggctaacatcccaaacagctcaagaagaaattacaaatcctgcaaatcttcacctgataattacgtgcctagtgcttcacctgatcacctggccatcaccctctatatcttccctattgctacagaaatattccatgtcaagggttccgtttattgtgatacctgccgtgctggattcgaaactaatgccaccttttacattcaaggtgcaaaggttggaattcagtgcaaagaaaggaagaccatgaaggtggtttactacacagagggtgtgacagactccactggaacataccacattgaggttgagaatgaccaccgcgacaatatttgcgaatgcgtgcttgttaaaagccctatcaaatggtgtaacaccccagactctgggcgtgacaaatccagcatagtactaacccaccaccaaaatggcgtagtcaaccatcttcactatgcaaatgctatgggttacttgagggactag

SEQ ID NO: 28252 - DNA, 366 bp, Glycine max
  Peptide Sequence Number=SeqID_145030
atggaaaaaaaagaagctatatggctagctgctctgatcagtgtgaagttcttccttaaagcaaactcacccatatttcaaagcttggaagaatacatgttcctactctccttcctcattgatgatggattacattctccatcagattatcacgcctccactacggcgttttgttttgaatcgcttcctatttctagtccacttttgctcttgttcaaaactctctgctgctcccacccagaatactcctcatatgggattgtttatcccattttaccttccatcccttgcccacaaagacgcgacgcgtttatgcgtgacgatgcatgcaactatgtcatccccaacatcccaaaaagagtgtga

SEQ ID NO: 28253 - DNA, 120 bp, Glycine max
  Peptide Sequence Number=SeqID_145031
atggcgcttaagcgagaatttatcaggcttaagtgcgatgctgagcttggtttaactaaatctcccctaagttgttgggattggattgtagtaggacttccaagcatctattctctatga

SEQ ID NO: 28254 - DNA, 612 bp, Glycine max
  Peptide Sequence Number=SeqID_145032
atgacggttatgttacaatcgatgtggaaagctttactttctacgacgttgttggcgtggtgtagtgagggtgacactcatcccatggaatcggcaacatggagtaaccctctccccctttccacactcacttccccttcccatttacgccacccctcgccctacaaattttcaactctccacgctttcccactctcttccctttcttcttctttttctttccacccttttccccttcacctcacaccctccctttcccctttctctccaaaacccatttctttcaaccctcttcgccctctccctcgcaccatgcacgccacgcgcatccaagacgccgttggaggggcactggccctcgtccaatcgtctcccgccacgtggcagtctgcgcttctcagcaacgcgcttatattcctcttggggtctccgattttggtctctggtttgtctctctccgggatcggtgctgcgtttctgcttgggacgctcacttggcgcgcttttgggccctctgggttcttcctcgttgccacctactttgttatttgtgaagttgggctttttggggagtggtgtggaatttgggaatgggtgtgcgggtttggttga

SEQ ID NO: 28255 - DNA, 609 bp, Glycine max
  Peptide Sequence Number=SeqID_145033
atggctcagctactagaagaatctgagtgctttggcctaagcttttctaactggatcaaccaccacatctcatacattgaagctctcaatgtatggctacaaaattgtatactacaaccaagggaacgtttcaagagcagaaaacccttctgccctctccgtgctttggctccacctatatttgttctttgtcgagattggtgtgctgggattaaagctttgccttctgaggaactaagtcacacaattaagaactttgtgtctgatcttcgttgcatggtagagcagcaagataaagagcttcatgaaaaacagaattcagctgttgcaagcattggtggagaaaccgagagcaaaactaatgaggatagtgaagatgattctttacatttgtgttgcatacatgcaagtttaaccaaacttgttcaccaactcactaaattttctgaggcatcattgaagtcgtatgaagatatcagacaaaaaagtgaaacagctcaaaccgcgtatcataattgcatgtctatcaggactggcaaaattcgatcctcaaatattaacttcctgttcttacctaaaattaatagaaaatctaagatgatctcttga

SEQ ID NO: 28256 - DNA, 573 bp, Glycine max
  Peptide Sequence Number=SeqID_145034
atggagttgtgtaggaagaaacagtggttagtatcagtattgttgggagcaatagttttgagtgatgtgttaggcaatagtagtggttgcttccaacaagagaaggctgcgttgttggatttcaaggctacttatcatggcaacgactcattgaagctgcgttcgtgggtgaatgaggctaagagcaattgttgtgattgggaacgggtcacatgtgattcctcttctggtcacgtaatccatctagatcttggaaatacaattgctgaaagtgaaatggtaccatttgtatatccacctggtgaaatgggaccatatacgtcgaacataaaaatgcctccatggccatatccatattgttcaaagcacacaagccgtttcttaaactggtccttgtttctacccttcaggaaattgacaagtctcagtctgtccaactcttgtttgctgggattcattcggacggaagtaattataacaggaatgaggaaatattgtcttggagttactattattcttaatctgtatgataaaatcataaatgtcaatcaatgtaaaatgaaggtagtataa

SEQ ID NO: 28257 - DNA, 486 bp, Glycine max
  Peptide Sequence Number=SeqID_145035
atgtttcaaggggatgttgctatagcggtacaaggttgcaaacaaaataatgttggtgttgttggacaatcaaattcaaagtacaataagaaggatctaactgtgaacgctgagagggaagatccttctgagttcatcactcacagggctaaagattttcttcctagcattaaggttatagagaatcggtttgtacgagcttctgaatctggtagggaggtctcaaggttattggaggcaaacaaaatcaaggttggatattatgaggcaaaagggaaatcatctcccacgattttgctagcggcttttatgtttgcttgctgcgatcaaaagggtacacctgtttgccaagaacctgcagagaagattattaattggaagagggcattatcttctcaatcatcctcagtcaggaacccattagttacaacatcgaaggaatatatattgataatggaagcgactttgttgaagaaccctgcatga

SEQ ID NO: 28258 - DNA, 315 bp, Glycine max
  Peptide Sequence Number=SeqID_145036
atgacgtggatgatacttggacgcattactcagaccatctggcggcagcaagtgatctatgtgttatgccagcccaatcatatccctcatgaggcaacaccggcatcgacacatgcggatcttgatgcggacgaacccagacatgtagtggaggcttgccatgcgatcgcggaggcgttggagcagcatctaaatgcgccaggcacatccacacatgaagaggtcatccaaaaatgtctcaggattgccaaaggtgtcacagaagaccgcaatgtgtatgtgaagtctcgacgtaggcggcgcactgatcagtaa

SEQ ID NO: 28259 - DNA, 275 bp, Glycine max
  Peptide Sequence Number=SeqID_145037
atgacgtggatgatacttggacgcattactcagaccatctggcggcagcaagtgatctatgtgttatgccagcccaatcatatccctcatgaggcaacaccggcatcgacacatgcggatcttgatgcggacgaacccagacatgtagtggaggcttgccatgcgatcgcggaggcgttggagcagcatctaaatgcgccaggcacatccacacatgaagaggtcatccaaaaatgtctcaggattgccaaaggtgtcacagaagaccgcaatgt

SEQ ID NO: 28260 - DNA, 897 bp, Glycine max
  Peptide Sequence Number=SeqID_145038
atggagcatgcctctccctcgcattacctcagccctctcatccgctctctccccttcgtcccctgccacgtgtcgtccctcgatttcctcgccgatcctttctccgacgaggtcttcgccaagttcctcctcactcccctctcacaatcacaacaacaacctttccaaaacgacaccaaggaggctcggaacgacgatgacgatgaggaccgcgagaacaacggcgtcgtttcgttcgcgaagatcctcactccctccgacgccaacaacggcggcggcttctccgtgccgcgcttctgcgccgactcgtgcttccctccgctcgacttccgcgccgatccgcctgtccagctcctctccgtcgccgacatccacggcgtcgagtggcgcttccgccacatctaccgcggcacgccgcgccgccacctcttcaccaccggctggagcaagttcgtcaaccacaagaagctcgtcgccggcgacaccgttgttttcgtcaaggactccgacggtatcgtctctgtcggaatccgtcgcgcagctcggtttgccgccgcgatcgagactccgccgcctgcggaacgggagggattttcgcggtccacaacagggagagtgaccgcggaggccgtggcggccgccgcggagtccgcggcgcgaaacgcaccgttcgaggtggtgtattatccgaggaccggctttgcggattttgtggtgagtgctgaggttgtggaggaatcgatgaagtgcgcgtgggtaggtggaatgagagtgaagatttcaatggagactgaggattcttctagaatgacgtggtatcaagggactgtgtcttctgcatgtgcttctgagaatggaccttggcgcatgcttcagacgtttattcatgtaaactaa

SEQ ID NO: 28261 - DNA, 135 bp, Glycine max
  Peptide Sequence Number=SeqID_145039
atggagcttggggatttgcacggcggcgccggcacatgcccgccagattttggggtcgacgcggctgggctgcggcggagacatgagggagaattgaagtatagagaagagactgagatgaaacgtgaacaataa

SEQ ID NO: 28262 - DNA, 427 bp, Glycine max
  Peptide Sequence Number=SeqID_145040
tttgttgtctgggccaactgggttcaaggcccagacgaagcctacaaaagccgaaaccgctctcagaggaaaagttgatgttgttgtaaatgtcgtcgtcgttgtctttttgggaatacacggtgctcctccttctgcggcccctcttcgccgtagcgttcgttctcttcttaatatccctcggttggtttgtggcgtggaaactggtgctggtgcacgtgccattggtgcaagaggttttcggcctcaagaagaaagctgttcgagtgaagcccccaactgggtgagccctagcgcagtggtaaagttgcaccttgatgaccagttggtcatgggttcaaatctagaaacagcttctttgcatatgcaaggctttatagccaacctcacctcgtgggataaggcagttgttggtgtattgaaatag

SEQ ID NO: 28263 - DNA, 666 bp, Glycine max
  Peptide Sequence Number=SeqID_145041
gttaattgggatgaacctgaagtcttgcagaatgcaaagcaagtcagtccttggcaggttgaacttgtttcccccccatttgcacttcatacagtattttcccccaacaaaaggcttagagctgaccagggttctgggctgttaagtaatagggagcaagatcccttctttcctatgccagggttctctaactcggcaatgggacacatgacagggttccctaactcaacagtgggacaaatggataaaccattgttgagttatgaaagttttcctgctggcatgcagggagccaggcatgatctatattctccattgagtttttccaactttttaaatgataactcttatctgtatatgggtagtggttcatttgggaacaatccagtgcaaagtttgggaactgtgacaacagagctaaacatgagcagttctcaatcggatgatttgtcaccacatagccagagtagttttcattcctttggcacagagtttactgggactcggaactgtgacaccaaagttggtccgggttcaattctgctgtttggtaagatcatacagcctgctgaaagtgatttgcatgatgctgattgcatggaacgtgatggcagcaggggcagcaataaactgaagacagtcgaggcatgttatttctcaaagtag

SEQ ID NO: 28264 - DNA, 384 bp, Glycine max
  Peptide Sequence Number=SeqID_145042
atgtacatctacgcatattacagacaacaatttgtctattgcatcatgaatgttgactgcattgtgccgcatcacgcactgaacccacacaaattattgagaaccacattaatgctattgtcgatgcatgtaagtgaacagtatgcagctgcgtacattacagatgaaagtttgtccgttacatcatggttgttgaccgcactgttcagcatcacgtaccaagcccaacgaattactgagaaccacattaaagcagttctcgatgcattgtgcagctgtaaacattacagaagaaggtatattgggacaattgtttctgttataaccttgttgccaacagattacgtacaaaagacagtttcttcgttgcatcatgactattga

SEQ ID NO: 28265 - DNA, 817 bp, Glycine max
  Peptide Sequence Number=SeqID_145043
atgtacacagtggaattccaaaaacgagggcttcctcatgttcatttattgttatttttacacgccaacaacaaatattcatctccaaacaatattgataatattatatctgcagaaataccttcacagaaagatgatccagaactctataaattagtccaaaatcacatgattcatggtctatgtggaattttgaggcatgcatctccatgcatgaaggaaggaaaatgtagtcgattttatccaaaaaagtttcagcccacaactcttatagatggagatggttatcctatatatcgtagaagaaatactggttggacaataaccaagaatggtattataattgataatagatgtattgtaccctacaatccaaaattgctgaaaaattaccaagcacatataaatattgaatggtgcaaccaaagcacttctatcaaatatttattcaagtacatcaataaaggatacgatagagttacggctgtgatggtacatgatgacaatgaaacagttccgcttgcaaacactccaaatgatgaaatcaaggaatatctggattgcagaaaaccttctgtagagaggctacagttccatcttccaggccaacatagcgttctctaccaagaccatgatgatattgatgatctcctctctaacccaagcatttctaaatcaaaatttatagcttggatgaatacaaaccaagcttttgttgaaggtaccatgaacaaacctgaagaagtatgggaaaaaacttggcattggttaagtgatgatattgtatatagtcatcgcagatcatcaaacactccag

SEQ ID NO: 28266 - DNA, 270 bp, Glycine max
  Peptide Sequence Number=SeqID_145044
atgttttctcattggtgctgctttgtgtgtctctttctcttggcgggtttgagagcagtggtagctaatgctcaggtttatagaaaagttggaaataaacacttaccttccaggtcaatattggtggatgcatcagggcatgaaaacttctctaccatacaaactcccattgattcagtgccttctaacaacaggtattgggtttccatcaaggtgaaggcagagagccctacgttcgcagccatggctgacaatcttgttgtgaaatga

SEQ ID NO: 28267 - DNA, 243 bp, Glycine max
  Peptide Sequence Number=SeqID_145045
atgcaacacaaaccaaaagttcagagagcaagcccaaaggagagaaatagtcaacggagtgaggacaagagaggtggaggtacgggatgggaatggcaaaacaatgctggcatgtcattgtggatgctgagttgccattgggtgggttttagaagttcgcggtggatggctggagtggcggtgtgtaggtccgtcaacatgaaccgtgaaagtggtatttctgtcagcagcaatgaaacgtag

SEQ ID NO: 28268 - DNA, 958 bp, Glycine max
  Peptide Sequence Number=SeqID_145046
atgatgaaccacctacctcgaatattcggccatagaaagaagcaagcctccgacaacatggacccgacgacaaagaacaagaagaagagtaagaagaagcagcagcccaaactcgagcgccgcaacgcctccaatcacttcgaatacgacgccggatcgtcgtgctcctggcgcggcggcgacgagaaggacgcttccgtctcgacgtcgtcgtcgtcgtcgtcgtcgttgcattgcacacgctcgatggacctctacgaccgcacgagcttccgaattgagggcgtggagggcgagttcgaccggatttgccgcagcctcggcctctccggccccgaggacttctccattccggccgccgcttgggaggccatgaagctccgctgctcctcggacctgcttcctcgccgccccaagcacggcggcgatgaattcgacgaagaggcgaaggagaaagaggaaattgaagttgtcgagagcgaggatcgagctagggttttggatgaatgtgttgtttctgctgagagcagtggttgctgtggtggaatcaagggttttcggcctccgatgctgaagccgccgccgggagttagggtttcggtggtggacgacgccacgtgttccacgtgggatttgatgcgggattttgcgccgaatggggaaggagaagggaaggatagttacgtggagttaaattcttttgatgatgaagatgatcatgagcgagtagagaaggaagaagaggaagatgaagaagatgaagaagaagaagaaggggaagttggtggagtgagggagaagagtgtagaagaggaaaatgcggcgaggattgcggaaattgtggatgatttttcagggttttctactccgaacgaagatgattcttcaagcactaccacgggtcctaggtctaacagtatatctcccaatgggagaatcaagcgtgttattaccgcgg

SEQ ID NO: 28269 - DNA, 303 bp, Glycine max
  Peptide Sequence Number=SeqID_145047
atgacaattatattttacaatgacatcaacttcggtgaaggtttccttcaatcgttgtgcaagaatgacgatttggggttccgaaacgacgaggtttatgctgcagcacaagataagatttctgattttgagatgaagctgatggacatcgacaatgagtaccttgggattctagaggagggtgtaaagttttccaccaaaggagacattggaactaccaatatagtttgcaagcagaatacttctatggacaagcctgaagaagcttctatcattgagatgaatgagccattgtccaacata

SEQ ID NO: 28270 - DNA, 201 bp, Glycine max
  Peptide Sequence Number=SeqID_145048
atgaaagcagaggaacaacagttacaaccttcgaagctttaccttttaggttctcggtcaaatccacgccatcaatggggagtgggaaaagcagagacatctcaagaattgttctattcaagcttggattacgattatcttgttaggatgttcagcttagattgtggtcttgacgtattgtcttgtaatattgttgattga

SEQ ID NO: 28271 - DNA, 207 bp, Glycine max
  Peptide Sequence Number=SeqID_145049
atggatgtggagatcaatggctacaccatcccacagggtgcacaaatagtgattaatgaatgggccaatggaaggaacccaagcaaatgggaaaaccctaattcattttcacctgagagctacatttgtgccgataaaaccgcacatgtacatttattcttggattcaaacactgaacaaattagttacgaaatagggctctcataa

SEQ ID NO: 28272 - DNA, 885 bp, Glycine max
  Peptide Sequence Number=SeqID_145050
atggagatgtgtaggaagaaacagtggttagtatcagtattgttgggagcaatagttttgagtgacgtgttaggcaatagtagtggttgcttccaacaagagaaggctgcgttgttggatttcaaggctacttatcatggcaacgactcattgaagctgcgttcgtgggtgaatgaggcaaagagcaattgttgtgattgggaacgggtcacatgtgattcctcttctggtcacgtaatccatctagatcttggaaatttatatacaattgctgaaagtgaaatggtaccacttgtatatccacctgctggtgaaatgggaccatatccgttgtccataaaaatgcctctatggccatctccatattgttcaaagcacacaagccgtttcttaaactggtccttgtttctacccttcaggaaattgacaagtctcagtttgtccaactcttgtttgctgggattcattcggacggaagatgacagcaagtcaacattgaagaagttggagactttagatctcagtttcaattatctcaatgagagcataatggaacttgtgggcgttctcccatctgtcaagaatttaattcttgctgctaattttatcagaggaccctttttgaaagaattatcacttttaccaaacttggaagtgttggatttggctattaatctgctcggcaatggcagccactttgcaactcaagattataaaaacaagtcaacattgaaaaagttaaagacattagatctcagttttaattatctcaacgagagcataatggaacttgttggtgctctccgatccatcaagaatttagctcttgccgataactttatagctagaccttttccgataaaaggtatgattgtacataactaa

SEQ ID NO: 28273 - DNA, 1956 bp, Glycine max
  Peptide Sequence Number=SeqID_145051
atgaagcaacttcgagaggcaggactgtcatataataatctcataggaactttggatccatgccttggcaatttgacatcacttcactctcttgatctctgctttaacttcttaagtgggaacccggcaccttttattgggcaccttgtctctatcgagaatctttgcatatctttcaatgaatttgagggcatattctcattaagcatttttagcaaccattcaaggctcaagagtttgctaattggcaatatgaaagttgacactgaaaatccgccttggatcgcaccatttcagttggagcaactagcaattacctcttgcaagttaaacttacccacaaaagtaattccaactttcctttcaaatcaaagtagcttgagagatattgatttatcgggtaacaacctagttggtaaatttcccagctggttgcttgtgaacaactcaaatttagaagaagtggatttatttcataattctttcagtggaccttttgaactaccctttgatctaaatcatcacatggacaaaataaaaaccttgtccttatcaaacaaccagatgcaaggcaagctccccgataacattggatcctttttccctcatttagtgaattttgatgtctcaaacaataactttgatgggcatattccagcttcaattggagagatgtcaagcttgcagggattgtatatggggaataataatttttctggcaatgtacctaatcatattcttgacggatgcttctcattaaaaacattgatgatggatagcaaccaactcaatggaacactgctgagtgtgatcagaaagcttagacttgtcaccttaaccgcatcaaggaacaactttgaaggtgcaataacagatgaatggtgccaacataatcttgttatgttagacctatctcacaataaattctctggtacaataccctcttgcttcgaaatgccagcgtacttgttcttgcagggaaacagtcttaccggcacgatacctgaagcattaataagcaactactcccgaccaacggccatagattttagtgacaacaagtttattggaactattccagatagcatatataagctttggtctttaagatttcttttattggcaggtaatcagttgcaaggccaactttccagtcaggtatgccaactagagcaaatcaatatcttggacctttcgcgaaataacttcactggctctatacctccttgcttcagtagcatgtcatttggaaattttactatacccttgtatagtcttgataggcttaaaccatttagccctagacctgatgttgcagaaatgcaactcacaacaaaaaatttatatctttcattcaaaagtgacaaatttcaaatgatgtcaggattagatttgtcatctaatcaattgacaggagagattccacaccaaataggagatttgcattacctccattcactcaacttatctcataaccatctacatggattgattccagagagcttccagaagctaaaaaacatagagagcttagatctttcaaataacaacttgagtggacaaatccctattcagttacaggacttgaactttttatctaccttcgatgtttcctacaacaatttgtcaggcaaagcacctgataagggacagtttgctaattttgatgaggacaactacaaaggaaatccatatcttacttggaataacagtaatagaggcagtctaacaacgctgccaccaccaagtactgcattgcatgatggagaggaaaatgacactgcaattgatttcactgctttctgttggagttttgcttcatgctatgtcatggtacaaatagtgttggtgataatcctttggatcaatcctcattggcggagacagtggttttattttgtcgaagtgtgccttcataaatgctttggtcaatttcttgaagatgtgttctactag

SEQ ID NO: 28274 - DNA, 202 bp, Glycine max
  Peptide Sequence Number=SeqID_145052
gaagctaatccgaggatgtcttcctcagtcgggcaaggttgttgccttggatataactttaccagtgaagcaagcattccatgctctttatcgagagggaatatctatggcttctttatgggattctaacaagtgccagtttgttggaatgcttagtgcgatggactttattctagtactaaaagaggtttgtggggaataa

SEQ ID NO: 28275 - DNA, 297 bp, Glycine max
  Peptide Sequence Number=SeqID_145053
atgataatgatgcctcagtggcgaaagcttatcacatttgttttgagagaagttgttactgatgttgatgttgaaggttttccaggcggaccccatgacacattagttttgagagattttgaaaattacattggtcttagagtttggaatggagtggaacatcctgagctaaagttatcttcccatggaaggaagatggctaagttcgggaggcatgctccagagattgaaggccttgtggcttccagcagactaagtcctttgatcgcatgctccctagatatgggcaatctatag

SEQ ID NO: 28276 - DNA, 2160 bp, Glycine max
  Peptide Sequence Number=SeqID_145054
atggaatcaactggcaaggattatgacaatactatggagcttgcatcttataggcagctaattcctccaagttctcctgatataagcaagatagttggaaccacaaagtcaaatcttcgaattggtcatgaataccaggtggaagttccttccatcataaaagaatcagaacagcttaaacttccaatgaatcctgctgattcagaacttgtagataaggaagtggaggataatgtagcagcagcagctaatttgaataattcgtggagtgatgctgatgtaaaaagttttctccttggtttgtttatcttcaggaagaattttgtgcagataaaaagatttttagagaacaaagggatgggggaaatactgtcgttttactatgggaagttttataagtctgatgaatatcagagatggtcagattgcaaaaaattaaaagggagaaaatgtataacaggacacaaacttttttctggtcggaagcaacgtgaactgttgtctcacttgactctccatgtctcagaagaatttaaagatgctttgcaacaggtttccaagtcatattcggaggggagaatttctctagaagaatatatctcttctttgaagtctactgtcggacttggtgttcttgtggaagctgtggatattggtaaggggaaggcagaccttacccgcccagctgtggaacatgtgaagaaaacccaggtgctttcaataccaactagcaaagcttggtcttctcttgggcccagtgatataatcaaacatttgactggaggatatcgactgagcaaagccaaaagtaatgatatcttctgggatgctgtttggccccgtttactggcaagaggttggcactcggagaaactaaagaatcaaggctctctaagctccaaaaatcttgtggtctttcttttccctggtgttaaaaagttttcaaggagaaaacttgtgaaaggtgatcattactttgattctgtcagtgatgtcttgagcaaagtgatagctgaaccaaatcttcttaagcttgaagttgtagaaactaaagttggtggcagcaatgaggaagatgcagaaacgggatccaacaaggatagtcaacctgataatcatcaccatcgttacctcaaacaccgagcttctactaacaatgcagaccatatgaagtgtgcagtttttgatactggtttggtgcacagagggaagacatctgatttaagggaattgaaatctttacctgccaatttggtaggtaaagttgaggtagatgctgatgatatggtatataataaagggaacaagcatgttagtaaaacaaaacaagggaaaggtaagcttgatgacatttcaccaagtgggacagaaactgctaagatatacagtaaaaagaatagtagtgatgctgactgccagaaaggtaaacacaatagagatgctagtggccaaaaacaagtgaatgttaaccctgatgatgcaaacaagatggcagaaaactgtgaaaatcagaagacctacgtgcctgatggaaatcaaccaaagagaaacgtagagaatcaattcagtcaaagagcaagatcaggtcattcagatgttgcagttcctcccatcaaacggcaaagactcacttcttgggctaaggctgagacaagccacattcttaagaactcctcaggaggcttaggatcagaaaaactgggactctcccagtcatcttgctttccagatgccaacaagaaggccggtaatccacttgatcatcagcaggatgtgactttaatttcttattcagctgaagtaagcatggaattgaaaaaagaagaaagaaatttcaatagagtctgtcttgacaagggtacttcttgtgacaaagttgagaaatgtgaatcacaacattccatcaacttcaatgcacctcaggtttcactgaagtttgaagatggtgaaatgatggaaatggcagaggaagatgagcagggcccaaagcccaatgacacaattccaaggaggaagagcacaagaaacagaccattgacagttagagcgttggaatcttttgcaaatgaattcttgcatgcacaaaggaaacagaaaagaaaacacaccctgacacttaaacacccattcagtgcttgcagccgcaaggctcgcacctaa

SEQ ID NO: 28277 - DNA, 267 bp, Glycine max
  Peptide Sequence Number=SeqID_145055
atgccacttctccccttcaacgtggccaaaaggagaaggttaagtaaaagtaagaggcaagaaaggcgaaaaaacaatagagaatccattggcgagtgcacaccactactcatggcagctaaaatcggaattgtggaacttgttgaaaaattcattgatgtgaatccctcggctacttttcatgttactaagaatgggcagaacatattgatcattctttgcctaaaaaatactaatgactggaatagacacgacccatctatatga

SEQ ID NO: 28278 - DNA, 1197 bp, Glycine max
  Peptide Sequence Number=SeqID_145056
atggttacggtggggacctcagggatatcgggggttggcaaagttgtgggccccagctactttccaatggccctcgtgggtcccatcaaatttgattgtgtcaaaatgacgcagcagaatgtggtagtgtctgatactaaatcaggagtttccttaacggttttctcaacaacacaaaagccaccggcggcgccaggagggtacatttccattccaaggaggagggttttgaagaaccttgaaatcaatggaggccaaagaatcaatgcatgggttgagtccatgagagcctcctctccaacccatcataaatccacaccttctttgtctcaggagcataactcttggattcttcaccatccatcagcattagacatgtttgaccaaatcattgacgcgtcaaagggaaaacaaattgtcatgtttctggactatgatggcacgctgtctcctatagttgacgaccctgaccgtgctttcatgtctgattcgatgagaaaaacagtgaggaaacttgctaggtgtttccctactgctatagtgaccggcagatgcaaagacaaggtgtacaattttgttcgcttggcagagctatattatgcaggaagccatggcatggatattaaaggaccaacaagaagctccaaatacaacaaagatagcaaagctgaggcaatcctttgtcaacctgccagtgattttcttcccatgatagatgaggtgtatcaacaattagttgaaaagacaaaatcaactcctggagctctggttgagaacaacaagttctgtctttctgttcattttcgttgtgttgatgaaaagaaatggagtgaactggcacgccaagtgaaatcagttttaaaggagtacccgaaacttcgacttacccaaggaagaaaggtgctagagattcgtcccactattaaatgggacaaagggaaagccttggaatttttattagagtcacttggtttggccaactgtagtgatgtctttcctgtttatattggcgatgatcgatccgatgaagatgctttcaagaaattaagagacagaggacaaggttttggcattcttgtctccaaatttccgaaagacacaagcgcatcttactctttgcaagaacccaatgaggtgatgaactttcttcaacgcttggtggagtggaaacatgtgtccctgcgagcacgttcctga

SEQ ID NO: 28279 - DNA, 432 bp, Glycine max
  Peptide Sequence Number=SeqID_145057
atgtatgcaaatgtttgcattgacgcaactcgccaagaagccatgcttagtggaacacaaaatgaaggcgttgccatggctatgaaaaagtcagccaactccaagaaagcaaatcgtaaatgcacacattgtaatggaaccaaccataccgtgaatacttgttttaagctacacggttatcctgaatggcacccaaaaggaaaaaaggtggaacctcccaaggactactccaccgcagctactgtatttgttgctaagtcaggtacatttcaaccaatttgtggtttttctgttgttactaagggtagtgattgggctcccaacacagggggtttagcctttcatatccatgagagactttacacttcaggggctcatgtggatggaagaagggattggatgactaaaggaaagaaagggaggaatggctaa

SEQ ID NO: 28280 - DNA, 280 bp, Glycine max
  Peptide Sequence Number=SeqID_145058
atggctggaagtctatcaaaaatcattccggatatgtcgaaaatagaacctctagatagctcaaattataggagatggtctcaaaaactgttgattttgtttgaagccttagaggttgattatgtgctatttgaagatcctcccgctgatgtcaacgcttctgaatcatctactcctaaaactcctgccacccctgtcgtcacaccgcttcctgcagaaaccaagaaagctgacgaagaagcaaagaagaaatatgaaaaggacaacaaaactgctagag

SEQ ID NO: 28281 - DNA, 372 bp, Glycine max
  Peptide Sequence Number=SeqID_145059
atggataaagatacactgggatatagtgggctgagaggtttgaataacctaggggaattagtgagtggtgactatccaacatttggtgcactcatttggcacgggagtggaggactcacccctacaaccaacaacttccaggaagagccacatcatgatttggaattcctgttgactccagttgagtacgatggttgggacaatgttcgccgatacagtttggagcaagtgcacccactggaggttagagaggatcatcgagaccatacagacatgtcgtctgaggagatcgaggagtaccaagaacttttgtggcagttgaagcatgcatccaaggaggagagtgacgatccttctgaggacatatcttag

SEQ ID NO: 28282 - DNA, 297 bp, Glycine max
  Peptide Sequence Number=SeqID_145060
atgcctgcgagagcagaacgcatggctcggaggagtgattttgatcaatacaccccttgttgcagtggggaaacctacgatgttgttatatattgtgggattattgacattttgcaggattacgatatcagcaagaaactggagcatgcttacaagtctttacaggttgacccttcatcaatctcagctgttgatccaaagctttactcaaaaaggttccgggattttgtgggtagaatattcattgaagactgccatgataatgaaggcagggagatctttgtacatggaggatga

SEQ ID NO: 28283 - DNA, 201 bp, Glycine max
  Peptide Sequence Number=SeqID_145061
atgacagagattgtgatagtaacaggatgcacttgcatagaccatgggacaatccctgacaatgatgatggtgacaacatgaaggaaatatcactcaaatatagcaagagtgacaacatgaaggaaatatcactcaaatatagcaagagtgacaacatgaaggaaatatcactcaaatatagcaagagtgttttttattaa

SEQ ID NO: 28284 - DNA, 426 bp, Glycine max
  Peptide Sequence Number=SeqID_145062
atggttaagtgcgattacgcgacaaacattgttgatgttgcttggatggttgggttttatgttttattgagtgtgttttcaattcagagtgacccgaagcgatcagaaattctatcgacctatccttcccctcgcaatctcgctctatgtcaccgctccactcaccaacctctattttttttcctctcgttgtggcgtcgtggcgtcatgctaccgccaccttctatgtcaccgcttgtaatctctttctttcctcttgctcggagtctcgctctcgatcttcatagcctcaccttctatgtcgccgctcaccaacgaccaacctttccttccttcctctcgttgtggcattgtgttgccgtcatcttgctagactcactcagttcatctgcaacattgtccacaaccacaagtcagttcaactaa

SEQ ID NO: 28285 - DNA, 1899 bp, Glycine max
  Peptide Sequence Number=SeqID_145063
atggatgattttaaaggaaatgctattatcatttacattttactagagaaatacagagtacagttgctttggggttcttttagaggcaagagcatgcatgggacattgatgccattggcagtgggggtctttcacatggcaaacaaaaatattgacgcagatcagaggataactcacgacttggagaagttaacagcagacttgtctggattggtcaccggaatgcacttggacatgtttgatgcttgttctttccttctattgattttgctaactgttgtttatgtcaaggttcacatggagaatgaaactattaacagaactgttactcctgattttggcaatttgataagccaagaacaacaacttgaaggaacctttaggttcatgcatgaaagactctgtactcatgctgaatcagttgctttctttggaggtggagctcgagaaaaagctatggttgaatcaagattcagagagcttctctcccactctaaataccttttaaaaaagaaatggctgtttggtatactggatgattttatcacaaagcaactccctcataatgtgacttggttgctgagcttattatatgctatggaacataagggagaccgtgcttcgataagtactcagggtgagctggcacatgcattgaggttcttagcatctgttgtttctcaaagctttttagcttttggagatattctagaattgcacagaaagtttgtagaactttctggtggtattaatcggatttttgagcttgaagaacttctggatgcatcacagtctggggactccatcaatagtagtattacatctccaatatgggattatcatggtaaagatgctatttccttttgtatggttgatattgtaacccctacccagaagatgttggccagggagttgacatgtgacattgagtttggtaaaagcctgcttgttactggtccaaatggaagtggaaaaagttccattttcagagttcttagaggactttggccaattgcaagtggaagactctctagaccatctgaggatgtggatctagaggctggatcaggttgtggcatcttctatgttcctcagcggccttacacatgcttgggaacattgcgggatcaaattatatacccattgtcccgtgaagaagcacagtttcaagcattgaagatgcatggaaaaggtgaaaaacatcctgaccttagaataatgttggacacacacttgcaagttatcctagagaatgttaggttgaattatcttctagaaagagacaataatggctgggatgcaaatctaaactgggaagacattctctctcttggagaacagcagagattaggcatggcacgcttgttcttccataagcctaaatttggtatcctggacgagtgtaccaatgcaacaagcgttgatgtggaagaacacctatatgggctagcgaacaaaatggggatcacagttgttacttcctcacaatccttcaacttagattgttcatgtccccaagaattcttggaaagccttaagaaggaaagccttgtgttggagctaaggcaaaacaagatttttaggtcacatttggtgggaaagggtgagattccttggaaggcaattcttgaatcaccaaagatggaattcaaggaatgggtgaagatggatttggtgagtggaattagtgattgtgaagatattatgttcaaggcaccacaagtgcaagtggagattaaaatacaagtggagaaggagaataataataataataggagaaagaggttgaacaataagtgggacgagtgtggatgcaaacatggtcatggtcaacatgcatggtgcagtgctgatgattatgatatatatgctttgggggcagttttggaggctttttga

SEQ ID NO: 28286 - DNA, 408 bp, Glycine max
  Peptide Sequence Number=SeqID_145064
atggctataagctccttgaaagacaagttcccatggtttactgccatggctaacttcaaagccataggggaaccaccaatagacctaaattcatatgatagaaataagttctaccgagaagctaagatgtatgtgacaagggaaaaattagctagcatactatggcattgtcaaagttcaccctatggagacgctattgcacatgctcaaaggtgcaacaagtgccaaagaaccagcaacatctttaggagacatgaaatgccactacaatctgtgttggagatagaggtctttgactattggggcattgattttgtcagtcccctaccattgtcatacgacaatgaatacatcctggtagcagtggactatgttgtagtgatgaaagtcacagtgattcaatattga

SEQ ID NO: 28287 - DNA, 222 bp, Glycine max
  Peptide Sequence Number=SeqID_145065
atgcaacacaaaccaaaagttcagaaagcaagcccaaaggagagaaatagtgaacggagcgaggacaagagaggtggaggtacgggatgggaatggcaaaacaatgacaatattgggaaaagaagaaatgggaaaaaaaaccccgacaggacagctgtaggtacgggcaaaaaaatggaaagcggagaagggaagaagcaaaaacggacaggacgaacataa

SEQ ID NO: 28288 - DNA, 225 bp, Glycine max
  Peptide Sequence Number=SeqID_145066
atgtgctcaatgagatactgggacggcaagtttttatatgccaaggtcaaggcatttatctatctttgttgcttcttgagaacagtttctaccggtattagtggtgcaagctactacactggaactttcaatattgtcaatcgctctccgggtggaagccattctggctgccacgtaatagagcagttgctagaagaatccagaacatgcgatggtggtctgtga

SEQ ID NO: 28289 - DNA, 99 bp, Glycine max
  Peptide Sequence Number=SeqID_145067
atgcatgttgcggcaagggcttatgatcgagctgcgatcaagttccgtggcgttgatgcggatatcaaaaggaaatcgacctttctaaaatgtcaatga

SEQ ID NO: 28290 - DNA, 942 bp, Glycine max
  Peptide Sequence Number=SeqID_145068
atggacccttgtccttcatcgaacacgaacaccgtgaacggtttctacacgttcgtgagccggggaatggaggagctggagcgagccttcctagccaacaacaacttcatctccgtccagttcctccagaaggtggtgtccctcctccgctccctccacacccagctcacccttctcgtccacaagctccagctccccctcggcgacaagtggctcgacgagtacatggacgagacctccaagctctgggaaacctcccacctccttaagtccgccatctccaacttcgaacctttctactcacagggcttcaaccttctctcctccctcgactcatcccacccccacctctccccccagatagtgagggcgatatcagggtgtagaagagaggctttgggattggaggagcagaaccgtgctctgatggagactcggatccacacgctgtgtctgcgtttagacgagagggtgtccgtggagtctaagctgaacggcttcaacggcttcaggggagttctctacgcaatgaggaacgtgagttcgatgcttttaatgatcctgctgcacggtttggtctactgctggccggaaacctcggagttggtcgccggagggtacgagggagggaggatgtttctggggtcggcggtgatggtatcggcggcgagactgaggcagcgggtggcggtggagatgcgcggcgcggcggggccggggattttgctgtacgagtttaggagggctagggtggctgtggaggagctgagaggggaattggaggaagccgaaggtggtgttagggagagagtggagagtgttagagtgtgttttggggtgcttagatctggagctgagaacattgtttgccagcttgatgatttctttgatgagattgtggaggggaggaagaagcttttggatttttgcagtcataggtaa

SEQ ID NO: 28291 - DNA, 881 bp, Glycine max
  Peptide Sequence Number=SeqID_145069
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctcatagatggtgccggggctggcaaacacacgcgtcatgcccggcccaaagttcagcgcgctgaagccgccaaacacattggtggcgcggcccgcctgctggcgctccagcagctcgtacttgcgcgtcacgggcagcttggccaatgcctcgcggctggtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 28292 - DNA, 336 bp, Glycine max
  Peptide Sequence Number=SeqID_145070
atgatgtataggttggtcagggtactgatgatggtaatgataaggagactaatgatggtagtgataaggggactgatgattgtagtgataaaaagtgacaatgaatacagatcattggatgataaacaagcaacaataggtgattttgaagatgaggatggtgaaaccgatgagttggaaacaccacttgaggatgaaaggatttttaagattaagaaaaatgacaagaaaaaagttgttgtaagatgtgacccagggtgtccatttaggctaaaggctaacacaaagacaagagctctcattgcttatgcactagacacatggggtaacaactga

SEQ ID NO: 28293 - DNA, 237 bp, Glycine max
  Peptide Sequence Number=SeqID_145071
atggcatggactcaggataacccgaggagaaggtttttttgttgtggactatacaaggtatcaagtaaaagagggtgtaaatttttttattggtatgatcctgaaatgaatccttatgaaaatagagttattcttggattgcttaagaagaaggatgagctaaagcgtaagaaaattgagctaatgacaaagatgcttgcaagagatattgatgttgtaagtgttaaggctatttaa

SEQ ID NO: 28294 - DNA, 267 bp, Glycine max
  Peptide Sequence Number=SeqID_145072
atggctccgaggaagcttgcctcaaagagatctaggaaggataaagcggctgaaggaaccagttccgctcccgaatatgacagccaccattttaggagcgctgagcaccagcaacgcttcgaggccatcaagggatggtcatttctccgggagcgacgcgtccagctcagggacgacgagtataccgacttccaggaggagatagcaatttgtgaaattccgggacatgccggaaaacaaaagaaaatattgatgcacaatccgtaa

SEQ ID NO: 28295 - DNA, 651 bp, Glycine max
  Peptide Sequence Number=SeqID_145073
atgttgatgggaattaaggcagtcaagaaacattacagatatttggggcttccacgcctaattgggatatcaaagagtcaaattttccaatttgtgcgaaacagggtgtggaaaaaagttaaagggtggaaggagaagcccaacaaggaatcctcaaaatccctctcagttataacccatccccggactgccaatgtagcagaagcttgcgcgttgaggactagctctcatcaaataaatgatgttcaaattggagctattacgcacgtcatttggcatatttggtttgcctgtaacaaacatctctttgataatcattttgtggggctgcaagctgtgtgtgtctccatcacaacagatgtcaagctctcgggtgactcctccacaggctcaaagttctcaacgactgatgatctcgcaaccttacaggcttttagtgtgacatgccacgcgaggaaaaatcataagatcattcaagtcaatcggtacccaccactttatggatgggttacatgtaatacagacaactctgccaaagggtgtcccggtcgtgctggttgtggggggttttatagagatcgtagagctaaatttctaggctgtttagcttttcatctgggcaccaattggcctatgttgtgggtggcatga

SEQ ID NO: 28296 - DNA, 2058 bp, Glycine max
  Peptide Sequence Number=SeqID_145074
atggaaaatctattgaatagcaggttgtttggttgggaaggttggatattttttaataaccgttggaggatagtgagttgtggagtaattgaatttcgccgtaagagtgataagtggagcaaggtagagaagggagatttgtacacgatactaacaatgttagttatggaaagaagtgaacctgcattagttccagaatggttgagaagtgctggaagtgttgccggggctggcagttcagcccaacagtttgcctcctcatctggtcatactgattctctttccgtagctcatcactcaaggaatagatcttctaagaatggtagtgattttgatagtgctcgttctgtgtttcttgaacggacatcctcatcaaattcccggaggagttctataaatggttctgccaagcatgcctacagtagtttcaacagaagtcatcgtgacaaggaccgtgacagagagaaagatagatccagttttggagatcactgggactgtgatggttctgacccattggccaacctctttcctggaaggatggagagggatacattgcggcgttctcattcaatggtttctaggaaacagagtgaagttatacctcgtagagttgctgttgatactaaatctggtggcagccatcagaacaatagcaatggaatactttctgggagtaatgttagtagcagcattcagaaagctgtgtttgacaaggattttccgtcacttagtactgaagagaagcagggaatagctgaagtggtgagggtttcatctcctggtttgggtgccgctgtcagtcagagtctacctgttggtagttcagctttgattggaggggagggatggacatctgcactggccgaggtacccgctataattgggagtagcagtacgggatctttatcagttcaacaaactgttaatacaacatctgggtctgtagcaccaagtacaacagctggtcttaatatggctgaggcattggcacagactccatcccgagctcgctctgctccccaggtgctagtcaaaacccaaaggcttgaggaactggctatcaagcagtcaagacagttgattccagtaacaccctcaatgcctaaagcttcgaggataattgattctgtgaactgtcaggttcataattctgagaaatcaaagcccaaaacagctatcagaaatgctgatatgaatgtagttaccaagactgtgccacagcaaccgtctgcattgcacattgcaagccaatctgttcgcagtgttaatgccaaagttgatactccaaagacatctgggaagtttactgatctcaaatcagtagtgtgggaaaatggtgcttcccctacctctaaggatgtatcaaatccaacaaattattctaacagcaaaccaggaaatcaacatgctgttgcttcaggagctgcctctgcaccattgaggaacccaaataacctaaaatcccctacggagcggaagccatcttctatggatttgaaattaggttccaatttggagaagaaacattccatctctcaagtgcagagccggaatgatttcttcaatctcattaagaagaaaacattgatgaactgctctgcagttcttccagattctggcccgatggtttcatctcctgcgatggagaaatctggtgaagtaaatagggaaatagttaacccttctgcaagtccccagtctcttggaaatggtactgaactgaccagcaatggtacccatgctcatgaagtgattcacagaatttctgataatgaggagaaagaatcaaatcccagtgttacaatatatcccgaggaggaagaagctgctttccttcgttctcttggctgggaggagaactcagatgaggatgaaggccttacagaggaggaaatcaatgctttctatcaagagtgcaagaaattggacccaactgcattcaagctaagccagggaatgcagccaaagctgtccaagttgtttgaatcttatgcatctaacttgcgtgaatcttctgctgagttgagctcttctgatcccggatctgaagcttga

SEQ ID NO: 28297 - DNA, 630 bp, Glycine max
  Peptide Sequence Number=SeqID_145075
atgagcagtgaaaatcatcaccatccccatcattacttttaccatcagaacctgcatatccatcacagaagcacattcctgccaatgctatgttcaaggccatcaatcaaagatgtgagtcttccacagtggagagacccaccaggatccttctccaatgaccctttgtccccaagaattggttgcatgggtcaggtgaagaggcacaacaaaatagttggactactcaccaccaaaagtaacaccgccaacaacatctccatttcccctagtgttaagtattccaagctcaaaaaactcttctcggggaaaaacttaggcacaaacaccatcaatgctgctactgctcctactgcctccagctgtggaagtaggccgcgagggacggtgaatagcacaaatgtgccaaggaaccacaagcacaggagtagtagaaatgagaatgttgttcccataagcattgaaaatatggatcctcctctacctgtgatcaagagagtgcagaagccagaggaagaaagacaagtggataatctttggaaaagaagatcaggtggggctgcattgaagagtttgcagcttcaacagattcaccattcaagacatcatcctcagcttacaagtgtttga

SEQ ID NO: 28298 - DNA, 417 bp, Glycine max
  Peptide Sequence Number=SeqID_145076
gatgagcaagatagagcattgccgattgcaaatgtgagtcgaatcatgaagcaaatccttccccctagtgcaaagatctccaaagaaggtaaacaagtaatgcaagagtgtgtgacagagttcataagttttgtgactggcgaggcatctgacaagtgtcacaaggagaatcgcaagaccgttaatggggatgacatctgttgggctctaagttcattagggtttgacaactatgctgaggccataggaaggtacttgcataaatacaggcaagctgaaagggagaaaatcaatcacgacaaaaagtatgaaaaccctcatatcaaccgtgctccaccaccaccactacttctgtctagggttactcgtgacaaggttgaaaaccctcctccttctcctcctaatcaatctggatga

SEQ ID NO: 28299 - DNA, 141 bp, Glycine max
  Peptide Sequence Number=SeqID_145077
atgactggaaggtattgtaaatttccagtttatatatggagggagaccatccgtgaggaagaagctcaaaagattcttggatcttgccgttcaagtaaacacacatactttccacgaaaggaagccgtcatcgtcgtttga

SEQ ID NO: 28300 - DNA, 138 bp, Glycine max
  Peptide Sequence Number=SeqID_145078
atggcttactctatgaggaccaatatctgcattctagtggttgccttccttgattccccatgtaaaatcactcttgatgtctatagatggtctcacagtgggaagactgatgctcttcctcacattgttcacaactga

SEQ ID NO: 28301 - DNA, 468 bp, Glycine max
  Peptide Sequence Number=SeqID_145079
atgtatgacaggactgttaagctagtaaatagaaaccatagattggaaaaagtcattgctaagctcattgatttgtccattgcctccatggaaaaccagaaaaacactaatgcatccatcaagaacttggagatgcaaaagaccttgccagctaagttgagagacccaggcagattcacaattcctattaccataaggaatttgtcgattgggataacattccttgacttgggtgctaccatcaacttgatgcccttgtctgtgatggagaaaattggaaacatggaggtgaaggagacctacatgactatccaattagcaaatcgttccatcagaatttcccatggagtggtagagaacatgctagttgatgtgggaaatttcacacttcccgtcgattttgtcattatggacatagaggaggattcaaacattcccttgattttagggagaccattcatgaattag

SEQ ID NO: 28302 - DNA, 1764 bp, Glycine max
  Peptide Sequence Number=SeqID_145080
atggcattgactacaccctctccaactgtcattttttattttcagccgccatgtgcggaatcctcgcagtgttgggttgcgtcgacaactctcaggccaagcgcgctcgcatcatcgaattgtctcgcagtcgaaaaatgtaggttgcggcatagaggtcctgattggagtggcatagattgctatgaggattgttacctagctcatcaacgccttgctattgttgaccctacttcaggggaccaacctttgtacaacgaagataagactattgttgtcactgtaaatggggagatatacaatcacaagcaattgagacagaaactgagttcccatcaatttcgaactggtagtgattgtgaagtgattgcccatctttatgaagaatatggagaagaatttgttaatatgctggatgggatgtttgcctttattcttcttgatacccgcgataaaagttttattgctgctcgtgacgctattggcattacccctctatacttgggttggggtcatgatggatcaacatggtttgcatctgaaatgaaagctctgagtgatgattgtgagagattcattgcttttcctccagggcatatatattccagcaaacagggaggattaagaaggtggtacaatccaccgtggttttcagaggatattccatcaactccctatgatccaatccttttgcgtgagacctttgagagggctgtagttaagagactgatgactgatgtaccttttggagttcttttgtctggaggattggactcatcacttgttgcttctgtggtcaatcgttatttggctgaatctgaaactgctcgacaatggggatcacagttgcatactttctgcattggtttaaagggttctcctgacttgaaagctgcaaaagaggtagcagattatcttggtactcgtcaccatgaactttatttcacagttcaggaaggtatagatgcacttgaagaagtcatttaccatattgaaacatatgatgtaacgactatcagagcaagtacgccaatgtttcttatgtccagaaaaattaaagccttgggagtgaaaatggttctttctggagaaggttcagatgaaatatttggaggttacctgtactttcacaaggcacctaacaagaaagagcttcatgaagaaacatgtcaaaaaattaaagctcttcatctttatgactgcctgagagccaataaatcaactgcagcatggggtgtagaggcacgtgtaccattcttggataaagaatttatcaacgtagccatgagtatagatccggagtggaaaatgataaggcctgatcttggaaggatagagaagtgggtgttacgcaatgcatttgatgatgataagaatccatatttaccgaagcacatattgtacaggcagaaggaacagttcagtgatggggttggttacagctggattgatggcttgaaggatcacgctaacaaacaagtcacagatgcaacgatgatggctgccaattttatttaccctgaaaacactcctactacaaaagaaggatacctctacaggacaatttttgagaagttctttccaaagaattcagcaaaggcaacagtgcctggaggtcctagtgtggcatgcagtactgcaaaagctgtggaatgggatgcatcatggtccaaaaatcttgatccttctggtcgtgcagcgcttggtgttcatgcagctgcatatgatggtgcagtggatacaaccaaaaatggacccctttaa

SEQ ID NO: 28303 - DNA, 474 bp, Glycine max
  Peptide Sequence Number=SeqID_145081
atgtaccttgaagatcgaacagttcgtttgcagctttgggatactgcagggcaagaaaggtttagaagtctcattccaagctacataagagattcttctgttgcagttattgtatatgatgtagccaaccggcaatcatttttgaacactaacaagtggattgaggaggtgcgtacagaacgaggcagtgatgttattattgtattggttgggaataaaactgatcttgttgaaaaaagacaggtttctatagaggaaggagatgccaagtcccgtgagagtggaatcatgttcatagaaaccagtgcaaaagcaggcttcaatattaagcctttatttcgcaagattgctgcagccttgccagggatggaaacactttcttctacaaaacaggaagacatggttgatgtaaatttaaaacccaccgtgaattcatcccagacagagcagcaaggaggaggttgttcttgctaa

SEQ ID NO: 28304 - DNA, 408 bp, Glycine max
  Peptide Sequence Number=SeqID_145082
atggttgcctcctccaacgggatagttcgggagcgttcatcagggctaaggcagattgaaatcagccttgccttacagtgctggaagatgaagcgtgggcattgtggttttgttagaaaacaagtcaatgttgttgctcataacttagctaaggatggaaagcagattgggaagaaggatggtgcagttggcgaacctccccataaagcttttgatgcccaacaccttcaccaacatccaagaaatcgcccttcagtgacgaagatcgagattaagcgcgtccttgaatccctctacagcttcgacgttgaaaaggtccgaaccctcaatatggagggcaagaagaagaagcgtggcggcttgttgatcgaaaacccgattacaagaaggcttacgtcaccctcatga

SEQ ID NO: 28305 - DNA, 366 bp, Glycine max
  Peptide Sequence Number=SeqID_145083
atggcaaagctcagagattcgcgtgacacgtgtcccactctgcctagaaaggtggaattaatgatgggtagtgggagatcgaggcgacggttaccattaaacgtgccatcatgtcgccgtttcaggaaagctgtatgcattagatgtcgtctcgagtttcgaagcatattacagagcaagagtctggtcaggacctgctcgaatcgaaaagagaggagaatctttaagaaggaattcccaggttcaaagaagtatttacgaagtacaaagctaagacaagaaagaggacttcgagctattgggcaattcgaactggtgtatggacgagtcgaagtcgaggcagcaagagttctggacttagcgtaa

SEQ ID NO: 28306 - DNA, 780 bp, Glycine max
  Peptide Sequence Number=SeqID_145084
atggccgctacaagtttaccagcctatgctgctagggagatgaaatcaattggcaaggattatgacaaaattatggagcatgcatctaatcggaagctaattcctccaagttctcctgataaaagcaacatagctggagccccaaagtcaaatcctcgaattggttttgaatacgaggtggaagttccttccatgataaaagaatcaaaacggcttacacttctaatgaatcctgctgattcagaacttgtacataaagaagtggaggataatgtagctactttgaataactcatggagtgatactgatggaaaaagttttctccttgctgtaggcattggtaaggggaaggaagaccttaagcttgcagtagaagaaactaaagttggtggctgcaatgaggaagaggcagagaagggatcctacaaggttcatgacaaactagaagagatatatcctgatgacgaacaggttaacgatgctgtcatcgaaatccttgaaaaaaggtcaggtcggccctcccaattagcaatgaatttagaggccaatctgaatcaaccaacaactaatgaagaactgaagcaagctctgagcaaatttcgaagtttggcttatgaagaaagcttcaagacttgtttcgacaggccgaattacaagaaagaattggcagaagcaattgatgagctcataaagttcaaggatacgatgatcgaggaagataaacatgatctggacgcattcatagagatttttgaccaagcatatcctctcagtaagtag

SEQ ID NO: 28307 - DNA, 771 bp, Glycine max
  Peptide Sequence Number=SeqID_145085
atgtcttcaagttccggtactagtgccacgccttaccccatcaaaacgattgtcgttttggttcaagaaaaccgttcctttgaccacatgttgggttggatgaagtccctcaaccgggaaattgacggggtcaccggtttggagtcaaaccaggtttccacattcgatccaaactcgaaccgggtttacttcggcgaccagtccgggtttgaagaaccggatccaggtcacacggttgaggatgtctacgagcaagtttttggcgagccgtggagtgaatcctcggcggcaaataaactgtccccgaggatgaaaggttttgcccaaaattcggcaaagcaaaagaagggatcaacggcggaaacggtgatgaatggctataaaccggatttattaccggtttacaaagagttggttaaggaatttgctgtttgtgataggtggtttgcttcggttcccggtccgacccaaccgaaccggctttacgtgcactctgcgacgtcgcatggattgaccacacaggacacgaagaaacttattggaggcttgccacagaagactatattcgattctttggacgaaaatgggttcagctttggaatatattatcagtacccgccatccactcttttttttagattttttcggtacaacaacggatacattgagaatatcggcgaagctatcaaacaaaaactagacgttaatttggatccaaatcccaataataaaccaacacaattgtgtagaaaaaatgacacagctcggtga

SEQ ID NO: 28308 - DNA, 873 bp, Glycine max
  Peptide Sequence Number=SeqID_145086
atggagcatgcatctaataggaagctaattcctccaagttctcctgaaataagcaacatgattggaaccccaaagtcaaatcctcgaattggtcatgaataccaggaggaagttcattccatgatacaagaaacagaacggcttcaacttctaatgaatccagctgattcagaacttgtacataataaagtggaggataatgtagcagcagctaatttgaataactcatggagtgatgctgatgcaaaaagttttctccttggtttgtttatatttgggaaggattttgttcagataaaaagatttttagagaacaaagagatgggagaaatactgtcgttttactatgggaagttttataagtctgatgaatatcgtagatggtcagactgcatgagaattaaagggagaaaatgtataacaggaggacaccaacttttttctggtcagaagcaacgtgaactattgtctcgcttgactccacatgtctcagaagaatatatagatgctttgcaaatggtttccaagtcatattcagaggggagaatttctcttgaagaatatgtctcttgtttgaagtctactgttggacttggtgttcttgtggaagctgtaggtattggtaaggggaaggaagaccttaagcttgaagttgaagaaactaaagtttgtggctgcaatgaaaaagtcgtagaaaagggatccaacaatgatggtgaagaacctggttataagcaacattaccattgttacctaaaaccgaagagggccattggggccaaagacccattggaagcactttcagagaaggaggcattgctattccaggccaatgaagaaaaggaaaatgcaaagaagaggccaccctcatga

SEQ ID NO: 28309 - DNA, 294 bp, Glycine max
  Peptide Sequence Number=SeqID_145087
atgacaatgttggtttccttagaagcattggcaatggctggcgcaagtgatgtggaatgtgccatggatattgaagaatgggaacgcaaagatttggagcagtatccaccaccccatttactagcccaagaagaagaagaagaaaggaacaatggagtatatggccttccgaatcacaacacatgggaatgtcacaaggaggaagaacatggtgtcaccttcaccaatcatcaagaaaagctagattcaactatatatggaaacaatatggttaaaatgcacgaggtcaattaa

SEQ ID NO: 28310 - DNA, 1728 bp, Glycine max
  Peptide Sequence Number=SeqID_145088
atgtcattttggttggttacgggaaaagaggttgatggcgcaatagttaaggaggttgacggcatgacagttgaggacggtgacgactggtcaaactttggttcacccaacccaactcgagtcatagaggaggaaaatgcaaagtttcttgaaatcccgatggaaaagggcgctaatggtgaaggttctagggagacaaatgggattgcaaatcactatttgcttgttcagagatggagacttgggtttcaggcaagtgttgatgttgagaggagggttgctgcttgggtcagaatactaaatctttccattgagttgtacaatgatgctttcctaacgagagtggggaacatgatcggagtgatgctaaaagctgacgtggaggtcaataacattccttcaatggttggaattctacaacaaagcactcatgatatcgatggggccctctatggtccttggatgctgtcactaggaagaaggacacaaaagcgtggggcccaagctaggaaatcaactcctaggcttaagaagaaagtgattgtgcctagtattattttcagggcctctaaagataaggataaaactattgagatgtgcttagatgacaaagccatggacgtgcaaatgggtacccagaataaggggttttctaacctcatcagagatataaaaaaagagtataaggcttccttgatgtgcctccttgagactcattctagtggtttagtggcgaagaaaatatttaatggatgcaactatgataaagtgtttattcaagatgcagttggtgaagctggtgggatctggatcctttgggattctatgatttgggatattgagattttggcctatgaaactcattatgttcacttgaaggttaggaatggaacttctccttcttggtttatgacagttgtttatggcagcccccactatcaagctagaagtagattgatggactccttaatcaatcttgtagattcaatctctcacccttgggttgtggctttcaaggacgcgctttcaccaggagacgcaaaggcctcactaagagattggatcacttgctcattaatttcagagtggaagaaaaacatttttggtcacattcaggtgaggaaaaaggctttgttgaagaagcttcaatgcttagcaaaatgttttggttcgaataatgacactgggagaagaaacaaggtggacaccatccaagatgatgatggtgtttggctcaccgacaaatggcaaatagaaaggtatgcaacagatttcttccggaagctttttttggttgaaaacaacttcactccttttcgtcttgctaattcttttcctgatcttgatgttgatgaggtggattcactagggaagcatgtcactagggatgagatcaagctctcagtcatatgggtggcttcaaagctcctgatatttaactatccttctatggtggcagatctgaatgatacactcatcactttaattcccaagctaccagttgttacaaaactaaaagacttcagacctattagtctttgcaatgtcacttacaagctggtagcaaaagttcttgcccaaaggttgagagttcttatggagaagctagggaagaaaggttggatgactattaaagtggacttggataaggcttatgattgtctcaagtgggaatttgtgaaggaaactcttcaagacattggctacccaaacaattttgtgcaacta

SEQ ID NO: 28311 - DNA, 237 bp, Glycine max
  Peptide Sequence Number=SeqID_145089
atgaacccaggtacttacattgtgagtttaagtcctgaggctgctgagaaaaggcactgcaacagtactaatagttcgagcttggacaatggcatggcgattgagtgggtgaaaattaagatgcgtgaatgggccacagcagttgcttcaaacaatgacacaaaagctaatcttacagtttcagagatacttcttattatggataatcatttcatgcgaccaacaccagacacatga

SEQ ID NO: 28312 - DNA, 228 bp, Glycine max
  Peptide Sequence Number=SeqID_145090
atgccattactttggagaaagactccaggctcaccaacttatctaacctcgtttttcatgttggagggcaccaacttgattgggacattggctgtagagttgtttctctcaactttaataagtggaaagttaactccaacaattacagttcttcaactatttttaagttcgactaagctagtgttgagatttgttgttgtccgcaccttcaacaagaatgtgaaataa

SEQ ID NO: 28313 - DNA, 1071 bp, Glycine max
  Peptide Sequence Number=SeqID_145091
atgattgacaggaaatgcagatcttttatctggggtgattttgagcgtgttagaaaggttcacactattccttggcgcaaggtttgcactcctaaaaatgatgagggccttgggatgagattgactagagatttcttgaggaaattcggttggaagttaatgccaaagaagccttccttgtgggctactctcattcgaggtaagtacaagtgtggtgcgggcgttcttcctaaagtccaaaagagaatatctgaatccaatttttggaggggtctttgcaaatcttggaatgatttgcaaaatcaagtttcttggcgggttggaaatggtttggagactgatttttggagccatgattggattcccttcattggtcctgtagttgataaagcaactatctatttgagtaatgctgataaggaagccaagtttggaaagcctgtgactgatggcagatttactctggaatctacttatgcttccatttcatctcagtctggtcaggccaatcccctctttaaagttgtttggagatggtcgggtcctgagaggaccagaattcttttatggaaaactgctcagcaagccttagttaccaatgattttcgggctaagaaaggtatgagtttgtctaatgcttgtcatgtgtgtgatgttgcatctgagaatgcggtgcattgtttcagggattgcccgcatgcaattcagatgagctcgaggctattaaatgttaatatcggtttaaagttggcgtctaagaaagggtttagtgatctgattgttgaatcagactctctggttgccatcaagcttctcaccgggagttgtagtactaatcattcctctaatcaacttgtgtgcaatattggtcaattggctgatcaaagaagtttggtttggcatcatgttttctggggagtcaaccaagtggcggattctttagctaaatcagtaacattcatggtgatgatgagcacgggtttaacatgcatgccgttgcaggcattgagttatgacgtgggcgtcatgagttatgacgtagttgctgatccaagtgaactgatccattag

SEQ ID NO: 28314 - DNA, 339 bp, Glycine max
  Peptide Sequence Number=SeqID_145092
atggcgccgctctttcccggctgcgactacaaccactggctcatcgtcatggaccatcccggcggcgagggagccaccaagcaacagatgatcgattgctacatccaaaccctcgccaaggttctcggaagcgaggaggaagctaagaagaagatttacaatgtttcatgtgagaggtactttggtttcgggtgcgaaattgatgaagagacttctaataagctcgaagggttgcctggagttctgtttgtgctaccggattcgtatgttgatccagagaacaaggactatggcgtccatgttgataaagctagattatatgcagttcagtggagatga

SEQ ID NO: 28315 - DNA, 396 bp, Glycine max
  Peptide Sequence Number=SeqID_145093
atgtctattgaagctatggcaatggcaggcatggattacaaagaatgtgccatcactttggaaaagtgggatcctctttacccacagcaacctcctttgtaccttctggcggcagagcgtaatgaaatagttaatttggctgcagaggggatgaaagcaaagatccgagaatgggcaaaagttgttgcttccagttccaagcaacaacaacgtgtcacaactgacaagtgcaaagaacaaaacaattgttgcctaagctttacccagaaattgaatactaccatgttttattcaccagcgttaataagcaatagttatcacatcgcatttgttgtgcagtgcatccgatgggataaacatcaagaagatttacatcgcatgctctattcaatgtaa

SEQ ID NO: 28316 - DNA, 2004 bp, Glycine max
  Peptide Sequence Number=SeqID_145094
atggtatcacgtaatagtaatatgatgtgtgataagcatgaagaaattgaaacgttggccaaggaagctagagccttgcttggaagacttgagtatcagaaaggcaatatcgaagctgcacttcatgtgtttgaaggaatagatattgctgctgtcattcccaagttgaaagtttctatatctagaagatgtgaacccaataaacgccgttcgcaaagtgatgcaatgcctcctatgtcaatgcacgctgttagtttacttcttgaagctgtctttctcaaggcaaaatcgtttcaggctcttggaaggtttcaagatgctgctcagtcatgcaaaactatattagacactgttgaatctgctttaccagaaggctggcctgaaaactttgtttcagactgtaaactacaagagacagtgggaaatgctgttgaactgcttccagagttgtggaagcttgcaggctctcctcaagacattatgtcatcctataggagggccttgctttatcattggaatcttgacattgaagccactgcaagaattcaaaaggaattttctttttttcttctgtatagtggttgtgaggcaagccctcctgctctccgctctcagttggatggttcctttgtgccaagaaacaacatagaagaggctgttcttctgcttctgattctgctgagaaaatctattcttggatacattgcatgggacccttcattgcttgatcacctttcttttgctctaagtgtttctggggaattcaagactctagctcaacagattgaggaattgcttcctgaaagcatggagagaaaagaaagatactatactctagctctttgttactgtggggaaggtgaacatatcactgctttggaccttctgaggaactctttgaatcatagagagaactcaaactgcataaaggaattgcttctagcttcaaaaatttgtgctgacaacaaggtttgcgtcgaagaaggaatcaaatattcttgcaaagccatttctcagtttaatggaaagtgcatgcagatggtagctattgcaaattgcttactaggtgttctgctgtcatcaaaatccaggtcagctgcttctgaatcagagaaggtttttatgcagtcagaagcactcagtgctctaaaagctgctgagggaatgatgagagaaagtgatccttacatcgtccttcatctttgtctagaatatgctgaccagaggaagttaagcattgctcttgatcatgcaaagaaactgattaagcttgaggatggatctagtgttagtggatatattctattagcacggattttatcagctcaacaaaagtttgtagatgcagaacttgttatagatgctgctctagatcaaagtggcaaatgggatcaaggagaattgttgagaactaaagctaaactacggattgcacaaggaaaattaaagaatgcagtggagacatatacttttcttcttgctgttcttcaggttcaaaataaaagtttaggcacagcaagtaaggttgtgaagaataagggaaaccgtgacagaagactggaaatggaaatatggcttgatttagccaatgtgtacacggccttatcacagtggcaggatgctgaagtttgtctcgcaaaatctgaggctattaatccctattctgcttctagatggcacacaaaaggtttgctttctgaggccagaggttttcatcaagaagctttgaaatcatttaggaaagcattagatattgagccaaaccatgtaccaagtttgatatccacagcctgtgtactcagacaacttggtggtcaatcatcttcaattgttagaagccttctcactgacgcactacgccttgacagaacaaacccttctgcttggtacaatcttggactgctctacaaagctgatttggggacatcagcaatggaagctgttgaatgctttgaagcagcagctcttcttgaagaatcttctcccattgaaccctttagataa

SEQ ID NO: 28317 - DNA, 455 bp, Glycine max
  Peptide Sequence Number=SeqID_145095
atgggggagacacatgaagtaccccaccacaatctagccgactttgagcctcgcctcaaatatgtcgttgaagggcaagtagttggtggtgtacccctaccaaacactttggagggctctcagtttcgtccacaaccagaacccttgcattttgcggtgaggagagtctctcctgctatggcggaaaagggaaaattgaatcatatagaggaaaggctcatggccattgaaggaggtggagatcatgcttttgctgacatagcagagttgtacctagtgtctgacgtcatcatccctttgaagttcaaggtgccagatttcgataagtacaaggggactacttgccctaagaatcacctgaaaatgtactgtcagaagatgggggcatacgcgaaagatgaaaaactactgatgcatttcttccaagaaagccttactagggaaactgtcacctg

SEQ ID NO: 28318 - DNA, 204 bp, Glycine max
  Peptide Sequence Number=SeqID_145096
atgaggatggatcaaagtgcctcctgctttagcttagcatggcagatgaagagaaaagaagagaagattgaaccttgtgaatcaagctcagccagtgcagaagaagagcataagctagttaatagcaaaagaacagatgccaaatccatttttccactgacatcaaccgctgacataacaacaacgtgcattatgctcaagtag

SEQ ID NO: 28319 - DNA, 264 bp, Glycine max
  Peptide Sequence Number=SeqID_145097
atggaaaaaatattactgcagccagatgctactgaccatcatggtggatatcaggattttttcaacaagaaaaatgtcattccaataaatagatggcgaggggggcggggtagaaaaacactttacagaacaaagcaggatcaacaaaaagtaaccttgatatgcattatcagatgtgcaaagatgaagataattcacaccacagttcaaattatttccagtgaaactgcaatgaggaacatagtgaaactaggtggaacataa

SEQ ID NO: 28320 - DNA, 435 bp, Glycine max
  Peptide Sequence Number=SeqID_145098
tccactggagtgggcggcgagggaatgaaggtgtcattcacttgccgtcacacgttcgatgagacgacagggaaagacgtcatttgcaactggtataacattttgtgtgttcccgcacaccttatcctatcacattatcactttctcaaaatggcgaacaacaaagaccaacaagacttttcccaacaaaatgtccctttctctgattccgactccgactccaactactcctacaacgaggcggaggacgaggctttttgccgtgcctttggccaatgcaacgatggcgacaacttgtcatcgtcggagaacctaaagcacgacgacctggaggcgaacttccttgccttctcaaaggcgctagagagccccacaatgaagaagctgcacgatgacatctttgcgcaatcgatttcgattccaatttggatttga

SEQ ID NO: 28321 - DNA, 162 bp, Glycine max
  Peptide Sequence Number=SeqID_145099
atggaatgggaagataaccttagtgggaacgagaacgagtgggtgtgggaattggaggatgaggatgacacagagaacctcgtggacgagttttctttcaccctattattttcgtttaccgctaacgttggcctctctacttcgctgtttctagaaccctaa

SEQ ID NO: 28322 - DNA, 1140 bp, Glycine max
  Peptide Sequence Number=SeqID_145100
atgatttggctggggatattcacagcatcttcctctgcgttcttcaatgtttcatgtgtttgggttgacagtgatttattgcacgcaactttagagggtaattcggtggtgacactgaaaagagcttatcggaagcttgcccggagttgtcatcctgatgtgaacaaagaacctggtgcagaacagaaatttaaagaacttagtaatgcatatgaggtcttgtcagatgatgagaaacgatccatatatgatacatatggagaggctggacttaagggttcaggaatgggcatgggggatttcagcaatccttttgacctatttgagacactgtttgagggcatggggggcatggggggaagcagaggatcttggaatggagcagttgagggtgaagatgagtattacagtcttgttttgaacttcaaagaagccgtttttggggtggaaaaggagatagagattcggcgattagagagctgtggaacttgcaatggttcgggggctaaaccaggaactaaatcatccaagtgtagcacttgtggtggtcagggtcgggttgtcacatcgacaaggactccattaggcatctttcagcagtctatgacatgctcttcttgcaatggaactggagaaacttcaacaccttgcagcacatgttctggggaaggtcgagtgagaaagacaaagcggatcagtctcaaggtaccagctggtgtggattctggcagtcgtttaagggtccgaaatgaaggtaatgctggaaggcgtgggggttctcctggtgacctctttgtcattcttgaagttatccctgaccccgtgcttaagcgagatgacacaaacattttatacacatgtaaggtgtcttatattgatgcaatcttggggacaacaattaaggttcctactgtggatggcatggtggatttaaaaatcccagctgggactcaaccaagctcgacacttgttatggctaagaaaggtgttcccctgctgaataaaaagaatatgaggggtgatcaattggttcgggtgcaagtcgaaatccccaaaaaactgagcaaagaagagagaaaacttgttgaggaactagctgatttaagcaaaggcaagactgctgccaccagtaggagataa

SEQ ID NO: 28323 - DNA, 201 bp, Glycine max
  Peptide Sequence Number=SeqID_145101
atgggtgaggctttagtcctcactttggtcttaaactttgtgggcaggatcctcttaggccataatcagaagtcgagacaggttgatggcggaaatcaaccaaggtacataggaacggatgcaagtggggatagggtcatgaccgaccgatcgttgtccctccccggcgctagacaagcagaggacgtcgctgcaaggtaa

SEQ ID NO: 28324 - DNA, 165 bp, Glycine max
  Peptide Sequence Number=SeqID_145102
atggataaccataaggtatcttcgcatgctaccggaccctcgagtcgcgatagcagaagtgagactttttcgcgatctcagctagaagacgttaacatctccgggaagggtacagatgatcacattgatctttgtgtgaaaacgagctcgcttgcctctagttga

SEQ ID NO: 28325 - DNA, 168 bp, Glycine max
  Peptide Sequence Number=SeqID_145103
atggctatgggtgagaaagaccactttctggtcaggaagaggaccttttataaccactactcccatcaagtagcacgggtggttgctggtgctttggttggtgatggtgttggtgctttggttggttgtggtgctggtgcaaggttgacagacaaggttttgggatag

SEQ ID NO: 28326 - DNA, 228 bp, Glycine max
  Peptide Sequence Number=SeqID_145104
atgctggtggcgacaatggttgtgatggagttggcaaaggcgaggtgcaatggtggtggtggtggtggaatagtggaggtgctagcggtggtggaatggtggtggcggtggcggtggcggtggtgcggtggtaaggtggaaatgatgaggtgtagtggtgacaatggtagggttagggtgatgattagtggtcttagacaacgtaactcaaacaaaagtaggagttga

SEQ ID NO: 28327 - DNA, 447 bp, Glycine max
  Peptide Sequence Number=SeqID_145105
atgagtggagtcgacaccaacgtttattcaaggaaaatgttagaaaaaaccaaaaagaggtctacgaattttgaaaacaagggttcaggagttgtttgcgcatggggaagtcgacaagggtgttgcctttgctcttacgtatccctagaaaaagccatttggggcaggggcaactcgtctaggcgagctggttacttcatcctgaaggatactcaagtctcagacacatcttcttcctctcctcgattggtgcctccagatcaatggtttaaactcaatattgatggtagcagtcttggtaatcttggtgcatcaggctttggtggcatcattcgtgattccttgggttcttttatcattggtttctctggctactgcgggcatacgacgagtgttcatgctgagttgtttgcaagtggcttgagatcatggtatccggtaccttaa

SEQ ID NO: 28328 - DNA, 480 bp, Glycine max
  Peptide Sequence Number=SeqID_145106
atgacgagagtgatgagcaaaatgacggcgacaacgacgaagtctatttcgttgaagcctttgggaagacacggcaccgtgaggcgccatttggtggaggagattccgattgtggtgcctaggtacgccgtcaagcctctggcgacggtgacattggaaagcacggaccaaagatttcacaagcctgacgcgctcgaaaaccttgccctgcctcttctctttgtcaccgtgaaatcactcttctctttctcctcccgcctgaaaactgccggaaaccgctccctcgacacccacatggtccttgctcaaacccacagaaccccctacattgccgaaaaacccacattctcctcgcttgaacccacagaaccccctacactgttcttggaagtctggctcaaagaaaacccaacatacattgttgttactagggtgctgaaacagtcgtgggtgctcaaagctcaaagctttctctgcgag

SEQ ID NO: 28329 - DNA, 387 bp, Glycine max
  Peptide Sequence Number=SeqID_145107
atggcctcactcaattcaattcagaactccaccaccacaatcttgcttcttattattctcattacatttctactccaccatctgctgtgtccagtttcttgtttcaatcaaccacaacatgcaattcctccaccagaccctttatgtgaggagcaaaacagattaggttcaatgcctcccacttgccacaacaagtgcaaccagtgtcatccatgcatggcagtgcaagttccaacctcgcctaaccatgaacgagttcacccaggtcttcttcccccaactgcttcaatggaagttttctttctccaaggtaacactaacaggtactccaattacaagccattgagttggaaatgccattgtggtgaccactttttcaacccttag

SEQ ID NO: 28330 - DNA, 141 bp, Glycine max
  Peptide Sequence Number=SeqID_145108
gttgttgtccttgcccttattgtggtggagtttcatgctcttgtggttgtgaaagagcttttgtcctttgttgtgatggactttcagtatgacatggagagagtgctaatgggtggaatggaattaaagatgaatcattga

SEQ ID NO: 28331 - DNA, 231 bp, Glycine max
  Peptide Sequence Number=SeqID_145109
atgtcaaattctgaattccaggcgaagtgcattggtgaggctgaagataagtatgcaagtttacagaaatcacttgatccacatctctctctgagctaccagaaaagatgtgcagaagccactaaagaaggtggaaaagtatcagaccacccacttggaacatggagtattccaactgtgattcaagatgaggaattgtatagattaaagctgaagtcagatatttcgtga

SEQ ID NO: 28332 - DNA, 543 bp, Glycine max
  Peptide Sequence Number=SeqID_145110
atggagattaggaaagaccatagactcttgatactcctggaccatattgcccttttacagtttgcacaactttttataggacatattaagaacttcactgccaaatacagagcagttacaagtgcatactacaggggtgctgttggggcaatgttggtttatgacataaccaaacgccaaagctttgatcacatacctcgttggttagaagaattgcgtaaccatgccgataagaatatagtcatcattcttataggaaacaaaagtgatcttgagaaccagcgccaagtacccacagaggatgcaaaagaatttgccgagaaagaaggcttatttttcctagagacctcagcactggaagcaactaatgttgaaacggctttcatgactgttttgacagaaatattcaacattgtcaacaagaagaacctagctgctggtgataatcagggaaatggcaacgcagcatctctgtctggcaagcagataattgttcctggtactgcacaagaaatccccaagaggagcatgtgttgtcagtaa

SEQ ID NO: 28333 - DNA, 2172 bp, Glycine max
  Peptide Sequence Number=SeqID_145111
atggtatcccgagaatcttgcttggcattcgaatttctcccgtttcatgaattcttaaagctggaaaatgaaattggaaatattacaagacaggaagttgtcagcatggcacctcctctgttcttggatgtacattcaaatcattttgtacttgatatgtgtgcagcaccaggttcaaaaacattccaattgctcgagattttacacaaattaactaaagctggatctcttcctgatggaatggttatagcaaatgatctagatatccaaagatgcaatcttctcattcaccaaacaaaacggatgtgcacagccaacctaatcgtcaccaatcacgaagctcaacacttcccaggatgtcttttaaacaggaactatgataaaatggagccagatcagcaagatcagctattatttgatcgtgttctgtgtgatgtcccatgcagcggagatggcacccttcgaaaggcacctgatctctggaggaaatggaacacagggacagggaatgggcttcataacctacaagttctaattgctatgcgaggtgtatctttacttaaagttggtggaaaaatgatctattcaacctgctcaatgaatcctattgagaatgaagctgttgttgcagagcccctgcactgtctaaatactaagtttagttgtatcagggatcaattggttttgcggaggggtggagggtccattgaacttgtagatgtctctagtgagcttccccaacttattcgccgaccaggtcttaagagatggaagatgtccatcaagttatacccatgttcgcattcatgtagtctagaagggtttaaggttgttatgcagcagtatgcatttgcatctgaaggtggcaagtggtttttctgttgcaaagatgttcccaagcttcgtagaaatgtagtttttcccagcatgtttccaaatggtggaaactataaggatgatagtgattgtaatatcagcattggagatgatattattatagatgatgtttatggaaattctgaagatgatgttcaagcagtggagaatcctgtgatgcatgaatttactgaggaagtttctgatttcccactagagcggtgcatgaggttggtgcctcatgatcagaataccggagccttctttattgctgtattgcagaaagtttctcctctgccagttgcagcaactcaggtaaaacctagaaaagaagttgataaacatgatgacacagcaaaccagggcaatgaggatgcacaagaattgcaggttaatccattggaaagtacacctgaagaaatttcagaggctaatataaatgacaatagacccaagacagatttgaaagttagttctgttacatgtgaagaagtgaatttgaaggaagcccaagatccctgcaatgtggaaaacatgacaaagaatactccaggcaaaagaaaactacagattcaaggcaaatggagaggcattgaccctgtagtcttcttcaaagatgaagtagttattaacagcataaaggtattttatggtattgatgagcagtttccattcaatggtcaccttgtaacaagaaacagtgatacaagtcacgtgaaaagaatttactatatctccaagtcagtcaaagatgctctggagttgaacttctcagttgggcagcaacttaaaataacttctgttggcctgaagatttttgaaagacagacatcatgtgaaggtaggtctgcaccatgtgctttccggatcacttctgaaggattgccccttattctccctcacatctccaaacagattcttagtgcatctgctatagacttcaagcatcttctgcagtatagaactgtaaaatttgcagattttgtggatgccgaatttggtgaaaaggctgcaaacctaatgcctggttgttgtgttgtagttctgggtgaaggaagcagagctgctacagggcccctccaagtggatgattcaacaatagccattggatgctggaagggtagagcaagtttgactatcatggttggtgcattggaatgccaagagctgctcgaaaggcttttaatgtgtctagacacagtaacagaaaaggactcctccatgcatgataacaaggtagatgaagcacatgaatcaaacggtaaaaatgaagatgttgaaattactggttgttaa

SEQ ID NO: 28334 - DNA, 243 bp, Glycine max
  Peptide Sequence Number=SeqID_145112
atggcttattgtgatgtgtataaccaacttgtttgctttgtcagggaggagacaagtacctcaatggaaaacaatattataatgcctattaaatttggtgatagggtgcttggccgacaatgcagaaggttgaaggagtttgagaacgattgggttcaatggaccttgaaagtgaaagatggtgggcagaaacttctatctttacattcccaaacaaaagacaaggtgcatgaagttccttaa

SEQ ID NO: 28335 - DNA, 156 bp, Glycine max
  Peptide Sequence Number=SeqID_145113
atggcaagttctaatgtaatgggagtcaataaagctgaaggatgtccggtgtcagcaccagaaatgaatcctaaaaacccttcaaaatgttctcaaggactacttgacactgctgaggacagctcccacaacgaatgctcatgtcaatcagcatga

SEQ ID NO: 28336 - DNA, 375 bp, Glycine max
  Peptide Sequence Number=SeqID_145114
atggggagaggaaaaagagggaagagtcgcactcaaagaaagcatttccagcagaacagagagaatgtttggacatcttccaaacgctctaaatcagatccttcctccgaaaatcctattcctatctgcaatccctacgccactcaaaacctcgctttcgatcactattacaaggcaaaccaaacgcttccaacttactatttccacacttttttattttattattattccccctatctcctccttctctttcatttgctcatttcttttcttttcgaattttcaggagcagggaatcgtttcctcagaagaatgggatgcattcgtgcaagttctcagaactcctttgcccgcagcattcagaatcaattccac

SEQ ID NO: 28337 - DNA, 258 bp, Glycine max
  Peptide Sequence Number=SeqID_145115
atgaatatagagagaggaggcaccagcacgatgatgctatttattatggatttggttgcttacaacttacaagttacaactattcctcagcttaatgaaggcgcaaacgtgtcgatcagtggttctatgtggtggcggtgtatggagagaccctacttctattggtctacgaatttaatgatgataatcattaccgaatggtgctcattgctcgaacatgctgaaggtcgagatgtattgttcgagagatgtggataa

SEQ ID NO: 28338 - DNA, 216 bp, Glycine max
  Peptide Sequence Number=SeqID_145116
atggaggctacacctctatcgtttcaagttaaaagtgctcagctaccaatagcgtccccgtggttgcttcataaccactctatagcggcggtggtggcactaggttggacggtgatggcgatggttttcattggaggaggagaagaaggagatgacatgacaatgaataggccagctgatgtggtactttgtatgtcacatcattacttaacataa

SEQ ID NO: 28339 - DNA, 513 bp, Glycine max
  Peptide Sequence Number=SeqID_145117
atggctcgtacgaagcaaaccgctcgtaagtccacaggaggaaaggctcctaggaagcagcttgcaaccaaggctgcacgtaagtctgcaccaactactggtggtgtgaagaagccccaccgttatcgtcctggtaccgttgctcttcgtgaaattaggaaataccagaagagtaccgagcttttgatccggaagctccccttccagaggctggttcgtgaaattgctcaggacttcaagactgatctgcgtttccagagccacgccgtgcttgcattgcaagaagctgctgaggcataccttgttgggctctttgaggacactaacctgtgtgccattcacgccaagcgtgtaaccattatgcccaaggatattcagctggcaagaaggattcgtgatggggttgttagggagggtaggttttctgctggtagtagcattaattgggatataggcaaatactgccgagtgtccgtgactgtgttttcttcctttaagaaaattggcttgtaa

SEQ ID NO: 28340 - DNA, 2586 bp, Glycine max
  Peptide Sequence Number=SeqID_145118
atggcttcaagatcatatgctaatctctttgacttagctagtggagactttcttgattttccttgcaccccaagagctcttccaagggttatgactgttcctggaattatttcggacctggatggttatggttgtaatgatggggattcagatgttagttcttctggatgtagggagcggaaaatcattgtggcaaacatgttgccagtgcaggctaaaagagatatagaaactgctaaatgggttttcagttgggatgaggattcaattttgttacaattaaaagatggtttttctgctgatagtgaggtaatctatgtgggttctctcaaggttgaaatagatgcctgtgagcaggatgcagttgctcagagattgctagatgaatttaattgtgtacctacctttcttccccatgatctccaaaaaaggttctaccttggattttgtaagcagcaactttggcctctatttcattatatgctacctatatgcccagatcacggtgatcgctttgaccgtatactttggcaggcttatgtttctgcaaacaaaatatttgcagacaaggtcatggaagtaattaatcctgatgatgattttgtttgggttcatgattatcacttaatggttttgcctactttcttgaggaagcgatataatcgggttaaacttgggttctttctgcatagtcctttcccttcatctgaaatctaccgaactttaccagtaagggatgaaattttgaggggattgttgaactctgatttaattggctttcatacatttgattatgctcgccactttctttcttgctgcagtagaatgctaggtctggactatgaatctaagcgaggacatatagggcttgattactttggccgcactatatttattaaaattttgcctgtaggcattcacatgggtaggcttgaatctgtgttaaatctttcttctacatctgctaaactaaaagaggttcaggaagagtttaaggataagaaagtaattcttggtattgatgacatggatatttttaagggcattagtctgaaacttctagctgtggagcatctgctgcagcagaatccagatttgcagggcaaagttgtcctagttcaaattgtaaatcctgcaaggggctcggggaaggatgttcaggaagcaaagaacgaaacatatttaattgcccagagaatcaacgatacatatagctcaaataattatcagccagtcattctcattgaccgccctgttcctcgctttgagaagagtgcctattatgctgtagctgaatgttgcattgttaatgctgtaagggatggtatgaacttagtcccatacaaatatatcgtctgcagacagggaactgcacaactagatgaagcattggatagaaaaagtgattctcctcgtacaagcatgcttgtggtgtctgagttcattggttgttcaccttctcttagtggggcaataagggtcaatccctgggacatagatgccgtagccgatgctatgtatgcagcccttacaatgagtgtttcagagaagcagttgcgccatgagaaacactatcggtatgtgagttctcatgatgttgcatattgggcgcacagctttatgctggatttggagagagcctgcaaagatcattacaccaaaagatgctggggatttggtttgggcttggggttcagagttgtttctctttctcatggtttcaggaagctgtcaattgaccatattgtttcagcatacaagagaaccaatagaagggccatctttcttgattatgatggtactgttgtacctcaatcttccataagtaaaacccccagccctgaagtcatctctgtcttaaatgctctgtgtaacaatcccaagaatattgtgttcattgttagtgggagggggagggattcactgagtgaatggtttacttcatgccaaatgcttggacttgcagcagaacatgggtactttttaaggtggaacaaagattcagaatgggaagcaagtcacttatctgcggaccttgattggaaaaagatggtggaacctgtgatgcagttgtatacagaagcaactgatggttctaatattgaagttaaggagagtgctttggtgtggcatcatcaagatgcagaccctgattttggttcttgccaagccaaagaattgttggatcacttggaaagtgtgcttgctaatgaaccagcagctgttacgagaggtcagcatattgttgaagttaagccacagggaataagcaaggggttggtagctgaacaggttcttatgaccatggttaatggcggcaatccaccagattttgtgctgtgcattggagatgataggtccgatgaggacatgtttgagagcattttgaggacagtttcgtgcccatcattaccatcagctccagagatctttgcctgcactgtgggtaggaagcctagcaaggccaagtattttcttgatgatgcttctgatgttgtgaagttgcttcagggccttgctgcttcatccaatccaaaacccaggcatcttgctcattctcaagtctcttttgagagcacagtttga

SEQ ID NO: 28341 - DNA, 147 bp, Glycine max
  Peptide Sequence Number=SeqID_145119
atgggtgagtttggggaactcgtgctcattgcaaggatctttgtttgtttgtgttgcaaggatttggtttgtggaactcgtgctccttgcaaggatttgtccatttggggtgctcactcatgctcgcagggtctcattttgagtgag

SEQ ID NO: 28342 - DNA, 414 bp, Glycine max
  Peptide Sequence Number=SeqID_145120
atgggtatgaattgtagactcgaacatattttgtattaccaatattttggatcagtgcaggcttacttcaaatcaatggctgtttcgtatgttcacatgcttcaacgtaacagggctttccacaaggcatttgttgcaaatttggatttaaagattgttttcttaagatcccagactgtaactgtatctttctacctgcagagaagaggcaaacgagttgtgtcaaatctagagaacaatgagggcgagtcacgtactgcttcagagatggctgatgtactctatcattccatggctctgttggcaaagaaaggtgtcaaaatagaagatgttttgcaggttcttcgtctgagattttcccaatctggtattgaggagaagaaaagtcgtgtattccagaaatcaatggattga

SEQ ID NO: 28343 - DNA, 198 bp, Glycine max
  Peptide Sequence Number=SeqID_145121
atggttgatgaggtgcaaccgtgcaagcatagtgtggatagggactttgacgtacacattctggcaatagcaacttgtattcttcctcgtgcatggcttggaaccaatgatgttaaaggactgcatgcgttgcatattaatcttgcttttgacttggcatttgaagaggtaatgactttaagaaaatggaatgtctaa

SEQ ID NO: 28344 - DNA, 387 bp, Glycine max
  Peptide Sequence Number=SeqID_145122
atgagtattggtgacctgcttggtaatcaggctggaggtttggacaagcttacactagacagcctatacgatgatgccctcaggagaaacaaccaaaatgtcagctataatccatgggagccagcaccaggtggaaacatgatgcaaccgacaatgcacgatccgttttttgcctcaaatacagttgccgctccaccttctgttcagatggcttccatgtccaaccaacagcaagctttcatgtatcaacagcagcagcaaatgatgatggctccccaacaacaatctgtaaatccttttggaaatccttatggagccactgctgtccatccctatggctcaggtatgcctgttcaatcatacaatccatatacaggtctcatctag

SEQ ID NO: 28345 - DNA, 744 bp, Glycine max
  Peptide Sequence Number=SeqID_145123
gacaatgtagaggctaacttagattgggaaataagggtaaagcaacaacttaaaaggaagtctacttcaaaatcttatggctctcactcttatccaaagaaagaccaaggtcaaggcatcttaggggtgacaccttttaagctcaaagatgataaggggaagacaatagaaaggcaaccccttaaggctagtatgcaagagaagactagatttataaagtgctttaaatgtcttggaagaggacacattacttttcaatgccccaccaagaaaaccatgattatgcggggccaatacatttatggtagccaagatgaggctactacttttccttcctctagtgaaagtaaagaagcaaaaggggaagaatctagtgaagagatctacccacaagaagaaagacaacctttaatggttaaggaggagtgtaaggaggcaagtgtctcctccaagaggttagctaagaaggaaaggtattttgaaataaagacaaatattaaagttatttcccctcttagacaacctccacattttctcctttgtgaaaagacccttgttagcattgccacacctcttaggcttgagtttattcctcaagtaaaggagttcttggatgagggtttggttcgcaagagcttaaatccttgtgctttgttggtgcccaaaataggtattattaggcatcaaattcctaaaataggtggtatgatgaatgttttgagtggtgcaaccctctttttgtaa

SEQ ID NO: 28346 - DNA, 177 bp, Glycine max
  Peptide Sequence Number=SeqID_145124
atgtcaatgaagaacctcgtcgggcgcctaggagtacataacaaaacaaaccacacacaatcagggtcgtgctgttttgcgaaaatgctccaaccatgtgggatcgacataggcttaaaggagcacttaaaccagatgtatttacccccaaggcctagactccgaagagttcgttag

SEQ ID NO: 28347 - DNA, 535 bp, Glycine max
  Peptide Sequence Number=SeqID_145125
gcttttcgtcttacagatagcaaaaaggtttatacggataaccactcgggtatctccgcccgtcagcgtgactcaaaagtcaatatgacagatcttgtaagcgcggaagatgacagtaaatctccacgtgtcaacgggcttatagcaaaaaatgtttatacggataaccacttgggtatctccgcccgtcagcgtgactcaaaagtcagtatgacagatcttgtgagcgcggaagatgacgcttttcgtcttacagatagcaaaaaggtttatacggataaccactcgggtatctccgcccgtcagcgtgactcaaaagtcagtatgacagatcttgtgagcgcggaagattatgcttttcattttacagatagcaaaaaggtttatacggataaccactcgggtatctccgcccgtcagcgtgactcaaaagtcagtatgccatatcttgtgagcgcggaagatgacgcttttcgtcttacagatagcaaaaaggtttatacggataaccactcgggtatctccgcccgtcaac

SEQ ID NO: 28348 - DNA, 635 bp, Glycine max
  Peptide Sequence Number=SeqID_145126
atgggggcctgtccgaaacgatgggccgtcatgcagagttccgctgtcacttcccgcgccgaggcgttctgccggcgctttggcgtttctgttccgatcctgctggcaccgatggccggtgcctgcccggtaccgctgtcggccgcgctggccaacgccggcagcatgggcgcgatgggcgcggtgttgtcctcttcggccgatatcggtcgctggatggacgaattccgcaccgcttcgaccggcccggcccaggtgaacctgtgggtgcccgatcccgcaccgacccgtgatgtggccgccgaagccgccagccgcgctttcctcgcgcagtggggcccggacgtgccggccagcgccgccgacgccacgcccgccgacttcgaagaacagttcgccgcgctgctggcggcgcgtcctgcggtggcgtcgaccatcatgggcgtgctgttgccgcatcacgtgcagcagctgaaggacgccggcatcgcctggatcgcctgcgcgaccactttgtccgaagcgcgtgcggcacaggacgctggtgccgatgcggtggtggcacagggcgccgaggccggtggccaccgcggcgcgttcgatccggcgatggccgagcgccagccggtcgggct

SEQ ID NO: 28349 - DNA, 249 bp, Glycine max
  Peptide Sequence Number=SeqID_145127
atgatcgccatcatcggctcgatgaccaagaaggaacggcgcaacccgaacctgctgaacggctcgcgccgcgcgcgcatcgccaagggctcgggcgtgacgccggccgacgtcaacaagctgatgaagcagtacatgcagatggaaaagatgatgagcaagatggccggcggcggcatgaagggcatgttgcgcagcatgaagggcatgatgggcgccatgggcggccgcggcatgccgttccgttga

SEQ ID NO: 28350 - DNA, 764 bp, Glycine max
  Peptide Sequence Number=SeqID_145128
tggtgtctcctctctctcttccttctctattccactaccattcatcttccaagaagcaaaggaatccattgatgaagaagatcttaggccgacaagctccaatggagcttacatcattaagtcttccttgaccactaaatttatgtatgctgacactgagggtgcacgttcaagtacaaatgggactgatgctaaaactactatcaatccatcaagaaaagaacatgttgctcatatgatgcctaatatggggttgtatgtgaaagatgatgtgataagtgtcagtgttgaaaaagtttttgacgacgatcccttgcgtgactttattaagagcctgtatgatatttacaagaagcctattgagttgatgtgggatgagactaaatttgggattccaaatgtagatggatcctttttcttaacatatcctgatgatcgatatgctgaatatgaatattacattgaaacatgggtgaaggaatcccaacaagaggagtacctaggagcttacttgaattatgcaataaatacatcaaagaccaccgtggatggtaaaaatgatcaaggtcctcctaagtggattgaagcaaatagtcatgttcaaagtagaggctatgagtgtgactattatgtcatgcattggatgtggaacatagtaagctggggtttaaagaatgattgtagcatggtcattgtgaggttgaggatttggatattcaggggaaagaatggcgagctctctgttacgggaagacttgcatcag

SEQ ID NO: 28351 - DNA, 171 bp, Glycine max
  Peptide Sequence Number=SeqID_145129
atggtgagggtaactagtacccaagggtccacccttatgagaaagcaagagatcgactcatcgagagggccggagggaacctattgggtgagaacttctaatctgcccctaggttcacttgaggctcatgcacggtgcccctcattgccccagtgtagggctatgaggtaa

SEQ ID NO: 28352 - DNA, 507 bp, Glycine max
  Peptide Sequence Number=SeqID_145130
atggcgcgcgacgtaggtcggcgaggcgcaggtcacggtctgcagggtgccgatgcggcgcgccaccaggctggaatcttccaggtcgccggcgcggatgacgcagtcgaccgcctcctgcaccatatcgacgggacggtcgcccatgcccagcaccagctcgacatcggggatcagccggccgatacaggtcggcacatcgatgcgcagccggcccttcaggcgcagcgccgcttcctggaaacaggcctcggtttcctcgacgtcggccaggatgcgcacgcagtgctggtagtagccggcgccgtcgggcgtcaggccgatgcggcgcgtggtgcggttgagcaggcgcacgcccagcaggcgttcgagattctggatgatggtggtgacggtggtgcgcggaagcgagaggctgtcggccgcccgggtgaaactattggcgtccacgacgcgcacaaacacctgcatagcctgaaaacggtccatggcgacggtgtcctttaa

SEQ ID NO: 28353 - DNA, 243 bp, Glycine max
  Peptide Sequence Number=SeqID_145131
atgccgcagaccatcgaggaactgcgcaaccaccacgccgtgcattatttctccagccgcaccggccgcaactgcgcctgggacttcaagatcgacggcaagcaccaggaagtggacatgcgcggcaccgtggcggtgaacgaggccggcgcctacctggattgcggcctgaagggtttcggcctgatccagacgccgcgctacatggcgctgccctacctgcagtcgggcgagctgatcgag

SEQ ID NO: 28354 - DNA, 451 bp, Glycine max
  Peptide Sequence Number=SeqID_145132
tcatcagatgttgatcatcatggaaaatttgggagcgaattcaatcatactttcaatcttttatgtgagctatggtttgtcaagttcgtaatgagctttgaaatctctcttgataattgctctatttcagattatcttttgcatgttcagacacttgttaatgagcttacttcaattgctgaaactgtttccaattctgaacatcttgatctaattctcgatggtcttcctgatgagtatgagtcatctcgtaagagagctttaagttctattaatcttactcaaggtttaggatctgttagtctcaactctggaagttcttctctcgataattctgttaatcctaattttgcacagtctataaaccctaacttaaagttcaatggaaatcgatttttcaatgatcgttgtggctggaattttggccgaaacaactgtggtggtggtagag

SEQ ID NO: 28355 - DNA, 279 bp, Glycine max
  Peptide Sequence Number=SeqID_145133
atgcagcaagatataagggattttgtgagaaagtgtattatttgccaacaagccaaggtagaacaagcactgatggcttattacaacgacttccaattcctcaaagaatttgggaggacattgctatggactttattacgcatttgccatcttcacatgtgccttctggcaacagttattcaaagcccatggcaccacattggctatgagttctgcttatcatcctcagtcagatggccaaacggaggtgttgaacaagacactaaagatgtactttag

SEQ ID NO: 28356 - DNA, 1461 bp, Glycine max
  Peptide Sequence Number=SeqID_145134
atgaggttccttctgcccaaagcaaagctccttcacaggccaaatgtagcatgtggcaagcaggagggaaaattggctcgtgagtcagttacaaaggaaggacacgtggctgatgatccacatgtggggaaccaaacaacggctaatggtggttcgaactcaaaaggtcgtaattccagcacttcagtcttgtcaccctcgccaatttcaataaattctagtgttaaggagatttcattgggttttccgcattttgatggacaaactccaagaatggagacggtgaatacttggagtgagcttcgacatgtgttggaatctcagtttggtccttcactttttgattgtcctatggcagagttattcaaacttcaacaacaaggtacaattgctgattattatttgaaatttatgtcattaactcatagatctgatggtttgactcctgaggccttacttaattgtttcattagtggattgaacaaggacatccgtagagatgtggttgctcaggctcctaatgatttgttacgtgttgttgctttggctaaattgtatgaggaaaagtatgttacagtgcctattactcgtcctactccattttcacctagatactcaaacttgtcttcttctaatactcacaataatgtcctaaaaaatccagtgaaaaatagtttaactccaaatgtacctcctattcgaaatgcttcatgtcctactagacagtttctgttgttacaatctaagaatgatgatgctaagcttgaatttcatgatagtgaagacagatttgatagtgtggttgataatgcggaggtgattcttgaggatcatcacttgtcactgaatgctttaaaaggtggtatgggtgtaggtacaattcaatttatggcttatattgacaagctcctagttaaggttttggtggatgggggtagttcagacaatttcttacagccaagagtggctaaatttctcaaattacctatggaaccagcacctttttttaaggttatggtgggaaatgggaattatatgaaagttgaagaaatgattagcaagttaactatcaaagctcaaaatgccaggtttcaattgcctgtgtttttattacccgtatcaagtgctgatcttatcttgggagctagttggctgaaaactgttggtcctcacatagctgattatgacaagctcaattacatcatatcaggaggatgtaatatcgatgctattgctaagatttttaccatgcaattaattgagcccaattatgtacaatttcctttattggagttgcccactgatatggaacctgaattggccttacttctgcattcttatagtgttgtgtttggaactcctacgtcattacctcctccacgagctcatgatcattccattcccttagtggatggttatcaacctgttaaagtcaaaccttataggtaccctcacaactag

SEQ ID NO: 28357 - DNA, 286 bp, Glycine max
  Peptide Sequence Number=SeqID_145135
atgactacatcctcgattctcgcattactatatttcactcaagagttcatcattgagagtgatgcatctgaaaatggcttaggtgcccttctgactcagaaagggcaacttgtggcttactttagtaaggctttgactgaacacaatctagctaagtcagcttatgaaaaggagctcatggctgtagagaattatcgggttgaggagaatctccctattaatttggaggatgacaattcctatcagcctgaggtagttttggctgctcatactataaccaaagcag

SEQ ID NO: 28358 - DNA, 1230 bp, Glycine max
  Peptide Sequence Number=SeqID_145136
atggaggctaaggtcacaactcttaagactgaggtcatgagtcttcataatgttctcatcacaatacagtctcaagtgaaggaaaaccatgagaagcttctcactatgtttgaacaacgccttacaatgagtggcgatggaggtttaggcgtgaagtggttccacagtgacccaattattgaattccgtcaatcggtgaaaaaggtggaattacctatgttcactggggaagatcctgcaaggtggactacaagagctaacatttattttcaaatcaaggagacaactctagaaatccatgtggatttggatcaattgtgcatgaagggatctacaatacatttcttcaaaccattgttggacgatgagagaaagagggagctcctacactacaccgtcatgccagggttggaaatggggccaaattgggggtctatatgcaataataaggaggtgtgtgatgaaagcacaattgggcctagtcctcccaagacttcagataagaacgaactcatatccaaccttgtgatggaggggccttttcattcccaccaccaatgtccagatcgtcaattgagtatccttgtcttcgacgaggagaacatcgacgatggtgaggttcaggtgttaactatggaggagacgaaagaactaaagttagatgtccttattcttatacttgttgatagtggcaccactcataatttcatttctaagaggttagtcttagctttggaaaatcgaattgaagtaatgcgcttgatgcgaattaaaaatgggagatggttacaaggtgattgctcaagcatgcgatttcaacttgccaacgaatggtttgagttaacgggaggaggccatgggctattgggtccaatggcttttcagagcctatttgagctacagatcaataacaacacaacaattctttttgccacaaacgttcaagaggtcacttctttggttgatcaaaatcatgagatttttcgtgaggcacagggattaccaccccaacatacaattgaacattctattactctgttggagggccacagttctatgaatgtgaggctgtatcactatccacatcaccacaagaatgaaattaagaagcagagggataatacttggcatatatgtgtgcattaccgtgctctgaacaaagtcaccataccggacaagtttcccattccggtaatagacgagttattggacgaattgcatggtgcttaa

SEQ ID NO: 28359 - DNA, 183 bp, Glycine max
  Peptide Sequence Number=SeqID_145137
atggcttctcgaaagagaaaggcacctacctcaacatcccaggcccgctatgaccgctctagattcacatctcaggaggcctgggaccaggaaccctatcagagcaaccagaggaaaaacttgaggaatcttaggaaattgctagagatgtcgctattgctgccggaatgtgagcccgcttag

SEQ ID NO: 28360 - DNA, 264 bp, Glycine max
  Peptide Sequence Number=SeqID_145138
atggaagcaataggaagcaatggaagaaggaaccttacctcgatgaagattgaaagaatggagctcacggaagaagaagaaacactcgccggaagacggaggaagaagaaacggctcgtgggagagcaccagcaacatcatcgcgagggagaagaagaaccagcagcagctcgcacagaagaagggagaagaacaatgctcgcggaagaaggaaatgaagaaggaagcagaatgactgggtgcacaagttttttaaaaatataa

SEQ ID NO: 28361 - DNA, 222 bp, Glycine max
  Peptide Sequence Number=SeqID_145139
atggttcaacctatagtagtattagattcaagggtgttattgagagactcttcccaagtggaacaggtactgattcagtgggaaattgttggtcttgaggaagctacatgggaggatgtgacttgggttaaggcaagttatcctcacttcaaccttgaggacaaggttatttttaaaggggaagctattttcgatttcgttgtgaacatcattccttgttag

SEQ ID NO: 28362 - DNA, 381 bp, Glycine max
  Peptide Sequence Number=SeqID_145140
atgggaaaagatttgggtggatggaaggatgcattgaatagatacgaaaagtgtccacatccaggtgttcaaaaagttcatagaataagctatgatagccttcccttcaatgagaagaacatttttctagatattgcatgcttcttcaaagggcgaaaattggaatatgtaaaaagagtactagttgcaagtaacttcagctcaggaaatggtcttacaacattagttaataaatctcttttaactgttgacaaccatcgcttgcggatgcatgacctaatacaagacatgggtaaagagattgttaaggaggaagcgggtaataaactaggtgaacacagcagattatggcatcatatgaagatgttcgtcaagcactag

SEQ ID NO: 28363 - DNA, 771 bp, Glycine max
  Peptide Sequence Number=SeqID_145141
atggggagctgctggcctcatccatattgttcgatatacgaacactttttgtcagttgtagagtgcaatgctgatttggactacgacgaggtgtcaccacgtgcatgtcggtggattgcgacaaagaagactgtgaaaaaggtatccacaacgacgtacaagcagtgcttggatcgtctgaggatcctatatgtctgctggatgccatatgcggagcaccgacctgcgcaggactttcatctgatttcatgcttctcagggcagctccgctgggggcctgttgttgtcagatacagaccagagaaggttatgcgccagttcagctacgtccaatgcattcctacacaccctatccattcatgggtgtcatatgatgacatggatgatacttggacgcattactcagaccatttggcggcagcaggtgatctatgtgttgtgctaggtcaatgtgcacctgactacatagactggttcttcatcatatcgcatccattcatgactacgccacagacggatcctcctcgagatgcatatgcgacgcaacccagtcatatccctcatgaggcagcaccggcatcgacacatgcggatcctgatgcggacgagccaagacatgcagtggcttgccatgcgatcgcggaagcgttggagcagcatctaaatgcgtcaggcacatcgacacatgaagaggtcatccaaaaatgcctcaggatttccaggggtgtcacagaagaccgcaatgtgtatgtgaggtctcgacgtaggtga

SEQ ID NO: 28364 - DNA, 507 bp, Glycine max
  Peptide Sequence Number=SeqID_145142
atggatacccttcacagtctttcccatcaggtgcataaagagattaagacattagaagtgaagatgccgagattaagggacattccaaaatgtttcgtctatgttaacgagggagggctcgtgaagttcccaaccgttgctttagcgtttgtgttcggaaaaccaaaaccaaaaactttggaatgggcatcgtatgtagtttgcatgcacttgttcattgagggtgaacacaaagggtaccgtgatttccttgtgaagaagaatcttgcgttgttatgcgacctacgatttttttttggtttggagtgggaggatgcaggtgttgggatgggtaatgattggaagaccatacaggtttactgtgaaacagagttgactgtatgttcttggggagtttgtgtgtacaagcatgagactaacatcgaggatatccagatcacgagtgaagttcctagttccactttggttcggagtcttcatgcacttaaagtgaagtataagaattga

SEQ ID NO: 28365 - DNA, 136 bp, Glycine max
  Peptide Sequence Number=SeqID_145143
aaatgcacttgcggttgtagatgattcaatcagtgttcagttaaccaataggcagcatcgctaccgacaagggagggtctcatacaagagacgaaatgatttagggactcaatctgtaaaaagctcaatggagtga

SEQ ID NO: 28366 - DNA, 456 bp, Glycine max
  Peptide Sequence Number=SeqID_145144
ccccaagggtcgtcgtcatcatcaataccaacaatggaggaagatattgacaaagctgctgaagcactcgtttctttggtaacttcataccaagagggaaaacataatttgccaccacacgagaacctcagagactatattttagagtatggtgagcctctcaaaaaggtattgacaaatactgatgtgaatgtaaatcaaaataggatttttctcaaaaaagagcatgtggaaaagtctttcttaccgttattgaggaatgatgaaaatattgaagaaggaatacgagtctgtgcctatgacatgcatgacaatagttacactctaatgttcaagaaatggacaaagaagttttatgtgcttaacggtgagtggaaaaaattcttccaaattcatgaattgcaaaagaacgatgttgtcacggtgtggatatttcgtcattcaaaaagcaacaag

SEQ ID NO: 28367 - DNA, 951 bp, Glycine max
  Peptide Sequence Number=SeqID_145145
atgggtcagctccagcggcaagctttttgcaaagcttacggtaaaatttgggacttagccatggtagaagtctccacagaggccattgcctccctcgcccagtattatgatcagccgatgaggtgcttcacctttggggacttccagctatcacctatggcaaaagcaagaatcttggcaggtaaaggcgagtgggccccgttcatagatattcttgcactattgatcttcggaggagtccactttctgaatgtggatgggttggtggacctagcagcgatcgacgcttttcttgcctatcataaccacaaggaaagcccggttgtcgctatgctaaccgacttatatgacaccttcgaccgaagatgtgaaaagagcaatacaaggattgtttgttgtactccagctctttatgtatggttagttttgcacctttttcgccaagaggtgaggcatgcttgcccgctagaaggtcaccgttcatgcacagagaaaggaggggcaaattgggaccaactcttattgagcaaagaaggagcctctatcaactggttccctcgatggaaagaaggaagaaccggagttcttgtctcgtgcggaggatttctgaatgttcccttgatggggacaaggggttgcatcagttacaatctcgttcttactataagacaacttggctaccctatgagaggggcaccactagaggaagagctcgcacctattattgcattaggtttcaataaggccaatgtggaggcacttcagaaggtccgcaaggtgtgggagactgtgcaaaagaaggacaaagaattcaaaggcagtaacaacaggcccatcggcggctaccgtaagtggttgaaagcccacatgcaaggtttggattggctctcgagtttgaggaccgctaaaggggaggaagttgaggcaccggaggaagacgaagaggtgtag

SEQ ID NO: 28368 - DNA, 843 bp, Glycine max
  Peptide Sequence Number=SeqID_145146
atggcttccaagaagagaaagtcttctgcttcttcctctacccaagcaagatatgacagatctaggtttcattctcaagaagcttgggagaggtacactgatataattgtgcctaggaaactgcttccagagaggaatgtggtagtatattacactgagtttgatgatttcaaagaggaactcgagagaaggaaatgggatgaagaattgactaattttgatgaaggcagcattgatgttgccatagtgaaggaattttatgccaacctctatgacccagaagacaattcacttaagcaggtgagggtcagaggtcatctgatcaaatttgatgaagatactttaaacacttttctgaagacccaagtgattctggaagagggggaaaatctttgtgcttattctagattttcactcttgaggcctgatcctcaagagttagctgctaagctctgcatcccagggaaaggatttgagcttaatgcagatggcctccctttgaagattttaaggaagaacatgaccactttagctcagacatggagcattctttccttctctaacttggttcctacctcccacacatctaatgtcacattagacagggccaaattaatctatggaataattatgaagatggacatgaatgtgggttacctcatctctcaccagatctctattacagcacagcatgacccctctaggcttggatttccagccttaatcacaactttgtgtaaagctagaggagtcacatcagattctagatccctggagagcctcagccctgtcattaacttcgcgtacattaagaagaactattggaatctagatgatccaaca

SEQ ID NO: 28369 - DNA, 348 bp, Glycine max
  Peptide Sequence Number=SeqID_145147
atgaatcgacatctgccattaataacattggatgatagtgatgaagatcaaacactcccccaccacaaagcacctaaggagtttgtctcgttggaccaacttgttgaacttggagtccttagttggaaactagatgctgataaccatggaaatgatccagagctgaagaagattcatgaagagcatggctattgtgatgttaaggatcacaatgatgcttggattcgtgagtgggtcaagaaaggaggaatgatcatcttacctgtcagaatttatcatcactttacgctagatgagagcaactacattaagcggttttggagtgggtcgctctgtgttgctatctag

SEQ ID NO: 28370 - DNA, 135 bp, Glycine max
  Peptide Sequence Number=SeqID_145148
atggatccagttactaccagtctagctctttcgatgcacttcattcttatttttgggtacctcactccttcacagaggaagggaaatagttcttctatttatgaatacctatttgaaagattactacactggtaa

SEQ ID NO: 28371 - DNA, 744 bp, Glycine max
  Peptide Sequence Number=SeqID_145149
atggagaacattagcaaattcactgaaggcaaaaatcaaattgtgattatggttgcttctagcggcatagcttctctgttattgccaggaggcaggactgctcattccaaatttaagatacctgtgccaatttttgaagactcaacatgcaacatacttcaaggaagtcaactagcagaattgttaaatcagacaaatctgataatttgggatgaagcacccatggcacacaaattttgcttccaagcacttgatcaatgtttaagagacattattaaagaaaaaaaatcgaatcaaatttttggaggcaaagttattgtatttggtggagatttccgacaaattctgtcagtcattccaagaggaagtcgttcagacattataaatgcaacaatcaattcatcatatttgtggccttcctgtgaagtcttaacaatcagcaaaaacatgcgtttacaaggcaatgcccaatcaattgatgatcaagaaactactaaatttgcaaagtggattctagatattggagatgaagttattgggaatcaaaatgatggatatgctaccgttgaaattcctgagtacctattgattactgaatataatgaccccattgatgctatagtcaaatcaacatttccagatttatatgaacatcacagtaatcctgaattcttcaaatgtagagcaatattagcttccaccaatgaaacagttgaagaggtcaatgattatatactttcttga

SEQ ID NO: 28372 - DNA, 657 bp, Glycine max
  Peptide Sequence Number=SeqID_145150
atgccgggaccttttgattataaaaacggaatttctctcatgcagcagggaaaatttatcgatatctaccaaataaatatcaaagaagaactggccagcaggctttctatattaaatgaacagatccactttgtaaatgacgctgccgcatttctggaaggcgaagttttcggaggttgcgtcactgaatataaccgtgtatttgggataacgctgggaacaggattaggaacaacattctacaatggtgagacttcaacagatgaggatttgtggaattctccttttaaagattccttagctgaagattatcttgccacacggtggtttgttaaacgatatgcagaattaacaggaggcgaaatctcaggaaccaaagaattacttgataagcctaaagacatccaatcccgaatatttcaggaatatgcagattctttctcggaatttattgtcagatatgtatgggattacaagccggaggtccttgtaataggaggaaacattgcgaaagcatatccttattttgaagaaagatttaatgagaatttagtaaaaaataatattaacttgcctgttaaaatttcggctatttttgaagacgctgctatcttaggtgctgcaagctatgctttgaagaagaccttaatcaactaa

SEQ ID NO: 28373 - DNA, 927 bp, Glycine max
  Peptide Sequence Number=SeqID_145151
atggctcgctatgatttggtggctgatttacacgaatgcgtgaatacgctggagcgagaactcactgcactgcgcgcgtcggttgaacagcagccgctgttgctggcgcgcgtattcagcctgccggaaatcgagaaaggcaaagagcatgatgaaatcaaccgcatcgcggtgacccagcatctcggtaaacgcgcgcgcgaaatggccctcgcccactattgtcgcctgtttatgcagcatcagtcagaaaaactcagcaccaaagcggcggtgcgtctgcctggcgccctctgcattgaggcggatgaggcagccagccagcgactggagcagcaggtcacgaccatcaacacccttaaacagcggctggagcaattgatcaccgtcgactccggcctgccgagcgaggcgcgttttgagtttgtgcaccagcatctgcgtggcctgatcacgctcaacgcctaccgcagcgtcacgctactgcaggcgccggatacgctgcgttttggctgggcgaataaaaacatcatcaagaaggtgacgcgcgaggctatcgtcgggcagctggagcgcagcctgaaggcgaaccgcgcgcaggcgccgtggacgcgcgaacagtgggcagagaaagtgcagcaggagctggagcggttgcggtcattgccggacggcgcgcaactgaagatcaagcggccggttaaagtgcaacctatcgcgcggctgtggcgcgccagcgagaaaaaacagctgcagctggcctgcccttcgccgctgctggtgctgtgccgcgatcgtacgcaggtgccgacgctgggtgaactgctggattacgatgctgaaaacatcacgcaccgttacaagccgctggcgcagccgctgcatctgatcatcccgcggctgcatttatggagtgaccgtctgtaa

SEQ ID NO: 28374 - DNA, 264 bp, Glycine max
  Peptide Sequence Number=SeqID_145152
atggtcgaaaaggagatgattaccatgatggtagacaccttgccggtgttttactatgagaagttagtgggctacatgccctccagcttcgcggacttggtattcgtcggagaaagaattgaaataggtttgaagagagggaagttcgattacgtctcctccacaagtaccaacgctatgaggatcagagcaactggggaaaaaaggaaggaaggagatacccatgccatcacttcagcgcccacatggatcaagccaccgtag

SEQ ID NO: 28375 - DNA, 432 bp, Glycine max
  Peptide Sequence Number=SeqID_145153
atggagccccttgagcaaaaaaaggaagccttttgtaatcaggataaagccacccgcactccttctgctagcctaactacccagcaatatttctgcgttcccaactccttctcccgactctaccctgactcgcccgagtccacactcaaacccgcgctcatggcaaataacccttccgacgctcccgccgatgacttccttgaacaaatcctcggcctcccgaacttcgcttccgccgactccggcctttccgctgccgatgtcggcctcgccggtgcggccactcaggctccgatgatgctgcaactcaactccgccgacgccaacgctcacctcgccggcgccgccttccacgcgcccgtgtatcagctagggctgagcttggaccagggcaaaggtgggttcatgaaagcccgaggaagcctccgctaa

SEQ ID NO: 28376 - DNA, 198 bp, Glycine max
  Peptide Sequence Number=SeqID_145154
atggcaatatggagaagagcaggcgcagaggaagaaagaaacaagaaaggaagtgagaggttgatggaggacttctggagcatattccctaattctacaccattgaaaaattctattatactccaagctcataggatctctaactcatttctcggcttgtatcagaacatacaaaaaggctacataaatcagcaatga

SEQ ID NO: 28377 - DNA, 492 bp, Glycine max
  Peptide Sequence Number=SeqID_145155
atgacagatgtgactgtctgtcacatgaaggacaggagaaagctggttgttcaagtgggaggggacattagggcaacaaacacagccaatgatggtgacaagcgtggaccagcaactgacggttcagatcgagtgggcttttgggagtggatccgggagcgttggatctgtatgggaacaaatccatgtgacagagggtgtggggcccaaatgggtgtccttgattggatgggcatgaccatgtggatgttggccagtggggacacaaatctcaaccaccccttcctcatcctcatcttcgtcattctcgtcgctgtcaaagggctctgtctccacaatcatcttcaggcactaattcttatacccattttcatttgggatccaggttctgttttctacacccaacaccttgaggacaaggtgtttttgatggtggttattatagcggttattgtaatggttcttgttgcggttattgtagtgggaatgtag

SEQ ID NO: 28378 - DNA, 708 bp, Glycine max
  Peptide Sequence Number=SeqID_145156
atgaagaaagaacctggcttggaagatgaagttggtccatctgacgcgcaaccacactaccctcctctaccaacaatgttgtgtaaaaatgttaacccgacacccaactcgcgtcaacgcaccggtcctggcttaactgtttttagttcatcaaatatactcggaatgggattaactgtcaacaaaattacatactatgacatggccaacatgatgttgcagtgttgtctacaaccaaaatttacaaacccaaggattatctctgggtggagagcacttaggcatttctatcaattgactggagatcatcaagtcacgttaacccaccatggtcaaagtgtcttcttgatcaccatatacaaaaccagtagccctctaaaatcgttcccaaagtggcactcattatatcatcaagtgtcgaactcggtgactttcgcggtgcttctcaatgaatacaaaattagttgcagcagcttggatgtacccaacaacatgtattatttcatgaaagacaaaggattcgagcatttgaatttggaagatgttgcggaatgccgcattgtttacaatcattggaggaagacaactaaaattggagcaggatggaaatctttttgtgaaacacaggcttttgaacctagcatgctacttgtcttcgagtttcccaatccagtagtgaactatgttttattttggccatgtttataa

SEQ ID NO: 28379 - DNA, 106 bp, Glycine max
  Peptide Sequence Number=SeqID_145157
atgccaacgtcatcacgtcggctcggcggctcctcaccagaatcttactccttgcaccctgctactgtcattctgctcccacgaacaatgttcgtgatcatcacag

SEQ ID NO: 28380 - DNA, 279 bp, Glycine max
  Peptide Sequence Number=SeqID_145158
atgggcccaaaatctaccctaaggcttatgagaaccctagggccttctcttgcatctttggcccaatcttcttggagtcttctatctaatgcccttggggggatactaatccaggctcaaaagagtattgcttggaacttcatagcacatactagtttcagcttcctcaaaagagtagaaattctttcgaatgatcatagagaaaaggcaatcaacaacacagacaggacaaaaaagctgaaaagcaagtctgtgctattgaggttaaaattaagatga

SEQ ID NO: 28381 - DNA, 1803 bp, Glycine max
  Peptide Sequence Number=SeqID_145159
atgcttcctttgccgtcttcattcaccaaaccaaactcccacacttcacaattcacaaatcacactatgcaacattttcacccggagccccacatcgctcccaccgtctcttccgacgctaagcgtagcggcaaaaagcgcggcagctacaactgcggccgctgcggcctccctaagaagggccatgactgcaccggcaagaccgcccccactcccacctccgcttcttccgccaccccttcccactcctctttctccgccgtttccgctccttcctccggctccgcctcccgccgcccgctgtctcacctccgccgcgctctctccttcgacgaggacgaagccggcaggctcgatccgtcggagcccgccgatgtgtggtctgtagaggatgatctggattcgtctggtttgccggggaatcttctatgggaagtgttgaggaggctgccgccggcggggctgttaacggcggcgatggtgagcagaggttggagggagatgacaaggagtttgtggagagcggcggaggagttaaggattagggttccggcgtgggctcaggtgggttttgtgtcgtcaattttgcagaagtgtccggggatcgtgacactctctcttaaaatggaaagtgatgtggattccacgatactggcttgtattgcgttctcgtgccctaatttggcattcttggagatctcggtctctgatcctgcagttaatcggatcagcgggggtgaatttgctcgatttgttgctgataaaaagagcctcaaaagcctcaagatggaaggttgttctaaccttggaggttttgttctttgttcgtctagtctttctaccctttggctgtctgatttatactctctgtctaaaatggtctttaattgtcctcagttgagagaggtttcattggagtttgctcaccaagaaagtgacagtactgatcttacaaccatggttgaaggtttgggaagaagttgcccgaggttgaaaaacatacatatatcttcaatgcatctttctcatgctgctgtgcttgctcttactgctgctcagttaagggggctgcgaatgctttcacttgttcttggatccgaagttaccgatgcatctgttgctgcaattgcctcaagctatctaaatctggaattgcttgatctcagtggatccagcatcagtgacagtggcattagcatgatttgcaatgtgttctctgaaacattgacaaggctccttctcgctctttgccccaatgtgacttcaagtggcattcaatttgctacggctcaattgccacatcttgaacttatggactgtggcatgaccatatgtgaacctaattcccaccatccaactgctgatgaaagtaaccgcaaattacagaaaacatttgctactaatctacaccttacaaaccaaaagctaataatcaaacatagttgtttaaagaaacttagtttgtggggatgctcaggcttggatgccttgtatttaaactgcccacaactcaatgatcttaatctaaattcttgtagaaatttgcatccagagagactgttgcttcagtgccccagtctagaaaatgtgtatgcatctggttgtcaggacatgttaattggggctatccaaagtcaggtttgcaatgcttttactgatatggaaaacccttcaccttgtaagcgtttacctgatggctccaaaagggttcgggtacctcatttagttaatactgagtcgcctgaggatgagaagaagggaaggagaaagaagagacggctttgtaacgtggttgttgattga

SEQ ID NO: 28382 - DNA, 360 bp, Glycine max
  Peptide Sequence Number=SeqID_145160
atgaagacatgtcgatatcatcagaactttggtcataccacaaaggaatgtgtgaccctaaaggacaagatagaggagttgatacaagagggtgcttttgtcaactacatctacacccctaacaacaacagaggcagttaccgagctcgtagtcggggccgtggaggcggcttcactagcgaagatagcacgaagttggctcaacagaggtacttacacgccatcaaaagcatgaaccacatttccataacgagctcgaggagatcaatcccaccaataacgttcaccgacgctaactttgcaagagtcgatctcgagcaagacgacccaatggtgattacggttggcatcgccaattag

SEQ ID NO: 28383 - DNA, 903 bp, Glycine max
  Peptide Sequence Number=SeqID_145161
atggaagcgacattctcttcaacgacggcaagaggatactggaatcagacacgtggttcgacagaacctttgttgctgagagtagatgaggctcgcgatcggaaaccgagttcactgtccattgcgcggcctagcaagttcgtgcagctgtcacttgctcgaaccaggaagagttctttctttaaggtgttatctgctgaaaaggaacaaattcacgttgtagagggaagtcgtgttgatgagttatatgatgcattggttacacgtattctgcctttggtctcagtgtcatcaaatcctaatcacaagcttttagttgggctggctggtcctcctggtgctggaaaaagcactctagcacatgaagtagccagacgtataaacaaactttggccagagaaagcttcttcctttgactctcaggttcaacttccagatgttgctattgtggttcccatggatggttttcatctttaccgatctgaactagacgaaatggagaatcccgaggaagcacatgccagaaggggagctccctggacattcaatccattgcgactacttcaatgtctcaagaatctgagaatgcatggatcagtttatgtaccatcatttgaccatggtgttggggacccagttgaagatgatatctttgtgaaccttcattatatacatgtaacagctctagcgtttaagccccaggcacaaggttgttattgtagaaggtttattgatattgacattgacaaagcaatgcagcgagttttaaagaggcatatttcaactggcaagcctccagacattgctaaacagcggatagagaacaacgacaggcttaatgcagaacttataatgaagtccaagaaaaatgctgatataataataaagtcaattgatttctga

SEQ ID NO: 28384 - DNA, 276 bp, Glycine max
  Peptide Sequence Number=SeqID_145162
atggcagagcaacacaaggtgatcctacacgggatgtgggctagcccttttgtgaagagggtggagttggcacttaaactcaagggtataccttacgattatgtggaagaagatttagctaacaaaagtgaactgctccgaaaatacaatcctgtctacgagaaggttcctgtttttgttcacaatggaaacgtcatttctgagtccgtgaacttggaagagatgtttagttacttagctctgtgcagcatatacgaggaaaacttccaaaactaa

SEQ ID NO: 28385 - DNA, 315 bp, Glycine max
  Peptide Sequence Number=SeqID_145163
atggggtgtgaagccttctccacatatccaaggacctatgaccttatccatgcaaatggcgttttcagcttgtacaagaatgtatgtaatgtcgaagacattctattggagatggaccgtatcttacggccagaaggagcagtaatattccgagatcaagctgatgtgctaatgcaagtgaaaggaattgtgaaaggaatgagatggaataccaaaatggtggatcatgaggacggtccgctggtttcagagaaggtgttgtttgctgtcaagcagtattgggtagccggtgacaacagcacgagctcagcatga

SEQ ID NO: 28386 - DNA, 1500 bp, Glycine max
  Peptide Sequence Number=SeqID_145164
atggggcatcaattgcagttgggatgcggtcacaaagactccaaaagccttgatgttgcagctacaattatgggagacagcatagctgttgagattactaaacatacagattgcagtgttctctctgatctaaactatgagacccaccatgatgatgattctggaacacctaacagttctgacacacaagtcagggagttcaagccgtgtgatgatcgctacattgattacacgccttgtcatgatcaagcgcgagcaatgacatttccccgagaaaatatggcttatagagaaaggcattgtcctcctgatgatgaaaaattgtattgtctcatacctgcccccagaggatattcaacaccattttcatggcccaagagtcgtgattatgtaccttatgcaaatgcgccttacaagagcttgacagttgagaaggctgtgcagaattggatacaatatgaaggaaatgttttcaggttcccaggtggtggaacgcagtttcccaagggagctgatgcttatattgatgaacttgcatctgttattccattggacaatgggatggttagaactgcattggatactggttgtggggttgctagttttggtgcatacctgtttaagaaaaatgttgttgcaatgtcaattgccccaagggactctcatgaagctcaagttcaatttgctttggaaagaggtgttccagcaatcattggtgttcttggaacaataatgctgcccttcccttctggagcttttgacatggcacattgttctcgctgcttgattcaatggggtgcaaatgatggaaagtacatgaaggaagttgaccgggttcttagacctggtggttactggatactttctggtcctcctatcaactggaagaatagcttccaagcatggcaacgtcctgaagatgagcttgaggaggagcaacggcagattgaggatactgctaaactactatgctgggaaaagaaatatgagaaggagtacttgacaaacattgtttatctaggatcagatttcttcaatcctttgtggaaagttactagtgtagtcctaacctttggattatggactattggtttcaataataattgtctgaaaggtctgacaatgtataggtacaagaaaatgaaagattgtgtaactcctagtaaacctagtggtccatggaagccattccaagagagactcaatgttgttccttccagaattaccagtggatttgttcctggtgtatctgaggaagcatttgaagaggacaaccgattatggaagaagcatgtgaatgcttataaacggatcaacaaaatcattagctcagggaggtatcgcaacataatggacatgaatgctggtctgggaagttttgctgctgcactggaatctcccaaattatgggttatgaatgttgtgcccacaattgctgagaaagctaacctgggtgttatatttgagcgtggattgattggcatttatcacgactggtaa

SEQ ID NO: 28387 - DNA, 867 bp, Glycine max
  Peptide Sequence Number=SeqID_145165
atggtcatctccatttttatcgccaatttcatggtgtctaaggcctggcagtgctatgctgaaagcttaaaggtggttttttatcctcccattagagagctagccaaccctcatcccacctctcgtggcaacgacaatcaactcataagcgtggacgaagaatcctcaaaccaaaccctgaccgtatacgaagcaattaggggagatcaagatgatgcatttgatgtagacttgtgcaatgatactatcgacaaagacccaaaaccaatcaaagaacttgtcaagttacaactcggtccaacacatgggcaatgcatacaactcagcagggaccttactagccatgagtacaaacgtataactgaagtcctacgcaggaatgaggatttatttgcacgacaaccatttgatatggcaggtatccgccctagcatcatatgccacgcattggccatctgttctcaggccaaaccagtctcacataagaagagaaagacgggagaagagcggcacaaggcggtcaaagaagaggctagccaacgtggtcatggtcaaaaggccaccgacaaatggtgtatgtgcattgactacaccaacctcaacaaagcatgccccaacgacgtgtatcctttgcccactatcaacatattggtcgacagcgcgtccagtggtggaaagttcttgggttccatgattatccattggggaatagaagtcaaccctgacaaattcctcctaaagcttataaagaaggcaaggccattctacaagctactcaggaagattgagtcattcctctccaccaacccccttcctttctactgtggcacctgcaagaattaccaaccaagaggtggctatgattaa

SEQ ID NO: 28388 - DNA, 1425 bp, Glycine max
  Peptide Sequence Number=SeqID_145166
atgacagatgtgaatgttgaagtgatagataagaaatctagtccaaaagcaatccaacatcgtcagagttcacgctctcagtctcagagagtgacaaatcagaaggttttggagattaaggatcaaattattagagccagagcatacttggggtttgctcctccaggcagcaactcacacttgatgaaggagttgaagctgagaattaaagagatggaacgtgctgttggagaagctactaaggattcagatctgtcaaggagtgaacttcacagtgctttgcagaaaatgagacacatggaggcttcactgtctaaagccaaccgtgctttcccagactgcactgctatggcagctaagctccgtgcaatgaatcataatgctgaagagcaagttcgttctcatcaacacgaaggaacatatcttattcatcttgctgcaaggaccaccccaaaaggtcttcactgtctttctatgcagctaactgctgattactttgccctgaaacccgaggaccggaagcttccaaatgaaaacaagattcatgatccaaaactttatcattatgctgtcttctctgacaatcttctggcatgtgctgtggttgttaactccactgtctctaatgccaagaaaaaggagaaacttgttttccatgtagtgaccaattcactcaactttcctgcaatctggatgtggttcttattaaaccctcctggcaaagccacagtccacatacaaagcatagagaactttgaatggttgcccatgtacaatacattcaacaaacataattctagtgatccaagatatacttctgagttgaactacctgcgtttctacctgccagatatcttccctactctaaataagattctgctctttgatcacgatgtggtggtgcaacaagatctcagtggactatggaatgccaatttgaaaggaaaagtaattgcagcagtgggcacctgtcaggaaggtggaacctcatttcataggatggatatgctcataaacttctcagatccattcattgcagagaggtttgatgccaatgcttgcacatgggcatttgggatgaacttgtttgatttacaacagtggaggagacataatttaaccgctctctatcacagatatttgcaaatgggttccaagaggccgttgtggaacattggaagtctgcctttaggctggctcactttctataacaagactaaggttttggacagacggtggcacattcttggccttggttatgactcaggtgtcgataaaaacgagattgaaggggctgccgttatacactacgatggaattaggaaaccatggttggacattgcaatgggaagatacagaagttattggaccaaatatatgaactttgacctccctattttgcaacgttgcaatctccaggcgtag

SEQ ID NO: 28389 - DNA, 288 bp, Glycine max
  Peptide Sequence Number=SeqID_145167
atggcactagatcaatacaaaatagagtttcatgttgttggttttggggtgtggtggggtttaggtcgaggttcggtggcaacatggtggttgcaacacgaattagatcgcggaagttggtttgtcgaggaagagcacaatggggtcatggatgatgttgattctgatggagagcagagacatttgccaccagagacaccgcagtcactctcatcaccaatgagccaaagtttcgcattagctagcactatcagaatcactgtgcaatgtcgtcatccctctccatga

SEQ ID NO: 28390 - DNA, 186 bp, Glycine max
  Peptide Sequence Number=SeqID_145168
atggatgaagctgctgttggtaatggtagcgatcggtggagatggatgataatagggaatgggtcgggattacattgcgcgccgttgggcagcgtgtcatgcgggagggtccatgatagcggatggataggctatgttgatagggcaagtgccttggggaggaatgtgaaggtccttaccaattaa

SEQ ID NO: 28391 - DNA, 579 bp, Glycine max
  Peptide Sequence Number=SeqID_145169
atggctcttgctggctctgtggttgagcttcaagcctcttcagtaaagaagaaaactgcagtttccagaagttggattctgctggaccactatggcaaaggcactgttcttgatgcggataagtatgctatcatgcgcctggttcaaattcacgccagagatcttcggattctcgaccctctcttatcgtatccttccaccattttgggcagagagaaacacattaaagctatcatcactgcagatgaggtgttgctaagagacccaacggatgatgacgttgttccaattgttgaggaacttcgacgacggttacccaaagtaagtgctgctgagcaaggccaaggagaagaagaggcgtgtgctcaagatggtgaaggtggagaagaaaatgaatttccatttgagatacgagctttggaagttttatttgaggcaatttgtagtttccttgatgcacgaacgagagagctagagacttctgcttatccagctttggacgaactgacctctaaggttttaaactgcggtcatggtctcgattttgttgcgcttattgatattattgaaaagccttga

SEQ ID NO: 28392 - DNA, 144 bp, Glycine max
  Peptide Sequence Number=SeqID_145170
atggaagataacaacaacaaccaattcgttgttgagaaatacagaataaagcttggaagagaagttgaatatttggagattctcgctcagcgcactatacgcactcagcgcgacacagtcgctcagtggacaacactcgcttag

SEQ ID NO: 28393 - DNA, 900 bp, Glycine max
  Peptide Sequence Number=SeqID_145171
atgacacccacgaggaataaagttgttgtgattccaacaatcaataatgaagaggatgctaagaatgtatttctagaagaatctttcatccctggtcgatggatgcaagcgttcaaagaaaaattcaaccccaaagtgaagaataaccatgtcccttatggtatgtttttcactcagattataaggaatattggtgttgatgtgtctggtatggcactatttggaaaggcagtacaacttaaaaggatggcctttttaaaaatgaggattactgataatttcccagagtatgctcaaaagcatataaagagaaaggtcaagaatgagccaaaaggaggaaccccagactatgtctccacctcattcatagctaagaagaagtccttggctgaagcatgcaagaaggacaatttggatgagactcttgaaagaaatgaggctttggagttggaagaagttgtacatgcatctatcagagctctattagttaaggagcacaataggaagttggctaatgatgcaaatatttttgccttggcaggcaaaatctctaaacacactattgttgaagaagttcagaggcagactactgaaaaagctaccatgatggatatagatggtgagtcagtgcctgaagctattattattgagtcaatacaagcagagtctaaacaagagatgaagaaaaatgagatggatgaactggaaagagtccaatctacagtaaaacttagagctaagatcatgtctttcgatgcaactcaaagacaagtaaaaatggaagccaccattgttgctaaagacatggatcccgtagagaagaaagctcttgaagagaccatgcttcaatttgttattgaagcttctcttagagagcagaagatgacattgttgaaatag

SEQ ID NO: 28394 - DNA, 558 bp, Glycine max
  Peptide Sequence Number=SeqID_145172
atggcttgcttagcgcgctcctgctcgctcaacaaaattccctctcgggttggaattgcgcttagcatgccatgctcgcttatcgagagaccaaactttgttattttcaaaatcccaatggtcaagctgtggaaaattgtcttaggaaactcaagacaaaatttgaagatgatccagcgttgggctaagagcacctccaccagcacgctaagtgcgactgacgtgctaagccactgcacgattctacaacttacaccatttaattcgctaagcgctacatctcacgctaagcgagcctcctatgctcaccaagcacgtgatagctcgctaagcgaaagttgcaggcttagcgcccatcacgcgctaagcaccacacctcagaagcttgtgcttgttttgcctaggaggaggcaatggtaccgacaactcaccctcctgctggagaagcagattgatgtggcatttgtgaagaagttctactctaacatctatgacccggatgacggctcttcgaagcagtgccgggtacaagggaagatcattaaatttgacacttag

SEQ ID NO: 28395 - DNA, 576 bp, Glycine max
  Peptide Sequence Number=SeqID_145173
atgggcctgaaatctaccctaaggctcataagaaccctagggccttctcttgcatctctggcccaatctacttggagttttctatccaatgcccttgcgggagctagtgctgaagcatatgttgaagcgaatcttgtgctaaactgggagaagagccacttcatggtcctggaagggatagtgttgggccataagatctcagctcgggggatcgaggtggacatagaaaaaattgatgtcattgagaagctacctccaccaatcaatgtaaaaggcatcaggagtttccttggacatgtcgacttctattggcggttcataaaggatttctcaaagattgccaagccattaaccaattttctcaacaaggatgcaacgtttaaacttgatgaagaattcctggtagtttttcagactctgaaggatagacttgtgtctgcaccagtgatggtggcccttgattggagtaaagaattagagctcatgcgtgatgctagtgattatgcagttggtgtagttctaggacaacagagggataagatatttcgtaccatctgttatgccgcaaggtcctga

SEQ ID NO: 28396 - DNA, 429 bp, Glycine max
  Peptide Sequence Number=SeqID_145174
atgagcttgaggctcttaagtgcaaaaatgagcataccagtctggattggtctggaaccaaaaaataagccatttgcagaaggctttcatcatgaagtagggcattactatcagactttgaaccattcatgcttcactgaggagactcctttcaacatggtttgttcctggaaaggggatttctatgttgtgtttgatcataatttcttgttcgttttgcatttgcctcattccagattcacttccacttatcatgtacaatctatcatagaagaagtggattctgatgttgaagttgatgttgatctagatgccatggttgttcaagtgtatgatcatccgcccttaacagagtatgtttgtttggtagatgttgagctattaaagatgaaggaagcacttgctcaagatttggaaagtcgtgcttga

SEQ ID NO: 28397 - DNA, 341 bp, Glycine max
  Peptide Sequence Number=SeqID_145175
tggcgtctcctctctctcttccttctccattccactaccattcatcttccaagaagcaaaggaatccattgatgaagaagatcctaggcctacaagctccaatggagcttacatcaataatcaacctaaagaagtcaaagaaccaactagacgcttgctaagaaaacattatccagaatctcatatcattagtgatcccaaggacaaaaagcttgtagaactccccaaaagaaaatcagctattggagctaagtgggtgttcagaaacaagttggacgaaataggtaaagttgtgaggaacaaggctaggcttgtagccaaaggaaactcacatcaggaag

SEQ ID NO: 28398 - DNA, 378 bp, Glycine max
  Peptide Sequence Number=SeqID_145176
atgaaagaaggaaaatttgtggacgacatgtttggaagctctaggacacacgttcaccatagctcaaataaatctacagattctagacaactttcccaagctgtgagaaccaaaaataagagtcatccaagaagctatctaaaaacactagcatgggatgaattgttagaactaagatcatcttccaaagagatattttgttgccccaaggctagagaaactagctctagaagaggagaaaagaagagctcttataaggctctaaaagtgcagatggctcagataatagttatggaagatccacagatgatgaacccttatgtccagaaagttcaaacaaatgctaaaaaagaaaggaaaatttcaacattcttgtaa

SEQ ID NO: 28399 - DNA, 480 bp, Glycine max
  Peptide Sequence Number=SeqID_145177
atggcccttttgccgggtcagcaattagggtcttctgggattggtgggaatatgaacaacaacgaaggacatttgagtatgctttcggggcttaaccctaattatcgaacgacggtgatcggaatttcggagtctcaggcgagttttagagaatggatgattaagatttttgagagatggatggtggggtctgcaagacctcatcggttcgaggtgttggctccatggtgggatccagctgctgattattgcccaaaccaatgtacaatgttactgactaacagtgcctctgttggtcatcatgttcgtgctggtaacctgactgttggtcatctgcctagtcctgttgttggccctgttggtgctggtgttgtttgtcatgttcatgatgctgctagtgaggtaggaactgaaggacaacaaactgaaaaacatgcatatcctcctttgattgatgcaactcctctctcactcgattaa

SEQ ID NO: 28400 - DNA, 567 bp, Glycine max
  Peptide Sequence Number=SeqID_145178
atgaagggaggtagtgatgacttccaccaccaccatcaccaccatcaccataaccaccaccgacaaaacttcccattccaactccttgagaagaaagaagaccaacaagacccttcttcttgctccacctcttccccataccctcccctagccatcttagctgaaccctccacctccaacaacaacaaccaactcctccccacaccctcctccgaaccctcccccaaaaaaccaccccccaaaagaacctccaccaaagaccggcacacgaaggtcgacggtcgcggtcgtcgaattcgaatgccggctctctgcgccgctagggtgttccagctcacgcgtgagctgggacacaagtctgacggcgagaccatcgagtggctcctccaacaggcggagccatccgtcattgctgccaccggcaccggcactatccccgctaacttcacctccctcaacatctccctccgcagctccggctcatccatgtccgtcccctcccaactacgatccagctacttccacaactcaaacttctccctccaacctagaagagcctattcctag

SEQ ID NO: 28401 - DNA, 621 bp, Glycine max
  Peptide Sequence Number=SeqID_145179
atggttcctctatacaaggcagcactgttactcacaccagggaatgtccacaaaggaggagcttcaccactcacaccaccacctaggacaagtctagtgatgaagattcgcgcaattcgtgcttgggttggaagatggcgtgttgttgttggattggaaatggaggagtgtgttgttgtgggaggagtgttgggagatgttgagggaggtgaagttagcggggatagtgccggtgccggtggcagcaatgacggatggctccgcctgttggaggagccactcgatggtctcgccgtcagacttgtgtcccagctcacgcgtgagctggaacaccctagcggcgcagagagccggcattcgaattcgacgaccgcgaccgtcgaccttcgtgtgccggtctttggtggaggttcttttggggggtggttttttgggggagggttcggaggaggggttcagctaagatggctaggggagggtatggggaagaggtggagcaagaagaagggtcttgttggtcttctttcttctcaaggagttggaatgggaagttttgtcggtggtggttatggtgatggtggtgatggtggtggtggaagtcatcactacctcccttcatga

SEQ ID NO: 28402 - DNA, 480 bp, Glycine max
  Peptide Sequence Number=SeqID_145180
atgccagtgttgaaggtgaacaaaataacaacatttgtgaaatgcggtgaagccaagttgcatttcaatgatgagggcggaagtggagaccggaagtcgcgccatgttttaggcatagaggtagtcgttgagtttgatggcttcgacaatggaggcggtgcgatggcggcgaaggtaagagatggtgagggggaggatcatgtgggggatgttgacgattttgaggaagctggagagccagacatggtggccaccatggaggaagtagagacgcatgacgaggggcccactaaaggtgctgatgaaggaggaaaggtgattggagatgccacttcaaggagaatatgcgttaagaacaagctcacaaccataggaagccatgataagagcttgaaggtagaagaagatgagtggagggagagggagagggagagagaggaacgaaatttcaagagagagaaaagggagaatgaggtgtga

SEQ ID NO: 28403 - DNA, 318 bp, Glycine max
  Peptide Sequence Number=SeqID_145181
atgggtgagggttatttcattagtgagactgtcgcaacctacccttcggcgggagggcaacgcctggctcgcgggatgcgtgttccacgaaaggaatatgcgcggagtcgccaccaacgtttatttgaggaaaacgtcggaaaaaccggaaaggacgcgatctacgaacttttaagtgaaaggttcgggagttgtatttacgcacggggaagtggtgatcattttaaggcgttggaccttataaatgatccattttactcagtgagaaattgcaatgacaaacttcaaaaacctatttttatggatgagcttgactag

SEQ ID NO: 28404 - DNA, 978 bp, Glycine max
  Peptide Sequence Number=SeqID_145182
atggcgcagcgcgtggcgcaagagctgagggacggttactacgtcaacctgggcatcggcatcccgacgctggtggccaactacgtgccggcgggcatggacgtgatgctgcagtcggaaaacggcctgctggggatgggcgaattcccgaccgagcagcagctggacgccgacatgatcaacgccggcaaacagacggtcaccgcgcgcctcggcgcgtcgatcttcgattcggcgcagtcgttcgccatgatccgcggcggccacgtcgatctgaccgtgctgggggcgtttgaagtggacgtcgagggcaacatcgcctcgtggatgatcccgggcaagatggtcaagggcatgggcggcgcgatggacctggtggccggcgtcggccgcgtggtcgtgctgatggaacacgtggccaagaagaaggatggcaccgaggacatcaagctgctgcccgaatgcaacctgccgctgacgggcgtgggcgtggtcgacctgatcatcaccgacctgggcgtgatggaacagcatgccgacgtgcgggatgccgtcctcgatgtattcgtcggtgaccggcacgaagccgtggccgccgtagtagcccttgagccgggcctgcgcgcccagatagaccggcgcgccgggccacagccgcgccacttcgtccttggcgcggcgcatcagctcgtggcccaggcccgtgccacgcgccgcaggcgccgtgatgacgcggccgatgaccgcctggccatcattgagcgccggctccagcaggcggcaataggccagcagttccccgttttcccatgccatcaggtgttccgtctgccccagcaggtccttgctgtccatgtcgaggaagacgcaattctgttccaccacgaagatttccgagcgcaggcgcagcacggcgtacagctcggccagggtcagttcggcgtggggtttgcaggtccaggcgggcattcgagatag

SEQ ID NO: 28405 - DNA, 522 bp, Glycine max
  Peptide Sequence Number=SeqID_145183
gtatgtgcagcgtcattgaataaggctgatacgcccggactcgaccttttgctcaacccagctgcgctcatccccccaggtgtgacgtttccatccttcccaggtgaagccgcagattttcacgtcccagctttcctgcgggcacttttcgagcatgtaccagatgccaaaaaaaccagtacttggaaagactttgcttatgttctcttcggttacgcccagctctttgcacccggccagatagaactggggcggcatgatccggatttccttgccggcagaaccgacaacctcaacggtctgcatggtccagtcaccgcgccgtcccttgaggcgggaaaggaaattcgggcgggggtgatatttgcggatgatactgggatgataggccagcatcacttccttggcggccttgaaggtgggtgtctgtacgaagcccggatcgcgcagacgccgctgcatgggcttgctggaggttgccagcatcaggagatccgtccgggtgccactcatgccgattga

SEQ ID NO: 28406 - DNA, 189 bp, Glycine max
  Peptide Sequence Number=SeqID_145184
atggggcaaggaatcacaacgacaagtgtacttaggaggttacctgaatcaggcacactggcaacttgttgttctatgtccacgggacaatattgttgtttggttttgttctttgctgcaatgaagacaacaaccactactttggaaggaaagctagatccacctgtacctcagtggattgaaccgaag

SEQ ID NO: 28407 - DNA, 528 bp, Glycine max
  Peptide Sequence Number=SeqID_145185
atggatgccattaagcttataactgcgcgggatatcgataaaatgaacaatatctctgtaacgcctaaaggcggaacgattgctactgaagtgagcggtaatcaggttaatttgactgctcccagtgtggttaagctcaaccttaatcaggctgatattaagtctttcacacgcaatggtagtgatttagtggtcaccactaaatccggtgaagtcgttgttattcataaattctacgatgctaacggcgacagcgatctggtgctgcaggacgacaaaggcgcgctgtggtgggtggaagatcccggcacagaaggcttccagtttgtctctatcgacagcacggaagggctgttagcggaaaacgtcacgggtgacggaacactgaccgcctttggtatcgccggcgccgcgctggccggtatcggtgcgctgatcgccggtaacaacggcggtggcggcggcggcggtggggataacggcggcggcgacaatggcggcggcggtgataccacggcaccggcggca

SEQ ID NO: 28408 - DNA, 222 bp, Glycine max
  Peptide Sequence Number=SeqID_145186
atgcatggcaactcctcatgcctctcagggcatgtgtcgcccgttcacgttaacgggcctgaatgcagtctttccctgtcacgaatactcctgagcaacgtggctgacagacagaacgcaattgatgaagcacgaacccctgagattccgtcagggtgcagaaaggataaggtgcgcactggccggttgatggccaggacagcgcagcattgcgcaggctaa

SEQ ID NO: 28409 - DNA, 273 bp, Glycine max
  Peptide Sequence Number=SeqID_145187
atggcagtgtccgtgacacatggttcggagaaaggaaccatcgctagttcgcatcgcaaacttcttactaatggttgttttcatgttctccttgtgcagcttttggccattgctgtgataatatttggagtgtggatgagcactcatcatgatggctgccgaaagtctctcaccatgcctgtgataggcctcggagcgatctgtagttggctttttgggtgccctgaaaaacatctccatactattatggattgtatccttattccttgttag

SEQ ID NO: 28410 - DNA, 192 bp, Glycine max
  Peptide Sequence Number=SeqID_145188
atggaagaagaagaagaagaagaagaagattcaggggaaagttttgtactttgtgctgtggaatcaacggtgtcgtttaggtgttgtgttttcataatcaacgatgccagcgagtccatgaaatcccgtgggggcactcgagtgttttggggtcccactgagcagcaacaggacaagtttacaactaactag

SEQ ID NO: 28411 - DNA, 348 bp, Glycine max
  Peptide Sequence Number=SeqID_145189
atgcccaacgatcacgtaggtcgtgattcgcgtcacaaaaacacccaagatgcaaaatttactgataaactcagtgtgggcatagaaggccattttagacattctaatcaggctgtcttagttcaagttttgccaataaaagcaatgaggaaacatgaagcaaagccccactgcttgaaatggctgagcagaggattcgggtatggcgatttttccattgctcttggagttacatcaagaaagctttattctacgagcattgccggcacaactgttgccatcgccacccccaacaaaatctcatgttcgcctcctctgaaaactttactcgtgtattccttcacgtga

SEQ ID NO: 28412 - DNA, 125 bp, Glycine max
  Peptide Sequence Number=SeqID_145190
atgacgatggttgcaataatagtgatgtcgatgaaaatgatgataatggtgagatggaataggggcggtgacgatggtgatgatagtggtggtatggtgacggtgatgatagtagcggttgaatg

SEQ ID NO: 28413 - DNA, 675 bp, Glycine max
  Peptide Sequence Number=SeqID_145191
atggccgagcacggttttgatggacatgatgtaggatatgtgcctgaggaccctaattttcctcagaatcattctgatgaacatgatgtagggactgtgattgatagctccggatttcctcacctgctacctgatgaagatgatgcaggcaatttgatggaggacgccaattttcctgaaaatgattttgttgggcatgaacatgatgttggaggtttggctggggacgcggattctccaccggaggagcatgttgaggaagttcatggtgctggagatgtgcctgaggattttgattctctgccgaaacagggatccgagattgattcgaagggaaatgaaataaaaaagtggccgggatggcctggagagaatgtcttcaggatgttggttccagtgcaaaaggttggcagtattattggccgaaagggcgagtttataaagaaaatcacagaagagactaaggcgcgaattaaaattcttgacggtccacctggaatctcagaaagagcagtgagtttcgatttctctgttattttatgtattgaaggatggccttggatatacatcagtgtctgtttgaagaatatgatgcttatttattatgtttatctccttggtgctttgaatacgattaagcatacctttacttccatcatggttactttggactaa

SEQ ID NO: 28414 - DNA, 195 bp, Glycine max
  Peptide Sequence Number=SeqID_145192
atgactgcaagagaacgcgacagaggaaccaaacgtgacaaagaccgcaagagaatcaggcgaaatggacgccacagagcacgcctgaacgacaatggaagagggcacaaatgggggaggagggggagaagaatgcaaaaaaacgaagtgactcaaaaggctaaggttgtcgagatttgttttggagaattttag

SEQ ID NO: 28415 - DNA, 189 bp, Glycine max
  Peptide Sequence Number=SeqID_145193
atggatgatgagaatggtcgatggaataagggtaccttggtgatgttccaattatgggcacttgaacatttttgttcatatcagatacaatatacaaattgtggtatcttgacaatgaagaacacataccaagaaattagatcgaggttgaacattccattgttaaggtgcaatcgacataggaagtaa

SEQ ID NO: 28416 - DNA, 177 bp, Glycine max
  Peptide Sequence Number=SeqID_145194
atggatgttgcctctccaaatggtatctctagtgttgcgtggatgcagtcagcaatagttgttcaaagaaatcaaccattgacatggcacaaggttttacttatggccagattaagattggcttctttgcatgttaaagtcaaaaagttagttaatgcctcattgcttcaattctga

SEQ ID NO: 28417 - DNA, 504 bp, Glycine max
  Peptide Sequence Number=SeqID_145195
atgacaatgaagaaggacaatggtggtatgggtttcaaacaattgcaagattttaatcttgtcatgctagggaagcaagtgatgaaagaaggtttgcaatggaggattggcaatggtgaattcattcatgtttggtctcaaccttggctcaaaaatggtattcatccctatgtctcgcccaaccctcacaatgataattttaatcttaaagtggctgacttaattaggcatgatcttggtgcttggaaagcttatctagtagaggaaaattttaatcattcatatgctcaaagaatcaaagctcttccttttctcaacacttctaaaaatgacaagttaatttggagattttcaccagcagtatatgggaatcctgaaataacaagcttcaagatgaagtttacagattcaaccgtggcttactccagcaatgtagttcttgattcaatggaagcgtgctcagaccataacatcaacaagcccaacagtgcaacaatagactag

SEQ ID NO: 28418 - DNA, 252 bp, Glycine max
  Peptide Sequence Number=SeqID_145196
atgaggaaacttgagaaggtacggaagaaggccaatgccatatcagatcgaacagagatatttgatcgttcaaagaggaagcaaattgaacaactatataaaagggttgttcctaagaggcctaaaaaggaatatgtagttgcaaaaaaaggtgtccaagtaagggctggcaagggaaaagtcattgttgatcgcagaatgaagaaagatgctctactttacttgaaaaagaaagtgaaagaaggaaagtag

SEQ ID NO: 28419 - DNA, 1002 bp, Glycine max
  Peptide Sequence Number=SeqID_145197
atggtttctgcaaaagaagagccagattgtcccataccacctgctgttgatggtttgttaagggttcataagcaagttatcaatgttgatcgtgaccttgcagatagtgcattggctgctgggcgatcagttgttaccaggcttctagtggcggatactcaagcaggaagcttgattgggaagcagggatcaaccataaaatccattcaagatggctctggttgcactatacgtgttcttggatcagaaaacctgccaatatttgctttgcgagatgatagtattgttgaaatacaaggggaatctgctggtgttcacaaggcagttgaacttattgcagttcatttacgcaagttcttggttgaccgcagcataatgcaaatgtcagatgttagagttaaccagaatttgccaccgcatcaaaattggggtcctcctcctcaagggtttcctgctcctgctggtggtggtggtggaggaggacctgcttttgcacctaatcatcaatatatgccaccttcacatcactatgatagttattatccacctactgagttgcctcccatggacaaacaccttcatcaaggtccaccacctgcctatgcaagggatgcttctatgggaattcattcatcaagtgcacaaccacaacaatctgttgtaactaaggtcacacagcacatgcagattcctcttacatatgcagatgctgttataggagcatcgggcacaaatatcagctatatacgtcgtgctagtggagcaagtattacaattcaggaaacaaggggtgtgccaggggagatgactgttgagataagtgggacttcttctcaaatacaggcagcccagcagctggttcagattttaatcctgacaaacatactacaccctaaaaccatttgcctcacttctctggtgccaaccatgtttatgattgatagttcatccactccactagctgctacaatccatattcctgctgttgaaactcctttttag

SEQ ID NO: 28420 - DNA, 1539 bp, Glycine max
  Peptide Sequence Number=SeqID_145198
atgattgagaacatacttctgaatttgcagcttttagcacctttcttcctcttattcatcttcccagtgcttctgttcttctttttctcgtcttcaggttccaaaaagaaagaggcaagcataaccaccatcccaaagccatacccacttattggtcactacttagacctcaaaggcgtcggtaaccgccgtatccagtggctatccgatatcgtcaaaatctcaccggccgccactttcaccctccaccgccccttgggcagccgccaagtcatcaccggcaaccccgccaccgtagagcacattctcaagacccgtttctccaactatataaagggctccatctttattaacaacctctccgatttcctcggcaccggaatcttcaacgccgacggcaacacttggaagtttcagaggcaagtcgccagccacgaattcaacactaagtctctccgcaaattcgtcgaacacgtggttgatgtcgaactctccgaccgtctcgtccccgtcctcgcttcagcagcacaacaagaccaaaccctcgatttccaagacatcctccaacgtttcgcgttcgacaacatctgcaaaatcgcgttcgggtatgacgccgagtacctgacgccgtcaactgaacagagtaagttcgcagtagcgtacgaagaagcgacggagatcagcagcaaacggttccgcgagccgttaccgttagtgtggaaaatcaagagattgcttaacataggttcggaaaagagactaagaatagcggtgaaagaagtgcgcgatttcgcgaagaagatagtgagagagaagaaaaaggagctgaaggagaaggaatctcttgaacaggttgacatgctatcgcggttcttaagttcggggcactccgacgaggacttcgtcactgacatagttataagcttcatattggcggggaaggataccacgtcagctgcgctgatgtggtttttctggctactatcgaagaacccgggcgtggagaaggaggttttgaaggagataatggagaaaccagagactccggcgtacgatgaagtgaaggacatggtttacatccatgcagcgttgtgtgagagcatgaggctctaccctccggtgtcgatggactcgaaggaagcagtggacgacgacgttttgccggatgggacggtggtgaagaaagggacgttggtgacgtatcacgtgtatgcgatggggaggatggagagtatttggggcgaggattgggcggagtttaagccagaaagatggttggagaaggttgaaacgggaaagtggaagtttgtgggaagggattcgttcacttatccggtgtttcaggctggtcccaggatttgtttggggaaggaaatggcatttatgcagatgaagaggttggtggctgggattctgaggcgcttcacggtggttccggcaatggctaaaggggtggagcctcactactttgccttcttgacctcccagatggaaggtggattccccgtcaagatcatcgacagggaagcttcatgttga

SEQ ID NO: 28421 - DNA, 1662 bp, Glycine max
  Peptide Sequence Number=SeqID_145199
atgaagagggtcaatagaagaagctgcacaaccacatcaatctccttccctcatcttccccacacgagcccttactcctccccggtccttctagtaaagaagaaggatgacacctggcggatgtacgttgactatcgcgcgctcaatccagttaccatacgtgatcgctttccgatacccactattgatgagtttctggatgaactaggtcaggcatcatggttctctaaactcgacctttggcaaggcttccatcaaatccttatgcatgagcctgatatcgagaaaacagcatttagaatgcatcatgggcattatgagtatcgcattatgccattcggcttgagcaatgctccttccacatttcaagctgccatgaacaacctactcacaccattcttaggggtcgaaccagaaccatctaagattcaggctatgttacagtggcctactccaacctcagtcaaggaacttaggggttttctaggacttactggattctaccgcaagttcatcaaagactatgcctccatagccacgcctcttactacactactgtgtaaggacgcctttgagtggactgaagcttctcaggctgctttcgataaactgaagttggcaatgactcgtgcccccattttggctctccctaacttttctaaaccatttgttgttgaaatagacgcatcgcaaaccaccatgggagctgtgttggtgcagaaaggtcatccagtggcattcttcagcaaggtcttcgggcctcgaatgactcatgcttcaacatacatcagagaacgccataccattgtgatggcagtacgaaaatggcgccaatatctcttaagacgatcattcaccatactggatcacaagagcctccaagaactcatgacgcaagtaattcagacccccgagcaacactactacctctctaagctactgggtttcgattacaccattcgttacaaagcaggcgcgtctaatgtcgtcgcagacgccttatctcgagcacccccttcccccagccagctgctcttgctttcggggcgcatctggataacaagaactaacccctacatccctaccatcttgctcgaatatcacgctactccattaggaggccacatgggcgttgccaagaccactcatcgacttgagtccagtttcttttggcagggcctcaaggatgatgttaaacgcttcgtccgagaatgcaaggatatatccatggactttatcacccatttaccagcctctcacggtttcaccgtcatcctcgtgattgtggatcgctattccaagggggtacacttaggagcactacccacgcatttctcggcattcaaagtcgcaactctcttcctggacttgaccgacggtcaaaaggaggtaatgaaccgcattctagagcagtatctatgctttttcgttcattctcagctggcgaattggttccgctacctagccctagcaaaatggtcctacaacacgtctctctacactagctccgggttcaccccttttgaagtcctttacagtaaaccactgccgacattacctcactacattctcgggacgaccaacaatgaagcagttgaaactctggttaccggccgtcaggagatccacaccaagcttcagcaacgattgctgaaggcatag

SEQ ID NO: 28422 - DNA, 1005 bp, Glycine max
  Peptide Sequence Number=SeqID_145200
atgtcaaaaattattaaagagatgttacccccggatgtacgtgttgcaagagatgcccaagatctattgattgagtgttgtgtagcagagctgtctatagtggtgctacactgttgtgttgcggctgtgggcccctccattgaagcccatccattgcctggggtgctgtggattgcagccacattcacggctatttgctttgtgcagttaatacacaagcttactggtgttgccattgctttgaaaacaaccagtgtttggcagaaccatccaggatttgatcacaacatagagggttggacggtatttggaaaaggagcaatcaaggagcgaatatcgaatgcaagcagtagattcattgttgctcacaacagaacacatccattggatagtttctctcagaaggtccaacttaagaaaggaatgctatacaccttttctagtaacttcactttctctattgttgagttatatgacatctctttcactagcattcatttcatgaatgttagtgaaggaagtgacattgtgtcagttatgtttaaaacaaaaggaagcaaaatggtacgaggtggccaagtgatagcaaagcatggacgcacggacatggataatcagaaattaccctgcagagcttgtgatagtgctcactcgcggtacattagttgctatgctatctatcccaccttgactgatttcggcaatttttgggtatcccttcgaagtattgttcatatatgggtcatgagcaagaagggccctctctatgttgcaatgtttaagccaattggaatcatctttgcggtcatcatgggaattgcctttcttggtgactctatctatcttggaagtgtgcttggagcagccatagcggttattggtttttatgctgttatttgggggaaaagccaagagcaagcaaaggaagagtgtgaagtctatgatgactcggaatcatactcgcccgttgtccctcttttggagaacaagagaatggaggaatag

SEQ ID NO: 28423 - DNA, 231 bp, Glycine max
  Peptide Sequence Number=SeqID_145201
atggggagagatctggatgagcatggagctgctttcctgaaacatggtgaaacctctcagtcattgtctctttccgatatattcacactgaaggatggatcttttaggctgtgcttcatggaattgtttgggcagcaactgatgactattttccatgtgcagccagcaaatcctcctgtgcgggctaatgtattgtatttgagcactgaattctctgtacctatcgcgtaa

SEQ ID NO: 28424 - DNA, 147 bp, Glycine max
  Peptide Sequence Number=SeqID_145202
atgacagtacctaaaaagactaaccacactcctcccatttcaaaggcgcataaaactaacaactgcaacaacatgcctagtgcagttacaggcaccgaaggtgcaacaatgatagaaaaaatcgaaaataaaaacttgatgagataa

SEQ ID NO: 28425 - DNA, 231 bp, Glycine max
  Peptide Sequence Number=SeqID_145203
atggcattcttgggagagacaagcagtcagacagttgagaactccacattaggttttatttttccaaatggatccattgttcacaatgacagtggtgtttcctttcaagcttccactccagttcccattcgagtacctaacgggtgtgattttcaaacgttaaaaaccagaatacacaatacccttaagctaaccgacaagcaatttttggataaaatttactactggtag

SEQ ID NO: 28426 - DNA, 147 bp, Glycine max
  Peptide Sequence Number=SeqID_145204
atgtcttcagtcatttatactttcaaaaggcgacaatgccttcatttacatttcgaagacaacaatgtcttcagtcatttcatgctttcaaaaggttttactgcttggacttccggtaatggccagttggacggtgagatcccttga

SEQ ID NO: 28427 - DNA, 264 bp, Glycine max
  Peptide Sequence Number=SeqID_145205
atgagtgaaatagaggaggtgcaagagcagatgaaggctgacatggagcccatgaaaaagcaaatgaccacaatgatggaagccatgatgagtatgagaaggatgatggaggtcaatgtggctacagttgttgctgtaagtaccgccatagaattggatccgactcacccacctggtttcaatcaagtaaatcatccagcctcggatatggtaggtcagggaggcaaagcgttgggaagtatgggtggcccccattttgtacag

SEQ ID NO: 28428 - DNA, 417 bp, Glycine max
  Peptide Sequence Number=SeqID_145206
atgggctttaaactcaaacgtcatgtcggcaagctaagcgtagctatgcaccaagctaagtgcaccctgtgcgctaagcctgagtgtcactctgttgaagctgagctaagcgcagcttcctgcgctaagcccgtgttatgtcttagtgaggctgatctaagtgcacctgctgtgctaagctcaagtccacttctatggcatcaaagaagagaaaggaacctaccacaccttcctaagtccgatatgaccgatccaggttcacttctcctgaggccttggaaaggtacactgatattgtggtacccagaaagatactccttgagcgaaatatgttttgatgaaggcaacattgatgttgccattgtgaaagagttttatgctaacctctatgatcctgaggataaatcacctaagtag

SEQ ID NO: 28429 - DNA, 552 bp, Glycine max
  Peptide Sequence Number=SeqID_145207
atggctatctggtttaaagaggccttcaccaagtttgagcttcgacacattgtaagagaaaataatgagagagtcaacttactatcgaaactcgccagtacaaagaagaaatgtcaatatagaataattattcaggaaacaatcgtggaaccaagcctggacaaggcaataatgagtagacatcagggacaaagtccatgcagcgcttgcgctcctcctcctaaagcttgtgggagacataaggcccttctggatctgcgtcgagaactcgatgattatgttccgcatccatcaaccacctccatatttgacctcctagggactccttcaactaacaccatcatgggcaacaaccattgtcgtcatcactccatgccacattggacctcatgcctttgtacaaacattaactccctaaaagcactctacacctccttcctcatccatgacccccctactacaacatcctcttcttcgtcattttcaaatcctacaccaaattgtgctaaaggaagtagccgacgatgggagagatgtgctagatccaaatga

SEQ ID NO: 28430 - DNA, 678 bp, Glycine max
  Peptide Sequence Number=SeqID_145208
atggcattgaaattgggtccattctcggacaccctacctgcaacattacacgagttgagagtaagggttgccaaattcattcaaatggaagaaatgactaggttcaaagagaaaacccatcacgtgaaaaggtgtgagatagaatctgagaacacaataggtcttgtgaggcaacgaaaacatagcgtcagggcgagaatcccccacctgaaaactcagcttttaggtgtaatcaacccaatagttggaggattcgcagggagaggaagttcaaacttagcacgcaagtgctatgttcgcaaccttaagtctgttaacttggtcctagtcgaaaagaggcccataaggatactaccccccatcactttcatggatgaggatttcgaggggatcaacagaagtcacaatgatcccatggtggtcaagatagaggtcgctaacttcttagtatgcaaagttctacttgataataggagctcgatcgatgtcctatattggttggcctttaaacaactaggcttaccaaaaagccaaattgagccattctcgaagaaattcatagcgacgaagttcccaagtgaggatggaaaaattatcactgacagagctgatcagatgatcgcaagggaatgttatgttgcaagcctcatgattgctaaagggaagaaaatggcataa

SEQ ID NO: 28431 - DNA, 216 bp, Glycine max
  Peptide Sequence Number=SeqID_145209
atgacaagcagagaccaagtttggtcattctgcacccttgtatcatccagaggcggcgggcccgatgatacgcggagataccttacggttatccgcacccttgtgtcatccagaggtggcgggctcgatgatacgcggagatacccaagtggttatccgtataaacattcttttgctatctgtaagacagaacgcttgatagcatgcagaggctga

SEQ ID NO: 28432 - DNA, 647 bp, Glycine max
  Peptide Sequence Number=SeqID_145210
tggaattggagaggcataatccacacaaacgcctcttcaatctccaagatggaagcatagatgtagctgtgataaaggagttttatgctaatttatacaccatagaggagcaagcacccaagcaaggggaatctttacccacctactctagattttgtaggttgaggactaatcctcaggagattgaacctaggctctgtattccccacaaggggtttattttgaatgctgagggccaatcatggaagcttctcagaaaagatctgacgacacttggccaaagtgtcttctcttactccaacctagctcccacatcccacacctcagatctgaatatggatagagctaggttggtctatggcttggtgactaacatggacatgaacatcggagcccttatctcaggtcagatttcttctattgctcagagtaactcctttaggctcaaatttccagccttgatcactgccctatggaaagcaagaggagttgcctctgacagtctgacttatgagagcctgagcctggccattaacttggcctacattaagaaaaactattggaatatggatgatctaacagttaacttcagaggggcgaggaaggcaaggacagataaagaacgtcttggtcttcctacaggatga

SEQ ID NO: 28433 - DNA, 645 bp, Glycine max
  Peptide Sequence Number=SeqID_145211
atggattctttgaagatgttcaaaggttatggcaaagtagaacacgagcaacaccaccttgaagatcattgtaaccccaaacccaaacctaaattctcaaaacccttcatcgccacaatttccatcttcgcaatactcttcctcactctcaccttcgcctttgccctagcatccatcctccaccacaccaagtcacaacaacaacttctgatcaacttggtcgagtcgatccgattcgtttgcaatgtcacgcgcttccccagtgcgtgcctccctgccatcccaccctctgccaacatcgctaacccgctccagagcctcaattccatgctcgaaacaaagaattcacgtgcgctcgccaactgtaggattcatctagacgacgtgctaggtcgacttagcgactcgctgttggcctgggcggcactcacggaggtgacaatctccgacgtccagacctgggcgagcatggcgatgacggaccaggagacgtgccttgacgggctggaagaggtgggtgatgtggcaacgatggaagagatgaagaaaataatgaagagggcgaatgagtacactagtaacagtttggctattgtcgctaatattcacaacttgttacaacgattctacatggcactccactga

SEQ ID NO: 28434 - DNA, 480 bp, Glycine max
  Peptide Sequence Number=SeqID_145212
atgtttttgtcaagaacacttggacgaacactatttgctgcagctgccagatcaaaacaatatgccactacagcagctgctgctgctggcagagaaggacacaacccccttcaggagttctttgaggcagacaggagccctgatgatgacaaacctgttgtttatggtcggagttggaaggcgtctgaactgcgtctgaagtcttgggacgaccttcataagttgtggtatgtgttgttaaaggaaaagaacatgttgatgactcaacgtcaaatgcttaatgcacagaacctgcgttttcctaacccggagcgcatccctaaggtgaggaagtcaatgtgtcgcatcaagcatgtacttactgagagagcaattgaagaaccagatcccaggaggacatctacatttgcggatgtaaggttcgctaacttgaagcattgtccaaaaatattgtttatgaaggagtttacccgtgaatga

SEQ ID NO: 28435 - DNA, 279 bp, Glycine max
  Peptide Sequence Number=SeqID_145213
atgttgttttccaaaaccaacaacagcaagaagcagcaacagcttccgaagacatcgaagatgagtcctacgacaaaacggcgccactggaatggagtacctcttcatcgcgtgacttggctcggagctaacaacggtcgcgacatctacgttgtggatgccgatggccgcatcgtgctccttttcggtgtaggattcaaaggagtgattagggttttggaagggacgctatttgagtacgcagagccttttaagattgttttcgaaaaaccgtcgtag

SEQ ID NO: 28436 - DNA, 552 bp, Glycine max
  Peptide Sequence Number=SeqID_145214
atggggtgttacactaaggagggagtcacatcgggggtggaggatcaaactctttgtattcttattatccctctcactctctgtactcaaggccacaaacttcctcgtcacccactcgcttgctccgctgtctttccatcgcacaaggagcacgatgcggccatcggcatccacaacgtagatgtcgcgaccgttgttagctccgagccaagctctgctttggatgatgcgtttgactttgtcgtaggactcatcttcgatgtcttcggaagctgttgctgcttcttgctgttgttggttttggaaaacaacattgatggcacggaagcgcgtgggtttatggcgaatgactttggcacatgcgatgccaaatttgccatcattgacaaagatgagacaattcaagctgaggctaagagagagtaccctttctacttggttgaggtttttgtttctcttgtcttagaaagagtggagaatcatgattggattggctatgatcctgaggtgggcttatatctttcatggctagtctctcaactcatatcctga

SEQ ID NO: 28437 - DNA, 255 bp, Glycine max
  Peptide Sequence Number=SeqID_145215
atgagatgggactatgttgccataacagtggtagcggtcaccaaaattgcgaagagagaggggaagagtgagaaagagaagggggagaaagagagcatgagaaaaggtgaggattttgatgatgtcaaagtagaatcaaacaacaaggttgtttcaacaaacattcaaaggttaagcattgcttcaagaataattcaaggtcaaagcaaacaagatcaagaaaaagataaggcctcaaacaatctcattggttga

SEQ ID NO: 28438 - DNA, 171 bp, Glycine max
  Peptide Sequence Number=SeqID_145216
atggcctttgccccattaggaaactctacaaggttagcaggtggtgtctcgctaagcgaggcttgtgcgcttagcgagagtcatgcgctaagcgagacactcagctcgcttagagaattgggagaatctggaggagaatctgagaagcatctgcactcagcgcgtcattag

SEQ ID NO: 28439 - DNA, 409 bp, Glycine max
  Peptide Sequence Number=SeqID_145217
tacttggttgcgtctgaccctggcctcagagatttcatttggggtagccggacaggtacctccaggtcgaaggcttcctcaagaatcgtggtacgattggccgtcaagggtcttggtgtttgctttgcacctttcacacttttgtttgacttggtagacttcattccagaatttggacatttcttctatctggatgtaacccttggctcgttcgtgcggctcatccatgctaccagccaaggtcatgcaatgagacctactggtggcgtactgcacactgaatcgttcgatgagggtgtcgaagctatctatggatcttggtttgtctatgttaggaaggcgtccaaatgctcgtctggatctgttgtctcatcataccgctcgaggttaagtgatttccaccccaagg

SEQ ID NO: 28440 - DNA, 144 bp, Glycine max
  Peptide Sequence Number=SeqID_145218
atggtttctagggcttccgtggcttccgtggcttccgtaaaatttccgaaaatcttggctattttgggtaaaaaagcacgtttacgtgaagaagaatcaagtcgaagtgcttctgtaacgcttctgagacgtttccgtgagtaa

SEQ ID NO: 28441 - DNA, 243 bp, Glycine max
  Peptide Sequence Number=SeqID_145219
atggcaaatgaagaattgaagttgcaggatccacgatgtcggatacaatgtcctgacatcctgcccgagaatactggagttgctgtacaatgcaagataaaaatttttcagaagaagatagatctcctccagcatcaagccgttgcagcccagaaacgcaaattgctatataatcatggaggctgcacgagttctgtaccaagtccgggattgaagagttattttgtgagttttgggacttga

SEQ ID NO: 28442 - DNA, 228 bp, Glycine max
  Peptide Sequence Number=SeqID_145220
atggaaagatcagagaggaaaaccttcaatgataagaaagcaaataaagcttatgtcacttgggaagataacaatatggattcatccgaagaagagaaaggacatggtgcatctacatgctattttaggaaaaatagtaataatattaaattgatatgggctccaaaaggatcttttatcaaagctgacattcaaggacccgagaaagtttgggtacctaagtcataa

SEQ ID NO: 28443 - DNA, 692 bp, Glycine max
  Peptide Sequence Number=SeqID_145221
ccgcttccaatacagctagggaagcggaaccggtgctacagcccgcaataaacttgggccgagacagaaacgcgacgggttttaatcggaggtatagtcctcaagcctacccttatggtttgcctccatacttcactccccgtaccgctccagacgatttgagccaagcctctaccttcgaggggcagctccctcctcatgccgactatcctatgcaagaagatgatgaaggagatgcccatttaggccctctacttcccctcaaggaaccagccccccatgagttgccccaaccaaacatagtccgccacgtcccgtctccatccgcacccgttaaggaactcgttccctttgcaaaagacaagggaaagattgatctacttgaagagaggctgagagcggtagaaggcctcgacaactatccgttctcagatttagtggatctgtgtctggtacctgacatcatcattccccccaagtttaaagtaccagatttgataaatataaagggacgacgtgaccaaaaagtcatcttcgatgtactgtcgaaggatgggggcatattctacggacgaaaagctgttaatgcacttctttcaagacaacttagtcggagcggcagtggcgtggtacaccaatctggaagcttctcagatccggtcatggaaagacttggcaactgccttcattag

SEQ ID NO: 28444 - DNA, 516 bp, Glycine max
  Peptide Sequence Number=SeqID_145222
atggagcttgtgaaggtagttatgagaaaaactaataacagaaagattcctattatctctactgaatctggaaattcaagaacttcgggatctcgctttgatgttatttctgataatgggaaacaagtttttgaatccacaaattatgttgacattgaagcaacatttaattcaaagtgtagggtccatggaggggataattcaggagtctttggctgcatcaggaagcaaaaagaatatggccctacattagcatctcgaattgtgcaagctaatttcaaaggagataatgagaaacaggtcaaggtttggaatgtatatggcaggaagaatccacaaaaaggaaaaggaaaagaacttaataaagaagggaaggcaaattttaaaaagaataatactcctaaaataaaatataaggagcaggtcggtgttgtgataaaagtcacagtgagtgcgaaagaagtaccagttgaggaaaagaagaaacgaaactatgacgaaacctttaacttctaa

SEQ ID NO: 28445 - DNA, 449 bp, Glycine max
  Peptide Sequence Number=SeqID_145223
atgggtaatcagtgtactgatgaccttggaaaataccttagggtacctatttttcataaaaaggtatcacgaggaacattccaacttatcatggacgaagtccatcaacggttaagtacgtggaaagctagaactcttttctttgctggtagggtgacccttgcgaaatctgttttgcaagctttaccttttcatgtgatgcaaataactttgcttccaaaaatggtgtgtgatgatattgacaaggcttgtcgcagatttattttgggagatatagataatggcaagaagattcacctagttgcatgggatactgttttctcccctaaggataaaggcagtttatgtctgaggaaggcacgggatgtcaatatggcttttatgtttcgagctaattggagattctgtaatagagatccccctcctttgtcagctattatccaggagaa

SEQ ID NO: 28446 - DNA, 177 bp, Glycine max
  Peptide Sequence Number=SeqID_145224
atgaaaggcctttttgttacaaaacttgaaagcaatgaagtgcttcttagtccaatagctcttaaggtggttggcccctttcttcttgactcaaattcttcaagggatggcaccaatcctccttccaattccctatatggcaacccacaaacaaggaaacaaagagacaagcaataa

SEQ ID NO: 28447 - DNA, 555 bp, Glycine max
  Peptide Sequence Number=SeqID_145225
atggcactgttggagaagagcattgtgccctatggatcgaccttggttacacgtgagcgccaaccagctgcttttgcattagggacagtggctgacccaaaggaccctcaccgatacagaccttgggatcctggaggacctcgacagactcaaaacaccttgaggacaaggttcctagccctcgaagctaggttgttcccgttcccgtgcttggttcgtaacacaatttctagagaggcatgtgtgccagttgggaggtgttctgcagaaatacgggatgtcccggaagatgtgttgaatgcctcggttgagtgtatgaaccctccaagaacagaagctggtttggatacaatagcttggaaaggaactgctgatggttcctttactttgaagtcagcttatggtgttgtttgtgatctgcaagtgacttctgatattaacttatttaagctgagaatgagaattggcatgagtgtgaatgatgcgtgttctgcatgtcaagctgaagctgaggctctcttgcatcttttccgggactgtaatgattgtaagcag

SEQ ID NO: 28448 - DNA, 525 bp, Glycine max
  Peptide Sequence Number=SeqID_145226
atggtgaaggaaaggaaattaataaatgcactttggcagaatctgtatgaattgggggcacgaagggttctagtgacaggcacgggaccactgggttgcgtgccagcagaattggctatgcacagccaaaacggagaatgtgcgactgagctgcaacgagccgttaacctgttcaatcctcaactcgtccaactactgcacgaacttaacactcaaattggctccgatgtcttcatttccgcaaacgccttcaccatgcatttggatttcgttagtaacccacaagcctatgggtttgtcacgtcaaaagtagcatgctgtggtcaaggagcatacaatggaatcggactctgcactccagcttcaaacttgtgcccaaacagggatttatatgcattttgggaccccttccatccatcagagagagcaaatagattgatcgtggataaattcatgactggatccaccgaatacatgcaccctatgaaccttagtacaattattgctttagattctacaacctaa

SEQ ID NO: 28449 - DNA, 429 bp, Glycine max
  Peptide Sequence Number=SeqID_145227
atgcatataaaccgtgtcatgtatgtaggtgagaaaattggctcagaacccacattaccatatttgagtccacagctcaatggtgaaaggctgcttgttggtgcaaactttgcttctgctgggataggaattctcaacgacactggaattcagtttataaacataatccgaattacagaacaattggcatacttcaaacagtatcagcagagggtgagtgcactaattggagaagagcagactcgaaatttagtgaacaaagcattggtgctcataaccttaggtggcaatgattttgtcaacaactattatttggttcctttctctgccagatcccgcgaatatgctcttccagactacgttgtcttcctcatttcggagtatcgtaaaattcttgcggtcatgatcgatacatatcgatacttttga

SEQ ID NO: 28450 - DNA, 420 bp, Glycine max
  Peptide Sequence Number=SeqID_145228
atggctactccacttgcctcgcctcctcctcctcctcctcctcctccttttccttctcctcctgcagtagcattattaccagtggtcaacgccgatcctacgaccggcaaggccgacggtcccttcaagaagaaattaagaacatatttaggggttgtcacatacgagacctggatggaagtccctgctactcaaaaggatttgatttgggaggatattcagtttaaatcggacttgactaggaaatgggcccttgcagttgaccaggacggtgtggacgacactgatgtgcaaaaaaaggcacaggccatccagaagcaaaagactgtcccccacgagttgtctcatgggggttatgaatatttagaacaaaagctaatggctaagaagaccaaaaagaaactggaggaagctgcttag

SEQ ID NO: 28451 - DNA, 448 bp, Glycine max
  Peptide Sequence Number=SeqID_145229
atggcctgcaccaagaaaactaggcagatgacgtctgaggcagcaaagaaaatcgctgagaagatcgattctttggaggagcaggcatcacaaggatcgttcgtccctcatggacagcaccctggccgtgtccatgctgctggagctagtgtcaccatcaagcaatattttggattggatccacgaatgtcccgcagctcttcctccttgcctcttgaagacctacagcagctgacccaacaaatcaaggaccagctagaggagtcgatcacacaaaaagtgactcgacagctgatggcatcttttagccagatgcagtcccagtttcaatcccagatgcaatctcagggagttgcactacctccagagcctatggttggtccctcaggtcctcgtgtcagcacaaaggagagttgtgttgatccctcagggaacgatcctgagacag

SEQ ID NO: 28452 - DNA, 156 bp, Glycine max
  Peptide Sequence Number=SeqID_145230
atggtggcagctgaggtggaccacggagtggggtcactgtcaggtatcatttatcaatcgtcaacggctaaccgtcaaaaatcaacgatcacccgtcatcaattgtcagttgttatatcaggcataagttctcaactattggatattagatgttag

SEQ ID NO: 28453 - DNA, 303 bp, Glycine max
  misc_feature (210)..(210): n is a, c, g, or t
  Peptide Sequence Number=SeqID_145231
atggtggtaggaaataaaaccatagaaaaacctagggaacaatggagtgaggaggaaaagaagttagttcaatacaatttaaaagcaaaaaatataattacatttgtattaggaatggatgaatactttagggtgtcaaattgcaaaaatgcaaaagatatgtgggataccttacaagaacatgaaatggaattgatgagattgaatcancatgaggagaatgataagacaaagaaaggaattgcttttaaagcttcatcttcaacccaagaagaagtgataaagaagattcaattgaaatag

SEQ ID NO: 28454 - DNA, 219 bp, Glycine max
  Peptide Sequence Number=SeqID_145232
atggagttagagcaacttgatgtcaaaacaacctttctctatggaaatttggaggcagatattctggtgcaacaacttaaaggttttgagatgcaagggaagaaaagttatgtctctaggttgaaaaggtcttcctatgggtcgaaggaaactccaaggcagtggtattttcatgtatgcaatgatgtgcaccagaccgaacctagcataagcaattag

SEQ ID NO: 28455 - DNA, 378 bp, Glycine max
  Peptide Sequence Number=SeqID_145233
atgaaggtagctcacctaggcgagttgttacttcattctgaagcaaccttgctcacccagggaagtaaaaataaagacactaatttcgttcgagcgatcttgctattcatcgggcaactggcgaaaaccaaggaagtgaaattgaggaaacatgaggacattgaagttcttcttttttcttttgtagaagcaaagcttcatggtgaatcaaaggtgattcaaaggtgttttgatgataacaatgatgatgacaaaagtgatgacaaaaagctcaaagatcaatcaaagaacaactcaagtgaatctcaagaatcaagatcaagattcaagactcaagattcaagaataaagagaagactcaatcaagataagtattaa

SEQ ID NO: 28456 - DNA, 734 bp, Glycine max
  Peptide Sequence Number=SeqID_145234
ggtgctggcaagcgtcgtatattcgcaataggaaactatgtgagaggttgctgaaacccatccaccattggtttgcggaggtcctccgccgcatcccaatggatgatcaaacagcacctctcattcgtttagttcctagtaaaacatgtttaagctatgacctcaagagtgctaccgattggtggcctcttgtgtttctgtttgaaaggcttgcgctattgtttgacaggtcatttgcttcaagtgttgtgaatacaacattagggacgaatgtatttgaggtacccttcgttaagagggctctatctcaagtgtcctttgtgaccggtcaaccgttaggctattatggttattggcctttgttcgcgttcacccatcatgttttggtgtggtgggctgcggaacaggttagacctgggatcctgttcgacaggtatgctatattaggtgatgatgttctcatcaccgatccacttgtggcggaacagtaccggctaggcttacaacggcttggtgttaagatatccacacacaagtctttgatatcctcaactggtgctgtagagtttgccaaacaatttctggtcaaggatatgagggttaacctctctcctgtgcttgacggagttcagtctgtctggagggaatcatttcttctcaatgccatgatactttctgttttgtcgagccctgctttggtctctggtttgatggttgcacgtgctaaaaatccg

SEQ ID NO: 28457 - DNA, 1440 bp, Glycine max
  Peptide Sequence Number=SeqID_145235
atggctgggagacctaacaacactactgctcaacttctagcccgtatgactcaagtgctagagaccttagtgcaagatcgtgatgctaaactagttgagtatagggggttgtttgctttcactaagcacaattcacctaagtttgaaggaaacattttaccaagtaatgagagagtcatagcttgggacatgttcaaggagagtttcatagggaactacttcttgagggacttgcttaaccaggagccatattatagaaatggtgagaacggagaggacatttgtgcccaattcgagaatgggttaagggctaacatctgcattgtgggaagcaagcatatcctacatttagagggtcatagaggagtgacaagaagcaccatatgcatcacaagaatccattcagcaaccaaaccaagctcagggaggtggcatagggattgttggtctacaccgaagagaaacgacaacaatggaagcggagccaaggttgactacaagaacaacaacaaggtgaagccgaaggtgacaggaagggtgtttgcaatgaacgggtctaaggtggcaacatctaatgatttcattcaagattttcctgtctcttctttgcattatgaagtagtagtgtctactcttaccgacaaactgattactacttctagtgcatgcttagattgttctatgatggatgtgtctgagttaccacttgagagggaacttgaattcgccatagacctagtgctcgggtctagtcctatattgatagcaccataccggatgtctttgatggagttagccgaagtgaatcagcaagtcaggaagaaagacattccaaaggtagcattcagaatgcgttatgaacactatgagtacttagttatgccatttggtgtgactaatgcacctattgtattcatggactacatgaatcaaatttttatcaatacctggacaaagttgaagaagaggttgatgtctgctcctatcttgattttgcttgaccccgagaagaattttgaagtgtactgtgatgcattagaacaaggacttggttgcattgtgaggcaggaaaagaaagtgattgcatatgcttcaagacaactgagaccgcacaaagggatatatcttactcacgacttacagttagcggcagtggttttcgtgctaaagatttggaggcattatctctacagggaaagatttgaagttctcaatgaccgcaagagtttgaagtacttgtttgacttgaaagagctaaacatgaggcagaagaggtggatgaagtttttgaaagattatgacttcgagttatcataccatcatggcaaggcgaatgttgtagtggatgctttgagcaagaagttgttgcatatgtccattatgatggtgaaagaattgcaattgatcgaggagtttagagatgtgaacttttcagtggaa

SEQ ID NO: 28458 - DNA, 156 bp, Glycine max
  Peptide Sequence Number=SeqID_145236
atggctgttattctatatgttttctgctctgtctatttgacatcctttactaatgtgaatttttcctttttgtattcagatcacatgctacctgaagttgaggtgaagaactttagaatggatgcacaggctatacttaacacacgacagatttga

SEQ ID NO: 28459 - DNA, 258 bp, Glycine max
  Peptide Sequence Number=SeqID_145237
atggtggcggtggtggactcgtcatatgggtggaatctcaacttgctactcacctcgattagtgaacttagttacgtacttggggtggaggacaaggctgtgatgctcgagaagtgtggggcccctattaggtacaaccccgatgctatagggagctctgatgtcatgctcatcggaggaaatttcaaggattacatggcagaggcaatcttgcgactaaaaagagattatgaaatgactgtgagatctgacgattga

SEQ ID NO: 28460 - DNA, 336 bp, Glycine max
  Peptide Sequence Number=SeqID_145238
atggtgcatgtgttagggaggaagtcatcaccagaaatgcctagaagaattcaaagttctgttggttgtctaggatccttctttgaaggtttatgcaagtttgctcactacagcaagtttgaagagtgtggcagattaagaaatagagatttgcttagttctgccaatgtaatgtgtgttttaagttttgaccgtgatgaggatcacattgcagcaggaggagtttcaaagaaaatcaagatttttgacctcaatgctatttcaagtgattctgttgacatccagtacccagtagttgagatgtcaaataaatcaaagcttagttgtgtcaaataa

SEQ ID NO: 28461 - DNA, 708 bp, Glycine max
  Peptide Sequence Number=SeqID_145239
atggacaatgctttcttgatggatttgtcttctttggagcagacattctgggatataatcaaacatgatgtgtttgcttccactttcaattctttaggcaaggggatactgacaatagaaacctggtttttgtggcctggaagaaaatttgcgctcctctatgggaaggagatcaaaacatccactaaccattgggctttgttggccagagctaggattttcaagggcgattttgtggcacacaactatgtcaagtcctctttatgtcactatttcgctgcgccattttctacttcttcttcgtcttcaccttcctcattcttgttcttcgcgtttgtgctgcttcttcctgtgttcctgcttcttattcctcttgacattcctgcttcttcttctttgtttgtggaccctgctccttcgttggttcttcatttgcattctccttcgaggcctatcacatttgcccataggcaacgacaacagatgcgtgttgttgagtatcctccaacggccgcggaggaattgaacgaagagcagccacaaccacctgttgaagaaggtgttactaatgaacgtcctgagctaaagctatcttcccatggaaggaagatggctaagttcggaaggcctgcttcagagattgaaggccttgtagctgccaacagactaagtccttcgattacatgttccctagatacgggcaattga

SEQ ID NO: 28462 - DNA, 1053 bp, Glycine max
  Peptide Sequence Number=SeqID_145240
atggtggtgcgcgacattttgatagtggaggttggatcgccgacatttgggctgatgattgtggaggatagggcggtgcaatcggtttggattatggtttggtgtttggaggagaaaaaggtgggggaagggtgggtccagagtatcggagacgaggctgctaacgaagttgttgttgacattagaccaagaaccgaattccccccaagccagagtagaaagaagtctgcctcccttcttttcatgagcaccaagaacaaaattgaagtcaccaaggtaccactagggaccctggaagcgattctagagtgtgtgctagaaattaaaaagatcattgacaccattgccgaagaaggggtctctgacctcactcgcatccctcttcccagtagaggaggtgcagaaggtgaccaagttccgtttgggaaagcagcgttcttcccaagttgtttgattcacaccaatgagttcctggttcttttaggagaaggatattatgatgagagaacttcgaagcaaaccgttgagattttacagcgaagagggaagtccttggattcgcgggttgattctcttgaggtcaatatcaaggaccttgaagcagaggcttcatttctcaatgccacggcttcatttttggttgctaggattatggtaggactaccatctttggagaacagggaaaagattttgaggaatcttttggcaaaagaaaaggtggacaacgaagttgagtttaaggaacttgcaactatgacagaaggatatactggaagtgatctaaagccacatagcagaacaattcaaaggtggctggtgttgattgattatttgcagtcatgggagttccacgtcaaccaagcctataatcagtatactcctcaacgtcttagaatgtctactttcaaagacgttgttgaggtaagcaccctcttagaatgcgtactttcaaagacggtgcttacctcagcaacgtctttgaaagtaggcattcaaagacggtgcttacctcaacaacgtcttagaatgcctactttcaaagacgttgctaag

SEQ ID NO: 28463 - DNA, 267 bp, Glycine max
  Peptide Sequence Number=SeqID_145241
atgggtctccactctccacagtttggctcttttgatacacatcatatcctcggtaatcttaatcgtgagtgtgtcccccttgaaggattgggagttgactcaatgggatgtcgaaggaagtgctcaaagcaagagaaaacgacttataccgcggcttcacttttgatgggcaaagatcagcgaaagtggaagaagcaagaaagggccaagggcatgctgttgcggcctcctccatcgtggacgtgcgggagcaacgatagtagttag

SEQ ID NO: 28464 - DNA, 393 bp, Glycine max
  Peptide Sequence Number=SeqID_145242
atgaggctattacttcaccttcctctagtgaaagtgacaaggccaaaaggggaaggatctagcgaagaaatctacccccaagaagaaggacaacctttaatggatttggttcgtaagagcttaaatccttgtgctttgttggtgcctaaaataggtattattaggcatcaaatccctaatataggtgatatgatgaatgtgttgagtggtgcaaccctcttttgtaaactcactcatgtgcccaacatcttcaagattcgggtagatagggacttattaggtgttgaggaaagaatccctgagtttcaagaacctctggatttgaggtcaaatccttttcaggggggaatgatgcaatcctaccccctaagggcattggatagaagactctaa

SEQ ID NO: 28465 - DNA, 522 bp, Glycine max
  Peptide Sequence Number=SeqID_145243
atgagcgaagtagaggaggtgcaagagcagatgaaggctgacatggaggccatgaaagaccaaatggccaccatgatggaggccatgttgagcatgaagaaaataatggaaaacaatgcaactgcagttgccgttaccagtgccgctgttgaggtagacccgactcacccatcgggcctcattcaagtaaatcctctagtctcggatatcgtaggtcagggaggagaagcattgggaagtacaggtggtccccatgttgtgcagagcaataattctttcccatcatacaacttgcctcccaactatgcagcacccaatgttgtaccggtgcttgaggaggacaccgacaactttgcacccatacctattgagggcgaacaacccgaatttgatcatgcacatgtctctctgatggaagcttgcttatgcagcttctatggaggatggatctttgagcttcaatgtggtccttcaatggtgatttttcaccatggagatgcagcggaaggcaaaggagaatag

SEQ ID NO: 28466 - DNA, 1326 bp, Glycine max
  Peptide Sequence Number=SeqID_145244
atgaatgtaagcagaactaaaagacgtaaatttgaaagcattgaggaaactgagggatctacttcagaaggaatcgtcaaacggagtttagaggcatcctcagaggtagatgtatgttgtacacatcccggatcgtttggaaatatgtgtatacgttgtgggcaaaagttggatggggaatctggtgttacatttgggtacatacataagagttgttggtcatgggttcgaatccggaaacagcctctttgcatatgcaagggtaaggctgcgtacaacatccctcccccataccttcgcatagcgaagagcctccgggcaatggggtacgaaggattgagacttcatgatgaggaaatttctagattgcgcaatactgacatgaagagtttgttaggtcgtaaaaagctctacttagttcttgacctagatcacacactgctaaattccactcaccttgctcaattgacttctgaagagttgcatttacttaaccaaacagattctcttacaatgatagatgtctccaaaggcagcctcttcaaattggagcatatgaatatgatgacaaagttgaggccctttgtccgcccatttctaaaagaagcaagtgaaatgtttgagatgtacatatatactatgggtgatcggccttatgcattagagatggctaagctacttgatcctcagggagaatacttcaatgctaaggtcatttctcgagatgatgggactcaaaagcatcaaaagggtcttgatgttgtcttaggacaagaaagtgcagtcataattcttgacgatacagaacacgcatggatgaagcataaagataatctgatactaatggaaagataccatttttttggttcgagttgtcggcagtttggtttcaattgcaaatccctagccgaacttaagagtgatgaagatgaaactgatggagcacttgcaaaaattctcaaagtgctcaagcaagtccattgcatgttctttgataaacaagaagattttgatgatcaagatgtgaggcaggtattgtcatcggttcgaagggaagtcttaagcggatgtgtgatcattttcagtcgtattgttcatggtgcaataccatctctgcggaagatggcagaacagatgggagctacttgtttgactgaaattgacccgtctgttacacacgtagttgctactgatgctggaactgagaagtgccggtgggcagtgaaagaaaagaagtttgtggttcatcccctatggatagaggctgcaaattatttttggcaaaagcagcctgaggagaacttcagtctaaaaaaaaaacagtag

SEQ ID NO: 28467 - DNA, 530 bp, Glycine max
  Peptide Sequence Number=SeqID_145245
ctgacacttggtatggtatcattaaacttcagttcacattagcctgcatcaagatgggaaggcctgatttggcacaaaaagcagtcgattcagcagagaaaaggctttcagcggatagatggcccgaatattacgataccccaaatggaaggtttatcgggaagcaatcgcggatggtgcagacatggaccattgctgaactgtgtctgcatgctaagcaaaagtggcagaaggaagtgttcccgttttgctgcaagcatgaagatttgggaaattacaccgaagcaagacccaacgtttcagatctgaagcttgacgtcatcgctgaggagcacgatgatgttgtttggtggatggaggttgcggatcttttcgagacggttggtgcgcactgcatccaccgtgtcctgctgctagatcagccgctgcagccgatcgactttggagtcgacaacggcgattttgtagtagagggcgcgaatggggaattggtgtggaagttgaattggaaaatggtttcatgtgagtga

SEQ ID NO: 28468 - DNA, 252 bp, Glycine max
  Peptide Sequence Number=SeqID_145246
atggagtactactacccgtcttccacgtgtttgcggtggcaatttctgccggaggttctgcgtttggcagcgccacctgcctcagaaggactgagccaatgcccaattctcatttctctgcattcctcaactcttagcggcacaaggtttccttccttttccttttatagcgccgatttaatcaatctgacggtggatgaaatggacacgtgtatggaccatcctggattgccgactctctcacacgggaac

SEQ ID NO: 28469 - DNA, 528 bp, Glycine max
  Peptide Sequence Number=SeqID_145247
atggggaggctagcgatgatgactacttgcgacagtggcagcatccttccaggaacagtggaggcacaaacacatttatgggaaggggcgagtgagaatgagagtgatggagagtgtgaggatacgtggggtggggtggggtttgcgtttcttctctattctctatcgcttcacaaattcacatggctctggaagcttacgcagcagcaaaccctgacaaaaatccacacagatgtcctcaccaaagctagagattcttgttacaatgctcgtgatgctttctatgcctgcctggagaaggaatctgacaagaagcccacagagattgcatctgtgggtttgctatacccagtagaatgcaaacagtgcaggaatgaatatgtcaaacagtgtcgatcttcttgggtgaaacatttcgataggcaatactgccagaacaagagggttcagagacttttggatgacaaagggtccaggagaggtccgttgacgctcccacagcctttcactttcaaacccattgcttga

SEQ ID NO: 28470 - DNA, 264 bp, Glycine max
  Peptide Sequence Number=SeqID_145248
atgaagctcaaaacgccttttataagctttgagaaaggaaagttcgcaggtcaagtaagtaacgtccctaatcctgggacattagggaaagggacaaaatgggtaatcaaagaaagtgatgacgtggtgaggataggcatgttcgaaagaaggagggtaaaaccgtctgttcgagtattcaaattactggagatatttaaatggatcaggcgacaagttggggccccacgaccctacagccataacaaaagcgcccaattttaa

SEQ ID NO: 28471 - DNA, 615 bp, Glycine max
  Peptide Sequence Number=SeqID_145249
atgagatactatctagtagatggtatttatccagaatggatgacgcttgtgaacaccatcacaaggtcccaaggcgataaaagaaaattatttgctcaacatcaagaagcaacaagaaaggatgtggagtgcacatttggtttaaaggaagtaagctttttggtgagaccttggaagcccctaaatagagttgcttcattggagagctttaatgctcctgtctcttccacaacaggaaccttacaaagtcgggaaaaaaaagcacccaatttgcaccaaaggaaaacacttatcaccttcgatccatttttctcatcttatgagagcattaagtgttggttggaagtcatcaaatcaaacccagatgcatattacactgtagagctgcacaaaaaggaaatgagggatagagacagaaagcaaggaagcaagttaaacaaccctaatcttgttggggtggaggacatcacattgccaaaaatgggaggttatgaggtttcagagttgagacatttggctctcattcatcagaattcagaaaagagatcgatggttaattgtttgcagttgatgatgaagaaaggctcacaagaaattgatgcaacaaaacattga

SEQ ID NO: 28472 - DNA, 1089 bp, Glycine max
  Peptide Sequence Number=SeqID_145250
atgcaaggccctaacactactaactctctcttcaacaacaatactacctgtagtaatcagccgcagatccacttcgacaccacttccaacgacgatttcctcaagcaaatgctttccaacctcccttcttcttcatggaccctcgaccaaaccacacccgataataacgtcgttttcccctacgacgtcgaacacgccaacttggcctccaagtttcgcaaccaccagatcaccaccgacaacgacaaggcctccgctctcatgctccaccaccacctcctcctctcctcctccgccgctgccgccaactcccaactcctccacatgccctttgactcctccgcgccaaacgacgtcgttgacgccccctccttcaaatctctcactcccgtcggggagcctgcttccgttcaagctctctacaacggcttctctggatctcttcaacccaataatcaaactcaccattttcaacaacacccccagccccaggttcaggttcaggggcaaaattttggagcttcggctccgggtaacggggggggttcgggtcagccgaaacaaaaggttaaagcccggagaggacaagccacggacccccacagcatccccgaaaggttacggagggagagaatcgcagagcgaatgaaggccctacaagaactagttcctaatgccaacaagactgacaaggcctccatgctggatgagatcatcgattatgtgaagttcctacagctccaagtcaaggttttaagcatgagcagattgggcggtgcagcagctgtggcaccccttgttgctgagggtggcggtgactgcatccaagccaaacgcagcaactcaaacgacagcctcgccatgacggagcaacaggtggcgaagctgatggaggaagacatgggttccgccatgcagtacttgcagggcaagggtctatgcctgatgcctatttcgctcgccagcgcaatctccaaagccacgtgtcaccccttcatcaacggtgatgggccctcctctccccgaatgtccgcgctcactctggctaacgccgtcgtcaaagacgcggcctccgtttccaagtcctga

SEQ ID NO: 28473 - DNA, 171 bp, Glycine max
  Peptide Sequence Number=SeqID_145251
atggccgcttcctctattcgagtcgtcgtcgtcgtcggtgatgtgcatgattactggaaccctgaacaagattcgaaagcactcgagctcttgcagggggggggggggtgcgggcgggggactgaggctgttagttttcatggggtggtagaaaatcttgccttgttgtga

SEQ ID NO: 28474 - DNA, 318 bp, Glycine max
  Peptide Sequence Number=SeqID_145252
atgtattacgacatacaggctttatataattgtttgaagaatgaatatggagttaagcaagaagaattgattttttatggccgatcgattggaagtggacccacactacacttggcttctaagttgcagaagttgagaggtgttgttcttcacagtgccatcctttcagggataagggtcttgtaccctgtcaagatgacattttggtttgacattttcaaaagggcgagccctggtgcagcggtaaagttgtgccttggtgacttgttggtcatgggttcgaatccggaaacagcctctttgcatatgcaagggtaa

SEQ ID NO: 28475 - DNA, 555 bp, Glycine max
  Peptide Sequence Number=SeqID_145253
atggcgaccaaagcgatggaggtggtgaagggtctggacgtgaaacggtacatgggtcggtggtacgagattgcgtgtttcccgtcgaggtttcagcccagtgacggcgtcaacaccagagccacctacgctctcagagatgacggcaccgtcaacgttctcaatgagacttggagtggcggcaaaagaagcttcattgagggcactgcttataaggccgatcccaacagtgacgaggccaagttgaaggtcaggttctgggtgcctccgttcttacccctttttcccgttactggggattactgggttttgtacattgaccaagattatcagtttgctcttattggccaacctagcaggaactatctttggatattgtccaggaagaaccatatggatgatgaaacctacaatgagcttgttcagagagctaaggatgagggatatgatgtgagcaaactccacaagactccacagagtgattctccaccggaggaagaaggtcctcaggacaccaaaggcgtttggtggatcaagtcccttctggggaaatag

SEQ ID NO: 28476 - DNA, 345 bp, Glycine max
  Peptide Sequence Number=SeqID_145254
atggaggtgagctctgagctcgatgaagaggtcgtgcatctgacccgagtcagcggcattaccgtgagagtacacgaaggtgaacctggcaaaagggtgtttccagaaggtggcgaggatcttgttgccacctttggtgtggagaatgtgagcgtcgacgtttttgtcggcggtgacacccgacactgttgggttacaagtgtgaggcttccttatgtggtggcttgtggtccaaatggtgtaccccttgaatctccccaacaattggtattagagtcgatggttcaagttgcaggggtttgggaattgggagtaagaatccctgaatacttcagctcagcataa

SEQ ID NO: 28477 - DNA, 2265 bp, Glycine max
  Peptide Sequence Number=SeqID_145255
atgttcagaagcttgtttctgattcccttgttgcttcatacaatattggccaaaaaaactgcacttccaaatcttccaacacctcaagtccctccccagcaatggtcaacattaagtggcaatgagcctcttgtaatagcccgtggtggtttttcgggactattcccagaaggctctcctgatgcaattgggctagcacaaggcataagcgttttcttgtgcaatcttcagttgacaaaagatggcggtgccttttgtgtcacggggactacgcttgacaatacaacaattatatctttggtggatcctaaggagaaaacctacaatgttgatgggaaggacgtgcaaggacacttttcttttgattacacaggtcttctgattgagcagaatgtatcaatgactcaggccatatattctcgacccaatttttacgatggtgcttctccggttcttaatcttgatgctctactaagcggaaaatcgcccccaaggacctggttgaatgttcagaatgcagcactatacatcgaaaacggagtacaggtggtagacattgttttagaattattgaaagtttatcaaatagagtttgtttcatcttcagatattggtttcttgaagagtatcagtgggaaatcaaacaaggcaactaaggtcgtctttaaacttcttaacaataataaggttgaaccctcaaccaagaagccatatggaagtattgtgaaggatcttgtcacaatcaagtcgtttgcatcaggaataatggtcccaaaagaatacatatggccagttaaaccagacaaatatctaggacttcccacaacacttgtggctgatgcccataaatcaggactagaagtttatgcttctggttttgctaatgacttctttactagttatagttatgactacgaccctgttgccgagtaccttcaatttgtagacagaggtgattctgttgatggtgttgtcactgatttcccagcaacagcatcaaatgccatcgcttgctttgcacacaacaatactttgcctaaaaaagcaccaactttgatcataagcaacaatggagcaagtggagtttatccaggcagcagtgatcttgcatatcagaaagcaatagatgatggcgctgacattatagattgctcggttcaaatgacaaaagatggaattgccttctgctcagaatccacagacctaacatcagataccactgcaatgcctaaattcatgtctcgatcttccagtgtcccagaaattcaaccaaaaagtggaattttctcctttgatcttacatggaaagagattcagacattaaaacctcaaatggttagtaaaagcagcgatttcctaagaaaccccgcaaacaagaccagcggtaaaattgtcaccctctcggaatttttggagttagccaaggctaaggcagttcctggcattttggtcaacatacaaaatgccccctaccttgcatccaaaaagggtcttgacattgtagatgctgtcagcattgctttgatcaatgccacctttgacaagcaaaccaaacaacaagttctgattcaatcagatgacagctcggtcctatccaggtttaaagacatcccatcttacaaaagggttatgttattgattgataaaatgggcgatgtaccaaaacaatcagcagaagaaataaagaagcatgcggatgcagtgaatcttccaaaaacctcaattctcaaaatatctaatgccatcttagtaggaatgacatctattgttcaagagttgaaagatgcaaacctcacagtattcgtccatagtcttaaaaacgaatacacaaccctggcatttgactattggtctgatcctaatgtcgagattgcaacttacatccaaattgccaaggttgatggaatcgtgaccgattttccagccactgctagtagattcatgaggagtccatgtagcattccaaccaatgatccttctatcttaccagctaagcctggtgatctattgaacactattccaactgaaattcagccaccagcactggctccacttcctcctcttgaggttgcaaacgttgttgacccacctcttcccgctgtgactaaaagttctaaaaattccactgtagctgagcctgctgatgctggtgctacacctgcctcccctcctctcccttcaggtgccagggcaaatgttgctagcagtggcctttctataataactattttggtgtttgctatgctcttcgctgctcatcaatga

SEQ ID NO: 28478 - DNA, 1938 bp, Glycine max
  Peptide Sequence Number=SeqID_145256
atggatggctgcaacgaaatcaaaaaaccgataacgttgccgcgccaccggcgaggatgtttgacggcgacggatccatcggacctcaccaaagtggatgcatgcctcttcttccacaaacaactccgaagaggtcgtgccctcctcgctcgcatccttgtaactggttccatatcctccactcaactcgccaacaccctcattaacctctacgccaaatgcagccacttctcaaaagccaacctcgtattcgacaccatcaacaacaaggacgttgtctcatggagctgtctcatcaacgcattctctcaacaacagagccacactccctctcttcatgtcatgcacctcttctgtcaattgacgatagcccacaaaaatgttgtccccaacacccacacctttgttggtttcttcaccgccatcaccctctttgacgcccaggcccttgccatcaaaatcgcttgctcccacgacgtcttcgctgcgagctctcttctcaacatgtattgcaaaacgggcttcgtctccgaggcgcatgagctgtttgacgaaatgcctgagaggaatgttgtttcttgggctaccatgatttttggatatgcttctcaggagctcactgatgaggctttggagctctttgaactcgtgcaggctcattctcttgccatgaaaaacgggttggtttgctttgtctttgtggcgaatgctcttgtgacaattggggattctgataaggctttgaagctgttttatgatatgcattactctggagagttgccttgtgagtttactcttgttggggtcatcaatgcttgtagtgatacttgtgctattgtggaagggagacaaatgcatgcgtattccttgaagctgggatatgaatcgcagttgtatgttttgtcggctttggttgacatggattatgaaggtgctttgaatttgtatggcaaaatgcagttggggggagttatccccaatgatttaactatggcaagtgtccttaaggcttgttccagcctcgcagcttcagatcagggaaagcaaatgcatgctcggattattaagagtaatttcagcttggaaattccgattggaagtgctctttctgccatgtatgcaaagtgtggaagtttggatgatggtgaagccttggagttgtttgagaagatgtgcttggagggaacggagcctgataatgtcatgtttgtgaatcttctctctgcttgtagtcatatgggactggtggacagaggccgtgctggtaaactccacgaagtaaaagagttcattgaatcagcattgagccgtgctcgacgttacattatttcattcaatgcaagcaccacgcttgtagttgagggcatggaattcgtaaagtgtgaggtcgggggacagagcttcatgcttcatcagatacgggagatgattgggatgacagtggcaatcatgagaaattgtgtactggataaagctttgcagcaggatgttaacattaatttgcctactgcccctgaggttggattatatttggatgagtgcttctttacttcatataaccagaagtggaaagatcatgaagagttatccatgaaagcatacgagaaagaagctgagttcaaaatgaagtacatatattctcatattgcttccacagaacagaaggaaggaactgtcgttccttggttgcattctttgaaccatagaaattatccagacctgcgtgttatcaatggggaagccatccccgataacaagagtgctgatcccgaagaagccatcactcataacaagagtgctgatcccgaagaagccatcaccgataacaagggtgctgatctcgaagaacccatcaccaataacaagagtgctgatcctgaagttgtgactcagtggaaccgtgttccagttgttcaatatgaactcttttctttctaa

SEQ ID NO: 28479 - DNA, 696 bp, Glycine max
  Peptide Sequence Number=SeqID_145257
atgacaaactacggtttcctcatcagagagtggagaacagctttggtcaacgaggctagaaactcagggaagcaaattttgctcttagtaggagcagttttttactcttccaattattactcattgaattacacaattcaggatgtaattaacgcctttgactttgtgaatgtgatggcttatgatttctatggaccaaattggtaccccaatttcacagcaccaccagctgctttatatgctcttaaccatccagcagctaatcgggttagtggtgacatggggatcagagattggattggatccggtatgcctgcgagtaaactggtgctgggtgtgcccttttatggctatgcatggcgtttgttgaattctaataaccgtggattgtttgatagagctaatggttcggcctttggtggtgatgggtccatggggtacagtcagataagggagtttgtaagccagaatagagcagcgtgtacgttcaattcaactgtggtctctgattattgctcttctgggacaacatggattggttatgatgacgtgcagagtgtgtctgcaaaggttgcttatgccaagacaaataatttgggtggtcattttgtttggcacgttggtgcggattacaattgggttctttctcaagcaggtgctgtttaccctgacatgtattgttgttacagagtataa

SEQ ID NO: 28480 - DNA, 1884 bp, Glycine max
  Peptide Sequence Number=SeqID_145258
atggcggttaagggagaattaattgggtttaatgggtctctcacccctagatttttcttccctttaaaatcgaagttgttgaccaaatccttcaagcatttactccccttccctccacatctcaaaggattcttatctattgcaggggtctctgaaattgttgcttcgtccttgatcaaagtgatggctgaggaaagtactgttaatcagttaaagtctgagaaaattgagccagaagttgttgacgacaaagcaaatcctaatgagagattgaccatcacaaaagttccaccaaagattctatcgcgttatcttagtgctcgaaaaagttcctgccatgatctttgcaaatatggcatcccacatgaagttgaagccaaaccatggagtccaacacagagaagggttacaaaaaaggaaaggaaaaccaaagttccacaagagaatgtgacttctttggaagggacagagaaatcagaaagcagttcaaagccttctcaaacttcaaaaattgaaaaggccaatattcctgttgacaccaagcaagtaacatataaaaaaacagtcacgtcagagataaactcaccaccttttgaagaaacacatgtttcctcggaaaataacaacagtgacctaatgcaagcacagtctgagccatctctcccagtgaaggaatcttccaagagtcaagcaaaaagggaaatggtaaaaaataagagtccttctgattcaagcagcagaaaggaaactgaaagtaaaatcaattcaagcaaacagaaaaagacatctttcactggaggcaaggaaaaaccaactccaccaagtcttcccttgtccccaaaacacaatgtcaagaaacctcaaagcttaagctccaagagtttaaagaacatggcaagagagtcctctctgaaacctcatgaaaatgttgaaatcaaacctgaactagctagcagtgacaatatcttgcatgtcacagagccagcctcagaaaattcatctgaggaccctactgtggcttgtggtgcaagtaagttgtcttcaccctcaccttcatcatcagggaacaaaagcttgaagcataccaatgagaaaactggcaagtctgcattgtctgcatcttcaaggaagggccttggatctgtggctgggaacaaagggaaggtaaatatgcgtagtgtttcacgaccgctatcggtatcatcatatgtttccacttccaactcttcccttcgtaaacaaaataatgctgcttctaagtccaacaaaagaggacatgatcatgaaggtgagaatgtgaagatggggtacaaaatcaggccaaaagtaagcacaaaagttggtgcagcaaataaatctgttcttgcagctcggaaattgaatttcaggagaggaaaagtgattgaacttcagcctcagagcaacgacgttccaaggagactcaaattcaggccggcacgcattcttggcgatgacatgaggagagacataaatagtgcaagaaaaaagaccattgtggataataaagttggtggtgatggtgaggtaaatgcttctaacaccaaatcagagaaagttgtggccaaactccaaactgtggaagaaagtaataggagaattgttgggagaaaggttggtggggatagaagcaagatagaggcttcaaaatcaggatctgatgagaaagtggttttgaggcatcaaaacgtggaagggaagaaacagaaccctcgtttgtataataatgtgattgaagagaccgcaagtatgcttgctgagctaaggaagagcaaggtcaaggctctagttggtgcatttgaaactgtgatatctcttgattctcctagagatgccacagccgcggaagtaagcacaacttgttga

SEQ ID NO: 28481 - DNA, 6018 bp, Glycine max
  Peptide Sequence Number=SeqID_145259
atggacgataatgaagtagttgatgatcagaactcaggatggttccaagtcaaaaagaagcacagaaatacttcgaaattctctttgcagagctgggtggggggattgtcggggacaaatgcctctaactctcttcacactcagcactccatgactaaaactgttgacaattcacatagccagcagaaaactcatctttcaaggtcaggggagaatttttcacagaaccctgtccctgggagtgttgcgagttctatttctgaatcaaatgaaaatgagggcacacactgtcttaatactggtgtagttagacataatactgaaagtcagaaatcgtctacattacttactatggattctcaaggtaaacatgaagaagttaggaaattataccaaactgttaagcctgacttagcccagaaaacaagatggggtgatttagaggagggaggcttggcactgccccatgaaaacttgattggagttggaatcaagtttggtagtattggagattatagtttacttagctgtagaaagaatgggaatattcccgatccttgtgattcatatcatcctcaagaaaaaaacttgacaacaactactattgatgcagaggctgtttctgatcagatcccttcgatgagatgtgaagacaacaagcttggggagaatggtaaagatgttaagaacatatctttggaacatttgaacattcaagaaacaaatggggaaataattggtccagaagatgatatattacattgtgttaagaaaaatgatgaagtgaataaaacaacgactaatagtgccattaacaatgatattttgtcttctaaagatgctacagtggttgcaaatcaagtgcatgtctctatcaatgtgttaagtgatataaaagtttctgaagtgccagaacaaaagggcagcttaagtgaagcagttactgcccagggcactgagtcacaagtgcctgaaattgtcaatggttctgtggcttctgctgacgtggttaggggtccacaggatggtaatgccgaaaatgttgttccaacctctcataatacgagttctcttgaagaaggtgattccaatgaaagcaaagaaaggtttaggcagaggctttggtgctttctgtttgagaatcttaataggtctgtagatgaactttatcttctttgtgaactagaatgtgatttggagcagatgaaggaggcaattcttgttcttgaggagtctgcatctgattttagagagctaataactagagttgaggaatttgaaaaggttaaaaaatcttctcaaacaattgatggaggtcctgttatcttgaagagtgatcaccgtcggccacatgctctctcatgggaggtccgaaggatgacaacttcaccgcatagggcagatatactatcttcatctcttgaggcttttagaaagattcaacaagagcgtgctagcttgcaatcaggtaccacagaaaatgccatgtctaaatgtgtgacttctgaatctattggcaatacgaacaaatcgagggtcaatgatggaacagatgttgccaaatattcggtgacaaagtcaagaaagcaagttggatcttcagatgcgaagcaagggaacctgaatggaaaaaagcgtaatattgaaggggggaaaccctttgactcaatcacagggcaaaatatatgtaacccaccagaaagcatattaacttcagaaggtaagttatctaaattatctccattggagaattcttctgcttctgccaccaccaagggcaaaagagatcaacttggacttggatctgacaagacactttataagaaagataaagcaccaacagaagttgttaatgagaaaaaccccagatccacagataatcttaggaggcaaatgccactgcctgaaaaagataaggagaaaaggagttctgctccaggaaagtctttgaatgcttggaaggagaaaaggaactgggaggacatactttcatctccatttcgtatctcttcccgcctgccatattcaccaagcctgagccgaaaaagtgctgaacgtgtacgtactctgcatgataaactaatgtctcctgacaaaaagaagaaaacaacttcagacttaaaaagggaagcagaagaaaagcatgctcgtgctatgagaatcagaagtgagttagagaatgagagagtccaaaagcttcaacgtacatcacaaaagttaaatcgtgttaacgaatggcatgctgatcgtcatatgaagttacgagagggcatgtatgcccgccatcaacgcagtgaatctcgtcatgaagcttttctagctcaagtggcgaagagagctggtgatgaaagtagcaaggtaaatgaggttcggtttattacttccttaaatgaagaaaataagaaattgatgttgcgtcagaaacttcacgaatcagagttgaggagagccgaaaagcttcaagtgctaaaatctaagcaaaaggaggatttggcaagagaagaagctgttctagagcgtcgaaaactcattgaggctgaaaagttacagcgtcttgctgagattcagcgtagaaaggaggaggctcaagtcagacgggaagaggaaagaaaagcatcaagtgcggcacgggaagcaagagctattgaacagcttcgaagaaaggaagaaagagccaaagcacaacaagaggaagctgaacttttggcccaaaaattggcagagagacttaatgaaagtgaacaacgccgtaagatttacctggaacaaattcgggagagagcaaatttgagggatcaatcatcccctttgctgcgtcgatcaataaataaagaggggcaaggtagatctacacctacaaacagcagtgatgattctcaaacaaacattgtttctggcattggttctagtcttggaattggcaatgtcacattgcaacactcaataaagagaagaattaagagaattcgacaaaggcttatggctttaaagtatgagtttcttgagccccctcttggtggtgaaagtgctagcctgggatatagagtagcagtgggtgctgctagggcaaaagttggccggtggcttcaagaacttcaaagacttaggcaagcaagaaaagaaggggccacaagtatcgggctaataatttctgaaatgatcaagggaaaggatcctgagttacaagcatctcgtcaagctggactacttgattttattgcttccaccttgcctgcatctcacacatcaaaacctgaagcttgccaggttatgttgcacttgttaaaacttctgagagttgtgctatctacacctgcaaatagaagttatttccttgcacagaatcttttgcctccaatcatcccaatgctttcagcagctcttgagaattatataaaaattgcagcatctttaagtattcctggcaacatcagtttgccaccaagtaaagcatcagttgagaactttgaatcaatttctgaaatattaaataattttctgtggactgttactgctatttttggtcatataaactcggaagaaagacaacttcagatgcgagatggcttgttggagttgctgatttcctatcaagtgattcaccgattaagagatctttttgcacttcatgataggccacagatggaagggtctgcatttcctgcccctattctcttaagcatacaacttttggtggttttgacctccatatcaggaagattgagttatattggctggggatcttcccctgtggcaatggagcaggaaattgttagtgaaagggctaagtttgcagattctgcacattttgtagtgaataactcctgggaaaattacaaccccttatcagtgaccaatggaagttcagttgtgcatttacctgatgttcctgaggacagaccattggatgaaatgattaaggtgaacaagagtgatgaatctatttctattgggaaagattgtgaattggagcatgatagttctgttaaattgaaaaatgatgatatggaaaagatagatgatctagatgaatccaagaaaaatcagaatggggatattactaatttgtctgttctccaaaaggatgagaaacatacagtggtaaatattacagtacagaaaaatgaaagaatttcaaactttgctcagccaatagtatttcttctttcagctatttctgaaacaggacttgtcagtctcccttctcttttgactgctgttcttctgcaggcaaacaatagatcatcctctgaacaggcttcatatatccttccatctaattttgaagaggtggcagccggagtactgaaggtgctgaacaatgtggctcttttggatcttgtatttttgcagcaaatgctggctaggccagatctgaaaatggaaattttccatttgatgggcttccttctttctcattgtgccagcaagtggaaagctcctaatgatcaggttggttcacttgtgcttgaatctctatctcttcttggtcactttgcattgtttcatcctggaaatcaagctgtccttcgatggggcaagagtcccaccatcctccacaaggtttgcgatctgccattcgttttcttcagtgacccagagttgatgccaatcttggctggcacgttagttgctgtatgctacgggtgtgagcagaacaagtttgtagttcagcaagaactgagtgttgacatgctactttccttgctaaggtcttgcagaaatgctgcgcctgcaacccagcttaattccaccttggacaattccacaacagacgaatctggtgaatgtaatcaattaggtactgaaattaaaaagcctcaagtggactttcctgtaaaaaatagccgttccaatggcaaaggcactcgggcttcctcgggaaagagtggtgcttcgggaaataacataaaaaattgcagaataagaagccaacgggacgggaaaataaccaagaattctgaagaagtggctcctaagcacggcgagccttcaaatttaatgttgcactgtagatttcctcccagcttcatcgataaagtagagcagtttttttcagcggaaattgctaacgggtttaaagagagggtactttgcatcctctggaggctgcttgtaaagcctattttgctttgcttgtctgcatgctgctctacgcataaggccagctctctgttcatctttacacaatcaaacgggttggaaactagagaagttcaagacagagaagtctacacagatttcaatttcaaggaatggaaaatagactccaccaaagaagtgtcattttctgattcacgtccaacaaaacatcatgggtccagtggcagtagaaatgacaaggcttggaactggctcccaaggataacttctcatgatgactatataagagatgatgagtacataacttcagttgcagctacagcatttgccattcattctctagaagaagcggagttacgtgacttgccaaaaatgagagagcgttccaaatcttcaaggtctcaaactatgagaagagaagagaatgacataccaaagcggccaagttatggggaaacttccatgaaaaggtcatttggacaagaacctgggaccaaagaaagtgcttttcctgttagacgtccaagtggtatatcacctccaactccaaggtctttatctccagcactagggtatcagaggcagcagcaagggattccattgcaacacaaaaatgccaaaaccagaccagaaacttgggaaaaggccatgataaaaatgattcaaaagcagtatgagaaaatgaagtccaagattttttcctgggagtttgtgaaaatgattcaggccaaagtccagagagcaatggaaatgcaaaattaccagaataagctagcaagggaagatagggtagcgcagggagctggagcagggttagaagacagaagaagaaaagagtccgaggcgagaaagaaatcaaacaaaaatcgaaaaacaagcaaggaccttgtggaatgtttgtgcttcaattcttaa

SEQ ID NO: 28482 - DNA, 1743 bp, Glycine max
  Peptide Sequence Number=SeqID_145260
atgggagggaggaagaagaagttcatcgacaagaagaactctgctactttccaactcatcgctcgcgacacctccgacccttccttctcccaatccgaccgtgtcttcgtccgcgtcgacaacaaccccgtttccttccccgtcgccgacgactccgctttcgatgactcccccgacgactactactacgacgacggcggcggcggagttagcggtggtcccttgccggagggcgtgaggagggagattctggagctagggtttccggatgatggctataactacttgaatcacttgagggaaatcaaaaacaccggcgctggtgctgctttctttcacaaccccaagttcaagcttcaacacctccctcgcgatgttaaggcatatgatgcttcgagattgcaaatttctgaggcggatggagaggctgtggagaacactatatacagtgttgcgtccaaaactaccagcgtaagggtgcagaaagcagttgatcctgaagtggctgcattgcttgatgatgacgatttgtcacggttgggatctgatgttgaggatttggaagaagactttgttgttcaggcgaatctccttgaagaggaagatgaagaagatgaagagaaggatcctatatgtaatgaaacgagtttttctgaggagtctgcgatacatagaaacgggaacaatgcacacacactgcaagtctcttcctgttccagagtcacagatgattctggacctttggatggggtgacagatggtgtaccaggagaggactgtgttggtgagaagccaggggctcgtcgtttgctggatgagcaatttgatttgcttgaacaccaagaatatggaactgatgatgatgatgatggtggtgattattatgaaaattatcaagctgatgaagacgagtcccttgctgagaagctcaaacactctcttaaaaaccatgtgatggatgatctagaacttgatggcaagtataaggttccttcagatttattgaagaataaagaggccccacatgaggaacaagaggattttgctgcagatgtgattcgccgctgcaaggaatatgctgaggggtatgaagttgaagatgataacaaggatgttgtactcgtagaagaaagtagtgatgaatcagaagtttgggattgtgagactattgtttcgacttactcaaatctagataaccaccctggaaagattgaagcacctggagtagctaggaaaaagaaattggctgaaactgtgtctgcagccttgagttcctctagtcaaataatatcccttagaggcaaagagaaactccctgtagacttcttgcctggtggcaggaaacctgccactgaaaaggttaaagaccagagcattgcaaaaactgaacagtacaagagaaaacaacatggccttgagtcaaaggaggagaagaaagaacggaaggctgctgtgaaggaggaacgacgtgaggcacgtcgcaataaaaaagaaatgaaagagctttataaatgtgaagcacatcgggcacagagagctgctgctgtgtctggcactggggcgagggagctaccttattgtgatcagggacgagaagaaacccaccatgaaagagatcatcatcgacgttcctcttcaggggattcagctggcccgttgctgcctacagagaactcattgccaaggatgtctaagcttaacctaaatggctcccattccttccctaaaccacattctaactga

SEQ ID NO: 28483 - DNA, 1602 bp, Glycine max
  Peptide Sequence Number=SeqID_145261
atgacaaaaataagttacagttcagatttcaagaatgtatttttgggctattctccttcacacaaaggctacaagtgccttgctgctggtggcaggcacatgcttatgattgtcgataatgaagaattttatgagcaagagaaaccgctatcactgaaggacattagaagcctcatcattatattgagacaggttctgtggcagctactgtgggtgaatcatatcacatctgctaattcggtaaaatctgttccagttagttcagctagtaaggggcagtctgttcagaccattcaacagagggtttgcattgtagtctctgagcttctctcccagctgcaagattggaacaataggcggcagtttacatcccccagtaacttccatgctgatggggtgaatgacttatttagctctcaggctgtaatagaaaacacacgagcaaatgaaattttgaaacaggcccctttcttgataccatttacaagcagggttaaaatattctcttctcaactagctgctgttaggcaaaggcatggacctcaagctgtattttctagaaatcgattcaggatacaacgagatcatattttggaagatgcttacaatcaaatgagtcagttgacagaagatagtcttcgaggatcgattcgtgtgacttttgtcaatgaatttggagttgaagaggctggaattgatggtggtggaatattcaaagatttcatggagaacatcacacgtgctgcctttgatgtgcaatatggattatttaaggaaacagcggatcacctgctttatcctaatcctggatctggaatgatacatgaacaacatttccaatttttccacttccttggtactcttctcgcaaaggctatgtttgaagggattctggttgatataccatttgctacatttttcttgagcaaattgaaacaaaagcacaactatttgaatgacttgccttccttggacccagaattatatcgtcatctcatttttcttaagcattataagggtgacatttcggagttggaactatactttgttatagtaaataatgaatatggagaacaaacagaggaggaactgcttcccggaggaaggaacctacgtgtcactaatgagaatgtcattacttttatccaccttgtagccaatcaccgcttgaattttcagatacgccaacaaagttcacatttcttgaggggatttcagcaacttatgcagaaggattggattgacatgtttaatgaacatgaacttcagcttctgatatcaggttcacttgacagcttggatattgatgatctgcggctgcataccaactatgcaggaggctatcataatgagcattttgttatggagatgttttgggaagttctcaaaggcttttcattggaaaacaggaagaaatttttgaagtttgtgacaggttgctctcgtgggcctttgcttggtttccgatatcttgaacctatgttttgcatacaaagggcttccggtaatgccgttgaagaatcacttgaccgattaccaacatcggctacttgtatgaatctactaaagcttccgccttatacaaggtttggcctaggttag

SEQ ID NO: 28484 - DNA, 5484 bp, Glycine max
  Peptide Sequence Number=SeqID_145262
atggttgatttggaagttgtcgcaacctgtttcaatattctccattttgattccttgtgtgcaccaatccttcaattggctgaaaactttgggggggaaggattgaatggtaatagctcagagttatcttctgaaaaattgtgtgctgggttatctatgcctggaaacgaagtaggagacagggtccacaatttttttggtcaagaaaacttaccccagggccagtatcattcacaggcagttgacgggaactggccagggctaagcaacaatttgtgggctggtagccagagaccaactgttgctccttttatttccaatttgaagaattttaatctacaacaatcagattttgagcagggacacacaagcactccacatttgcgacatggtttaaacctggctcaatcaaatttgaggcctgactctggcagaaatcaactcccaaatcaacagacaactgtaaatggctatatccaggggcatcaggtttttcagtcgaggcaaaatgaagcaaacattttgggaatggatacagaaactgatttgcatggcatgccaaatctgtcaagaggaatatcagtactagattcacaacaagggtctggtctcgagcactataagaaaaacttgaccaggtctgatgcatctgagtctcctgtcaattatgatttttttggaagtcaacaacaaatgagtggtcggcattcgggcatgcttcagtcttttcctagacagcagtcagggatgaatgacatgcagcttttacaacagcaagcaatgctcaaccagatgcaagaacttcaaaggctgcaacaatttcatcaactagaagctaggcaacagagttctatgaatccagcttcctccatttcaaaacagacgattgcgagccattctgcatctctcattaatggcattcccatcaatgaggcatctaaccttgtgtggcagcagcctgaagttgtggcaacgaatgcaaattggctccagcatggtggatctgcagttatgcaagggtcctctaatggacttgtgttatctcctgaacaactgcggctgatgggtttggttcctaatcagggtgaccagtctctgtatgggcttccaatttctggctcaagaggtacacctaacctgtattctcatgttcaagcggataagcctgcagtgtctcaggtttctatccaacatcaacatcaacatcaacatcaacatcagtattcttgcattgaaggtgacaaacctacattgccacacatatcagccagtggccattcatttccagttcatcagtatggttcaattttggatcaaactaacacaaatgatggaacttcagtttcaagacaagatattcaaggaaaaagtatgtttggttctcttgctcaaggtataaacaatggactaaatatggagaacttgcagctagttaattctgaacaaagaaaagtacctattgaagattttaacgggaggcaagaacttgctggatcttctgacacttcacaggacaaggtggtagcgcaggttcctccttcacagaatgtggctaccctagatccaacagaagagaagattttatttggttcagatgacagcctctgggatggattgggttggagtgctggtttcaatatgctggatagtacagatagttttggtggagttccatcagttcagagtgggagttggagtgcgcttatgcagtctgctgtagctgaaacttctagtagtgaaatgggtatacaggaagaatggagtggtctaagtgtccggaatactgaacgttcatctggaagtgagaggccttcaaccatggatagcaccaaacagcaatcaggttgggctgacaataacttgcagtcagcacccaatagaaattcaaggccttttcttcggccggatgatctcagcaggcccagtaccactgtaacctattctggtcttcctggatttcatcagtctggttctgatactgcacaggaacagcaagataggttacagactggttcttctcaaagatcaattccacagtttttagaaagtggcaaatggttagattgcagccctcagcaaaaaccaattgcagaagggagtcatagttatggaaatgctgctaatagcttagaagtaaatgagaaggttatttcaggttcttgggcacatcaacagatgctatcatcccctaacaataggggtgagccattcaatagatctaatggatggaatgctatcaaatcacccacacccagtaacaattctagtatgaaaatccgtgaaaatgaaaatgtgttgcagcctcatcatgacaaagctatgcaagaggatttgggccaggttcctgcaatttgggaggttgattctgatactaattcatctgttgggttggaacatgcaaaatcaccaggtaatatgcaggtctgtggggaggattctggtatgaatggtatagctgccataccaaattcaggttctacatgggttagtaggcaaagcagccagcaactccctaatgctgatgtatggagacagacagatactgtggggagccaaagaagaaatgaaagtgcaggaaaatataagcatcatatggagaagaatcctttagttttggaatcattgaagaatgaaaagtcagaaggagaggcacatggtatggaaaactctaacaaaaaggataaatcagcaactggtggtttgagagaaaatcccagttttgatggtgatttgcgtagtccaaagttatccgggcagggaaatcgaaggcctcctgtaactcgtaaatttcagtatcacccaatgggggatgttggtgttgacacagaaccttatggaaataaacatgtcataaattcacagcctatgccccatcaacccattggaggacttaaaggtcaggaccaaagctatcctggccagtcaaaatatagtcactctgatgggaattgtaatgaaacggagaagggtgactcaaaaaccatagatgataatgcttcaaaaagcacgctgcctggtcatatgctcaaaacattgactccatttgatagaagtgttggtaattatgcattgaacaagactgcttcacccagtcaaaatattcttgagcttcttcataaagtggatcagtcaagggagcatggcgttgcaacaaacacaagcacttctaaccgccctttatcttccagggtgatggataccgaatcttctgatgggtctgctgcacatcatcaacgaaatcaaagttctttgtctcagggctttgctttacaattggctccacctactcaaaggcatcatatggcatcttctcatgctacaccacatgttgcatctgagacaggggataagggtcctacttggttggctgcttctcagacttttccttctcaagagtcatctcatgagcttagaaataacatttctggttcctcaggacaaatgtttgacaaaacctcacagtacagtgctctgggaaatattcaacaggcttttacttcaggctttcctttttcaagaatccatactcaaaatcagaatgtggctaatcttggtggacaaatagcaaatactcaatgtgataattcaacttttgttgatcggactgcttctactaatcaggtagatgaatattgtgaaagagctcaaactggtcagtctgagttacaatctgctcaggacatgtctcagaaggatagtatgaatcaaattcgtgccggagatcctaccatgaaaatttccacattggaagctggcactgctcctcatgctcctgttacatcatctctacagagcgccccttcgaaagttctacacaatgtgtggacaagtgtttctggcaagcaacatcctaatgcttataagattccatcccatccccaaccaaataatatttgtgaaactacaataggaccacagaaaccaggtattgaagattcagagaaaggtaacctttctgagcagtgggtattgcctgagagtgttgatgctgttgaagagactgcaagtgcttcacaagtgaaggagcatgtgaaatatacacccgatacatctcaatcaggcccagctgctacctctaaagatattgaagattttggccggtctttaagaccaaacaatttcttgcatcataatttctctatgctaaatcaagttcagtccatgaaaaatatggagattgatcctagtaatcgagatgtcaagaggttcaaggtttctgataatgtgatggacaaacaactggtagattccatttccaaccgtggacaacagtcatatggatacaataacatagtcaaagatgtgtcagataatagttcttcagtgccaccatcagatccgaacttgctaaggttttcaacaaagccaggtgatgcacgagacactagtgcatcttctcaggaggtggttggatatggacagagaaatgctcttaatgttgctaataataacaaagtaacttctgttagaagtgagcattctgtgataaatcctcagatggctccatcatggtttgagcagtatggaacttttaaaaatggtaagatgttgcaaatgtatgatgtacggacaatgactcctcaaaaagttatggagcagcctttaattataaggaaccaatctggtagtttgcatcttgctaattcaatggagcaagttaacagtctcagtgatgctgggcaaaattcaatgcttacttcagttgcaaatgagcatctgccttcccagttattgcttcctgcagctgaacctgatctgtctagtatgcgaccaaagaagcgcaaaagttccacatctgaactcttgccatggcataaagagctgagtcagggttctgaaagggttcaagatatcagtgcggcagaattagactgggcgcaagctgcaaatagattggttgagaaggttgaggatgatgctgagctagttgaagaattgccaataatgaagtcaaagagaagacttgtgttaacgacacagcttatgcagcaactacttaacccccctccagctgcagttctctctgcagatgtgaagttgcatcatgaaagtgtggtctactctgttgctaggttagcgttaggagatgcatgcagttctgtctcttggtctggaaatgacacactcatgtcccctggcagcaaaaaccccctgcctgataagcccaaagcgtctgagaaaattgatcagtacattttgaaggtggaagactttgttgatagagcgaggaaactggaaaatgatatgttgagattggatagcagagcctcagttttggacttaagactggaatgtcaggatttagaaagattttctgtcatcaatcgatttgccaagttccatggtcgggggcaaaatgatggggcagaaacctcatcgtctgatgcaactgcaaatgctcagaaatcatgcccccagaaatatgtaactgcagttccaatgcctagaaatctccctgacagggtacaatgtctttcactttga

SEQ ID NO: 28485 - DNA, 315 bp, Glycine max
  Peptide Sequence Number=SeqID_145263
atggaaacgagaagaagtatggaacgtagcggattaataccgttggtaaagatgatacttgccgagtgcgtgatatcttcctgcggaagaagcagagaaccatcgattttcacacgaagctggcatgtgaccactggtttctacgctactggcctccataacctgagcaccgatgacggcaatggagatgagccgatagctttggaagtaactcctccaacttttggtatctcaattcaataccacacaactcttggcttacatggtatattaacttctgctcaaccccgatctcctgcgctaaaatcgagctaa

SEQ ID NO: 28486 - DNA, 807 bp, Glycine max
  Peptide Sequence Number=SeqID_145264
atggtggtggagattatggtattgggtggtgttttcaacattggtgacttcattcttgccttggagtggttggatcttcaaggagtgcaagccaagatgaaaaaattacacgcaaagtttgacgcatttttcactagcattgttgaggaacacaagatttctagaagtgagaatcatcaagatatgttgagtacgttgttgtcactcaaagaggcacctgagaatggagaaaaactcactgacacagagatcaaagcattacttttggttgtggtaaaagaaacatttcgtctttatccatcaacccctgtgtccctcccatgtgttgcggcagagagttgtgagatctttggctaccacattcgtaaaggtgtaactcttttagtcaatgtgtgtgctatagcacgagatccaaacgaatggccaaaccctttagaattcaagcccaaaaggtttttctctagtggtgagaagactgttgttgatgttaggggaaacaacttcgagtttatacctttcggcgttggaagtagaatatgtgcccgtatgagtttgggcctcagaatggtgaagcttctcacagctacactggccccatatgcattttatttggagttagaaaatgggcttaacccaaaaaaactcaacatggatgaagcttatgtggcttaccctccaaagagcagtgccattattgctccaccctcgcccaaggctctcatcacacgtgtactcgtcatcatcgtcttcttgatttggagtttagctttgtgtgattttgtcttctcccctccctctttctattaa

SEQ ID NO: 28487 - DNA, 2145 bp, Glycine max
  Peptide Sequence Number=SeqID_145265
atggatgatgacagagattttgagttgttattttacagttggaataacaagaatccgactgatcagctttttgttatatcttgtgttgttgctgctcttgttggaattttgaccatagcctacacggcctttcaatggaggagaaacatcaatctaagttggatgaaagcgatagctagatctaagaaaaatccaaaggcaaggcacaaaattcctgcggcccctcatacatgggatctagaatctgcatctcgtgcaaagaatttaaactgctgtgtgtgttttaagtccatgtcaccctctcaaacccttgggcctatagtagcttctgaaggtttcatccaccgttgctgtacttgtggtgcagtagctcatctgagctgttcctctagtgcacacaaggactgcaagtgtgtttctatgattggatatgagcatgtcacacaccaatggactgttcgttggatagatgtagctgaccaacctgacgaaactgctctctgtagttactgtgaagagccatgtggtgggacgttcctcagtggttcccctatatggtcttgcttgtggtgccaacgtttagtacatgttgattgtcatagtacaatgtctaatgaaacgggtgatatttgcgatttgggccaatttagaagattgatactatcaccactgtatgtgaaggaattgaactggaacttgccaggtggatttttgagttcaattactcatggggcaaatgaaatagcatcatcagttcgggcaagtattaggaaccagagcaaaaagtacaaacatggaaatgaaccatctgttgaatctgggaacagtgagagcattggtgaagtgtccaccgaaagcactggtgattctcatcaaatacataatggtcatcatgaagtgggtgaaaaaagtagctcgaataaggaggttcgacatcaagatagtgaattagataataagttggatagaaaacccactcttagacgcaattcatcaatcaatcagaaggatgaatcccactcattaggagtgaagcagaaatatgatttgattgatctgcctccggatgcaagaccattgttagtttttataaacaagaagagtggtgcccagcgtggagactcacttagaatgcgcctgaatatccttttaaatcctgttcaggtgattgaattaagttcaacacaggggccagagatgggactttatttgtttagaaaggtgtctcacttcagagttcttgtatgtgggggagatggtactgttggttgggttctgaatgcaatagacaagcaaaattttgtttctcctcccccagttgctattcttcctgctggtggcttgggtccagtggagaggcaagggggtcttactacatttttgcaacacatagaacatgctgctgttacggttcttgaccgttggaaggtaacaattagtaatccacaaggaaagcaacagctgcaaccaacaaagtttttgaacaattatcttggaattggttgtgatgcaaaggttgctttggacattcataatctgcgtgaagagaatccagataagttttataaccagtttatgaataaagttctatatgcaagagaaggtgctaaaagtattatggataggacatttgcggatttaccttggcagattcgagttgaggtggatggagttgaaattgaggtccccgaggatgcggaaggtgtgcttgttgcaaacattggaagctacatgggaggtgtagatttgtggcaaaacgaggatgaaaattatgataattttgatcaacaatccatgcatgataagatacttgaagttgtgagcatatctggaacatggcacctcgggaagctgcaggtcgggctttctcgagctcgaaggcttgcacaaggacagtcaattaagatacaactgtttgccatgtttcctgttcaaattgatggagagccttggtttcagcaaccctgcacaattaacataacccatcaaggccaggctttcatgttgaagagggtggctgaggaacctcttggccctgcatctgcaataattgctgaagtgcttgagaatgctgaaacacataatgtaattaatacttcacaaaagcgagctcttcttcatgaaatggcactaaggctgtcctag

SEQ ID NO: 28488 - DNA, 336 bp, Glycine max
  Peptide Sequence Number=SeqID_145266
atgtctatgccaggtttatttaacaacatggcttgcagaggtgaacatgtcactcccaagtatgattgcaatgaagttcatactttaaatattagtaatcttagtctcaacattaacaaattgtggacattagttcaaaggaaaggcaaacctaacaaaattggtgtctgcatggatagtatgctcaataatattgcaaaaatgttggagtacaatagattggatattaaatttcaatctttttcaatgccttttactatcatgtcaagatcggtgtttccgttcatgcttctattttggcatcgtcctttgggtgtgcgggcgcaagtacaatag

SEQ ID NO: 28489 - DNA, 111 bp, Glycine max
  Peptide Sequence Number=SeqID_145267
atggagatagaggaagaactcaagaatattacaaaaggtgatccacctcaacgggagagaagtgaaaaaattgccataaagaaaaagttcaagaaaatggcacaaggttag

SEQ ID NO: 28490 - DNA, 291 bp, Glycine max
  Peptide Sequence Number=SeqID_145268
atggaggaagaaaaaggagtgccgaactacgacgagttgacctgtaaaggcgagagagttgcgtggttcaagctgggtctccgcttttcctcttcagcagcaaaggatgatgttccaaaaccctcctcttccttcctctccaaattcgtcaaagcctcctccgagtcaaagaagcaagcgcagctccaatccatccacgacaatctcaagaaaagccttctttcgagtctagggtttcgagctgggatagggacaacgatagaagtagaagatgaagtaggagcagagtaa

SEQ ID NO: 28491 - DNA, 1248 bp, Glycine max
  misc_feature (26)..(26): n is a, c, g, or t
  Peptide Sequence Number=SeqID_145269
atgaccacatacatgacctataaccnaaaagaccttgcttttgctccctacggcccacggtggcggtttctccgcaaaataagctcagttcacatgttctctgttaaggccttggatgattttagacaactccgacaggaagaagtggaaagattgacaagtaatttagcaagttcaggctctacagctgtgaatttggggcaattggtgaatgtatgtaccaccaacacattggcaagagtaatgataggacggcgtcttttcaacgatagtcgtagtagttgggatgcaaaagcagacgaatttaaatctatggttgtggaactcatggtgttgaatagagtttttaatattggtgacttcattcctatcttggatcggttggaccttcaaggagtgaaatctaagacaaaaaaattacacaagaggtttgatacatttttgactagcattcttgaggaacacaagatttttaagaatgaaaaacatcaagacttatatttgactacattgttgtcacttaaggaagctcctcaagaaggatataaacttgacgaatcagagatcaaagcaatacttttggacatgtttacagcggggacagacacatcatcaagcacaattgagtgggcaattgctgaactgattaggaatccaagagtcatggttcgggtccaacaagaaatggatattgttgtaggtcgggataggcgtgtgactgaattggacttgccccaacttccttacttgcaagctgttgtgaaggaaacatttcgtctccacccaccaacccctctttccctcccacgagttgcgacggagagttgcgagatattcgattaccacatccccaaaggtacaactctcttggtcaatatttgggcaatagggcgtgaccctaacgagtggattgacccattggagtttaagcctgaaaggttcctccttggtggtgagaaggctggtgttgacgttatgggcaccaactttgaggttataccctttggtgctggtcgtagaatatgtgttggtatgggcctaggcctaaaggtggttcaattgctcactgccaccttagcccacacatttgtttgggagttggaaaatggacttgatccgaaaaatctcaacatggatgaagcacatgggtttatccttcaaagagaaatgcctctttttgttcatccttatcctagactttcacgacatgtgtattcatcatcatcatcaccatcgtcatcttcatga

SEQ ID NO: 28492 - DNA, 306 bp, Glycine max
  Peptide Sequence Number=SeqID_145270
atggattcatattctgactttaaattttctctcatctttatagcgaggccaactttctacaactatgttgctgtaatgtttgtcttcagtgtgattaccctgtttgcttgtggactagcagcaattggcgctggactcggcaattggttgtatgatctcactgtgctttgttatcactctttgtatcttccatttctttacgtaacttttcttgcagattttttccaggaggaagatttccttttggacaacgcatattactccgagatgaaagatgccggattctttgatgctgactgggaataa

SEQ ID NO: 28493 - DNA, 324 bp, Glycine max
  Peptide Sequence Number=SeqID_145271
atggcattggaaggcaaaattgatcctgagtgttgttgttccacatcaatggctagtaatgtgggttcatatgctcgtgaatcttgcgcatcgaaaatgggaaggaagaatcaagagcccatttactgtcctactgaagttagaagaataaaactggggatacacctttctgggatgttaaatttcgagccaagtacagtgtatgtgaatggtacttatgtggaaaaatattggagcatggatgtggatgagctatcttatattgacatgaagaatctgatagagaagatgggatacaagaagtacaaattcatatggtattga

SEQ ID NO: 28494 - DNA, 645 bp, Glycine max
  Peptide Sequence Number=SeqID_145272
atggcaggaatatatgttggagagggaatggttatccacttcaccagaagagcagggcaagaaactagatcaggaacgatcttggaccgtctccttataagttcaccaccacttcgtgctacttttgacactccatgtccaagatgtggtgatcaagctagatctgatggtgtcatttgttcctgcttagattgttttctctcaggtggtgatctatacttatttgaatatagtgtgtcacctgcattttttctagccaaagctagaggaggtacttgcaccaccgcattttctgatccaactgatgaagtccttcaccgcgctctgtttcttcttgagaatggattcggtggttaccatgtcttcaagaataactgtgaagactttgcaatttactgcaaaacaggtttacttgtagtcactaacatcagtgtagggaggagtggacaagcagcatcatgctttgctgctgctagtgctgtagtttcttcaccactgaggtttatgactgccagctttggtggtttggcattggttggatgtggtatgtattgtgttagcagatatgtttctgatattggagtacgcggtgatgtagctaaagttccagtggagaagatatctgagatggccaaggagcaatga

SEQ ID NO: 28495 - DNA, 360 bp, Glycine max
  Peptide Sequence Number=SeqID_145273
atggtgatccacttcataagagggccaggccaaaaccgtttcctttcatgttcatcatcatctcttttagttttactcatggcattccgtgcccaatatgtggagagaaaacaagaactgaagaggcttgcttgcagtagaagacacggcggtagggcggagtggacaagcattactggctatgctgttgctggttctatggttttttcagcagctggtattgtgacaaataactgtggtggtgcattggttggatttggctcatattgttatggaagatatatctatgatattggagtacgcagtgttgtgacaaaagttccagtggaggagatacctaaaatggccaaggaaaactga

SEQ ID NO: 28496 - DNA, 234 bp, Glycine max
  Peptide Sequence Number=SeqID_145274
atgaccatgatgggcatggatgtaagcctgcctccaagaataaatgtgatcgccaggtgcattgttactcagaacaatttaatgttcgacgttaaagaatgcaacgatggtaacgtcattctgtcagctacgctagcgaagttcaccctaaacaacgccgacgaattgcatttcttcgacatggacctcattgatggttacaacctctcaatgatcatgaaaccacaggactga

SEQ ID NO: 28497 - DNA, 246 bp, Glycine max
  Peptide Sequence Number=SeqID_145275
atggcgaggcgaggcgagactcggaacgagtcgttattgactcgggcggttgcggcggtcttcgccttcgtgagacacgccgagtttgagatcctcttctttcttttctttttcatcgcttatcttctattcaaagacatcgttagtctagtggttgggaaggggggcttaagggttgaaggaagaagggaggagagagacatcatgagtttgaatcccctcactgacatttctaacaaaaactaa

SEQ ID NO: 28498 - DNA, 630 bp, Glycine max
  Peptide Sequence Number=SeqID_145276
atggagcgtgaaaacgagaacagcgtcaacgctcaacgccgcgtgggtttactctacgacgagactatgtgtaagcaccacacaccagacgacgaggaccatcccgagaaccctaatcgcatcagagccatttggaacagactccaaagcgccggcgttctccaacgatgcgtgattttggaggccaaagaagctgaagacaaacatctactgttggtgcattctataaaccatgtgaatctgattaagaacatcagctcaaagcagttcaattcgcggaggcataagattgcctcaaaattgggttccatatactttaacgaaggttcatcagaggctgcgtaccttgccgctggctctgcagtagaggttgttaaaagagtggcaagcagggaattggattctgctgttgccattgttaggcctccgggtcatcatgcagaacaacaagaagctatgggattttgtctgttcaacaatgtggcagttgctgcaagatatctcttagacgaaagagtgagtaacgtaactcctcctaccaattccatatttggaaaacttttagcctttaatttaacagttggttactgtattgacacctttgcttttctggttttgccgtctgcatga

SEQ ID NO: 28499 - DNA, 1176 bp, Glycine max
  Peptide Sequence Number=SeqID_145277
atggcgttgttgagaagatatgctactgctagtgctattgcattgtttgtgcttttgctgttgttggttacttgcaaccttaacatggcttcggccttgtccggaggcgtgatgggagggaatttctttgattcggattcagagtcttcctcctcagaatcgtacaccagggattcagaatcatacagaatgggacatcatcatcatcattattataatgatgatgccccttctcctgacactccggccgcaaagggaagtcacagtggactcgtgttttttctgattttcgtattgggtatgtttttggtttcattctataaaggcagcactggaaattcagttactgtgctcaagcttcaggttgcaatgttgggtggtgggatgggaagcacaatacaaagggatctaaccaggattgcagaaactgcagatacatcctctcgggatggtttgacctatctattgacaggttacattttcctcaagtctcttcctccttatccatggttactggtcgttggtgatcaagtttatgagctctattattttgggaataatgcttcttgcacatccctaagaagcaaatcacctcagttaaaactcactaggttcagcctaatggtatgggatttggacacaatacagagtttggttcgacatcttggtaactgtattgcaggatattcatttgtggatctaaagcggagtaaagaggatggggagaaatactataaccaactatcaaatgaagaaagggccaaatttgatgaagagacattagttaatttgaacaacacagaaaagagaagtacaaaaatccagagtgatgtgtttagcaatgtatactcaatgtttgatggaaaggggattaaagaggaaagcaaaaaatttgaagaagagaaacttctcaacgagattggttccgagtacatagtgataacaatcttggtagctgctaaaggagcacataagcttcctaacatcaatggaactaaagatttgaaggaggctttgcaaaagcttagaacccttctctcaagcaaattattagctggcaaggtattatggaccccacaaaatgaggatgacactctttcaaaacgaaaactacttgaagactaccctcagttagcaagaagcatgacaaactttctggttaagaaacatgaatga

SEQ ID NO: 28500 - DNA, 1923 bp, Glycine max
  Peptide Sequence Number=SeqID_145278
atggatggacttgtaaagtctcaagttcctcatgaacgttccctccttgctctcttcaaatcatcaccctcttcatcatcgttatcttcctcattctcttcttcttggacctctgaagtagtccttcagacaaggtccaagattcggcgtgaaggtgagcctaacaatgtagcagacttgagatcggaacaaacacgttctcacataatagaaaatgaagcaattcaaggtgtgggattcatcaatggcattgatggtcacagtggaatggagtggaaggatttggagaaacggttcgaccaggtggcacgaaccggaagtggagccgaaccggttgtgacatggtccgaatttggcttctgcattggtgagaatagcaaattaaagtcaacagttcatacaattttattaaccgcttctacaaataagctatccgtgacacatgatgaagcagaggactatgcttctttgatcatgaaatttctagacaagaaaaacaaaggctacattgaggcaacaaatctatcaaattcaaaggcacattctccaatgaaacaagtatcatcagtaggtagcagcacacacaatgttcttcataacactagcggtgacttttgtgaagaacaacaagaaccaatgtcaaggactgaagttttgttcagaacttattggagacgtgcttggattgttctggtttggttgcttgcatgcttgggattgtttgtgtggaaatttgttcaataccgccatagatcagggtttgaagtcatgggttattgtcttcctactgctaaaggtgcagctgagaccttaaaactcaacatggctcttgttcttcttcctgtttgtagaaacacaatcacgtggctccgcaaacaccgtccgatcaactctgttgttccattcaatgacaacattaacttccacaagcttattgcaggaggaatagtggtgggtgtgatcctgcacggtggaacgcaccttgcgtgcgatttcccaagaatcagtgagtcggataaatcaatattccggcaaactattgccgcaggattcgggtaccaccggccaacgtacacgcaaattttggcgacgacggaggtggccagtgggataggcatggtggtgttaatgggcattgcatttgcactggcagccaagtggccacggcgtcggtcaccggtgctgccggtgtccctccgtcgtgtcactggttacaacacattttggtactctcaccatttgtttgtccttgtctatgccctgctcattattcactccatgttcttgttcctaaccgacaagttgatggagaaaacgacatggatgtacattgcttttccagttttattatacgctggggagaggatctttcgagccattagatctggatcttacgaagttgatattttgaaggcaagtatatgtccaggaaaagttttgtacctcaaaatgcaaaaaccagaaggttttaagttccatagtggcatgcatccattttccttgacttcagggccacaagatgactacctcagtgtgcacattagaacactcggagactggagctaccaaatatatgatctattccaagaggcagtgttatcacgatcaaaagggtgtccaaaactgtacatagatggcccttatggttctgctgctcaagaccatgtaaagtacgacattctagtactaattggtcttggcataggagcaacacctttcattagcatccttaaagatgtagttaaaggtgtccagacaacgcaaaatgatcattcggttgtggagatgcacaatttcctgacaagtgtacatccagaaggagatattcgttcagctttgctaagtgttattcaggccttgcatgttgccaagaatggcactgacatagtttccaggactcaagtaagtgaatcttctccttag

SEQ ID NO: 28501 - DNA, 1531 bp, Glycine max
  Peptide Sequence Number=SeqID_145279
atggcgtcgtcgtcggcggcaaagcgatgccactacgaagtcctcggcctcccccgtgattgcgcccccgatgagatccgttcagcctaccgccgcctcgccctccagcgccacccggacaagctcgtgaaatcgggtctctcccaagaagaagccaccgcgcagttccaggaactccaacacgcctacgaagtcctctccgaccccaaggaacgcgcctggtacgactcccaccgctcccaaatcctcttctccgaccccaacaccgtctccaactccttcgtccccgacctcttctccttcttttccaacaccgtctattccggctacaccaacaccgcaaagggattctacaaggtctattccgatgtattcgataaaatccacgccaacgagatcaatttcgcgcgcaaattggggcttgactctgatgcggttagacaggcgcctgttatgggtaatttagatagtccatacgcgcaggttactgcgttttatagttattggttagggttttgtactgtgatggatttttgctgggtggatgagtacgatgttatggccgggccgaaccggaagtcgcggcggattatggaggaggagaataataaggtgaggaggaaggcgaggagggagtataatgacactgtgaggaggttgggggattttgtgaagaagagggataagagggtgattgatatgaaggtgaagaggagtgtggaggaggagaggaagaaggaggaggagagggagaggaagaggaggttggagaaggagaagaaggagagggctatggcgtacgaggagccagagtgggctaaggttgacgaggatgtggaggaggtggttgaggaggaggtggaggagagggagaatgaggagttatactgtgtgctgtgtaaaaagaagtttaaaagtgacaagcagtggaagaaccacgagcagtccaagaagcataaggagagggtcgctgagtttaggggttcgattggtgatgatgaggaggatttggaagaagaagaagaaggagaggagggattggaaagtgcagaagttggggtgaatgatgagactgataatgggattggtgatttggaggcgaggattaaaaatggtcttaatgttgaagagggggagactagaaatgggattgaactgaatgatgatgatgagtttattgatgcctcacgtgtgaaggaaggcgaagaggccggtgtgtctgttagttttgatgaggatggcaatgaagaagaagaagaagaagaagaagaaggtgatattgaaaatggtgttcttgaagcaatggtggctgggcacaagaacagaaaaccacgagcttcaacacacaaacccaagacttcagtggcaccattgccaattgaaaatgagaatgatgatgagcttggccctatggaatataacaaccaaaagggggcaagaaagaaacgtagagccaagaaagagaagggtaggaaaaattgggaagagtctcaggaggctgctgacagtggggattatgaggatataatca

SEQ ID NO: 28502 - DNA, 726 bp, Glycine max
  Peptide Sequence Number=SeqID_145280
atgacattgccttggccatcctccgggatgaatttataccacaactcatttttatccttaaacccaccattccaaaccagaattcaacttcctttttctgcaaatattccattttcacaccctctcacttcaatctctccccacttcaattcaaactcccttcaaaaacccagattcccacgcgcgagtgcaaatgctactaccaacgaagcagttattatgccaagcatggccgaaattctagacgcatcgagagcgcagaaactcgaccttcagctcaaaacattgggaccctttttcagaatcacggcaaggagcatggtaacgggcacagagctcggaagggccgaagggttggtaagattctgggtaggaggcaaaattcttcacttggactcaatcaaactacaaagagagacactggacatggagaaatcaatctttggccttggcttgttcatcggagccgttgcaattcgacacggctatgattctggctgcaaaacagcgcagctattggccatcaatgattccgatctttaccattctaagttggttcggttctacactagacttgggtttaaagctgtgtacgaggttacggggtcatctgttggagatgttgggcacatgcttgtgtggggtggtgttggtacccgcatggatgctagtgttgaagaacttatgataaaatggtgtacaagatttaaagctccgcataaatga

SEQ ID NO: 28503 - DNA, 507 bp, Glycine max
  Peptide Sequence Number=SeqID_145281
ggagtggcagacagagccaaagagagagaaagcaagagagggagcttaggatatgatggaaggaaaagaagcatgatggaagaacaggcaaaggaagagttgaagctgcttgaagcccaatatcctaaccatcatgagcatctaaagaatgagctcaggtcctttatctttcaactccagaccaatcaccatgattctgaacagcttccagaaaacaataacttcagcactcaccttgctttctttgatactgaagaatccactagcttggaggagctaaggaagaggagtgactatgatttggaacttggtttggcagacagagtagtgatagagaagattgatggaagttctaagcttgaaactcccaagagtgttgtagtgaagcatttctcaagcaggaagaacaagagaaaagatagggtggatttggttcttgagagggcacaagtacagtcggggagaggacacaacgggtgcatacccatggagaagtacagtttataa

SEQ ID NO: 28504 - DNA, 2178 bp, Glycine max
  Peptide Sequence Number=SeqID_145282
atgggtgcatgtttgagtaagaagaaagggtcttcttctacagcaaccaagtcagcttcttccacagcacatgttgctgtgcctgagctgaagaacaatcctccttctgttagtggtgtcactgtttccaaacccaaagtggaaactgaaactgccccagaagtgaaactgaacaaggacaattctaagaaagtggaagagaagcatgagacagtgccagaacctgaagggcatgtgaaaaaggagatattcatcatcaagcacaggaagagccatgatgatagagagagaaactccaattccaaatccccatctttcactgaagaatcaatggctgataaaactgccccaacaccatccacaaacatgggtgttgtaggagtgaggacttcaagctgcaccaaagaagaggtggatgcaattctcatccagtgtgggagactcagcagaagctcttcagggaatgctgctgctgctgcttctggtgaacacagaagaaggtactcaggctcaaagagaagctatgattttgaccactgtgacaatgacaccgtttccaatgatgatgactcaaagaaggccaatgccaatgagagcaacagtgatctgtgtgaggaggagaggcaccagcaacggccacggcaacgccagtctccgagccgaaggccttcttcttctcaggaaaggagaagaagaacaccaagcagggaaagggaacagcagcaaaggtcaagcagcagggagaggagagtgagtagatctcctggaagaaggtcatcagagaacaccacaccttccaatgcaagaaacaacaattgcagcaacactagttctaggcctgggaagatggtttctgttcctgccactgtttcatcactggtgatggataagagtaacaataatggtggtggtggcggtggtggagaatctggagcaaccactggcatcaagaggatcacagtgaagagaaatgtgggtgctgcctctccgcggtcgcagtcgccagcaagagcaaatgggaatgctgcaagtggtaataaagctttcaatgagaatcagcagcagccatcccttagccgcagcaattcaaggaaagcagaacaatcaccttacaaaagaaatccattgagtgagattgaacctaactcccttgcttttccacattcaacagccaataatagcagcagcaaggtgcaaaacagacccaaaaaggaatttgaaacagaagctaatcagaaaacaaacggcagcagaactgcattggacaagggaatgaatgtaaattgcaagacaaaggtgcaacaagaggaagatgtgaaagtgcagtcttcaattactgataatgttgttgtgaaaacaatggtaccaccaggagttgacaacctaaaaccaccctatacattaacaagaagcagatcttcgaggcaatcgcgggacttagacctcaaccctgaagctctattgaatcctccacagtcctatgcttcactgctgcttgaagacatccagaatttccatcagaagaacacaccacctgtttctctcccagcatgtgtcaccaaagcttgctctatcctcgaagctgttgctgatctcaactctaacgccggcttaaatttctgcggtgcagaagacaggagaagtccactggcttttcagtgtagcaggaatgactacaatgtttcattgactacccacgattatggaaaaagggagccagatgccgaggacccggttgtagaatcaatgttattattcaatgatgatgatgtgatggaacaaagcttgcacaagtatgtgacagtgaataggggtggtttgcttggtggggtggacatggatgaccaagagtcttcgggaagcaacagcttcactgtcagtagtggtcaacagcgctggggtgtttcttcttcatcatgggaaccaagttctgttgaatcaaaagattgctggacttcaagatcgaactactccaaagaggaaggccagaaattgggcttggaagggagggtggcatctgaagcggggcttgacgcaggtgaagccaagaagaaattgaacagccaaaggagagagtgtgatcatcatcagcatgggagtggaatagggcatggcaggcttggcgccaataaagttcttcacaacagacctgttgttacagcagctgcatccacatag

SEQ ID NO: 28505 - DNA, 1044 bp, Glycine max
  Peptide Sequence Number=SeqID_145283
atgcatgctgggaatacagtgcaggagaagctgatagtaaagcattttgctagtatttcttcttcgaatactcaagaagcgacgtcaactggagttaacccacaattatcaccatcttcaactatagggtcacctctcttctggattggtgttggtgttgggctttctgcactgttttcagtggtagcttcaagattaaaggtgaatgccactttattgcaaggcattgatataagctggactgggagcatgcatcaagaggctgagattaagcctacaaagaaagtcttacaaaaatatgcaatgcaacaagctttcaagaccatgatgggccagatgaattcacaaaataaccaatttggcaatgctgccttttctccgggatctccttttccctttccaatgcctacagcagcagggcccactgcacctgctagttctgcaactactcaatctcgagcaccttcagcatctagtgcatctcaatccactatcacagtagatatacctgcagcaaaagtagaagttgctccaactactaatgttaaagatgaagtcgaagtaaagaatgaacccaaaaaaattgcttttgtagatgtttctccagaagaaactgtgcaggagagtccttttgaaagttttaaagatgatgaatcaagttccgtcaaggaagctcgggttccagatgaagtttctcaaaatggagccccctctaaccaaggttttggtgattttcctggttctcaatctacaaaaaaatcagtcttgtcagtggatgctttggagaaaatgatggaggacccaacagtgcagaagatgaagtctaatcttagaactgctgatgacagtagtactggtatctgtgatgttcagaattggggtttaaactatttacccgaggagatgaggaaccctactaccttcaaatggatgctgcagaatccacagtaccgtcaacaacttgaagaaatgctgctcccagccctccctctaacctatgagggtggaaatgcctgttcttacctccagacttcgttgttttaa

SEQ ID NO: 28506 - DNA, 1017 bp, Glycine max
  Peptide Sequence Number=SeqID_145284
atggaaactggaggtgataacaaagaaacaggtaaacatgatttgcatcagacatctcaatcaaaggaacaagaacatgaaatcacaaataatagccatttggacgacaaagctcatccttcatcatcaacaccaccatcccaaaacccttctgatgcatcagaatcatcacagaacaaatcatctaaatgtgagactatccccacaaacgttgaatcacatacaccaacaaaatctggtgaagatgatgatgttcaaaatagttctattattccaaaacatgaacatggtgaggtggcagtaacggaagacaaccaaggatcatcagaaatacaaaaccctccggtgcaagtgatggagcgtccgggtgaatcaggaacctctcctcagtacgtttttccatcccatgtcttctctaaaagcaacgcaaactccacagtggaatggagcactgcctctaatgaatcactgttcagcattcacatgggaaacatgagcttctcaagtgaattggtttgttttaaatccggtgagttggataagtctggtgatgtgtccatgcatgatcatcagcctataataaacgcttcaccaccaactcagcagccagatgctccaccagcagagaacaaattcaatgatatcagcaaaataacttatgaactacaattgctacacgaaaaaagttcgaaagctactgaagcaaaagctgctgagactatgagagaggttataatggaaagtagtcgaaccacagagaatgttggtaaaggggatgataaggcttccaattcctgtcgccaatcaaatggcagcaccaattcctactcgtttcaatcgtcgaaaggtcgagataaaagtgtttcatccaagggtgctgctggagagaagcaaaatcaacagaagcagtcagaggaagatgaaacaccaaatgcagctgatcaggccccgaaatcatccacaaatgcaccaaataaatggctgaattgcttttcgtgctttacgtgctgtaattag

SEQ ID NO: 28507 - DNA, 927 bp, Glycine max
  Peptide Sequence Number=SeqID_145285
atggctttctttggtagaattgggaatttgttacgacagacagcgagcaggcaggctatacgctgtatgtcatctgccccaagcacaaaactgtttattggaggtgtttcatattctactgacgagcaaagcttgagggaagctttttcaaaatatggtgaagttgttgatgctcggataattatggatcgtgaaactggtagatccagaggatttggctttattacatacacttcggttgaggaggcatcaagtgccattcaggccttggatggtcagttctcagttggggatgatgaggttgtgatggcccatcaggctcatgcaatattaagtatccagtttagtgcccggtacttattacatgtctaccttgttaggataattctcagtaactttcctgtgatgtatgggaatgatcttcatggtcgcccaattagggtgaattatgctaatgaaagacctcgtggatatggtggtggtggcggcggctttggttcatatggtgctgtaggtggcggtggttatgaaggtggtggtggcagcggttatcgtggaaatgtttctgatggttatggtggtggcaactatagtcgaaatgatgggggtggttatggatatggtgcaggcagttatggatcaggcggcaattatggggacagtggccctggcaataactactcgggaggctatagtggtagtaacagtggacattttggtgatgccggtagtgtaggcaatcatgaaagctctactggttttgccggtaatggatatgatggaagtgtcgtggatggcggtgttggtgcagggtcggaatttggcagcagtggccaattagatagcaaaacaagcagcaatggagatgagggttttggggattacagggatgacaacgatgcagataattttgccaagagggcttga

SEQ ID NO: 28508 - DNA, 1839 bp, Glycine max
  Peptide Sequence Number=SeqID_145286
atggccgccaaaacggtaacccctgacgccgtttcgatgctcctggcaaacacttgccccgattcctcatcggatctccccgaaatcgttgttcaagttctcgatctcaaggcgacaggcaataaatacatgtttactgctaatgatggaaaaacgaaactgaaagctatgatttcttcggatatgtgctctcaggtgctctccggggctattcaaaacctaggtcttattcgcgtccttgattacactgtcaacgtaatacccaataaatcggacaaatacctcattgtcactaaatgtgaacctgtatctcctgcgcttgaaattgagataaagagtgaggaatctggatctgggattcttttgaagtccaaggtagagggtggagtcaatactgaaggtcctgctgctgctgggattcttctcaagcccaaacaagtagtgacaaaatctgccaatcagattctacgcgaacatggaaattcggctcctgctgcacgaatggcaatgacgcgtagagtgcgtcctcttgtttccttaaacccttatcagggtaattggacaataaaggttagcgttacgagcaaagggaacatgcgtaactataaaaatgctaggggtgatggttgtgtcttcaatgtcgaattgacggatgaagatggtactcagattcaggcaaccatgtttaataatgctgcgaggaaattttatgacaaatttattctgggaagggtttactacatttcaaaggggactttgaaagttgctaacaagcagttcaaaaccgtgcaaaatgattatgaaatgacgcttaatgagaattctgaggtggaagaggtagccggtgaagcaagttttgttcccgaaacgaagttcaactttgtgcagattgatcagctgggtcctcatgtaaataagtccgagcttgtcgatgtcattgggattgttaagaatgtgtcttcaacaatgaccattcgtaggaagagcgacaatgagagtattccaaagcgtgacattactattgctgatgacaccaagaagacagtagttgtgtccttgtggaatgaacttgcaactaccacaggacaagagttactggacattgttgataaatctccagttgttgcaatcaaatctctcaaggttggggacttccaaggcaaaagtgtggttctggtaaatccagtcatacccgaagcaaaaaatctcagaagctggtatgattttgaaggcaaggatgctgcaatggactctgtaggctctggttcaagtccaacatctaacaatgggattagatcagtgtacactgatcgtgttttactttctgacataacctcaaacccatcattgggggatggcaagcccgcatttttcagtcttagaggacatataagcttcataaagcctgatcaggcaatgtggtatcgtgcctgtaagacatgcaataagaaagttactgaaagcgttggttctggatatttgtgcgatggatgccagaaaagcgatgagcagtgcagtttaaggtatattatggttgccaaggtttctgatgcaagcgctgagacttatatctctgcctttaatcaggaagctgagaagatcattggatgctctgctgatgatctagataaccttaaatcacaagagggagaagttaatccttatcagatgacattgaaggaagctacttgggctcaacatctttttcgggtaagtgttactccgaacgagtataatggcgagaagagacaaaggataacagttcgggcagttgttcctgttgacttcgctgctgagtcaaggtttctgctggaagatttatcaaagatgagagcataa

SEQ ID NO: 28509 - DNA, 1374 bp, Glycine max
  Peptide Sequence Number=SeqID_145287
atggcacaaacacaaacccagagaccctgttcaagcgtcctcgattctctgggggaagaaattgtgagaatcgtcgcacccgtttcaatatgcatgttcctggtcgtaatcctggtctcaattctcaacaccgattcttctctcttcgtcgcatcgatgagcatggtcaccatcgcgtacaacgaaacaacctcggactccacctgggacaagttcctaggagcccttctgaactccttagccttcgtcgtccttgtcaccttcgcaaccttcgtcttggtcctcctcttctacttccgatgcaccaggttcttaaaactctacatggctttctccactttcatcgtgttgttattcctcggcggcgaagtctcgatctttttgatccaaaagtttagtactcccattgattgcatcacgttcttccttgttctgtgtaatttcgctgttgtgggtgttttgacagtgtttatttcgaaaatggcgattcttgtgacgcaggggtatttggttgttgttggaatattggttgcttattcgtttactatgttgcctgagtggaccacgtgggccctacttgttgctatggcgttgtatgatcttgctgcggttttgttgccaattgggccgttaaggattttggtagagcttgcaatttcaagggatgaggaaattccggcattggtttatgaggctaggccggtgaagcatggtagtttggatcctagggaagtcgcgcagaggcggttgtggagagaaaggagggttcagagtttgaatgctaacaactcagtgttggctcatggccccaataatgctgaatcacactctgattcgggtgcgaacgctggcgataactgggatggcgcaaacttggttagggaaaacgcgtctttgaattcgaatttgaatgctgatagttctggtggctcctatggttatggaaatttggtgagtgtggaagagggatggctgcgagttcaagagactgattcggacctttctgcacccttgatggatcgtggaatgaatgtccagctcggtaggggggaagatactgtgtcgattgataacttgatgctagagggaattggattggcttcttctggttcaatcaagttagggctgggagattttatcttctatagtgttttggttggcagggcggcaatgtatgattatatgacggtgtatgcgtgctatcttgctatcattgcgggtcttggcataaccttgatgcttttggctttttatcagaaagctttgcctgctcttcccgtgtcagtcggaatgggcgtgttgttttatttcttgaccaggcttttacttgaagtatttgtagtacaatgttccttaaatctcctgttgttctaa

SEQ ID NO: 28510 - DNA, 588 bp, Glycine max
  Peptide Sequence Number=SeqID_145288
atgtttggaagtggaattagaagcaagggagttataaaattcttgcagcctgaccctgattttgtagcagaatttgctcaaggtgagttgcaaactgatgtgattgctgggaaagattttgtccattcagaactaaatgaggatgacagtgacactgtggttcctttatccaatccagactcgagggatgtgtacaggagcttgagattgccctcgaaaatagccagaggaaattacggcttatggaatctgagcatgagagtcatccccttgactaaagatgactgtgagcctattactgaacctggtgcttacattgacacctcttatgaagaaataataaagatagatgacttcgaagaaaactcaccatcaagcatccatatttctgactacaaagtagattcacattcacatgatttgcatgcactaggggttcaaaattgtggagcaaatgatctcctaactcattctactgttaatgaagagagactgtcaagggaactctcttctggtgaggtcacaatgttggaagggctaagctctagcaattatgaattaaatgatgttactggagatgaaaactga

SEQ ID NO: 28511 - DNA, 174 bp, Glycine max
  Peptide Sequence Number=SeqID_145289
atgaaaggcatacatcccaagtggagaaaaaatacaattgaagacaaatggtatggatattatgaaattttcggtgactctcgctcagatcgacaaaaacgaaaaaaagagaatgcggaggaaaaagaaaaaggtgaagggattctgaaaagtaaaaaaggccttactgggtaa

SEQ ID NO: 28512 - DNA, 153 bp, Glycine max
  Peptide Sequence Number=SeqID_145290
atggatcatatgctagagtattgttcttcaatggcctgtagagagaatgttatggtgcttagagtaaaatccaatttgattgaagatggcttccagctaacttccacagctttaccttttagaggattacgagatgttttgcttgtgtcttaa

SEQ ID NO: 28513 - DNA, 288 bp, Glycine max
  Peptide Sequence Number=SeqID_145291
atggggctttcaactaacagaaaattcttttggcaccagattataaccaatggaaagtacaggagctgtgagcatagggcaatcactaatcctgatagagcaaggctctctgtggcaacatttcatgaccctgctaagacagtcaagatttcccctgcttctgaactgataaacgactcatcactagctaaataccgtgatgttgtttatggagactatgtatcatcatggtataccaaaggccctggaggaaaacgaaatattgatgcacttttgctggatccttaa

SEQ ID NO: 28514 - DNA, 1185 bp, Glycine max
  Peptide Sequence Number=SeqID_145292
atgcaaggactttgtatccacttcccagcaaaggtggtaatgggagtaggaagcccctacaaacttttcgcccttataacattgctcatcgcggttcaaacggagagcttcctgaagaaacgcgtcctgcatacttggcaaaatgtagatgacatgatgaatatcattgtcatctttggcttatgctttctcaaaaacgaatctttcttgcagagagctattgaggagggtgcagacttcattgaaactgatgtcttatcttccaaagatggtgttcttatatgtttccatgatgttacccttgatgatactactgacattgcaaatcacacagggtttgctaaccgtaaaagaacatatgaagtccaagggataaacatgactggcttttttcctgttgatttcacattaaaggaactaaagtcattgagggtgaagcagaggtatagcttcagggaccaacaatttaatggaaaatttcaaatcatcacttttgaagagttcattaccatagcacaggatgcacccagagttgttggaatatatccagagataaaaaatccagtatttatcaatcaacaagttaaatggtcacatggcaaaagatttgaggacaagtttgtggagacacttcagaaatatgggtacaagggttcctacctgtcaaaagattggttgagacaacctgtatttattcagtcatttgctccaacttcactcgtgtatatatcaaacaaaacggacttgcccaagattttcttaattgatgatgttattgttccaacgcaagacactaatcagtcattttgggagattacatctgatgaatacctagactacataaagcaatatgttgtgggaattggaccttggaaggacacagtggtacctgtggtagaaaattatatgacaaatcctactaatcttgttgccagggcacatgctcataacctgcaggtgcatccatatacttaccgaaatgagttcccatttttgcacttcaacttcagtcaagatccgtatatggagtatgattactggatcaacaagataggcgttgatggtctctttacagacttcactggtagtcttcatcgttatcaggaatggacctctaaccataaagatgatgatgacaagaatctattgcataaaattgctttgttagtctcctcttatgaatga

SEQ ID NO: 28515 - DNA, 633 bp, Glycine max
  Peptide Sequence Number=SeqID_145293
atgtcatggaagagaaaaaccagcatctgcggccaaatagtccatagcaatatccactctctccaggaaggaaagattcaactcaatgaaaaaatcataaagatcagtgtcacgaaacaaacacctcaaactaacacagcccctgaaaagatcaagctcctcttcctccccgcactcgaaccgacaatcgaaaaggcacaatctttcgagagaaacgaaatcaaaggttgttggggtctcggtggatatgtctgcaaacttgagggtggtgagggattgacagatagagagttgaggaagcttctctacgacgcattcagtgaggatgctgagaatctggatgctggtggagatggtgggtgtgagggtaacatagtcaatgatggaatctacaacatgcccatcatcatcgagttcatcgtggcacgtgaagttgagggcgtggacgttggtggaagcgtctctgagggagaggaagtggtcgacgaaagagtggaaaaggagagggtcgtggaacttgaggactgggagggaagtccaaaggtaaatgaatcgcttactcaaaacgctcgtttgaaccgcagaaactgcgtccagaaagtaaagtacgcggtcgatgatgtcgtccggtaa

SEQ ID NO: 28516 - DNA, 144 bp, Glycine max
  Peptide Sequence Number=SeqID_145294
atgaataagacttgtgcaatgggctatggctattcagtgttgtttaggttttacttaattataaagaaattgctgcgtgctgctggattgtttgcaggatcaatattacttatgcgaaactatggtgaccttatggcaatttga

SEQ ID NO: 28517 - DNA, 1595 bp, Glycine max
  Peptide Sequence Number=SeqID_145295
atgctcatgaaagtttccctgattttggtcctcctttcaattttctgtgtcactttcaaaccatacactgaagttgatgttcaaaatgatcacaacaatgatccaactctcgccaacaaagaattttgcaagaaagccaaaagttcagaatcaactagattaaacaaggaagaagatggagatgatgctatatcagcaaagcctcacaaaaggtcagcaaagtttcacctaaaacgcaggccaatcaatcatgggaatgagcctaaaacacacgcactggactcagcactcagggatttggtcagaattcagactcttcatagaaaagtcatagagaaaaaggacacaaaaagcatgtcatggaagcaagaagtcaaggttatcaccatccagcagcagaacaaccttgctaatgctgttgtagcatcattgaaatcttctaaagatgagttttcaggtaacatcatggcaaccttggaatctggggcctctcttggcacaggagagtacttcatagacatgtttgtaggtacacctcctaaacatgtttggttgatacttgacactggcagtgacctcagttggattcaatgtgatccttgttatgattgttttgaacaaaacggaccccattataatcccaatgagtctagttcttataggaacataagctgctatgatccccggtgtcaattggtttcttcaccggaccctcttcagcattgcaagactgaaaaccaaacatgtccttacttctatgactatgcagatggttcaaacacaacaggagattttgcattagaaacatttactgtgaacctcacctggcctaatgggaaagaaaagtttaaacatgtggtggatgtgatgtttggttgtggccattggaacaaaggcttttttcatggggctggtggattgctaggacttgggagaggacctctctcctttccctcacagcttcaatctatttatggtcactcattttcttattgtctcactgaccttttcagcaacacaagtgttagcagcaaattgatctttggtgaggacaaggagctattgaaccaccacaacttgaactttactaaattgcttgcaggagaagaaactccagatgatacattttactatctccagataaagtccatcgtggtaggtggggaagtgcttgatattcctgaaaaaacttggcattggtcatcagaaggtgttggtggtacaattattgattctggctctaccttgacctttttccctgattcagcttatgatgttatcaaagaagcctttgagaagaaaattaaactgcaacaaattgctgcagatgattttattatgtctccatgttacaatgtgtcaggggcaatgcaagtggagctaccggactatgggattcattttgcagatggggctgtgtggaatttcccagcagagaactatttctaccaatatgaacctgatgaagttatttgtttggcaattctgaagacacctaatcattctcatctcacaatcattggaaacttactacaacagaattttcacattctgtatgatgtaaaaaggtctaggctgggatattctcccaggag

SEQ ID NO: 28518 - DNA, 705 bp, Glycine max
  Peptide Sequence Number=SeqID_145296
atggcttcacctttctcttcttggatttcaatggaggagggattttattctaagaaaccatacacatacactaactctgagcatatagaccttactctcaagctttctccctgcggtcaaaatgcagaagaagaagaagaagaagaagaagaagaagaagaaaagatggttgagaagggtctggtgaggtttggggacttgcagacaatgagaagagtgaagacttggaagagattattgatgaagaagatgcgaatggctgcggcgaaggaggcagagaagtctcttccggtgtctccgggcggtggtgctcagactctacctcactcaatttataacagtctcaagacatttgcaaatccttgtggggatgcatggcatgagggagcaatgcaggaaatgacactgtggccctctgagactatgattgagaatgagaggccagccaaaaagcttaagcatgtgaattcctatcaagaaagtgatgcaatgcctagtgtgattactactggagatggcaccattactgggaagagaacagtttgtattgtatgtgtctgccatggcagcttcccctccccaacagaattcgtgatgcatgctggtggtaaggaagtggcagatcccatgaaacacatcactgtttgttctgattcatttggtatcaatggagatggggctgcttttatcacacaccccttttag

SEQ ID NO: 28519 - DNA, 510 bp, Glycine max
  Peptide Sequence Number=SeqID_145297
atggcgaaatcggcgtcgaattctctgatgcagagcctgaagcggttcataaagaagccatgggagatcacgggcccgtgcgcggaccctgagtacaaatccgcattgcccttggccgtggagtaccgcctcagctgccccgccaccgtcaaggagaagcccatcatccccaactccctcccggagaccgtctacgacatcaagtacttcacccgcgaccagcgccgcaaccgccctcccatacgacgcaccgtcttgaagaagcccgacgtcgagaagctcatgaaggaacagaccttcgccgtctccgactttccgcccgtttatctcaattccgccgttgaggaggacatcaacgctcgcggcggcggataccaattaacctttggaggtaaggttttaaatatcggtcgcggtcgcattcgcattccggtttcgttgcgtttgttgatattgcggacaaatgcgatcacggtcgcgttgcggtcagggacagttaagaaaccttga

SEQ ID NO: 28520 - DNA, 1014 bp, Glycine max
  Peptide Sequence Number=SeqID_145298
atgtggggtaggtggtgctggtgtgctggtggcggttttctgaggcaaagggtatcttcaattggtagtgttacttcaattggtagttttagccatggttatggagaaaagcttcaccctttggaccctcctttgttgggtttgaggggtgttgttgaagtgatgtgtggtggaagaagaggtggtggtggaggggcacctttatctgttgtgttgaaccaaatcaagaggggtgtatcaacttccactggggatggtgatgtcagcaatggcaataatggaacaacagaagattctatatcattctctgaagccaagaagcttatgagattggtgaatgtggagtcactcaagatgaagcttggtatggaagggaaggaagttatttgctattctgagcttcttgaggcctgtgaaagtatggggattgcgaggagtcctgaggaggctgcagcatttgccagggttcttgatgaggctggggttgttctcctctttcgggacaaagtttatttgcatcctgataaggtagtggatctggttcgaagagccgttccactggcactgactgctgataacgatcctatgagggaggagttgaagaaactgcaggacaagaaagaggaaattgatgtgttagcacataagcaggtgcggcgcatcctctggtctggactgggatttggtgtaatcactgttggcttcttcttccggctaacattctgggaattttcatgggatgtaatggaacctattgcattttttaccacaaccactgggttggtcataggctatgcctatttcttattcacttcaagagaccctacttaccaagacttcatgaagaggctctttctttcaaggcagaggaagctttttaagaggcaaaattttgacattgagagattcaaggagctccagtgcaagtgcaagacacctttacatgctagtaccgttttaaaaaatcgcataggggtggaactggatcttgaagatgctttacatagagattaa

SEQ ID NO: 28521 - DNA, 1488 bp, Glycine max
  Peptide Sequence Number=SeqID_145299
atggcaatgccggagacaatccctcccactactcccagtgctcaagttgtcggcaatgcctttgtggagcaatattatcacattctgcatcaatccccagaattggtgcacagattttatcaggattcaagtttcttaaccagatcagacagcaatggtgtgatgacaactgtgacaactgtacaagaaatccatgaaaagattatttccctgaaatatgaagattatacagcagaaataaaaactgcagacgctcaggagtcacataagggaggtgtgatagttttagtaactggatgcttaactgggaaggataatgtgagaaggaagttctcacagacattctttctggctccacaagaaaaaggatattatgtcttaaatgacgtctttaggttcattgaggagaatgacacacctcagataaattcttcctcagtaagtgtcatcaatgaaaatgctgaagcagtgcatgagccagaatcagaggatctgcatgctcccaaacatctcgtggaagacaatgcaactttggcagagggtgagaaccttaataatggtgctgaagtttatcatcctcaggatgaggaagaaggatcagttattgatgaagaggttgctgaaccccctacagatttaagtcagaatgatattgttactgttgatgattcaacttctgctgtcctggatgatgcaccaaggagatcatatgcagccattgtcatgaaaagtcatgtagcatctggtcatgtctatgttcccagccgagctgcaagaatagcatctgctaaatccagtgaacaatggcctactactgccaaatcaacccctgtgcctgaggcattagctcctagtagtgatagtgcacctgggagcagtgatgttcatgaagaagctgaaggtcactccatatacatccggaacttgccatttaatgcaacagttgaacaacttgaagaagtctttaagaaatttggtcctattaagcatggtggtatccaagttagaagtagcaagcacggattctgttttggatttgttgaatttgaagaattgagttccatgcacagtgcacttgagtggtaccgattagcattagcttgtagcaatgttgcctgtatttcccaaggttcagcttctgattggagcagttctggggctggaatgttcaggaaaagaatatgttctgcatcttttgctcataaaaaattgtgcctgcttctaaactggaaggcttcacctatcactgttggtgagcgacaagctgttgttgaggaaaagagaactaccacacgagcggtagtgggagagggaggcactcaggaagaggtagtttccgaagcgacagtttcagagcacgtgggaaatttggtggtggacggggttatggcagaaatgaattcagaaaccaaggagaattctcagggcaacctaggagttctcaacggccaaatcaaaatggaggtggacggggcggtggacgtcaag

SEQ ID NO: 28522 - DNA, 2490 bp, Glycine max
  Peptide Sequence Number=SeqID_145300
atgtatgaatatatatatatccagcatcagcgagtaacgagaagacgagttttctctgacagacacgtaacggatccttgtaatattccgaagaagctaaaaaagggttctctcaccaacaaccctcagttgccgctccctttctctcacagttgcgtaccatcaccaccagtcgccatcgcctccgcactccgcaccgccgtcgccgacgtcgtacgcacttcgcaccaacctcggcctccttctttctctcatcctgctaaaaattttcacgctggtctctcgtggaagtgtaagcaagcatcccaaaaccccagccgcttgctttcttcgttcgtttcttacatcagtgctgctgaggttatggaacgtcagggtcatgattatgcagctgcatctgctatggcatatgctcagcaacagcgacaagctgctaatatgcaacaacagcagcagtttggatttcatccccagcatcagcaatttccttcatcaatgcacggtcctccttttataccctcaggtcctggtcctggtcctggtcctgcacccccccctatgcaacagttcccttatcatcctgccctacagcagcagcaacagcaacagcaacagccacttccacaattacaccctcatgcccctcccccgcctcatcttcttcttcagcagcagcagcaccaaggaccgcccacgttcccttcacattatcctcctccgcttgttccatcaccattttatgattctgctcctgctccacccccggttgctcccccttctgatcctgagctccacaagagaattgacaagcttgttgagtatgcagtgaaaaatggccctgactttgaagctatgatatgtgaaaagcaacgggataatccttcctatagtttcctctttggtggggaaggccatggttactaccgttataagctttggttatcaactcgtcccccgggtggtccattcaacccgtcttttccatcatcttccatgcccatgatgcatcctccaaatccaatgatgaatctgtctcctctaaatgcttctccaatgaaccctgcaggaattggttcttcaccttcgatgctaggtccacctcatttccaacagttctatgatcaacaacaccaccatcaacatcctcagtcttttggacttcctggtcggcctgagtatgatccgtcatccaagtctttcaaaggggtctttgggccacttccatctgatgttgcaatggagctcagtaatgtccttaacaatctgaatggtacaaaagaatccatcaaaggtgcaaaactttggttcatgcagagatctccatttgcaccagccctagcagaggctcttagagatagggtctttgcattggatgaagttgagagacaattacacataatataccttgccaatgacatactttttgacagcttaaatcggaggacaagcagtaatgaccttgacaatgaagctcttgcctttaaacctgttttaggctccatgcttgcaagaatttatcataatccacaaagcaatgaggaatacaggaaaagaatgcagcaaatggtggagttctggtcttctaagaaggtatacgatcaagagactatatctttactgaaaggtgagatgattggtgggccacaatcaacttcttttcctggggcttcaaaggatttatcttctgcttcagcagagtcaggttcaggaatactgcagacacctaatcatgttgcccagcagtggcaaactgataggttaggtgctggttcaagtgccttggatcaagatcgtcttgataaattggcagcttcagcacagtcactatcagtacccctagcagctcagcagtttcttccaagttctgctcctcccggtgcctttcctgggtcaatggctataccatcttctgttcaatcagctaaccaagcacctggtgctcatttattgccccctccatcatccaacaccagtgaacaattgccaccatatccattattcccacctggcctcattccgggaatggttaaaaagatgcagattggtagcggggtcccatattctcctttgagccctttggatatcccaactataataccaccatcgactgtaccaccatcagaaattcttcaaagagtgtcaaatttttttaaagaaattggagaggtaaatccttctgagggccctatgaattcagattcaagagatgatgatgaatatgatagagaatatgagagggagcctccagtacgaaagggaggtgcttgcatacctccacccccaaccttgcaggttgatccagagacgggaacctatgctgatgggactgtagaaaggaaaccaggatccagtggctcaggcaggttggggcttggggccacagccaatcccaatgaggtgagtcagtatgatgatgtatatacatcttacaggaagcagagaagcaccaattaccattcatcaatgagtgctagagccgccacaagatga

SEQ ID NO: 28523 - DNA, 3306 bp, Glycine max
  Peptide Sequence Number=SeqID_145301
atgtggagacctgctccattgacttgtagttgtcttatgaaccgtgtcctggaattaacttctgagtgtaaaggaagagaaaggagcttcctttatatctttaagcacaatttggatgagaagttgagtttaattggagaagaagaggtagatatggcagcaaagctattgcattctttagcagatgacaacccagatttgcaaaagcagataggatgcatgactggggttttccaactctttgatcgtcaccatattattcctcctcgccacattacccagaagatgcttcctccaggtaattcccactccaattatgacaacctggaaagaggttctaatagaatacaccaaagacaatcagcagctgatataaggggtgtgagtgaaaaacaaagaatttcaacggaatcatcaagaacctcattctcttcttcttgttcatcatcaatgtcctctttggagtataaagctcaagcaggcgctcccttcaaccggaatggttatcctaaaagtcctatgagggagccagttatgaaccaaacaagttcctctcccgatttaagatgtcagtcccttgatctgagggatgtggcgaaggactctatgtatagggaggccagaggactatctaaagaaaaggattccccaacacattttcagctgtccaaatccatcaaaggaaaacaaactcctattcatctaagggagtctctgagagtccttgctaaacttagagaagcacctcggcattatgttgaagctaaagaacttccaagattatcatatgaagtaaaaggacattggcattccatctcaaaggatgctcctcggttttcttatgatggaagagaaacaagtggtacatctttcgaatcacatgattcctttaaatgcccaccaaagctaaaagagcttgctagacattcacttgacagtagggaaggttcttggcgtgcatatggctctgattcaaaatccagtaacccctcaagaaatttcaatgcaggtgatgcctctacctcagttgacaacgtttctagtcgacaacaaccgtcagcatcccagagccggccacctagtgttgtagcaaaattaatgggcttggaagctttgccagaatcctataatgccagtgatactaactttagtttgagtgaaactggctcagctcaaggcaatgatcagtttttgaaaaatggactcgtcaagccacttcgagttcataattctcctaaaatctcattgaaagacacgacttcccctcgatggaagaatcctgacttggctgtgaaaccaatcttaagttcaaggtttcccattgaaccagcaccatggaagcagcaggatggaaaccaaagctctgagaaactaacttcccgggccataaaagctactgcaagatcaccagattcatttccatcagtttattgtgagattgaaaagagattgaaggatcttgaatttaaacaatctggaagggatctcagagctctcaaacggatactggaagcaatgcaagtaaaggggctgttagagaccagagaagaagaacaagctttaaatgttggaaataaaagagactatgaactaaatccgagtcttattcagcattctatatcagtgaggcaacaaacagccagggaaactgaatctgtaaaggctatagaatcaccaattgtgatcatgaaaccaggaaaacttattgagaaaagtggaatttctgcttcttcagtctttccaattggtgaactctctgattcccataaacttcggagtggtggtgtacatgcacatgataaaagggggacagcttccaatcaaatagcaaaagatcagtctcttagaaacagtcactggaatgctcctaccagttttagtgaaaagaaagaaaacagtatcaggactattaaatcagcacaatcccaaccaaggtctaaacaacttccaaaagaaaatagtccaagttcagtaaagaattcgggatctgttagcctgagaatgcaacagaagaagttagagtctgagaagcaatctaacctgcctaccccaccatccgattcaaataatcccagaaggcagtcctttaagcagccaacagaatcaggttctcccagtcaaaaactgagacctaaagttgctagttcacggtactgtgatgaccgacttagtgagactagcaatgaattgagaagtctaagtagtcagtgggatgaaatatctctgcaatcagacagtatcacagttgactcaaagatggatactgaagttaccagcagtttacaatctgctgaaattattgaaagccaatgctcatctatgaagcctattgagcatttggtttcaggatcaatgcataagaaatcaactctgaggtggaatgaggatgagtcaattgcagaacctgcaacatatgcctcagatcatccaagtcttgattcagtcgatgatgtctcggtatacaaatatgatatgccatccccagtaaagagtaaatccaatgctcctaaagctgataatgctcaagaaaataaagcaaatgataatacagatcagtggaaccctgcagatggtttcttcgttaacaacacgatcaactgcaagaaattgcaaagcatagattgtcttattcaaaagcttaggcagctaaattcgagtcatgatgaaactagaaacgattacatagcttccctttgtgaaaatacaaatccagaccacagatacattgctgaaatactattaacttcaggtctattattgagagctttgagttctgagttgctgacatttcaacatcactcatcaggtcatcccattaaccctgagttattccttgtgctggagcagaccaagttaagtagtttgctttcgaaagacaaaagcagatttggaaaagctgcttacatgaagctaaatacagagaagtggcagaggaaactcatctttgatgctgtgaatgagattcttggtgaaaaactaggctcttttcttgagccatgcttgaagcctaatgaactcgtagcaatgaaattcgtcagtgcacaaaagcttcttaaagaactttgctttgaggtacaaaaacttcaatatgtgaagccagattgtagcttagaagatgagggagatgaactgaaaagtatgctacgggaagatgtgatgtgtcactcagaaaactggacaggtttctcagttcaattacctggggttgtgttggatgctgagagacagatatttaaggacttaattgatgagcttgtgattgatgaaatggctagtttgcaagtgaaatccggtaggcacaggtag

SEQ ID NO: 28524 - DNA, 144 bp, Glycine max
  Peptide Sequence Number=SeqID_145302
atggtggtgagcaagattgtggattcaggccaatcacagggatacacttgtttcttgagaggaaatgttggcaacctaatgaagagtgcaaaggactatcaatctgtgatgacagaagaagaaattgtggacatggagtggtaa

SEQ ID NO: 28525 - DNA, 1287 bp, Glycine max
  Peptide Sequence Number=SeqID_145303
atgaggtgggaaaaggttgaggtgaaggcgataggcacaacaacagagggtggtggcggtggagggccagggaagaggtggggtcacacctgcaacgccgtcaaaggtggcagacttgtctatgtcttcggtggttacggcaaagataactgccagaccaaccaagttcatgtcttcgacactgtgaaacagacatggagccaacctgctttaaaaggctccccaccaactcctagggacagccatacaagcacagccgttggtgataatttgtttgtgtttgggggtacagatggaatgaaccctctcaaggatttgcacatattagacacttctttgcaaacatgggtttctccaaccataagaggagaagggccaccagcacgtgagggtcatagtgcagcagttgttggcaaacggctattcatctttggaggttgtggaaaatctgcagataataataatgagctctactacaatgatctttacatattaaatgcagagacatttgtttggaagtgtgctacaacatcaggcactccaccatctcctcgtgatagccacagttgttcatcttggagaaacaaaattattgtgataggaggtgaagatgggcatgattattatttgtctgacgtccatattcttgatactgatactctaatttggagggagctgagtacatcaggccaattgttgccacctcgagctggtcattccactgtttcttttggcaagaacttgtttgtttttggtggatttacagatgcccaaaacctctataatgacctttatatgctcgatattgatactggtgtttggacaaatgttacaactgcaaccaatggtccttctgctagattttctgtggctggtgactgtttagacccttttaggagtggtgttcttatattcatcggtggttgtaataaaagtcttgaggccctggatgatatgtattacctatatacagggattgctcgagaaagtgaacagagaccagaaaaattatctttaaagaagcaattgaaactgaaatgtctagaacaaaatcccaatcctagccaaaatcaagttctagttagatatggagtgggttctgatgtgggacagaccatgaaagtgttgaattatagccaacaaagtcttgctcttgcaactagtatgtatcagatcttagatatggagtgtagttatggcaagtcagtgatgactaaaataatgatccctctaaaagttttgattttaatcatttatgatcctggaggacaaaaagaattgaaatga

SEQ ID NO: 28526 - DNA, 390 bp, Glycine max
  Peptide Sequence Number=SeqID_145304
atggtgttaaccgaaatgccaaacattctaaatgatgtgtcaatacttgatttagtgtcagtacaatggttgattggcttcttgaacttttggcaccgaggagaggtgcgaagtgtgaggataaggatcttaccatggcatgtattccttggcctgtacacttatgcattggcaatagcaacagctgaaactggattattagagaaattaacattcttacaaactaaaagaaatgtacctaagcacagcaccgagtccatggtggtcaatagtttagggttgggtcttgccctcgttggtggctttgttattttggctgctgtttcacccaaatatcaaacccatcaaagcaaactttggtactcagaaacaaagtgtttatcatcttaa

SEQ ID NO: 28527 - DNA, 351 bp, Glycine max
  Peptide Sequence Number=SeqID_145305
atgaagaagcaaatacctgggctccaaagagggatacacaagccaaacccatccatgaatgtaggctatagaaatttgccacaatcccatctttgccctggaattttgtccaaatcccaaagatcccagaagctaaagccaccccttgaagccacaaatgcaccaatttctttaacccccttgatccagatgaggtcttgttgggagagtgaggtagtgaggaagctggatttgaaggcaagggcccatatgaggacaagcactgccactgcaagccctaagactcttgcaaagaagaggagagaaagtaggagagagggagagacactagtgtccataacaattcactag

SEQ ID NO: 28528 - DNA, 1179 bp, Glycine max
  Peptide Sequence Number=SeqID_145306
atgaacggcttaagaagtgaaagagcccctctcttggaggctgagcgtgctggaagaggaaagagggatggtgcctcggaaggtcaagcctcagaccttgagcatggtgatgcagtgccggcggcaaatgtgggattctgtagggtgctttcacttgcaaaacctgaggctggaaagttggtgatcggtactgtggctctgttgattgcagccacatcaagtatcttagttcaaaaatttggtgggaagataattgacattgtctctagggaaatgaaaactccagaggagaaagatgaagctttgaatgctgttaagaacaccatactagaaatctttctggtcgttgtcttcggttcaatttgcactgcacttcgagcttggcttttttatactgctagtgaaagggttgttgcacgactgagaaagaatttgttcagtcatcttgtaaaccaggcttgtacattatcgatgatgagttttcaggagatagccttctttgatgttactcgaactggggagcttttaagtaggctatctgaagatacacagatcataaagaatgctgcaactaccaatctttctgaggccctgagaaacttttcaactgcattaattggtctgagcttcatgtttgcaacatcatggaagttaacattgttggctttggctgttgtacctgttctttctgttgctgttcgcaagtttggccgttacctgcgtgaactttctcataaaactcaagctgcagctgcagttgcttcatcaatagctgaggaatcctttggtgcaataagaacagtaagatcatttgcccaagaagattatgaagtaacacgctactcagagaaagttaatgaaacacttaatcttggtcttaaacaagctaaaattgttggactcttttctggaggccttaatgctgcatctacactttcagtcattatagttgttatatatggagctaatttgacaatcaagggttccatgtcctcgggtgatcttacatctttcattctttatagtctctcagtgggttcttctatatctggtctgtcaggattgtatacagtagttatgaaagctgcaggtgctagcagaaggcattgctttacacctatacacatagtctacgatgtgcagacgaaggagtcttccttttggaatcttgtactatag

SEQ ID NO: 28529 - DNA, 432 bp, Glycine max
  Peptide Sequence Number=SeqID_145307
atgcaaagttggatagatgagttaaggttttctctccctattctgagatggtgcaaccaccgaatgatggaggaagcaaatctacgagacaaacatcgcccttgggtagtaagaaatttactaagggagaggatgatgaagcttaagcatgaaggagggaatcatttgctccctaagtttgttattgaaccaaaggaagaaattgagcttttcaatatcgcgagggagacgtttgagttgatgaatgatataaatggatgttttaagttttcagcttccgaatcaaaagtaggaaaggactttgtgaggcattgtacatcagtcagcaatgacaaaaaaattaacaaggagatagcggtgaaggcttggttgttagtcaatcaagaaggatacacagtccgcccgtcgaacgggaaggatacaatcctatga

SEQ ID NO: 28530 - DNA, 1416 bp, Glycine max
  Peptide Sequence Number=SeqID_145308
atggtgtctctgtggttatcaaccgctggatctgttgtccaccgtggtgacttctttaccatcttacttctgccactgctcttgtgcactacattcacttctacagtatgctcgctgagaattacgtcttccacttttcatggttgttcatatacagaagcctatgatgcacttgatccaattggcaatattacaatcaaatgggatgtcataagctggactccagacggctatattgctgttgttacaatgtacaactttcaacagtatcgccatattcaggctcctggatggatactaggttggacatgggcaaaaaaggaagtaatttggaatgtaatgggaggccaaaccacagagcaaggggactgttcaaggttcaaagggaacatccctcattgttgtaagaaggacccaaccgtagtggatttactgcccggaactccttacaaccagcagattgcaaattgttgctcagggggagtcttgacctcatgggcccaggaccctgaaaatgcaataagttcatttcaacttagtgttggttcagctggaacaaccaacaaaactgtcaaactgccaaaaaattttaccctcaaagcaccagggcctggttatacctgtggccctgccaagattgtgaaaccaactaaatttattactaaagacaagaggagaaccactcaggcattaatgacctggaatgttacctgcacatattctcaattcctggctcagaagaccccaacttgctgtgtttctctctcatccttctataacaatacagtagtaaactgccctacctgcacctgtggttgccaaaacaaaacagaacctggcagctgtgtagatcctaattccccacatttagcttcagttgtgtcaccaccaggcaaagctacaaatacacctctagtccggtgcacgaatcacatgtgtcctattcgagtgcattggcacgtgaagcttcaatataaagagtactggagggtcaagatcacaattacaaatttcaactatagaatgaactattcgcaatggaaccttgttgtgcagcacccgaactttgataatgtaacgcaggttttcagctttaatttcaagccactaacaccttatgtgggcttaaatgatactggtatgctgtggggagtcaagttctacaatgatttactcacttcagcaggaccccttgggaatgtgcagtctgaggtcttattccgaaaggacaaatcatccttcacatttgataagggatgggcttttccgcgaagaatttatttcaatggagataactgtgtaatgccaccgccggatgcctatccatggctgccaaatgcaagttcgaaactaattttctctttactgagtacactcctaggcactttagcttgtgtggcaatgttattgacttaa

SEQ ID NO: 28531 - DNA, 996 bp, Glycine max
  Peptide Sequence Number=SeqID_145309
atgctaacatcatcttttatccgaccagagatgcttccaagtggggtcatgtgttccgagaaatatggtatgagtgacttctggagacctatcaaagcagaacacgggactggttttaggaatctttcttctatggctgcaaccaatggacatcctctgccaagatctttattttcatcatataacggaaaacaatttccctttcttcatgaaaacagttctacatccaccacaggaagcatcttctgtgagagcaatagccactatccatctgcccttggggcccaaaattctggattgagaccactattccaggacactgtaggaaatgaggacttcagtgtttttgatacctcaccaaatgttcaaggattatcagggatttcagactcttgttgtgctctctctcttctgtcatctcaatcccagaactcttcaagccaatcatcaggaattcccttggctcactccttggttattccaagcagtcatagccatcactacaacatgagtcaggtctctgacaagataggaataagctcacagacttcttcaagccgagtgtcagatagttttccaccagaactaaatcatgccgatggaagccatctcagtcctgtattaatatcaggcaataatgatattataaactttgatatggcagatggtatcttccaaggttcagattacttgaatgtgaaagatcgtctttccgatgaagatggtgcaaccattgacttgctacaattgtcatcacagcttcagcgagttgagcatgagaggcaatccttgcagactagactacgttggcactttgctgcaggtcatggagacaaggtgaaggaaagagacattgttgctaacttcccctttgtgaagaaactagttgtgaagcatgtgaaagacacgcctatgccaatcatcttaagacaatgtaggccacaggggaatagaaacttcaaatggtgccattctgttgctaactatttacattag

SEQ ID NO: 28532 - DNA, 617 bp, Glycine max
  Peptide Sequence Number=SeqID_145310
atggaatcttggagctatatccctgaagaaaaggagtgtgtctccaatgaggcaccctcacctcccaacactctcgggaggagtaaaaattctttcttgggctgggaactcaaaaccccatgtggtttttccaccgacatgttgggtttgggtcaccacagcattgagaatcaaggtttcgaggaattggggtttcctgaaatgttgggaaaacacatgtccgatgatctagttgccagtgttccaaccagaaaggtggatggtaatagacaacaacaacaacaccacagtgacagaatcactggcactgttgtggatgccccaagtgggttttctcaaagaggggactcaaattccctcatcgatttgaagctgggtcgatttgctgagcatggagatttcactgatccagcgttttccaaagttctgtcttcttctgagtcatcaacgcctcctaagagagtgcgaacttcagggttacattctcagactgcatattgccaagtctatggctgcaacaaggatcttagctcctgtaaggactaccacaagaggcacaaggtgtgtgaggttcactccaagactgccattgttatagtcaatggcattgagcaaag

SEQ ID NO: 28533 - DNA, 478 bp, Glycine max
  Peptide Sequence Number=SeqID_145311
atggcagtattggtggttgagtttcagcagaaactggcacagatggctcaggagatgatgttgacgatacctgaaccacttcaacatccttatgaggtgcttgtgaaggctgagctgaagaaactatacttggtccaggctgcaataattgacctggggttaggagagaagggcaagcttgaacctgaaattgcatgcggtttgctggagatgggtggcactatagcatttatatctggaccagaaatggtcagtgatggcaagttagcagctaacatagctgctgaagttgaaacattgggtgccttatttgttactgatactggcaaattttcagaagcaagtgttgcagaaggtacgggagataaagcagaagatgcaggagatagagcagacggtgcaggaggcaaagctgatggagcaggaggtaaagcagaaggtgctggaggcaaattagatggaggcaaggaagcagatg

SEQ ID NO: 28534 - DNA, 966 bp, Glycine max
  Peptide Sequence Number=SeqID_145312
atggagttttcttgcaaggacttcaaggtgggaaaatgtgagggagaaaaagtagtagatggtgaaaccatgcccttggtgctacaacctccagtgcctaacaagagtgacttggaatccttgctattggctctgaagaacaacaaagaatggtttgagcaaatgatcatcaagaacagtgctgttctgcttagaggctttgatgtcaagaatgctgaggacttcaatgagattgtagaaacctttgagtgggaagacattcgttatgttggaccagcacctcgcacacatattcacaaaagggtgtggactgccaatgaaggacccctctcagagttcatctactatcaccatgaaatggttttgatcaaggaatatcccaagaaagtgatactcttttgtgagatacctccccctgaaggtggagagaccccttttgttccaagcttcaaagtgacagaaaagatgatggaggagttcccagaagaggtgaaggaaattgaagagaaagggttgaagtatacatttacagctcctagtgctaataatgtctcctccatgagaggtagagggtgggaagatacctttgggacctcagatcgcaaagaagccgagaaaagggcaaaagctctaggaatggacgtggagtggcttccaaatggtgggatcaagacaatacttggaccacgatgtttaaccaaggtatttgaaggaaggaaaggaagaaaaatgtggttcaacacagtagtagggatgcatggaaaagagattagctcggccataatggcagatggaacagagattccagaacatgtagtgaaaaggtgtgaagagatcattgaagaagagagcatacagttcaagtgggagaaaggggatgttctcttctttgataactatgctttgcttcatggcagaaggccttcacttcctccaaggaaagtccttgttgctacatgcaagtga

SEQ ID NO: 28535 - DNA, 150 bp, Glycine max
  Peptide Sequence Number=SeqID_145313
atggaagagagcaaaatgcagacaggttttcagagaaagagacagcagagatcacagatgcagaaggggacaccagcaagaaaagcatccgtgacagtcacaacactgagcgctttctataacaaaatgaaagggcagaacaatctctga

SEQ ID NO: 28536 - DNA, 207 bp, Glycine max
  Peptide Sequence Number=SeqID_145314
atggaagaaaacaaaacaaataagtggaagctaaagagggtgcgagagagagagagtttgggaatagtggaagatggaagtctcaagtgtgaagagaatatagtggcatggcatggaagatggaagatggaagttgaagaggttggaattgagagttgctatttttggagaaagacaatgagagtggacagctttccaccatgctag

SEQ ID NO: 28537 - DNA, 201 bp, Glycine max
  Peptide Sequence Number=SeqID_145315
atggcgtctgagagcgcttctcgatcgagttccgcggccgattcgtacattgggagcttgataagcttgacctctaagagtgagatcagatacgaaggcatactctacaacatcaacaccgaagagtccagtattggcctcagaaacgattgggtttgtctcagggatgtgaattcctgccatagggaaggaattttgtga

SEQ ID NO: 28538 - DNA, 404 bp, Glycine max
  Peptide Sequence Number=SeqID_145316
atggccgaatatgaagcatgcgccctggggattcaagcggccattgattttgattacatcgagaacaaagaatatccaccagggattttcgacaatgagaaaagaacgttaaggagattggctactggtttctttgtgagtggtaccatcctgtacaaacgaaaccacgacatgaccctcatgcgatgcgtagatgccaaagaggcgaactacatgattgagggaatccacgggggttcattggggacacatgccaatgggcatgctatggccaggaagatccttagagcaggggttgtaggggatggccttaggcctatgttgcatcctgaagcaatggggcatgccacgttgcccccactctcttgctattcatgcctaaacatgcgcccaccaaatgctcg

SEQ ID NO: 28539 - DNA, 360 bp, Glycine max
  Peptide Sequence Number=SeqID_145317
atggataacgaagagggagtgcaagaacagatgaaggccgacctatcagccttaaaagatcaaaatggtttctatcacggaggtttgcctccggacttcaatcccggcaccgctccagaagatttgagccaagcccctaccttcgaggggcagctccctcctcatgccggctatcctctgcaagaagatgatgaaggagatgcccatttaggccctctacttcccctcaaggatccagccccccatgagttgccccaaccaaacatagtctgccccatcccgtctccatccgcacctgttaaggaactcgttcccttggcaaaagacaagggaaagattgatctactgaagagaggctga

SEQ ID NO: 28540 - DNA, 690 bp, Glycine max
  Peptide Sequence Number=SeqID_145318
cgccttcctgcccatgcgcggcggccagtagcccacctcgccgcgctgctggctgttgagggtgaattcggtaaagctattcagcgccaccagccggctgcacacgcgttccagcacgctgccgagcagccacgggctggcaccggaaaacgcctgttcgtcgacctccagcgtgatgctgacgccgcgcgcaaacaccaccgggcccggttccggcacccggcgattgaccgcgctaagctggcagtggcgaataccgtcaatctggcgcgccaccgccgcttcggcgagattagcgtaaaggctcagcagctggcgcagcgcggcggcgccctgaccgtcgctgctgtccatcaggctcaggtagttcatctgcaggtggctgatcagacgccacgcggagagcccttcggccagcgccggacgcggtggcgtcgggcctttacacaacttcagctgaccgaccgggatcgaatccggcatgacgaaattgccctgctcctgctgcaacagcatcagcggcagatcgcggctggtgcagagcacgtctgccgacaggtagcgcatgtcgtcgcgccacggcgtgtgatgctcatccaccagcgacaaaaacacttccgagccgatatagccggtgcgcgtgccgtaacgctgcgcctgctcagacagcgtacgctgctcgcggcgtag

SEQ ID NO: 28541 - DNA, 219 bp, Glycine max
  Peptide Sequence Number=SeqID_145319
atgaaatttggcggagctgttccatttctcattcctatgaagaagggtattataaattgtggcaatattaaggttgaggacaattatcgtaggggtgggggtcacaaccctctctttgaggattcacatagtgagtctggtagtgaggccgccactgtgagatatgggctaatctccaatgacactcacgaagcaagatgcaagtgcaaggccgtgtaa

SEQ ID NO: 28542 - DNA, 204 bp, Glycine max
  Peptide Sequence Number=SeqID_145320
atgaaatttggcggagctgttccatttcttattcctatgacgatgtgtattataaattgtggcaatattaaggttgagggtgggggtcacaacccactctttgaggatttacctagtgagtgcggtagtggagccgccactgtcagatatgggctaatctccaatgatactcacgaagcaagatacaagtgcaaggccgtgtaa

SEQ ID NO: 28543 - DNA, 226 bp, Glycine max
  misc_feature (166)..(166): n is a, c, g, or t
  misc_feature (207)..(207): n is a, c, g, or t
  Peptide Sequence Number=SeqID_145321
atgtacaattatcatgtgaaaggaagagctcctgatcttgaaagtgtattggcagacttcatgacatatcaagctagttctaaagattatcaatgggagtcagaatggcaaccttattttcacaatgaagcagtggggttgtctaatctggatgacctgttaatgncattcaagggtacaatagattcaatgcaacaagcatttaanagagctgagactcagattg

SEQ ID NO: 28544 - DNA, 501 bp, Glycine max
  Peptide Sequence Number=SeqID_145322
atgtgggcatgggaacgctgcacgactttggctccaaagaggactcctcctgtactagaaaataaaccactcgaacacaggtggctgcgacgtggaaaccaacatattggcaatgattatctaatagttttccgtcgcaaattggatatcatgaaacaacatgagtttttatgggagccttacacagcaactgttatgtcgatgttgcctcccatttgtttgattggtagtgtggcgtggtgcgcagtggtgccactcatttgtttccatgttgtagagtggtaccaacccgatagagtgttgcgacaatttagaatgcaacagcctattccggagtctccttcgcaaccacagaatatccatgggctaacgctgaaaggcaaacaaggtgaaaattggttccaactgttggccctaatgatcagtcagtggaataatcgagctgactttaggggtgaagttgcggagacattgcagtatatggtgtcaccacaagggtag

SEQ ID NO: 28545 - DNA, 762 bp, Glycine max
  Peptide Sequence Number=SeqID_145323
atggggatattgtatggaatggtggcaagggggcaggtggttctggctgagttcagcgccacccagagtaatgctagtgtagtagccaaacagatactcagcaagatcaatcaagggagtgataacaataatgattccaatgtttccttttcccacgatcgctatgtttttcatgtcaagaggacagatggcctcactgttctttgcatggctgatgatgcatttggaagaatagccccttttgcatttcttgaagatattcataaaaaatttgtgaagacgtatgcccgtgctattctttcagctcctgcctatgccatgaatgatgagttctcaagggtcttgaaccaacagatggaatattactccaatgacccaaatgctgacagattaaaccgtctcaaagtaaatttcaaagtgagaacggtgatgatagacaacattgacaaagtgttggagagaggtggtcggttggagctgctggtggagaaaacttcagcaatgaatagcaattcgattcgtttcaaaaggcagtcccgccgttataaaaataacctgtggtggagtaatgttaggctaacaggcatctcatcttgtgctttgctcatgaagccagtctatacccaatttatagaaatcttgggctttgaaactttccattcattcttacaattattgaattgcacaataaaggtttggggagttgatattggcccctatccaattgctgatggcctctaccactttttgaaactgagatga

SEQ ID NO: 28546 - DNA, 291 bp, Glycine max
  Peptide Sequence Number=SeqID_145324
atggagttggatttggaatggttcggttcagtggattttgcttgtggaatgaagaaaatctgggggagaatttccaaatcaaaacaactgcctcgaaaagaaatacaggcatcagaacataaagacggaattttggggaatgaatgccaaagtgcagttgcttcaactttaagtatgccaccgaaaacatgtaagggatccattcatcatacacaggtagaaattccaaattctgaaacgggaaatcctaaacatgttactgtgaaaggattcctcaatcacggcatctga

SEQ ID NO: 28547 - DNA, 309 bp, Glycine max
  Peptide Sequence Number=SeqID_145325
aagtattgcatgcctagacaggcgcagggtgatgcactgcaggccgcagatgcactaccaccacctcgtcaggctgatctagctgggtcatttggcatggagcacctcagtctgcaaagccagggtttcgctccttttgcgtgccctactcctgatcagttcagggcagaggttgcatggcccggagattggtctgaggcccaggcaggggaggcacccacagaggctcccggcgatgcagatgaggcccgcatggatgaggagatgacagatttactcgatttcttgggagggagcggagccacatga

SEQ ID NO: 28548 - DNA, 331 bp, Glycine max
  Peptide Sequence Number=SeqID_145326
ggaggggttgtccttgctgaggtgttgttggctgaatcacgattcactcgaccggatatgggttttcacccaacaaaactcaatttcgtgcctagcgatgcggatgaggcgccactcgatgtttccatttgcctgcatgcctttggtattgtggggtgtgacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactctta

SEQ ID NO: 28549 - DNA, 234 bp, Glycine max
  Peptide Sequence Number=SeqID_145327
atgcagaagaaagcgaaaatgcaggaaattgagtacgagagagaagatgcaaggaatgctctgagaattatgggcaaatggcttggcttagtgttgcaacctaccttcggcgggagggcaacgcgaggctcacgggtgcgtcttccatgggaggaaaatgcgcggagtcgccaccaacgtttatttgaggaaaacgtaggaaaaaccggaaaaggcgtcgtctacaaactttaa

SEQ ID NO: 28550 - DNA, 296 bp, Glycine max
  Peptide Sequence Number=SeqID_145328
atgaattcattgcctagcgctgttcatgtgtcctccgttatcaagcgcggagcctctggtgactgggaaatatgtttttctgttattttccggatcggttccttcgccaaacataagaaaaaagaaggagtagagacaagagtcgtcatcacggaaagggcaggacggatgaaatcagtgtcctatctttgctttcctcttatctccgatgagagatccttcctccagaaggctgttgcttctggaggaagcaaccttgctcgcctgggcgagctgagctcgcctgggcgagttgg

SEQ ID NO: 28551 - DNA, 269 bp, Glycine max
  Peptide Sequence Number=SeqID_145329
agatcgcgcccacaagacgcccggtgggcccgaagaagtccaatagggccctggggtttccagctctggaatcgctctcacaaagacacccagtggacccggagaagtccaatagggccctggggtttctagctctggttatgggcctctatagtcctacagggtgcccgttccccccggcaaggtcacgtcatcatagggatcgcgcctgcaagacacccagtggacccgaagaagtccaacagggtcttggagttgtcaagctctaa

SEQ ID NO: 28552 - DNA, 549 bp, Glycine max
  Peptide Sequence Number=SeqID_145330
atgtccaaatcttgtggatttgggatgaccgggcctctcgatgagtcgatctcttgctttctcataggtgggaccttgggtactagttaccctcaccgtgagaggactacacgtcctcgcctgagaggactacacgtcctcaccatcagagggctgcacgccctcacctccagaggactacatgtcctcgccttgagagggctacacgccctcaccttgggtacttgttaccctcaccgtcagaggactacacgtcctcaccatcagagggctgcacgcccttacctccagaggactacatgtcctcgccttgagagggctacacgccctcaccttggaggactacacgtcctcgccaacagagggctgcacgccctcaccttcagaggactacatgtcctcgccttgagagggctacacgccctcaccttgggactacacatcctcaccatcagagggctgcacgccctcacctccagaggactacatgtcctcgccttgagagggctacacgccctcaccttgggtactagttaccctcaccgttga

SEQ ID NO: 28553 - DNA, 495 bp, Glycine max
  Peptide Sequence Number=SeqID_145331
atgaccaccttggagattatcactaaaggccttgttagctccctcccatataggtcccttgaatatgggcccgaagcggacacgctgcgtgccatttttcacactgccatgcataagtgtcatgttctatcaagtcaaggtcaagagcctagggatcaccagtctaagagagttagggcagtttatgggtcagctccagcggcaagcttttcgcaaagcttacggcagttgatgggtcagctccagcggcaagcttttcgcaaagcttacggtaaaatctgggacctagccatggtagaagtctccacagaggccattgcctccctcgcccagtattatgatcagccgttgaggtgctttacctttggggacttccagctatcacccatggtggaagaatttgaagagatcctaggatgtcctctagggggaaggaaaccatacctcttcttagggttctacccctcattagccagaatttctaaaatagtctga

SEQ ID NO: 28554 - DNA, 273 bp, Glycine max
  Peptide Sequence Number=SeqID_145332
atgacgaagaacagagtcatgaaagagcataacaagactttcctagattggtttaaagatacaatctttgctgatgagcctaaaagaaatgttgctaaatttgatatccctgaagcatctgatctgaggacaaaaaagaaaatacttcaaactgtgggggagcggtggagacaatttaagtctaatttgatgtccaaatgggcacttgcagccaacaaggaaagtgtcgtcggcattatatgcgaaaagtacggcattagcaaggagaagtga

SEQ ID NO: 28555 - DNA, 162 bp, Glycine max
  Peptide Sequence Number=SeqID_145333
atgaagtcaggtgacatgcggagatacccaagccgttatccgtacaaacggtttctgttaatcctgacccgtgaagtcaggcggagatacccaagtggttatccgtatgaaaactctttcgctatccgtcagactcagagtctgatagcatgcagagactaa

SEQ ID NO: 28556 - DNA, 738 bp, Glycine max
  Peptide Sequence Number=SeqID_145334
atgtttggtatggataatttcatatttaaaacattggctctgccgcttgaatgtttctgtatgacacttctacttaaaactaatttaccacgcgacgatagggttctgatggtgttttcttttgatgttgtggattatgatggtggagaaattggggcaacttgcttcaatgctgtggctgatcagttctacaatgttattcaagctggtaagacatttaattatcaccccattagtgaaattgaaagtttggaaaacaacagcattgtggatgtgattggtgtggtgacttctattaggcctacaacatcaatcatgagaaaaaatggcactgaagttcagaagagaactctccagttgaaagacatgtctggccgaagtgttgagttaactctatggggaaatttttgcattgtagaaggacaaaggttgcaaactatttgtcatgctagggaatttccagttttggctacaaaagctgtcagattaaatgatttcaatgggaagtctgtcgagactatagccactagtaaggtctataagggtaccatgacaaagaatctgaatgttgcaatgaagcacataatcaatgatgatggaaatgtggacacttttgtcagactaattacaagcttatctcatgttagacaccctaatatcagcagttgcaagcaatcacagtttacttggtgccaacttaaagtggaattaaacaaggaatatactgaaagtgcataa

SEQ ID NO: 28557 - DNA, 606 bp, Glycine max
  Peptide Sequence Number=SeqID_145335
atggcgaaagagttgacgttgagtctgaaagccatttattgcgatacggcgcaagcagaaggaaaaaccgaaatacgggccgaggtgatgacccgtaaggaataccggaaattactcgagctaattatgggtaatatcggcgggaataaaattatggcttccgagggacacatgtacaactcaattttggttcccattgacatttccgaggatagcctgacgcacatggttatcccgttcgttcaggcacacaccgcacttaacacggccaaggtccactttcttactgttattccatcgcttccctattattcatcgttaggtttggcctactccgtagaaatgccgaagatgaaagaatttcagcacgcggccctagcaaaactggatgaaatagttaagcaattcaaaattccttcagacaagatacagacgcatgccgtgacggggtctccgaaggatcagatccttaagctcgcagatacgatcggcgccgacctgatcattattgcctcccataagccggacatctcgacctatctgttgggctcaaacgctgcggcagtggttcggcatgcgaaatgccctgtgctggtggtaagataa

SEQ ID NO: 28558 - DNA, 192 bp, Glycine max
  Peptide Sequence Number=SeqID_145336
atgtcacgaaaccttacggattacgcaatcatcccttctttggcttccagaatgttacggaactttacggattgcacattaacacgccctttcaactcccgacatgttgcggaacttcacggattgcctaacgatgggtgtcaagttctcaaccccaaagcttacaaatctattttcagtccaagcccataa

SEQ ID NO: 28559 - DNA, 258 bp, Glycine max
  Peptide Sequence Number=SeqID_145337
atggccgatctggcactctggcgtcgtgccggagtcgaccgctatgaagtactgtcgacttcgtacggtatggaatcagaagcctattggccctgcggtggcgctggagaaggttcggcgctgatgcgggtacgcgcgcttagctccgggcccaaccgaaacgaaaacggccccttcgattcccatgagggcgccgagggggctgtcgtcgtttccgtgttgagagcccactgcgcgggcatgcaatccagctcttga

SEQ ID NO: 28560 - DNA, 854 bp, Glycine max
  Peptide Sequence Number=SeqID_145338
agctgttccgcagcgtcaggcagctggatgtattggtgaacaatgccggctatatggtgacggggctggcagaagagactcccgtcgaattgggacgtcagcagttcgaaaccaacttctggggcacgatcaaagtgacgaatgccttgctgccccggctgcgggcgcaaaagcatgggcagatcatcacaatcagctccatcgtcggcttgatcggcccgccgaatctctcgtactacacggcttcaaagcacgcagtccagggctacttcaaatctctgcgcttcgagctggatccgttcaacatccaagtcagcatggtggagccagtgtggttcaagaccaacctcgctcataactccgtgtctcaatcaagcgggcgtattgctgattacaacgcctaccgcaagcaagcagatgctgcgacacagaaggggatcgatgaggcggaggcgcccgacgccgtcgtcaacacgattaccaagctgatcgagaccaagaagccaaagttcagtaaccccgttggaaagatgaccggaatgatcctaggagccgaaatgaaatactacctgtgcaaatttgtcccgcctcgcgcgaatttcctggccaccatgtccggcgaagaaaaaacatggatgaggcagcatggcgaatatatgaacggtcttctcgagcaaggtgtgatcgtagcgcacgggcctgtgattgacgatggtgatggctacggcgtgtctctttaccagatcgccgacaaccaagagatcggttcgtttacatccgaagatcccatcgtgaagaatgggattggccactatgagcactacacgatggccagcttgacttcccgcagctga

SEQ ID NO: 28561 - DNA, 414 bp, Glycine max
  Peptide Sequence Number=SeqID_145339
atgactagctctcttattgctggcgcctccagtggcattggtgctgtttacgcacgccgctttgcggctcgtggccacgatctcgtatgggtggcccgtaccaccgaccggctcaatgcattgctgcctgagtcttcacaaggtatttgcgcagcaacgaagtcctacatgttggccttcttgcagagccttgcagctgaggcagggcccaggggcgtctacataccagcggttttgccggccgccacacgcaccgagatctatgagcgctctggtggcgatgtcatggatggagagcttgtgaccattccaccagtgcctgaggcagcggcatgggacgcatttgagcaagcgcgcggatatttggcccaggtcttctcaaactccaagcccgctactcgttacctcacttga

SEQ ID NO: 28562 - DNA, 573 bp, Glycine max
  misc_feature (32)..(32): n is a, c, g, or t
  Peptide Sequence Number=SeqID_145340
atgaagaatggcagcaaatcggtggaatattnttcgataaaattcacggggaaattgaaaatgcttggggatggaaatgaaggaatgtctacactacctggattgaatcagatacaatttgaagggttttgtaggttcattgatcggggcttaccagaagggctttttaagtttccaaaaattgaggatacagatcaagaaattgaatttcaattatttgtagaaacatatcaattattagaacccttgataaacgaaaaagatgctgtatatgaatcgcttacatattctgctgaattatatgtatctgcgggattaatttggaaaagtagtagggacatacaagaacaaactatttttgttggaaacattcctttaatgaattctctgggaacttctatagtaaatggaatatacagaattgtaatcaatcaaatattgcaaagccctggtatttattaccgttcagaattggaccctagcggaatttcggtctatactggcaccataatatcagactgggggggtagattagaattagagattgatagaaaagcaaggatatgggctcgt

SEQ ID NO: 28563 - DNA, 129 bp, Glycine max
  Peptide Sequence Number=SeqID_145341
ctggctaatggaaatgtaaggatcaggtttctccattatgacaaacctgaagaaaagtttcaagataccaaagatcagctaaagaggccaataaccatcttgcgttcaagaaacagacttcgatgtgag

SEQ ID NO: 28564 - DNA, 574 bp, Glycine max
  Peptide Sequence Number=SeqID_145342
atgattatgaggggccaagacatttatagtagccaagatgagactactacttcaccttcctctagtgaaagtgaagaagcaaaaggggaagcatctagtgaagaaatctacccccaagaagaaagacaaccattaatggttaaggagagtgtaaggagacaacctccacattttctcctttgtaaaaagacacttgttagcattgccacacctcttgggcttgagtttattcttctagtaaaggagttgttggatgagggtttggttcgcaagagcttaaatccttgtgctttgttggtgcccaaaataggtattattaggcaccgaatccctaaaataggtggtatgatgaatgtttttagtggtgcaaccctcttttgtgaaatcaatcgtgcacccaacaacttcatgatttgtgtacatagggactcattaggtgggaataatcagcataaaaataaagaaaaaggtatgttttattccattactttccttaactttttaaatagtgatcaagggcttcccatggaccctaagagaataaaggtcattcctgagtggcctactccaccaa

SEQ ID NO: 28565 - DNA, 294 bp, Glycine max
  Peptide Sequence Number=SeqID_145343
aattggcttttcggccagagaaagtatgaagagggttcctctgctgcaaaagttgcttctcgtgaatctgacgttgaaggatctcaagctaatggcttttgtgacttgaattggctttcctctggcaatgatatgaatgaagaggatgttttccaaaggtaccttacaatgacctcaacaaatgaggccaacggttggtatggaggtagtctcctaggcgatcaagatgaaagcagtgagatatataaacattatgctgagttatgtcaggaactgaaacttctattgaaatga

SEQ ID NO: 28566 - DNA, 261 bp, Glycine max
  Peptide Sequence Number=SeqID_145344
atggttgtcattttgcctaaggaaaatctagttgtctggtttagttccttgcataacaggctagacaactaccttaaaggaataattaacaatgctttgaaaggacttgatgatactccacaacctaaatcgaaggctgctactgctaggtggattgttgttaagtatttcaatgatgttagaccattggaagcagagagattgaaggcactttgcatccagtgggcacaatattatctcaaagttaaaaatcaaacttag

SEQ ID NO: 28567 - DNA, 294 bp, Glycine max
  Peptide Sequence Number=SeqID_145345
atggcaagagtagcaaaagtggtcaagatctcgacacaagagttagaccgagtgaagaaaaataggaatggggtggtagggttaccaaggaagcgcttggaggagaaggcagaagctttggtagatcaaggagagtggacctcattcattgacatattagcactacgggctgatgcaatcctccctaggaagggtccagtcactagagccatgagcaagaggctccaagaggattgggctagagctgctgaagaaggccctagggttctcatgaaccttagggtagatttttga

SEQ ID NO: 28568 - DNA, 309 bp, Glycine max
  Peptide Sequence Number=SeqID_145346
atggggtcgaaccaagcgccctcctttaaaaagaggttctatcatgtcaaagtcaagagcctagatctagccagcttgcgagagctagggcaacggatggatcaagttcgatgtcaagccttccacaaagcgtatgggaaaatctgggatttggccctgatagaagtgtccgttgaagccatcgcatccctctctcaatactatgaccagtcgctcagatgcttcacgtttggggactttcagttggtactaacaatagaagagttcgaagggatcttgggatgcctgctaggaggaaggaatgaatag

SEQ ID NO: 28569 - DNA, 180 bp, Glycine max
  Peptide Sequence Number=SeqID_145347
atgtcatcctctttgatatcaaacattgtggcggtagggactaccagcgacaatgtatcatcaaagagaaaaaatcaagatgaggcttcactattatcaagcaagtcggagacccagcataaccatagatcaacctccacttcctatgtctccacggacttgggtgccatgcgtgcatag

SEQ ID NO: 28570 - DNA, 267 bp, Glycine max
  Peptide Sequence Number=SeqID_145348
atggtaagaaccgagtatcgaactctcagggaacttgtgttacttggtggccttgttggtgcttgcacgcttagcgcaactctagctcgcttagcgtgcattagtgaatttcggcttagcgcgcgtcttctcgctcagcggaatgactcaagcggtgcgcttagcgggatgacacctcgctcagcgaacatgcacagctcatccttcttccagattcttcctcgcgctcagccaaaggagtgttgctctcagcggatggctcgctga

SEQ ID NO: 28571 - DNA, 423 bp, Glycine max
  Peptide Sequence Number=SeqID_145349
atgaaggaaactgaggattctttcaaaaaggtcatgaaattatcaagagaaagaattgttgatcagagtagcatgttcgaatttgatgacgatgataacactattatgcaccaatggaaaagtcatgaagaagaaaatggagttgcttcaaaaccaagtgcaaatcaacttgacaatctttctgaatatcaaaaggtttgggaacaatttcacactaccttcctccaagacaatcaagacctcaagtcagttctttctattcctgatgttcgaaaacaaatcaaagagatatgtgaggaattagacaaatatgaagatggtatatgcttgagaatgacaaataaaccttggacgcatttaattcaatcttctcgaatgggcatacatcataaaagaaattccatgccagtgaaattggcttaa

SEQ ID NO: 28572 - DNA, 735 bp, Glycine max
  Peptide Sequence Number=SeqID_145350
atgaagctgagtaaagccgcaatcagcactttaatcaaagagatgcttagcgcaggactgcttgaagagagcattccggaaagtaacggtcagggtcgaccttcggtgttattaaaaatgcgtgccgacagtgcctattttctcggtgcgtcgttgctcggtgacgatgtgtatctggtgctgacggatatgcacggccgcatcctggccagcacccacatgccgctgaatcccgaccctgtgcaactggctggcgcgctggctgccgctattccggacctgattgcacaaaaaggcatttccgccgatcagctcatcgggcttggcgtcacgctttccggctttgtcgatgagcaccaggccgtgtgcgtccagtctgccctgctgggctggaaaaacgtcccgctggcggcactgcttaacgcgcaaaccggtctggaggtgtcactggaaaacgatgccaaagctctggcggtcagcgaaaagattttcggcgtggcgaaaaaggcacggaatttcaccctgatttcccacggcgacggcattggctctgcgcacttctttcaggggcagctgcaccgcggcgcgcacggtggggccggtgaaattgctcactgtaccgtagagcccggcgggcggccgtgccgctgcggcaaacgcggctgccttgatacgctggcgtcgctcactgcgatgcgtgaaagcatgcgtgacaaacagctgccctgcaccagc

SEQ ID NO: 28573 - DNA, 1235 bp, Glycine max
  Peptide Sequence Number=SeqID_145351
atgcaaagcacactcaagcatttcagggtactgacacttgccgcgggtattctggcgtcgttttccagcgcatcggttttggctgctcagctggtcattatgcaaaacgaaccgccgcgcagcatggacccgggcaatcagaccgcgacctttaccggcacggtgctggacccgatgtatgaaggcctgacgcggctcggtgacgatggcaaaatcatgccggccctggcgctctcctggcatgctgacgacagcggactgcactgggaatttacgctgcgccccaacgttaaattccacgatggcacgccatttaatgccgatgcggtcgttgaaaactttcagcgtcatctggatacgaagcgcggtcttgccggaagtgggaaaattcgcacctttattcaggacgtgcagaaaaaagatgacttaaccgtcacctttacactgaagaaaattaatccggcgtttttaaccgtgctggcctccggtccgggattaatggtgagtccacaagctgacaaagccggcacgatcaataataaagccgacggtaccggaccctataaactggcgcagtataaatccggtgaatttgtcctggagcagaagaatccggactattggggcaagtctgccgggccggacgaaataaaatggacctggagcagtgagccgtcagtcatgaatatggcgctgcaatccggtcaggtcgatattattaacccggtgccgccgcaatttgccggcatgttaaaaaataatcccggcgtgcagttaaaacagtcgccgggcgcggcggtattctggatcgatctcaatacgcagagtaaagccctcagcgatgtcagagtacgccaggcgctgaacttcgcgaccgaccagcaggcgctggtaaaagcggtgatgtttggttatgcgcagccggccaattccccactggcgccggtcgatgccaactacgacaaagcgttgcatgactatccatatgatgtgcagaaagccaaagatctgcttaaggcagcgggctatgccgacggcttcgccatgtcgattgccgtgcaggcacctgacgcacgtaccgcgcaggttctgcagggtatgtggagcaaaattggcgtcaaactcagcgtgcgccagatggagagcggcgtatgggccaaagcggcgtttgccgatgccaaagagaaagccgcgcagggtacggacgcggtgctggcgtcctggtcctcggggct

SEQ ID NO: 28574 - DNA, 1322 bp, Glycine max
  Peptide Sequence Number=SeqID_145352
cgccgctgctggctattctcggggcgcgggcttcacggcttaatttcctgatgacgctgatgggcctgtttgcgctgggtaatctgctaagcgctgtcgtgccgggctaccctgcgatgctggcggtgtcgatggtgctgctgggattaaccatcgccaatctgattggcgtacccgccgttaccgccatcggccagtggtttggctggcgtgatgcgtttgccatcgtcggcggactggcgctgctgacgctgttactggtgtggctttgggttcccaatgtggccggtgacaagcaggccagtccactgcgcgagctctcggcgctgacgcgcaagcaggttttgctgacgctggcgattggcgcgattggcagcggcggcatgttctcggtattcagttacgttaaacccaccatgatggaactggcccacctgccggagaatctggtaccggcgatactggcgctgtttggtcttggcatgattatcggcaaccttgtcgggggacgtctggccgatcgcgggctggagaaaaccatccgcattgtgctggtgtggtcgctgctggtattgagcgcgtttgtctttgccgcgcattatgcgctggcgggcgcgcttaacgtgatgctggtcggcaccatggtggcgctgggaagcgtgctacaaatccgcctgatggacgtggccggtgatgcacaaaccctggcggccgcgcttaatcactcggcgttcaacattgccaacgcgctgggggcgtggctcggcggcatcaccatttccgccgggctgggctggcagtccaccggctgggttggggccattctgtccgtgctgggactgctgattcatgccattgcgacatctgccgttgttactgctggtcgtcattattcccggattactgctggtgctgtttcttgctgcaggcggttggctgacgccgcagcgcctcagtgcgcaaagtctggtgcagtcgctgcagcaaaacagcggtgtgcatccgggataccggcgcaatcatgccaagggcgtgtgcgttaccgcgttttccagccgggtacggtgccggtgattggccgctttgccattgccggtggtaatccgcacgcgccggactatggcgtgccggtacgcagcctggcgctggaatttcagctggcgcacggcgagcagtggcgtaccggcatgaacgcgctgccgtttttcccggtcagtacgccgcaggctttttacgatcagcagcaggccagtcgaccgctgccgcagactggcaaacctgatgcgcaaaagctgatggcgtttaccgttgcccatcccgaa

SEQ ID NO: 28575 - DNA, 258 bp, Glycine max
  Peptide Sequence Number=SeqID_145353
atggagcacgagatttgcaaaaacatccctgttataatcttaatttgtttgtttgagaaggttgaggtggataagcctgcggctagtcgttccgaatcagctgagatatatgtttgggggcttgggtataaggcccctgctaagattgattcacggcttcttgatgtgaagcatctctttcagggatctgtggaaccacagcctaaggtggtggatgtacttagagatactaagcaaaaaaggcaccatgatgagtaa

SEQ ID NO: 28576 - DNA, 348 bp, Glycine max
  Peptide Sequence Number=SeqID_145354
atgaaaaaagtggaacaaaaaagtaaccgcaggggaaatccaacaaaaagatctactgtaggtgatttgattcacattgatttggagattagcgccacctgtagaaagcgtaattcagagagaatcagaaatgttttgcaggatttagaagcagcaacaaccccagaagaagaacctcgatcttccgaggcatcttctagttttcctattgcagggcattctcatatagaacatgttgaagatacaatcatagctgaagagccaagaagagtaaccctggaggattattcaagttctaatttgccacaatttttcaccagcattgctcaaccagaagttcaagcataa

SEQ ID NO: 28577 - DNA, 114 bp, Glycine max
  Peptide Sequence Number=SeqID_145355
atggcaatgggcgagacaggaacaggtattgtctccccaatccctgaccccgactccccaacatgtctcataccgcgcatgtgtctacaaaaatcgttaagaaaagaatattaa

SEQ ID NO: 28578 - DNA, 279 bp, Glycine max
  Peptide Sequence Number=SeqID_145356
atgcgagagtgttgcggaattttcgagaagtttgaatgttcgttcatgcatctgaaagcacgccaccacgttagggtctgttcatggagggaacgccgatggcaccagcgacgcgaacgggctcgcgtacgccggagccgggtagccgctgctgcttccgccgccgtgggagtgggactcgttcttcgggggggaggcggagtaaggctgagcgggcggcggcgcgccgtagctgtagctgggaggctggtggagatagccggacatgatgaaatttga

SEQ ID NO: 28579 - DNA, 785 bp, Glycine max
  Peptide Sequence Number=SeqID_145357
catgttggcgatcatgtgatgcatgctgatcggcacgttgcacaggccgatgatcttcgctttggtaaagcgggacaccgcctcggtgacgatgccggccgggttggtgaagttgatgatccaggcgtccggcgccagtttttccacccggcgagcgatgtccagcatcaccgggatggtgcgcagcgccttggcgaagccgccgacgccggtggtctcctggccgagcagctggtatttcaggcccagccgttcgtcggcggcgcgcgccggcagttgcccgacgcggaactgggtcagcacgaaggcggcgccgcgaatggcgtcgtccagcgcaaagtgcacactgaccttcacctgctccagcccgtggcgcgccagcatgcggcgggtcagggcggcgatggtttccactttttgccggcccggttcgacgtccaccagcgccagctcggtgaccggcagctcctcgatgcgctggatcagcccatcgaccagttcggggagctcgatcatgtcgtcggccagatcctggatcaccatggcgttcatcagatgatcctgcgcatgcacggtgatcaggttgatcgccagtttgccgcagccttcgtccaggccgatcagctcggtctggatcagcgccatcagcgcattgctgcgcgcgctgccggagaacaccagcagttccatgatggtgctttcaaactcggggctgacttcagtcatcagttcactcacgtcatttctccaggggttgcgcggcgacgccgccgtgggatgcttca

SEQ ID NO: 28580 - DNA, 318 bp, Glycine max
  Peptide Sequence Number=SeqID_145358
atggcttctaggaaacataaaagtattggttcaagacccacaacacagtatgatacaaggagatttcactcctttgggccctggaatcgatacatggataacgttttaggaagacacatcttaccagagaggaaggtgaaaatataccacactaagctggacaagtttaaggctgaattggataggcgtaacttccataaacgccacaccaatttagttgacaacaacatagactcagctttggtgaaggagttttatgccaacctttacagctctgaagacccttcaccaaagcaagtcagggtcagaggccacctg

SEQ ID NO: 28581 - DNA, 171 bp, Glycine max
  Peptide Sequence Number=SeqID_145359
atggaggagaagaaaaagaaacaattggaggaagctgctcaattcggaagcattgacaccgtgattgatcctccatctcccatcagacgacatgtgaagtggaatatggctcacaccaagaaaattgggcaaatgacgtttgaggctcaaaggaaatcgctgacaaaaatt

SEQ ID NO: 28582 - DNA, 309 bp, Glycine max
  Peptide Sequence Number=SeqID_145360
atgtctaagttgtcatctgtgaggctcattggagtcgcaagtatgagaaaacacattatggaaatgagggatctagcggctcaacttaagttgctatgggttgaaatttttgagtcattcatggaggaagggagacttgctcaagaaattggtgaagatgctcttactgtgactcaagataaaagggaaaggaaggaaaataatcatatacctcctattgccaaaattaaaaaggagtctagggcttctcaagccagagggagccaaatgaaggtgaacgtgttagtcaagtggcctcagatatcttaa

SEQ ID NO: 28583 - DNA, 948 bp, Glycine max
  Peptide Sequence Number=SeqID_145361
atggactcgcatggccaaaaatattttatctctttcatagacgattactcacgatacatgtatctttacttgcttaacaataaatatgaagcattggatgcctttaaggttttcaaggcaggcgtagagaaacaatgtggaaaacaaataaagattgtgagatcagatagaggaggcaaattttacggcaaatacactgaaaatggacaagcacctggtccttttgcaaagtttcttcaagagcatgacattgtggcccaatacaccatgcctggctcgccaaatcaaaacagtgtggctggaagaagaaatcgaacattaagggacatggtaagaagtatgcttagcaattccaaacttcctcgttcattatggaatgaggctcttaagatagttgtgtacatactaaatcgggtaccaacaaaggcggtccctaaaaccccatttgaattattgaaaggttggaagccaagtttaaaacatgtgtgtgtttggggttgcccaggtgaagttaggatttataatccaaatgaaaagaagctggacccaaggagcattagtgcatatttcattggttatgctgaaaggtctaagggttatagattttattctccaactcatagcactagaattgttgagtcaagaaatagaaagtttctagaaaataatgtggctagtgggagtgatttaactcaacgcattggtcttgagaaaaatcaatgtgaggaagtagttcctacatcaagttataagctagtagtttttggcgatactcaccaaaatcgtgtaacacaagctccacatcaagttgatcctgtcctagaaaatccagttgaacaacaccaaacacaaaatgttgagcaacttgttgaacaacatcaaacacaagatgttgaacaacctgttgaacaacaaccagaatgtgtggatgtaacattgagaatataa

SEQ ID NO: 28584 - DNA, 162 bp, Glycine max
  Peptide Sequence Number=SeqID_145362
actacatcaagttcctattggtcgtcattgactatttcaccaaatggattaaggcaaggccattactagaaatctcagccaacgaggtagaaaagttcttgacgatgctaggtgtccatgcacctcgtgacttctatcgaacaccccaaggccaacgatcag

SEQ ID NO: 28585 - DNA, 558 bp, Glycine max
  Peptide Sequence Number=SeqID_145363
atggcttcaaactcccaacaatttagtgccagaagtgatgctattatcattagaggagtgcacgaagtagccacgaattcatcaggtgagactaagaagcttgaaggtaaactagatgccttggttaacctggtaacccaactggccatgaatcaaaaatctgcacctgtcgccagactctgtggtttatgctcctctgccgaccactacacagacctttgcccttctgaagcaattgaacagcctgaagcttatgctgcaaacatctacaatagacctcctcaacctcagcagcaaaatcagccacaacagaataactatgacctctccagcaataggtacaatctcggatggaggaatcatcccaaccttagatggtcgaatccttcacaacagcagcaacaacaacaaccttattttcaaaatgctactggcccaagtagaccatatgttcctccaccaatccagcaacaacaacaactacagcccagaaacagcaaacatccgcaaccttcccttgaagaacttgtgaggcaaatgactatgccaaacatgtag

SEQ ID NO: 28586 - DNA, 396 bp, Glycine max
  Peptide Sequence Number=SeqID_145364
atgtatcctcctttgttctctttgaacaacctagtggatgtaccctccactagaactgatccacaagagatgtaccctcccttgttctcagtcacaacaacccaagtagatgtaccctcttcttgtaccacaaaggatggaaaaggaagaatcaaaagaattctcagactgtatcgttttgaattctttgacaagggagaagggagacacaaaagaattcaggcggttagtcctcgttcttttggaaaagggagaagagagacacaaaaagaattcaggcggttagtccttggcgaattctttttggcaaagggagaagggagacacaaaagaattcaggcggttagtccttcgttcttttggaaaagggagaagagagacacaaaaagaatttag

SEQ ID NO: 28587 - DNA, 330 bp, Glycine max
  Peptide Sequence Number=SeqID_145365
atggacaattcttttttggataatatagtgtcttctgatcataaccaattggctcaatcttctccacaggttcgacttgactcttcagaggtatcttctgatcctatctctgataatactaatgtagatgaaactgatcgtgaaattgtttctcttgatcctacccttgataatactaatttagatggaaccaatcatgaaattgatccttgtctgtgtgagatcaccagcaatccaaacaatgagtctactattgtccaatataatcttccaccctgctctaattgtggtcaacctccagctaaatatgaaccagacctccaagccaaa

SEQ ID NO: 28588 - DNA, 834 bp, Glycine max
  Peptide Sequence Number=SeqID_145366
aaggtccgcaaggcatgggaggtggtgcaaaagaaggacaaagaactcaggggcagtaacaatgggcccatcggtggctaccgtaagtggttgagagcccacgtgcaaggtttggattggctcctaagtttgagaaccgctaaaagggaggaagttgaggcaccagaggaagacgaagaggtgcaggcccttaaggcagaactcgagcaagctcaaacagtcaaagaaaggttcaaatcagtggctcttaggatccgaaaggagaatgccgaattgagagatataaatacagctaccgcaaaagcccttgaacaagaaaccaagagggctcgcaaggaagagcatggccgagacaaattccgtggagctttgtggggcagcaacaatgagctcaagcttcgaagggaagagagagaccaatcacaagtacatagcatggccttaaaggaggagttagctgcttgctcaagatccaagaggagtctggcccaacatttagaagccatggagcaaagcatgctggctataataaggcagtacaaagaggagctaaaccaatctttggctcatgagcaaaagctagtagaggactttgcacaagcatacgccgagaaggaggcaagagggagggtgattgatgcattgcatcaagaagcgaccatgtggatggataggttcgccttgaccttaaatggaagtcaagacctcccacgactactagccaaagcaagggccaaggccgaagtgtgttcagccccagaggaaattcacgggctaatcaattattgtcaacacatgatagatttaatggcccatataattagaaaccgttaa

SEQ ID NO: 28589 - DNA, 474 bp, Glycine max
  Peptide Sequence Number=SeqID_145367
atgaggcttcactgtgatcaagcgagtcggagacccaacatgaccataaatcgacctccactccttatggtccacatagactcgggtatagggcctaatatctcaatgtgtgtgcaaggtgtaggtgccattccccagtggagtcgccaactgtcgcaacctacccttcggcgggggtgtgaaaaggccaaaacaaataaggccaaagcgtttgtctccaagagagaaaacgagcagagtcgccaccaacgtttatttgaggaaaacgttagaaaaaccaaaaaagacaaaagggacgaggaaggtatgcacgaggaagcaaaacaaggcattcgggatgaaggtagctcgccaaggcgagctgaactcccccaagcgaactgttacttcattctgaagcaaccttgctcgcccaggcaagctggttacttcaccatgaagttattttggtggcccaggcgagccagaggctag

SEQ ID NO: 28590 - DNA, 102 bp, Glycine max
  Peptide Sequence Number=SeqID_145368
atggcccttggaaccatggcagctcgcccaagcaagctgatgcttcatcctaaaagtcatgaatggccagttcacaactctattcggattcatttcttctga

SEQ ID NO: 28591 - DNA, 138 bp, Glycine max
  Peptide Sequence Number=SeqID_145369
gagccgtctgctacgatgaagagtcgtcactaatcgctgtccctccagggccactgtcctctgtagagtctgcctcagatgttgacataatatcctatggagaatcaacatcagggagtgggtcttcatcatcctcag

SEQ ID NO: 28592 - DNA, 309 bp, Glycine max
  Peptide Sequence Number=SeqID_145370
atgggctcaaaaatctaccctaaggttcatgagaaccctaaggccttctttatcaactctagcccaatcctcttggagcctcttgctcatggctctggtaactggtcctttcctagggaggattgcatcaacctccttgacacacaacaagggcttagcgctgcgcttagccttattcaaagggaaatgaggcaagcagatgcaatgcatgatttggaagcaagaaaacgcagtagcaaaggtagaggtaacagatcaaggtcgtacccgaatcaaataaacattaaaaatgcagtatctaggaagtga

SEQ ID NO: 28593 - DNA, 261 bp, Glycine max
  Peptide Sequence Number=SeqID_145371
atgagtgaaaaacatatggagaagaaggctcaagaaaaagaagaattgattgctgctttgatgaaggacaaagttgcccccacccaagctgaagcttttgctaaagttgtggacgataccattgtgcgtggggtcattaatgatcttattaacactggtgtcatggatgaaactccagaagcatccaatgtagtcgtagctgatgaggttgtccctttaagacaagaaacatgtgtccaagcaattcacaacctcaaatga

SEQ ID NO: 28594 - DNA, 408 bp, Glycine max
  Peptide Sequence Number=SeqID_145372
atgataataggaaggttgaacaagcactataaggatgcaattctgaagcttgtgaagttcttccaggactgtccagagcaacatttttttctagttgagaagtctgaattggatgttgcacttgacaaagatgctccaacgggtaaacgctgtctaacaacaattgtgtctgttgggttttggaaagtctctcagagagaaccattggacttatcaagtaacacaaggtttcctatctcaggcagcacaagcctgctcacttgtgatttcagtgatggtgttgaccatttggtgttgccatcttcatcaagaattgtggtccctttgaaagatagaaacgttttaccagaatctgagatggggccatcactgttagcaaaccaaatgatagtgttggaagtagcatga

SEQ ID NO: 28595 - DNA, 129 bp, Glycine max
  Peptide Sequence Number=SeqID_145373
atgggtttgaagagaaaaataatgatgaacatcataatcagtcttaaagttgaagtggtgagggtacaagtgcaacaacaactcctggcatactcatctgagcttgttgaagattctaaagaagaataa

SEQ ID NO: 28596 - DNA, 2976 bp, Glycine max
  Peptide Sequence Number=SeqID_145374
atgattgcctttgcatcaggaaatgatactgattatttggcactgcttaaattccgggaatccatatccagtgacccacttggaatcttgctttcttggaatagttcttctcacttttgtaattggcatggaatcacatgcaatcccatgcatcaaagagttacaaagttagacttgggaggatacaagttgaagggttccatatctccccacataggcaatctctcctacatgagaatcttcaacctcaacaaaaactacttgtatgggaacatcccacaagaattgggacggttgtcacaattgcagaacttctctgtgggaaataactcattggaagggaaaattcctacaaacttgacaggttgcactcatctcaaactcctaaacttatatgggaacaatctgattggcaaaataccgattacaattgcctcactaccgaagcttcaacttctgaatgtcgggaacaataagttaactggaggaatcccaccattcatagggaatctttctgctctactttatctctcagtggagagtaataacatagagggagatgttccacatgaaatgtgccagctaaacaacttgataaggatacggatgcctgtcaacaaactaactggaacatttccttcatgtctttataatgtctcatctctcatcgaaatctcagctacagataatcaatttcatggctctcttccacctaacatgttccacaccctcccaaatctccaacgattttatgttgcgctcaaccaaatctcaggttcaatcccaccttccatcataaatgtgtctaagctttcagtacttgagattagtggaaaccaattcacaggacaagttccacctctagggaagctacgagatctttttcacctaaggttgtcttggaacaaactaggtgacaattcagctaataatttggagtttttaaaatcattgacaaactgtagtaggttggaaatgttatccatagctgacaataattttggaggtcatttgccaaattctttgggcaatttatccacccaactcagtcaactgaatcttggaggtaatcagatatcaggagaaattccagaaactataggaaatttaattggcctatctttcttaaccatgcaagataaccgcattgatgggattatcccaaccacttttgggaagtttcaaaaaatgcaagtgttagatgtaagtataaacaagttgttaggagagataggagccttcataggcaatctcagtcaattgtttcatttggaaatgggtgaaaataagttagaaggaaatattcctccaagcataggaaactgccaaaagttacaatacttaaacctttcacaaaacaaccttacaggaaccataccgctagaggtttttaatctttcctctttgacaaacttgttggatttgtcatacaactcattgagcagtagtataccagaagaagtgggaaacttaaagcatatcaatttgatagatgtgtccgagaatcatctgtctggttacattcctggaaccctcggagaatgcacaatgttggagtccctttatttgaaaggaaatactttacaaggaatcataccatcctctttggcatcacttaaaggtcttcaacgtttagacctgtcacgaaatcacttgtctggatcaattcctgatgttctgcaaaacatttctttcttagaatatttcaatgtatcttttaacatgttggaaggtgaggtgccaactgaaggtgtctttcgaaatgcaagtggatttgtgatgactggaaatagtaatctttgtggaggtattttcgaactgcatctgccaccatgccctatcaaaggtaagaaacttgcacaacaccacaagttttggttgatagcagtgatagttagtgtggctgcttttcttctcatactttcgattattctaactatctactggatgagaaaaagaagtaacaaactatctttggattcaccaacaattgaccagctggctaaagtttcataccaaagcttgcacaatggaactgatggtttctcaacaacaaacttgataggctctggaaattttagctctgtctacaaaggaactcttgagttagaagacaaagttgttgcaataaaggtcctaaaccttcaaaaaaaaggagcacgcaagagtttcattgctgaatgcaatgcccttaaaagtattaaacatcgaaatctggttcagattttaacgtgttgctccagcacagattacaaaggccaagaatttaaagctttgatatttgagtacctgaaaaatgggagcctagaacagtggctgcatccaaggacattaactcctgaaaagccaggaacattgaaccttgaccaaagattaaatatcatgattgatgttgcttctgcaatacattatcttcatcatgaatgtaaggagtcgattattcattgtgatttaaagccgagtaatgtacttcttgatgatgatatgactgctcacgtgagtgattttggcttaacaagacttctttcaactattaatggtgccacttctaagcaaacaagtacaattggaataaaggggactgttggctacattcctccagagtatggagtgggttgtgaggtatctacgaatggcgacatgtatagctttgggattcttatcttggaaatgcttacgggaagaagacccacaaatgaaatctttgaagatggtcaaaatttgcacaactttgtggaaaattcatttcctgataatcttttacagattttggatccatcacttgcactgaaacatgaagaagcaacaataaacgaagcacataatcagaaacttactccaagtgttgaaaaatgcttagtttcgctctttaagattggacttgcttgttcagtgaaatcaccaaaagaaagaatgaatatgatggatgtcactagagagctaagcaaaattagaaccacctttctttcgggttaa

SEQ ID NO: 28597 - DNA, 619 bp, Glycine max
  Peptide Sequence Number=SeqID_145375
tttttccatgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgggagggacgaatcaaagcgacaaggggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 28598 - DNA, 555 bp, Glycine max
  Peptide Sequence Number=SeqID_145376
atgaccggccctctcgatgagtcgatctcttgctttctcataaaggtgggcccttgggtactagtacctaacacctttagaggactgtatgtcctcgccatcagaggactgcacatcctcgcctgtagagggctgcacgccctcgcctttagagggctacgcgtcctcattttcagtgtgctccatatccacaccttaagagaatataagggatcgtgcccacaagacgcccagtggacccgaagaagtccaacggggccctggggtttccagctctggttacgagcctctgtagtcctacagggtgcccgtttcccccttgtagatggatcggttggtctgtgccgtcatgacatagggatcgtgcccacaaagacacccagtggacccgaagaagtccaacagggccctggggtttccagctctggttacgggcctctgtcaatcctacagggtgcccgttcccccagaatcgcacccacaaagacacccagtggacccggagaagtccaacagggccctagggtttccagctctggttacgggcctctgtag

SEQ ID NO: 28599 - DNA, 180 bp, Glycine max
  Peptide Sequence Number=SeqID_145377
atggaggttaaggaatctttgataggcttacgactaccattgcattatcgagcagatacgggagggtggtgtttggtcttggatgtgcagcaggtggattttatggctgatttaggggtggcctttgtggatgattgggcgttcttggttggtagggtggtgagtaataggaaggactga

SEQ ID NO: 28600 - DNA, 593 bp, Glycine max
  Peptide Sequence Number=SeqID_145378
gggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctggggggccagagccatcagtgagataccactctggaagagctagaattctaaccttgtgccaggacctacgggccgagggacagtctcaggcctcccaaaaggtaacggaggcgtgcaaaggtttcctcgggccagacggagattggccctcgagtgcaaaggcagaagggagcttgatgcaagacccacccgtcgagcaggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggtgtgggcgttagagcattga

SEQ ID NO: 28601 - DNA, 309 bp, Glycine max
  Peptide Sequence Number=SeqID_145379
atgaccaaacttggtctctgcgtgccaacggacacgactgtgtctgaatggcaaaggggtgcggataaccgtaaggtatctccgcgtatcataatgaccaaacttggtctctgcgtgccaacggacacgactgtgtctgaatggcaaaggggtgcggataaccgtaaggtatctccgcgtatcataatgaccaaacttggtctctgcgtgccaacggacacgactgtgtctgaatggcaaaggggtgcggataaccgtaagaatgaccaaacttggtctctgcgtgccatcggacacgactgtgtctga

SEQ ID NO: 28602 - DNA, 336 bp, Glycine max
  Peptide Sequence Number=SeqID_145380
atgaaggttgaacaactctttgcttgccaacatattagcgaagagagaaaagttccattggctacccttagatttcaagtagagtattggaatgatcttaagagtgcccttaggaagaggcacattcctttctactatgaaatggagcttattgacaatatccaaaggcttagacaaaggagtatgagtgttgaagaatatagacaacaaatggaactactccttttaagagctagacttagggaggaggaaagaacaagcatagctaggttccttagtgggcttaatatggaagtgagggaccaggttgaactccttccatataaggacctataa

SEQ ID NO: 28603 - DNA, 1080 bp, Glycine max
  Peptide Sequence Number=SeqID_145381
atgggacggggttggggatacccgatacccgacgggtacggggatgagacaataaacttaaactcatcgggtatcgcgtacgggtatgagaatatgttggagagtcaaggggaggatcatgatccaaggagaaagaggacgacaaaggatcgtcccgttgatgtggaatttgcaagcatgggaactaaaattgaatattccataaatcttctagcatcctcagtagacagcaacaacttcattgtgggtggtgtggatgtctgggagcattatcagaacaaaggagagactaacaaacattgtagtattggagtgaataaattgcaagatccaatggataggatgcttgacagaaacaacatagagtccatcaaaaagacaatgcagatgcatgaggaaatcttcaaataccaggtgagggaactacatagagtatacagtgttcaaaagatccttatggatgacctaagaaaggaaacaaaacaaaagaaattttggacccctatgaatggcatagacataagccattctcatttccttcaacaacaacaacaaactactactacactaatttcatatgggcctgatttccatgtccaaagtttgagagaggacttatgctcaaaggaaaggagtggaagctgttctggagagaccataaaaaggcaaaggggttttgacctagaaaggcctgctgagagagacatttttggtggcggctgtgatgaacatgaggcaggacttagctcctacactgcactagagagatgcaaaataagcagcaacaatgatgatggttatgatgaagacatggaagtggatttgactctaagcataggaggaggaagccaagttaatgataagaagaatagtagtagtaagaaaccttatctgcttccattagggtgctcagactcacccaatgggaaaactagggagctaaattcttctgtctctttccaatcagatagggtgggagatttcagtgaccccaccacccctatgagcagctcaagtgtgacatttgatcaagagagaaaggggccacattggctttctcaaggtttaaagcttaaatag

SEQ ID NO: 28604 - DNA, 237 bp, Glycine max
  Peptide Sequence Number=SeqID_145382
atggagaagaaagaaagcacggaggaaacctcatgtagcaaacagaaaatggaaaacctcagtaaggggaaaactcaacggcaagtgaagctggaagaaacgaaccacaaaattgaagaaaaaaagcaaacgggagaaggtggggaaatgacgaaacacagttcagaggaaacaacgggagaaggctggagaaggaggcacgtggagcaaccaaagcttgaagcggaaataaaatga

SEQ ID NO: 28605 - DNA, 501 bp, Glycine max
  Peptide Sequence Number=SeqID_145383
atgaatttattcctcactaatacatcaattgtgcagtatttttacggcttagctggagatgagattggtgctgccttgaagaagttatttgctgatggtgtagttaagcgtgaagatatgtttatcacctccaagctatggtgtaatgatcacttgccggaaaatgtcccagaggcatttgataaaactttacaagatttgcaactggactatttggatctctaccttatccattggccagtcagtgcgaaaaacgggaagcttaccaaacctgacatacctagcacatggagagcaatggaggcactctacaattctggcaaggctcaagctataggggtcagcaatttctctgtaaagaagcttcaggatttgttggatgtggcaagtgtgcctccagctgttaaccaagtggaattgcacccttcattacagcagccagaattgcatgctttctgtaaatccaagggagtgcacttatcagtgagtgtgcaaatttaa

SEQ ID NO: 28606 - DNA, 1083 bp, Glycine max
  Peptide Sequence Number=SeqID_145384
atgagcaccgaaaaggagaaaacatctgcaccttcttcttcttcttcttcttcttcttcttcaccttccgtcgagctctgcaagggtgtcaatggcctcgagaagattcttctccgcgaatcgcgtggttcctccaccgaggtgtatctgtacggtggccacgtgacttcttggaagaacgatcacggcgaggaattgctttttctcagtaataaggctatatttaagactccaaaggcaattcgtggtgggattccactatgctttccacaatttggaggccttggcacccttgaccagcatggatttgctagaaatcgattctgggccattgatgatgaccctcctccttttccaacaaatactctgagcaaagcctttgttgatttgattcttaagccctctgaagaagacacgaagatttggcctcacagttttgaattccgtcttaggatagctttgggacctggaggagatctgatgctgacatctcggatcaggaacacaaacagtgagggaaagccattttcgttcacctttgcatatcatacgtatttctctgtatcagatataagtgaagttcgggttgagggattggagaccctggattatctcgataacttgcagaacaaggagcgctttactgaacagggggatgctttaacttttgaatcagaagggtgggcattactaagtatgttctggttgatgatatgccacccattccatatctggtgggtattagctaaacccaacccatttatttctgttgacaagatatatcttagcactcccacaaagattgcaattattgatcatgaaaaaaagagaacatttgttgtgcgtaaagatggccttcctgatgctgtggtgtggaatccttgggataagaaagcaaaggccctggctgattttggcgatgatgagtacaagcatatgctttgtgtagaggccgctgctattgaaaagcctatcactttgaaacctggagaagaatggaaaggaaggttagagctttcagctgtgccctctagttattgcagtggacaacttgatccccagagagttcttctgggaagctga

SEQ ID NO: 28607 - DNA, 996 bp, Glycine max
  Peptide Sequence Number=SeqID_145385
atgggacagagaggcctattaacatgggggagtcatgttctgggtttgaatcacttggttcaacaactccttaaggctgtgatgatctgtaacaatggtgaaatggtgcccggtaagggcttactgaagaaggctatggggtgtccctactgtaaaaggacgacacccatgccaatgcttgatgcatctgtctcaatggtgaacgggagcttgaagtctgggctctatgggggtagccttgaccatgggtgcaacaatggtggcataaccatggataaagcgacgatagaacccagcgaggcccataaagcttcgaagagctttaatggaacacgaagtgggccattgttgaatcacaacaattttggaagcaactggttcaacccctttatgcaagaccaggtggctgagatggtggagatgatccttaggaatgccgctatagatgagaatgtcgtcgaaaaagatgatgatgaagtgtcggagccctgtaacaggtctagcatggagaagcaacgcgcaccatcgagttcatccaagagctcgtcaattgtgggaatcgggaatcgatccttaacggtgagggcattcaaggctcggaaccatggtgacgtggaagcacgtggcattgccaggtttacggcacaagcgtcgaaggtgaggttgagtcatcatccccattctagcatccttatttcctcgcaattcgaccaggctaccttagtgaaagaattgtatgacgtagaggtctaccgtgaaggaggctatctggaggtcgatcgtgaccgcctcacaaagccaacgacactccaattgttggtcgttacccaccataaccgaaagaggagtagtggtgcgaaaagggagtccgagttgggtgacgaggtgctattggatgaaattgtgggtgctcccaccgtccaccaggaagagcaccacctggccagaaatcttacccaccactctgatggtctcgagtgccaaatggctcgctaa

SEQ ID NO: 28608 - DNA, 1047 bp, Glycine max
  Peptide Sequence Number=SeqID_145386
atggtagatttaggaatcaattcatatgagcaaaaagtaaacagaactgaacaactagtaatgggagatccttgcttctttgtggtcttatcgtccttgctgctcctcatagttagtacacaaacaagctcagctcaacttactcgcggcttctatctaaacacatgccccaatgtggaacagttggttcgttcagctgtggagcagaaattccagcagacctttgtgactgcccctgccactcttagacttttcttccatgattgctttgtgaggggttgtgatgcttccattttgctcgcatctccaaacaacaaggcagagaaagaccatcctgatgatatttcactcgctggggatggctttgacacagttgctaaagccaaggcagctgttgatagtgaccctcaatgcagaaacaaagtctcttgtgctgatatacttgctctggctactagagatgtgataaatttggctgggggaccattttataaagttgaactgggaagacgtgacgggagaatatctactattgccagtgttcaacgccagcttcctcaccctgatttcaatttagataagctcaattccatgtttagcttccatggcctcacccagacagatatgattgccttatcaggtgcacatacaattggattctctcactgcaatcacttctcaagacggatctacaacttcagccccaaaaaactaattgacccaacactaaacttacactatgccttccaacttagacagtcttgccctctcagagttgattccagaattgccataaacatggaccctgtcacacctcaaaagtttgacaaccaatacttcaagaatctccagcaaggaatgggcctattcacttctgatcaggtgctggccacagatgaaaggtcaaggggcacaatcaacttatttgcatcaaatgaacaagctttttacaatgcttttattgaagctattactaaaatgggaaggataggtgttaaaacaggaagacaaggtgaaataagatttgattgctccagggttaactga

SEQ ID NO: 28609 - DNA, 168 bp, Glycine max
  Peptide Sequence Number=SeqID_145387
atgattggcagagggtcgaagcttcggcaagaaaggttcgccagagagaagcaagtgagagatgagtggcagagggttaggagagcaagatgcatcttatgtggagacgaagatggagatttgttaattgagtttcataacattgaagatgcgacctgcagaaattag

SEQ ID NO: 28610 - DNA, 273 bp, Glycine max
  Peptide Sequence Number=SeqID_145388
atggttcctgatgatactattgactatgtatacgggaaaaatggtagcaatttggcttgtctaagacagaaccctaataaagcaaccagaggaagaactctagagagcaccagaaatgccaccattgctaacggaaaacacttgggcgactacattgaggtgagccagcctatgatgataatcatgttggagatggaaagacttagcctttctcaaggtgtcacatttagtggtatcagagcaggtcggacctttcggccatgtatgttatga

SEQ ID NO: 28611 - DNA, 2316 bp, Glycine max
  Peptide Sequence Number=SeqID_145389
atggcatgtgacttgcagaggatacccactaaaacatggtttaacctctgctttgaaaagggtcaggcagaacctgttgagactgattctttgaaaagggaattactagacacaaataaatgctatattcttgattgtgggtttgaagtgtttgtctggatgggaagaaatacctctcttgatgaaagaaaaattgcaagtggagttgcagatgagttagtcagcggcactgatcaactgaaaccccaaataattcgtgtgatagaaggatttgaaacagtgatgttcaggtccaaatttgattcttggcctcagataactgatgtaacagtatctgaagatggtcgtggcaaggtagcagcacttctaaaacgtcaaggagtaaatgtaaaggggttgttgaaagctgatccagtgagggaagaaccccaaccccacatcgattgcacaggacatttgcaggtttggcgcgtgaatggtcaggagaagattcttcttcaagcttctgatcagtcaaaattttatagtggagattgcttcatctttcagtatacatatcctggagaggataaagaagattgtcttataggaacatggattggcaagaatagtgttgaggaagaacgagcttcagctaattcattggcaagcaaaatggttgagtcaatgaagtttcttgcttcccagggtgggcttagtgaaggatataagacttacattgcacaaaaggaaattcctgatgatacatacaatgagaatggtgttgcattattccgcatccagggctctggaccagacaatatgcaagccatacaagttgaacccgttgcatcttccttgaattcctcttattgttacatacttcataatgggcctgctgtctttacttggtctggaaactctacaagtgcagaaaaccaggaacttgttgagaggatgctggatttgataaagccaaatttacaatccaaaccacaaagggaaggttctgaatctgaacagttttgggattttttaggaggaaaatcagaatatcccagtcaaaagattcttagagagcctgaaagtgatcctcacctattctcttgtcatttctcgaaagatgctagtttgatcaacttgacactgtcagaaaatctatcttcctggtcacctctcattctcaacatcttcttccctcatataatcatattcaagcttgtccatgattcgagcatccttgtctcctatcctcatctatcatgtgtccattctgttagaatttctccttccgtcaatagctcctatgcatttccggccttgactggcattcataatgtcgtacttcaggtgacagaggtatacaacttctcccaggatgatttgatgacagaagatattttcatcttggattgtcactcggaaatctttgtctgggttggccagcaggttgactccaagagtagaatgcaggctctaacaattggtgagaaatttcttgagcatgattttcttctagaaaagttatctcatgtagctccagtatatgttgtcatggaagggagtgagccacctttcttcacacgcttctttaaatgggattctgcaaaatcttcaatgctgggaaactcatttcaaaggaagctgacaattgtgaaaagtgggggtgctccagttttggataaacccaaacggagaacaccagtatcttatgggggaaggtcgagtagtgtgccagataaatcctcccagcgttcctcccgcagcatgtctgtcagtcctgatcgtgttcgagtgaggggccggtctccagcctttaatgccctagcagctaattttgagaaccctaatgctaggaacctttcaaccccgcctccagtaattagaaagctgtatccaaaatctgtgacaccagattctgcaatactggcgccaaaatctgcagccatagctgcacttagttcttcttttgaacagccaccttcagcacgagaaactatgataccaaagtcaattaaagtgagtccagtaatgcccaaatcaaaccctgagaaaaatgacaaggagaattctgtgagcaccagagtggaatctcttaccatacaggaagatgtgaaagaggatgaaattgaagatgaggaaggtcttgtgattcacccatatgaacgccttaaaataacatccacagatcctgtaccaaatattgatgtgactaagcgagagacttatctatcatctgcggagttcaaagagaaatttgcgatgtccaaggatgccttttacaagttgcccaaatggaaacaaaacaaactcaaaatggctgttcagttattctga

SEQ ID NO: 28612 - DNA, 657 bp, Glycine max
  Peptide Sequence Number=SeqID_145390
atggtacttgctaagggtgaatctttgcctgcctactcaagatattgtaggatgcctactgacattagagaaattgaggttgcattgtgcatacccggccaagggtttattctaaatgttgaaggtcacccagggaagatcctcagaaaagatctaaccacccttgctcaggtctggagtgttctatcctactccaatctggctctgacctcccacacttcagatctgactatggatcgagctaggttaatctttggcctagttactcagctggacatgaatgtcagagccctcatttctgggcagattacttctatggcccagtctaactcctccaaacttgggtttcctgctcttatcatagctttatgcaggaccagaggagttacctccaacactcttgtctttgaatgtctgagccgggtcattaatttggcctacataaggaagaattgttggaaccctgatgatccaacaattattattaggggggccagaagaccaagggcaaggacagctgaggctctttctacatcagcagctcctcctccagctcgtattgtagcagctctttctaccctacctcctgcaaattttcaatgtttcgaagcatacatcaggggcagattattttgctgcaaagtctccagatggtag

SEQ ID NO: 28613 - DNA, 381 bp, Glycine max
  Peptide Sequence Number=SeqID_145391
atgaagcttttgatctttcacaaacttgccaaatttattcaaaatgagaaaggtcacaatactgtttcaattaaaagtgatcatggaggttttcaagataaggattctggtcttaaaggtgaaaccaaagttgaggagcttgaacaaagcaaagaaatcactgccacacctcctaaagagctccttagagaatggagaactcaaaaagacctctccttggacaacattattggagaaatatcaaagggagtttctacttactctagactcaagattttatgcaataacatggcttttgtttctcagattgaaccaataaacatatatgaagccttgtacgatgaacattggttgatggctatgcatgaagagctaaattag

SEQ ID NO: 28614 - DNA, 757 bp, Glycine max
  Peptide Sequence Number=SeqID_145392
atggtagaagaatttgaagagatcctaggatgccctctagggggaaggaaaccatacctcttcgcagggttctatccctcattagctagaatttctaacatagtccaaatctcggcgcaggaattagaccacagaaagcaagtcgaaaatgaggtggttggaatactgagaaaatatttggaggcaaaagcaagaatcttggcaggtaaaggcgaatgggccccgttcatagatattctcgcactgttgatcttcggaggagtcctctttccgaatgtggatgggttggtggacctagaagcaatcgacgtttttctcgcctatcataaccacaaggaaagcccggttgtcgctatgctagccgacctatatgacacctttgaccgaagatgtgagaagagcaatacgaggattgtttgctgtactctagctctttatgtatggttggtttcacacctttttcgccaagaggtaaggcatgcttgcccgctagaaagtcaccgttcatgcacagagaaaggaggcgcaaattgggaccaactcttagcaaaccaagaaggagcatcaatcaactggttccctcgatggaaagaaaggagagtcggagttcttatttcgtgcggaggatttctgaatgttcccttgatggggacagggggttgcatcagttacaatcccgttcttgctataagacaacttgtttaccctatgagaggggcaccactagaggaagagctcgcgcctgtcatttcacgag

SEQ ID NO: 28615 - DNA, 282 bp, Glycine max
  Peptide Sequence Number=SeqID_145393
atggcacgcagcgtgtccgctccgtgcccatattcaagggacctatatgggagacagctaaaagggcttttagtgataatccccagggtggtcatatctctcttgatggtctctagagtccccagtggagtcgccacctgtcgcaacctacccttcggtgggagggcgaagcgtgactcgcgggtgcgtgttccaagaaaggaatacgtgcggagtcgccaccaacgtttatttgaggaaaacgtcggaaaaaacggaaaagacgtgatctacgaactttaa

SEQ ID NO: 28616 - DNA, 1499 bp, Glycine max
  Peptide Sequence Number=SeqID_145394
tccgtcagcacgcgcaccagctgcccgctcgccagctgcgcctgtacgtagcgctccgggcagtagccgagaccgtaaccgccggcgaccgcatcaataatcatgtcgctctcattgagcgtcagcgtgcccggcacatcgacctcatacatcgtccggatgctgcagcggcggcgcgtcgcgcaggtaatcgggtgacgccaccacgatccagcgcagtttgggcgtcagcggcatggcgatcatatctttcggtacgcggcgccgtagcgaatcccggcgtcatagccgctgccgatgatatccaccagattgttatccaccgtaatttccagactgagctccggataggtcgccataaagcgcgccaggatcggccgaaacagcagctgcccggcatcacgcgggatgtgcagatcgttcagcgccagctcaatctgcgcaaagccggtttccagatggcgcaaaaaagcggcaccggcgtccgtcggcaccaccgcccggctggtgcggttgagcaggcgcacgccaagacgcgcttcaagactgcgcaacgtgtggctgatggccgacgtggtgaccccgagttccagcgcggcgaggcggaaactcttgcgccggcaaatcagcagaaaaacattcagatcggccacgaagctgccgtaccggacgctatgcgtgcgtggcatggcaggcaaaacgtcactgttaaccctgagctcatcatgctgcccgaagaccgaaaagacgctatttatcgctacctgtttgcgaaacgatcggccaccattcacgaactggccacgctgatggcggtgtcggcgatgaccatccgccgcgatattaaattcctgcaggacgccggcctggtggttagcatacacggcggtgtcaggttgcctgcagtggtccatcaggcattgccgtatgtggagaaggcacagctgaacgtgcacgccaaacaaagccttggccgttatgctgcgtcactggtagaggatggccaggtggtctacctcgatgccggtaccaccagctatgaaattgcgcgtgcgttaggcgatcaggtaagtctcaccgtgctgactaacgactttacgattgccgcctggctgatgcgtcacagccacatcacgctatttcatacgggtggcaaagttgataaacggcatattgccagcgtgggtgccatggcggcgaccgcccttgccgcgttcaatattgatctggctttcctcagcgccagcgcgtgggatgtcacgcacggcctctcgacacccgacgaaaacaccttgctggtgaatcaggcggtgctggccgcctcagcgcagcgttatctggtggctgacagcagcaaatatggtcgttacagcgtgtattccgtgtgtaagctgcagcagctggacggtgtgatcaccgatgacgattgcccctgtgctgccgttgaggagatgaaacagcgtgatattcgtctgcaccgggtaaatcgccgtggctga

SEQ ID NO: 28617 - DNA, 603 bp, Glycine max
  Peptide Sequence Number=SeqID_145395
atggggcgggtcaccgccccgttttgtcatctgcgcaagcgcctgcagtcacctgccctgcccgttcgcggtgtcccggtacgtgccttacggctatgtgaacacgcaagtgaaacgatgatgaacaacgatctgacactggaattgagcgcggtcctttcgctggactgcacccgcagcggcgtacactgccagagtaaaaagcgcgcgctggaaattatcagcgagctggccgctaagcagctcaatctgccgcaccagacgctttttgaagccatcctgacccgtgaacgcatgggcagtaccggcattggcaacggcatcgccatcccgcacggcaagctggaggaggatacgctgcgcgccgttggcgtgtttatcagcctcgaccagcctatcgcctttgacgccgtcgacaaccagccggttgacctgctgtttgccctgctggtgcccgcagaccagtgcaaaacccatctgcacaccctgtcgctggtggcgaaacgcctggcggataaaaccgtctgccgccgtttgcgcgcggcacagagcgatgaagagctctacgccatcattacagaagctcaggaagatcacgcttaa

SEQ ID NO: 28618 - DNA, 810 bp, Glycine max
  Peptide Sequence Number=SeqID_145396
atgtacaaagccaggttggtttacggcttagtctcaggcatggacatgaatatcggagccctaatctcaggtcagatttctaccattgcccagagtaactcctctaggctcggattccctgctttgatcattgctctatgcagagctataggagttacctctgacagtctaacctatgagagtctgagcccggccattaacttggcctacattaagaaaaactgttggaatatggattatctaatagttaacttcaaaggggctaggaaggtaagggctcgactaatagatattccttcttcttccacaccatttgctccttccacttcagccactcatacaccagttcctcccacttctgccacccttgcaccaattgcccaggactctcagttctttgaagccatgcttcagagtattcatcaggggcatattttattactgcagagcttgcaggtggtagctcctccagggtccattctgtcagtagagcaattcattgagaaggtatcttggcctagaaccttaccttctgttgtgagagagggtgagggccccagtgctcaggtacctcaacaggtacaggatgagtcttatgaggttaccatccctgaagcttttgatttttcaggtgcaggagtagagatgagacctgatgaggttattcctcctaagccaattgtgccaattatacatgagacttttgaagcaggtgagtcacagttgaggcaggaggctgctactcctgagaggacaccacagaccccagaaggtccactctcaccagggatggacttatcttttgcttag

SEQ ID NO: 28619 - DNA, 222 bp, Glycine max
  Peptide Sequence Number=SeqID_145397
atgcaaaaatctggtccagttcctgtacccactgatgaggtttccttagtggggcaggcacttcacaccttccttgcttggtcaacacatctggtcaagtctttatcacagcagaggtttgagcaactaaagaatcctaggaaaaagagtgagcaacatactagtaattcaatgattaacaatgaagatcttttaaccatatacatatactttactaattaa

SEQ ID NO: 28620 - DNA, 960 bp, Glycine max
  Peptide Sequence Number=SeqID_145398
atgaagggctatgattataagagtttgaggacccttgttcttgatgaccaatctttgggtggtagcaactttgttggtgatgattttgttgttggtgttggcaaacttgttcaacaggatcaaatcattgatttgaccaaccaaaccatgcaatttgacaaagagaaagagaaagaaaaggagcaagataaaggaaatgagcaagagaagaagcaagcactagatagtaatgttaaccttattgctcaagtcgacaatggtggcaatgaaaataacaagttagatttgaatgttcaagtcaaaaacaatggtaagaagacaacctttgaagttcccaatccttctcctttgccgcaagatatgcaagtggctccaaatattgttttgctttggaatgttgatctcactggtccacacgcttgctatagtttagaattggaaagaatagttgttgtctctaatgaaaaaattagagtgatgcatgagcaattgaaaatcatgaaagctaacgttagtaagactaaacaacttggaatagccttagccaaaagcaaagagttggtgactaagttaaaaatagatttggatgagcatgtttcttcaatatctaccaagtgtatggaaaatgacactttaagtatccgagttgttgcattgaagaaagttgttgtatatgctaaagtcaagtttgacaactcttcacaatttattgttaagaaagccaaaagtaagagtgctaaggaggaaaagaaaagtgttaaagataagttgacatctaccaatgtggagcttgtcaacttgaaacaaactgttgcaaaattggaaagtgagttgcaggacaaagacaaagccaaatctgatttgatttttgaattggaggagattgttagagaatctcaaccctattctaatgaagaagaggaagagaaaaatgaagtggactcaactatggctagttag

SEQ ID NO: 28621 - DNA, 1095 bp, Glycine max
  Peptide Sequence Number=SeqID_145399
ggatatgcaaccatcttagtcaaaatcaaagaccttgatcctggtgttgctctacattcaatgatcactgctttgaagccaggaccatttgctgataaatgtgttgctctcaaagataagattgaagaattaatactagaaggagctcttaataattatatctacaaccctaacaacaacatgggtggtaatcaaggagaaaaacaagaacatgggggaaacaaaccagaacaaagtaaccaagcaacaggaggaaatggagttagacgtggtgtcataaacaccatcactggagcacaacacatggcaaagaaatcacttcctccaataacattcacaaatgaagattttgtaggagttgatcctaaccaagatgatttgatggtcatcataatcagaattgcaaattgggatgtgaagaaagtcttgattgatcaaggaagcttaaccagagtgcttttcttgtcagctttcaaaaggttagatatctcactaaaactgattaaaccccatcaagaacctttacttggttttacaaaaggacaagttcatacctgcgattatgtggaacttgagaccacctttggagtagggaaattatctcaaatagtgctcgtccaatacatcattgttgatgcaaacacatcatgcaatattctcattaaacgaccttctctggatgcccttggggcaattcctccaagttttagcctaccgtgtataacctcgaacaaaaaggttaaagttgtggatgtcaaccatgtcgttgagttatatccaatcgattgggttgattttgaatcaagaaatgaggaagacaaaaagccaacaacaattgaagagttgaactcattccaagtcggaaaggaacctcacaaatgtaccaaaatcaggaaggaaatggacaaagatctcaaaagaaaaattgaagaagtgtttaaacagtttgtttgtctgaagaaactcaatgaagaaaaaaaacgagttgtccaagaagaatatgagaaactaatcaaagctcgtttcatcaaagaagtcaaatactccacatggcatgccgatatggcaatggtgaagaaatccaatggcaaatga

SEQ ID NO: 28622 - DNA, 285 bp, Glycine max
  Peptide Sequence Number=SeqID_145400
atgttcttcagtgtgaaaaacatgatttttcaatcttcttctctccaaacgctcacccaaacactaacaccttcttatccaccacccacgaccaccggtggccatcacaagccaccgttgcttgtggtcggatcaccgcacgaagaagaacattttaatcagagaggaatcctcaaaatccacctcaaggatttgatagagaaacaagctctcaatcctttctttcataatatctctgagaactatgcatttggaccaacgaacatgaacgtgagaggtctctaa

SEQ ID NO: 28623 - DNA, 159 bp, Glycine max
  Peptide Sequence Number=SeqID_145401
atggcaagaaaatgcaacatcaacatccaatatgagtttaataaccctgctttagaggtgcatgcactactaagtctcaatatcaccaccaagaaggtgaagtccccattgcttcaaatttgtggtagagaccccactgttaacaaaatggaggcctaa

SEQ ID NO: 28624 - DNA, 351 bp, Glycine max
  Peptide Sequence Number=SeqID_145402
atggttgatgaagttctgaaggtccagattgatggcttcctgcatgatatcaagattgttgaagaccccaacttccgttgttgttctattggcaactcccaatcgagctctaatagctctttaatggtggatttagatatagaagctggttttatgctagaagagtttgacagtgacaatggtattgtaactcttttcgagggcccaaagatgatgacaaaaagcccaaagaatgatttcaagaatgagtcaacaagttcaagatcaagtttaatttcaagtttcatgagaagaaatcaagaagattcaagaatcaagagaagattgatttcaagattcaagagaagatga

SEQ ID NO: 28625 - DNA, 867 bp, Glycine max
  Peptide Sequence Number=SeqID_145403
atgggggagcatgtagcagcggtgcacactgctactaacgctttgcaagcattagggaggggttttgatgtgaactttgatacgaggttgctttattgtaaaggagtttcagggtctagggtagttgagattgatgaagaacaccgtagggagctgtggttgtacgaggatgtggctgttcccgatgtttccagggacattggatgctaccaggaggctatggtgcgtcagagttctggggtccgcagttttaaagagtataggggacatatctttggggtgtttgatgaatttaacagcggttatgagttgctttttatgattgtggacaagagatggtcctggtgtaatgaaattgagatggtggaatactttaatgaaagggcaaatgtatcagggaagtttcctattgggagttttaattctgcatttagcttcactggttcaaaacatgttgatgaagcagctacaaaaaccttgtcttcagatgggttttacattcctcttgcaaaggttcagcttcaaaaatcccacttaaggttgcaaggaaatgtcaaaaaggctgtcccagtcaattgggacccactgtccttggcaagttttattgaaaattttgggactcatgtcattacatcaataactatgggtggtaaagatgttatttatgttaaacaacaccatacttctcctttgtcaaagttggagatgaaaaactatattcaggatattggaaatcagagggtgttgatcccttttcattcaatagtcaaggggtttatccccaacccacgactgcaacatatcctattgggaaagaagtatgtaatggtagtttttacaattatatccaaaatcatggccatttaa

SEQ ID NO: 28626 - DNA, 1071 bp, Glycine max
  Peptide Sequence Number=SeqID_145404
gatgtcacagtcatttttagaagaagaggaggagatgatttggaacaaaaccacagtaaatggttatcaactatcaagtcctccccagatatcattgagatgactttctgtcctataactgatctccttgatgagatacctgccaaggagcatttgactcgtgccattggtctttatcttgaatataaacctcctattgaagaacttacatatttcctagagtttcagattccttgtgtatgggctcctttacaggacaagattcctggtcaacaaaggaaggaacctgtatgcccatctttgcaattcagcataatgggccagaaactttatgtcagtcaagaacaggtaaagcatccagaaaaatttgtacacagattcaagaagttttccgtgtcacattggtgtttggtggctaaatttatatacatattggctacttggattacagtcggacgtaggccagtaactggcttacatctttgtctagaaggaagcaagcagaatcggctgagtgttcacgttcaacacttggtatcccttccgaaaatccttcacccatattgggacagccatgtcgctataggtgctcccaagtggcagggccctgaggagcaagacagccggtggtttgagcctgttaagtggaagaacttttctcatgtgagcacggcaccaattgagaaccttgaaaccttcataggagacttctctggtgtctacatagttactggagcacaacttggagtgtgggatttcggatcacggaatgtattgtacatgaagctcttatattcaaggttacctggatgcacgatccgaagatcgctttgggatcacatcccgaacaagccgccaaagactgtgaatgctggaaacacctccaaccttgataactcaacccttaaagaaaatgccacaggcaacaagttggtgaagtatgttgacttgtctgagatgaccaaaggaccccaagaccctcctggccattggttagtcactggtggaaagcttggtgttgaaaaagggaaaattgttttgagagtgaaatattcattgcttaattactga

SEQ ID NO: 28627 - DNA, 525 bp, Glycine max
  Peptide Sequence Number=SeqID_145405
atgattcgtgaccttggacaaaagtcttttcaacaagaacatgcacctatgtatgatacattgcaaactgattcaaagaagcctttgtatccagggtgcaagaattccttgaagctgttgtcagtggtattaagtttggttaatgtgaaggccagatatgggtggagtgacaaaagctttagttcactgcttcaagtagtacacaatattcttccgaaggaaaacacattgccaaaaagttactatcaagccaagaagatattgtgtccaatgggtatgaagtatcagaagattcatgcttgccctaatgattacatactgtacaaacatgagtttcatgaaatgcacaaatgtcctaggtatggggtatcacggtacaaagtgaaggatgatgacgagtgtagtagtaacgaaaactcaaagaaggggcccccagtgaaggtgttgtggtatcttcccattattccaaggttaagtgtctgtttgctaatggagacgatgcaaaagaccttacatggcatgtaa

SEQ ID NO: 28628 - DNA, 342 bp, Glycine max
  Peptide Sequence Number=SeqID_145406
atgccttggccaactgtgtcacaaggatttataatgcctcttccaatacccagcaaggccaacaccatcaaaaagagtggaaatcttatttcgaatgttcaacccaatcagataaaaactacagttgaacttctatccaacggattgaaccgcgtcaaggaaggtggtgtgaatttgcaaggatgttggtgcgacaaagatgcaacgacccgcgtccaagcccagtcatcgcgtgcgcaccgtcaccacccagatccacctttgttggtggtggttttcgttagagaaggggaagaaggggagaaaggaaagaaggataagaggaagaaggtgatgacgtga

SEQ ID NO: 28629 - DNA, 204 bp, Glycine max
  Peptide Sequence Number=SeqID_145407
atgaagacgccacaatctgcatctaaattgaaaagctgtctttcagttatctgtgctcgttgtgattttgagcctagaaaagggaagaaggtaaaggtaagagaaaaaaagaaaggaggtaacaaggaggaaaaaaggaaagttgttgacgtccttgaatctcatagcatgctggagaatgaccatgatgaaggggaaggttag

SEQ ID NO: 28630 - DNA, 716 bp, Glycine max
  Peptide Sequence Number=SeqID_145408
atgcggatcggtcagggtgtggttgcggtgatgtgccaggtgcgaatcccggtagagaccatacggataccacaccgccagcggcagcatgccaaacagctgattaaggtgcggcaggcgcgtcggatggccatgaatcagctcatgctgcagcgacaaataccaggtcggcaattcgctgcgccagagccagctgcgcgccagctgatgcaccacttcgcgctgttgcgcactgaggatgtgctgctgcagtcgattgacctggcggtcgccgccgaagaactgggggccgacggtgcctatttccgcgtacaccactttgcccgccagctgagttcaccgtttccgctgctggcggcggtcggtgccaaaaccagccgcatcgagattggtaccggtgtgatcgacatgcgttacgaaaatccgctgtatatggcggaagacgccggggcagcggacctgatcgccaacggccgtttgcagctcggcctgagccgtggctcgccggagcaggtaattgaaggctaccgctactttggctttaatccgcgcgaaggggaaaccgatgcggatatgggacgtcgtcacaccgaagagctgctggaagtgctgcgtggcgaagggtttgccaaacccaatccgcagccgatgttcccgaatccaccggggctgctgcgcctggagccatattccgaaggcctgcgcgagcgtatctg

SEQ ID NO: 28631 - DNA, 509 bp, Glycine max
  Peptide Sequence Number=SeqID_145409
atggcgcctgctgttcctgaatctcaactatcattctgtacatcacgatctgcccggtttaccctgggttttcgcgttgccggttacggcgaatggatgaagcgcttctggcgtcagccgattgacgttaacgcccacccgggacaccacaaggacgcacagaatgcacatcatctctttaccgatgctgaggtgcagtggcacgaagacctgctgccacactggcgtgatgacaatctgctgctgagtcagacctgcggctatccgctggtcgcgctattgcctgacgtgcaactggtgggcacgtttcagtccaatgcgcctggctgccatgatctgcgctatcgcagctggctggtggcacggcaggaagatgagaacctgagcctcgtcgatttccgcggccgccgcgcagtgtgcaacagcaatgactcacactccggatacaattcgctgcgctacgtggtcgcgccgctggtccaggacggcaaattcttcgccactacccg

SEQ ID NO: 28632 - DNA, 948 bp, Glycine max
  Peptide Sequence Number=SeqID_145410
atgcaggcttacctttgtcggcggcggctgcaaacggaacaacaggcaacggacacgagatgctgtttgtcagagacgaagctctttgtcggagaagaaggtggcctccacgtgaaaccattaacgatacaaagtcgggtgttcgagaggaccgtcgtggtacttgaacgcctccaatcatgtggcctacacttgaaaccaccaacaatccaaagacggggatctgttcgatgcatgcttttcactgaagaggggaagtatgtcctctcgtctgctattggagaaagatatgttgctgtttggaggatagaaggtgctaaaaagcagtcagctagttgtgttcttgcgatggagcaccctgctgtctttcttgatagcaggtgcattgatagtggggaacatgatgaggttggcatatgtgttttggcaatctcagaaattgccatttgttatttatggtttggtaatagtatcgaagaactgtgtaatacaaaacccacaaaaatatccttatctttagaaggcatgccctccagaaattacaagggagctctgccagcaatatatgctgcaaaattacaaggcatccagaagccagcctctgggcaagtttttcttgtttatgggttgcttgtaaaaccatcatttagaaaaattctagtgcattctggtgcggacataaaattgaatgtctctcatgatggtgttcttcttccaatgagtcaatctcttgtcaaatataagaaggggacaaatgctcaaacagctactgcactagaccgagctaatgctgaggaagccttgcttccaattcctaaggtttttgattctcatgagaaagagaaagcatttcaaaactctctggacaaggatgtaattgatgatttccatagaagtagtaaagatgattctgttgagatagaaggtatcgatatgattttttcttga

SEQ ID NO: 28633 - DNA, 390 bp, Glycine max
  Peptide Sequence Number=SeqID_145411
atgtggaagtcaagaactttgatatgtgtggcaaagctttactcagggtttgacaatgagtctcctaggagcaaagttgtggaaagtttgtggcaagatcctgatgtcaatgattctggattaacagaaggttctgaaactgaagaagatgttgggtttcattcagatgaagaggatattggaattaatggccaaccaatttctgaagattcattgcatttgagctctttcgatttacatttgcaacataatttatccaaagaagaaattgacagccaaaggaataggaaatttagctgggagactccagctattggcatgtcaaattgcaagtggataggtgtagaagcaaatgactttgatgttttgatgatgatcatgatgatttga

SEQ ID NO: 28634 - DNA, 282 bp, Glycine max
  Peptide Sequence Number=SeqID_145412
atgaagccctctagccaagtggaagtggaggttgatgggatggtggtaaagttgttgggaccttggctcgtggtggttggtttgatgttcatacaaggtgagaggagttcttgtggtgaagatcacactttgagtggggaaaagtgttatataatgagtttgtggatgctctctctaatgtctcgcttaagaggcatcaacatgatcgcttattatgggatcttgatgcctcaagctctttctcagtggcctccacctattggttccttcttcaacccctag

SEQ ID NO: 28635 - DNA, 246 bp, Glycine max
  Peptide Sequence Number=SeqID_145413
atggagagagtctataccatggatattaaaccactgaacagtgaaaagggccgcccacttccaaaatttggtgaatgggatgtcaatgatccaacctcagctgaggggttcacagtgatttttaataaggccagggatgagaaaaagacaggtggcaacccagattcaccaggaaagactgccactgatcctcatagcaaaccagcagtagagcctggcaaaactcaaactgtaagatgttcttga

SEQ ID NO: 28636 - DNA, 309 bp, Glycine max
  Peptide Sequence Number=SeqID_145414
atgacaacatttaaatgttactttttggctaaaaagagaaagggtgatgaggttggacagagatggaatgggaccgtcgaaacggttgcatttaaggctgaggctgtggagctgggtgagggaggtgaggtggagaatggagttggtgaggttgaggtcttcaaagatgaggcaggaaacatggtggtggttgtggttgtagaagtgggagactttatgttggggttgttggcggtgcagcggacaacatgtttcatctcccttaaggtgttggtgttggctaatggtactgtgttgtttgtgatttaa

SEQ ID NO: 28637 - DNA, 1126 bp, Glycine max
  Peptide Sequence Number=SeqID_145415
atggtgacactgccaaggtcccctctgcagtcagatggtaatttggagccacaacctaagaagacaccacaaagcccacgtcttagaaggctgactttaagaagtttagatcagcctagaccaatagttaatgtggatcctgcaactggaagagcatcaggcccagagaagcaaaagttccatagttttttaggggttgtagctcgagaaaagatccccattgtccacagcaattggaaaaatgtgccagaaactcttaaggacatggctaaatttgatatcccagaagctgaaaaggccaagaaaaaagtaatgtccacgatgggcactagatggaggcaatttaagtcttcactaaccactaaatttgtctatgctgacacacaagccggacaggaagaaaatccttcagtaaaatatggtatggataaacaaacttgggacgaatttgttgcaagtcgcaagaccccggattggcaggaaattcggaaaaaggcaaaggagagtcaaaaatacaatgactgcccccacgtactgtctcgtggggaagagcaaatgacacagggtagttttgttccccatggtcgagatgacatcttgaatatggccattggaaaaccggaacatctaggtcgagttcgtgcagcgggatctggtatgacccttactcaattttatggtagggcaacacgtacgtcgagtagttcctcagcaacactaatgcagcaacagtgggttgacattattggaaacataaaggaacaagtaaggaatgaatatgaagaacaacacaagaggagtttggaggaatttaagaaggagttgtccagtcagatcttcattcagttgagtcagatgggatcacaatactctccccttattgaggtggatttacaggcattggctgcacgtcttagcactaaaggaagtaatgtagaaactgctgatgttgacccatcaggcgacaaaaatgtgagcttaaaacccactatggggttatatgtgcaacgacaacatactacagtgttggtggccttggggaaaatatgtgaggggggatctgccattcacaatgtcactgatgctgatgatgttgtaagggtgagtgttgacaaagttatagaag

SEQ ID NO: 28638 - DNA, 1503 bp, Glycine max
  Peptide Sequence Number=SeqID_145416
atggaagacttacagcgtctgacgatacatgtgcagcaacaggacatgtggagttgggagggagattcgtgcggtaggtatacagtgagaagtgcttatgaatttctcaataggaatttgttgttggaaagtcaggatgaaacgtttaaagcactatgggagataaaagtcccaagtaaagccacaatttttgcttgtagattgatcagggaaagactgcctacaaagaataacttgagaaagaggaatgtggaaactaatgatgtcacctgcccgttttgcagaagtcatgatcaggacaaggctcacttattcttcacttgtgctaacatcttgccactatggtgggaatcgcgatcatgggtaaatgtagtgggtgctttttcggaaaatccaaaacaacactactactacaatatcagtggacttaggcctcagaggtggcaaacatggtggattgctttgacatgttttaggctggatgggtacctagcggttagccagatctttggtgacctaattcaggttttaattttattgccattggcaagtattgtgtaccgtgttgtgaagaggcttatacagcttacaccttctgcctacatggtcaatgttgaacatatggatcgtttttccactaaatttggaagtgaagaacataaaggtgatatagaaaatggcaaagagtctgaaaatgcaaaacctcacaagtcttccaaagtggcggactttcaaatactttttggtgtttgtcctccgatgttatttgtggtcattttttcaattggtgaatggtggatgccagggattgatgtgggcactgttggggttccaaacaacaacaaaagccttatcccactgggcaaggttggctacatgggtcactttatgacattcagctcggttaaagacaaaatctttagagatattattttccatgaggtctctcttatcagcttctcccaatgtcattcttggaagacagtcaagttgtttagtgatttccatacctctgacattatcattgctttagcactttgcttggttaataaaattgaagaggctgggagtaataaggaaaaagatgtagattttctttcttccttagaggttctgatcattgatcatgcagatgtgacatcaatgcagaattggtatcatgtgcatacagttattgaacacttgaaccgcttaccatctaagcagcctggaacagatgtaatgcgcattagaccatggtatcttgatgatcattccagattttacaggcaaacagtaatactgggtttttattcaaatccagatgtaaatgcttcattcaatcatcagtgccttaattatgaagggaagattcaagtgccattacactatcggtctcttcactggattttagtagaactgcaattttccatcaatggcattgtgcttttcaccattcttcttttggcggctgaaactgccagtacactggcagatatgatggaggatggccgaatgatatga

SEQ ID NO: 28639 - DNA, 345 bp, Glycine max
  Peptide Sequence Number=SeqID_145417
atgattggggttttacccagaataaatgatttagatcagattcgtggggttcagaatttaatcatttattcactcccagagaggaaggagttttaccctgagattgtgaatatgcttgatgggtctgacaatatgacatgcactgctcttttttcctaccttgacaagcttcggctggaaagaattgttggaactactccagccaaaaggatggtggttgcggagaaagtggcatcatggattagtatatgtgaccatggatgccaagaggctcttgaaaacgattttgacgagaagatgagtggaaaaatagttttgccgaggatgcttatgagtggaaaatag

SEQ ID NO: 28640 - DNA, 423 bp, Glycine max
  Peptide Sequence Number=SeqID_145418
atgaatctttttactcatggacacttgttccaggctattattgtctcatgttgtggctgcttccatggtcgtacactaggtgtcatatctttgagctgtgacaatgaagctacccgtggttttggtcctttattgcctggcaatcttaaagttgattttggtgatgtagaagcacttgaaagaatttttaaagaaaaaggagaacacatagctgtgtttattttagaacctatccaaggtgaagctggggtgatatttcctccagatggttatttaaaagttgttagagatattggctccaaatataatgtcttgatgattgctgatgaaattcaaactgggttagcaagaacagggaagatgctggcttatattgctcatgtctacagcaaatttattggccctcttccgggggagtcctga

SEQ ID NO: 28641 - DNA, 318 bp, Glycine max
  Peptide Sequence Number=SeqID_145419
atgttctcacctcctgctgtagggaggaataataatggtttctcttcttcttattctgggaaagtggaacaagaaccacccacaaacgactcttcaacccatcatggtcatggccgccaccaccatgatgaggagcttgatctagagctccgcttgggaaataataattggaatttttttgtttttcctttttcatcaacaaatattaattgtgcacctgtagcagcaatttggttggaagagatggtgaagaagagaaaggagaaaggtgcacctaggacagtgaagaagaggaagaagaagacaacccatatgtga

SEQ ID NO: 28642 - DNA, 222 bp, Glycine max
  Peptide Sequence Number=SeqID_145420
atggctcaaggattgtgctgttatttgtccttacaagagatgaaacaagcgaccaagaattttgatgagtcaaatgtgataggggtaggagggtttggaaaggtttacaagcgtgttattgataatgggttcaaagtggctatcaaaagatcgaatccgcaatcaaggtcatgcactttatttgaggaaggtagctttggatacttcaattcacagttataa

SEQ ID NO: 28643 - DNA, 479 bp, Glycine max
  Peptide Sequence Number=SeqID_145421
atggggacgaggggttgcatcaattacaatcccgtcctcgccataagacgacttggttaccctatgagaggggcaccatcagaggaaggcctcacaccttttattacacgaggtttcaatagcaccaacacgggggtgcttcagagggtccacaaggcatgggaaatatcgcaaaggaagtacaaggaacttaggggaagtagcaacgggcccatcgacagttaccataggtggttgaaagcctacgcacaagatctggattggctcctgagtttgaggaacactaagggggtggagattgaaactccagaagaagacgaagaggagaacgccgaactaagagacgtcaatatagcccccaccaaggccttggagcaagagaccaagagtaacagcgagcttaagctccgaagagaggaaagggaccaatcgcgagtagacggtttgattccgaaggatgaattgagggtttgcctaag

SEQ ID NO: 28644 - DNA, 1005 bp, Glycine max
  Peptide Sequence Number=SeqID_145422
atgaaattctggcttactgaattggatttatactctgtgatttctaaaagagaaataaaaacttcaacttcctctactgatatagttcaaactgatgcaaccattaagcatgatgtttctgataaagatattttatgtcatggacgcattttaagtgctttggctgataacatatataagattttttgtcataccaaaacttctgttgagttatgggaagcacttgaattgaaatatggatctgctgaaaaaggtttaagtcgttactcttgtgaaaaaatgattgagtttcaaatgattgatggaaaatctatttcagatcagatccatgaatttgaaaacattgtttatgacatgaaattgaaaggaattgttttgcctgacattatgcttgtggctttcatgatatcaaaattgcctccttcgtggactgattttgctcgaagcttgaaacataaacatgaaagttttacctttgatgatttgcttgtctgtctccacattgaggataaacatcgttcatctcaaaaacacttgcaaaaatctgattctcactctaaggcctatcttgttgagagctctagcaaacctttctctaagtccttcaaaaggcatgggtttaacaaaaataaatttggtagaaagccttccttttctaaaaataagaacaatgcttttaataacaacaataagcctaaggataaaaatttggggaatgaaattttttgctttgtttctgggcgagctaatcatttggctaagaattgttttcaacgtcatcgccagcccacgtctttccctaaaccgcaagctaatgttgttaccaccaatgctacctctgattccccatctgacaaactccggggctcatgttcattaatcaagcacacgtactgtgagcatggggaatgggagtatggcacatgtgttaggagaaggtcaagtgaagctagagctatcttcgggaaactttattgttttagatggtgtctatcatatttctga

SEQ ID NO: 28645 - DNA, 552 bp, Glycine max
  Peptide Sequence Number=SeqID_145423
atgacagaaggagaaacatcaaacaagggtcgccagtcattgatcagtgaagaacaaaggttgtcagagaacaaaggtcgctggtcaccagagaacaaagagaagggtgcacagcatgtcttggagagaggaaagcctcaggaaaggagccaaattctcagcaagttgtcaggacatattgttcaattaagccagcataaatttgcttcaaatgtggtagaaaaatgtttggagtatggtgatgccactgaacgggagttgctagttgcagagatatttgggcatgatgaccaatgtgataatttattgacaatgatgaaagatcaatttgcgaattatgtggtccagaaggtcattgatatctgttctgaaaatcagcgagcaatgttgctttctcacgtaagaatccatgctcatgctttgaagaaatacacttatggaaaacacattgtggctcggttggaacatcaatttggaggtgtgtactctagtactttggttgacaaaatagaaatcctagttctctttggtattcttgtcacatataactga

SEQ ID NO: 28646 - DNA, 2259 bp, Glycine max
  Peptide Sequence Number=SeqID_145424
atggcaactgagagtccaattagaatctcagaagctggtggtaaatggccgtctcataaggaagctgcagcttttggttcactgtctcgtaacatggcaacagaggatttgggtatacttctgaagggccataggtaccagggtggtggaaaggatgtggcacccaatcgcagtggcagtgcacctcccagcattgaaggctcatttctggccatagaaaaccttttaccccagcataacaccacccagaatgcaagctttgccaacctaagcagcgctatgcaaaattgtgagtctgaagaacaattgcgagctgatccagcttatttggcatattacaattccaatgtcaacctaaaccctagacttcctcccccgcttacatcctgggaaaatcgccatctaggacgtcatattatcagttttagaaataattggagaatgtctactacggatgatagtggtaaaagttctttacatttgcctcaaaggactctttccacgcacaaggaggagtctgaagatgattcaccccaacagccatatgatcatgaattagttaaggcaagtggaatttggcgtagtcctgatgcagcttcattggcatctcagcacaaaaatatggttgacttaattcagtgggtagtaatcacaattatggaagattttcctcgcaccatgtcacctgtatataataagtctctttctgtaagtcacggactagtggataaaccgattgatttagaagctggttctagttcttctcatggcccccctgttactacaataaaggctggtaaacctactataggtgcagatgacataagggtgtcatcaagtgtcgatacccatgccccagttgcaagctcatcatctcttgaatccactggcagcattggtgttagtgacattgcaactgttgagtctcaactaaaggctcttggtgtatctaatgtaccaaattcagaaagtctgagttacgaagaaaaatggaaggcaagctaccagaacaatttgatgcgacacccgggattccagcaacaaaacaatccatatgatgttcctagtgccaattctcaaaatttaaattctgtgtacgttggtagggaacaatttccttttaattccagcaagttctccaatgtccagccactactgcagtcatctggttttacacctcccctatatgccacagcagctgcttatatgtcctcagccaatccattttacactaatatggaggcgtcaggtatatatactccacaatatgttggtggatacactgtaaatcccacagcttttcctccatatactgcataccctcctcatggtgttctacctcttgtcgttgatggagctactagttccaattatactccactaacaccgggtgtttcaattgggggaaacatttcgcatggagctgagatggtacagacaaacaagtaccttgggcaatttggatttcctccgcagccttcttttggtgatcctatgtacatgcaatatcatcagcaaccttttgtggaaggatatggtatttctggtcattttgatccactggcacctagagcaagtggtgttagccaaattagtccttatgattcgcaaaaaaggtccagtactggtgcttatttggatgataaaaaattaactgatcagagaacttctgctaatatgaactcaagaagaggtggagtatcgattcctagttattttggacacatgccaaacatgggttttgtaatgcagtatccgagttcaccacttcctagtccagttttatcaggatacccagaaggaagtcctggccttccaggagttaggaatgaaataaaactttcccctgcttctggaagaaatggaggcgtaatatctggatggcaaggtcatagatcttttgacagtgctcatgaccccaaaatggttaattttcttgaagacttaaaatctggcaaaggtcgaagatttgagctatccgatattattggacatattgttgaatttagctctgatcagcatggaagtcgatttatacagcagaagttggaaagttgtagtggcgaagagaaggcattggtgtttaaagaggttcttccacatgcttctaaattaatgactgatgtatttggtaactacgtaatacagaagttttttgagtatggaagctcggagcagaggagggaacttgcagatcgacttgttggccagatactgcctttgagtttgcagatgtatggctgtcgtgtaatccaaaag

SEQ ID NO: 28647 - DNA, 225 bp, Glycine max
  Peptide Sequence Number=SeqID_145425
atgagggataccagaatcagggtagttagggtggtagtccaagttgaagggaaattgagagagcttgagaaaaataagaagaagaagacgaagaaaactgtgatgggtcaactcaaaactgaacaaggaataaggggaaggtttgttcgctacaagcctacaagaaacaagacgttggaagttggaaccaaaccagggtttaggatactacggactatggcttga

SEQ ID NO: 28648 - DNA, 696 bp, Glycine max
  Peptide Sequence Number=SeqID_145426
atggatcagattccttactttgaggttggtgattctgtgacatataataatgagaaggagggtatcattgagtgcttgaaaaggaatgtggatgatgatttagatactggggtttcttctctccctgattggataacaaccaaagtgatgctcaccacttggcttgctgatgcacttgagtatgaactgtgggtgggatgtgacggttcctctgcttataacatctattattctgatcttccctggcctataggtaagatcctcttttggaagaaagcttattgggtaaaccagaaacatgggataagtaaagacaatgctgaagtaaaggaagaagagatttatgggagagcaaactctgcatatgatgctctgtcgacttggttaggggaacaaaacttcctctttgaaaacaggccatcaagcttggatgctatttttcttgcgcatgcattagttgttcttcaagctttacctgaattaatgttaaagaagatcttatttaaaaagggacctagtgcacgaggcttgcaagtcctacctagtgggatcagggaggaatggggatttgatatatgcagccttacccctggaagccaagaggctgtttacaaaatgggaacccatggcattcagttcacaaggcagcaaccttaccattgcaccaaggcttgccctcaattatatgttatctaa

SEQ ID NO: 28649 - DNA, 210 bp, Glycine max
  Peptide Sequence Number=SeqID_145427
atggagatgcagtgcaaaagaagaagatggaaagaggggagaagagaaagcaaaagaaacaaaaggaaagctggaaaagatggaacatatatagcgttggaggtgtcactaaagagtagatggctcatgaaagcggggcatcagagagctggactagagcattatcagaagctactcccattctggctaagtgatcaacacattggttag

SEQ ID NO: 28650 - DNA, 519 bp, Glycine max
  Peptide Sequence Number=SeqID_145428
atgtatcatgaaaatatgatgatacatgagaaatatgcatgttcaaaatggttcttccgtccatctaaagttgacattgttattgagataaaaatatcggcggctaaaaactatcataaaatcaatcaagatgttcaccttagcagtggtgatggtggctcaccgatggttttaggaggcagtggttatggttacacagtggatttgagcgatgatggtgtttttggggggtgtttgggtcatggttgtggcttggaggttgcggatttgagttgttttaggcggatctgggtgactaaacttgatggtggtcatgcacacagtgtggtggtttggatggtgcttgggatcgtcggcgtttacgggctatggtggttgtcagctaaggttaggattgaaagatttgaggttgggcctgagagtgttagaaaagcacatttgcttgttgtccacctgaggccagacgtgaaaaagctaaacctgcgcgtaggagtgttgatgtggcttaagtgggactga

SEQ ID NO: 28651 - DNA, 2829 bp, Glycine max
  Peptide Sequence Number=SeqID_145429
atggcagatcataccacgaggaagacaaccacggacaggttagaagaagcaatcgcgcgactcaccagtagccaagtctctatctccgacaaatattcagacctcgccggaaaggttgattccattctggatcaccttcgtcttcgtgaaacctcccacacccaactaagctcgaatcccccgttcaaccatcgtagctcgataaagcacgatataccaagatttgatggacgagatcctttaggatggatattcaaaatccagcagatgttcgactaccaaaacacgccggaagaagaacgaatcacggtggcctcgttctacctcaacggcgctgccctgagctggtaccagtggatgttcagcaatgggtttatcacgtcgtggacaggcttccttcaagcattggagtccaggtttgctccttccttctacgaagatccaaaaggggccctcttcaagctttcacagaaaggatcagtcaatgaatacttaactgaattcaaaaggctagctaaccgcgtaattggtcttcctccgccatttttactgagttgttttatctcaggactctcaccggagatcaaacgcgaagtgttagccttgcagcccatttcactaccgcaagcaacagctcttgcaaagcttcaagaggataaactgcgagatcgacgatcaacctcttcacggtctttcaaccctccactaccggcccataaccctcccaatcaacctcagaaacccagacaaccatttgtacagcgcactcccgaagaaatggcattcaaaagagacaaaggtctctgctataattgtgacgagaaatggcactccggtcaccgctgcaagggcaaaatccagttgttcatcgctgagaacccggcctccgacctcactgaaccagaacaaccaagcatttccaagataactgagcccatctccgacgaccctgagactaactgttctcacttcctacacctccccaccaagcccactcttcctctccgagtccttgttggaaacggctccgtcctagattgcaacgaggtatgccccaatactcagctattccttcaaggtcattcctttgagattaccttccacttgcttcccataagtggcgcagatgcagtccttggttccacctccaccctcttccatttatccattatcaccaccagtccaataacgccgccaccctcaaccctttcccacccaatcccggaaattaacaccctactccaccaataccagcaactattccaacctccctccacccttcctccaccacgacaggttacacaccacatcaacctccttcccggaacctcaccaatcaatgtgagaccttacagatacccacactaccaaaaatccgagatcgagaagcaagtctctgagctcctttcctcaagcctgatacgcctcagtacgagcccgtattcatcacctgttcttctcgtgaagaagaaagatggaacgtggcgcctatgtgtagactatcgggcccttaacacagctacggttcgtgatcgatttcctattcccactatagacgaactattagatgaactaggaagcgcttcatggttctccaaattggatctccggcaaggattccatcaaatctccatgcacgagcccgacattgagaaaaccgtgttcagaacccaccatggtcactatgaatacctggttatgccctttgggctcagcaatgctccttcgacattccaagctgccatgaacggcctccttcagccattcctccggcgttacgcagctgtcttcttcgacgacattctagtgtatagcgactcattaccagcccatatcgagcacttgcaagacatcttcaaagcattgctacgtgaccagttctatctaaagcaaaacaagtgcttgtttgcacaaaggaagcttgaatacttgggacacttggtctccggcaatggagttgaaccagaaccatccaaggttcaagctatgacccagtggcccacaccctcatctgccaaggatcttcgtgcgttcctcggtttaacagggttttacagaaagttcattaagcattacgcgtctatcgcagcaccactcaccacgttactccgcaaggatgcattcgagtggtccttgaacgcacaaaccgcctttgatcagctcaaaagggccatgacgagtgccccagtattggctcttcccaatttcgcagaaccctttgtggtcgaatcagacgcatcaaccaccaccatgggcacggtgcttctgcagcatggtcgtccaatagctttcttcagtaagctatttaaccctcgtctactccttgcctccacttatataagggaattacatgccatagttgtcgccgttaggaagtggcggcaatatcttctggggagacctttcacgattatgacagatcataagagcttgagggagcttatgacccagttgctagggtttgactacacaatccagtacaaagccggcactgctaacaccgtcgcagatgccctatcgcgcatcccacaggattccggccagttgctccttctatccgtaccccaccttgatttcatggacgacattagacgaaccttgtacgataaccccgaattccagcaactcatctctcggattcgctccaacccttctgaccaccctgagttttgcattcaccgagacttgctgttcttcaagggtcgcatttggttgaacaaagacaatcctagcatcccttctcacttattagaacaccactcaaccccgctaggaggccatatgggcgtcactaagactacctatcgtttggaaacaagcttcttctag

SEQ ID NO: 28652 - DNA, 144 bp, Glycine max
  Peptide Sequence Number=SeqID_145430
atggattccgttcgctcaaagttcttgacgatgaagagttatctttggggaggcaaagcttgtgaagcaaagggagtagagaacgggaaaggaagaagaagagagagaaatgaagaattgaagggttacttggtaaagaaataa

SEQ ID NO: 28653 - DNA, 315 bp, Glycine max
  Peptide Sequence Number=SeqID_145431
caaaataggggaggagcttgccacccagctcgcccaggcgagcaaggttgcttcctccagaagcaacagctttctggaggaaggatctggaaggcccaagtggggcagattgctatttctttcgaagaagttacggaaactcacggattacgcaaaaacaccttttttcgatttccgccacatcacggaatttcacggattgcgctagcctgcttccttttgatttctgacacgtctcgggacttcatttattgtgcaacaaaggacgccaagtatctcaaagcggctaaccaaaggttgcatgtcaacaagtaa

SEQ ID NO: 28654 - DNA, 168 bp, Glycine max
  Peptide Sequence Number=SeqID_145432
atgcaaattggtgaggcctcagctagtgtggtgaaggaagttgttggatcgtctaaacttagcatttggcaagaggtgcaccattacaaactcaagagtctcgatgtcattcatcaagctgaagcagaacgtggtgcatatgaagagatggatactacagttgagtag

SEQ ID NO: 28655 - DNA, 372 bp, Glycine max
  Peptide Sequence Number=SeqID_145433
atggcacccgaatggaaagcctacggggctcacgcggaagaaatctgctccgcattcgccaatgggatcaatacctatatcgatgcctgcgatgcaggttcgataccacttccgccggaatttacgctgcttggccatcgccccgaccgatggaaggcggaagatgtggtgcgcgtgcgcacccactcgctgacacgtaatgcatcttccgaactattgcggtcaaaggtgatggccgctgttggaagcgagcttggcgcaaggctcgatggattgcgcaagcagttgtcgcatggcgttgtgtcgaagccggtcgatgggtttgatccggcgatcatgacggatcgagttttgcgtgatttcaatcttgcg

SEQ ID NO: 28656 - DNA, 1485 bp, Glycine max
  Peptide Sequence Number=SeqID_145434
atgcattcggatttgcgcatcctcgatccgataatcacgactgcgcatatcacccgcgatcatgcctatatgatctatgacgtgttgatcgccgtagacgagaacttcaagcctcagccgcagatggccgactggaccgtttcagacgacaagaaggtctatactttcacgctgcgcgacggtctgaaattccacgatggagcgcccgtcacggctgctgatgccgtggcttcactggaacgctggtccaagcgcgatgctggtggccagcttatcatggacatcacagattcgcttaaggcgaccgatgacaaaacccttgtgtggaccctgaaagagccgttcgcgcccttcctcgatacactggccaagcaggcggcactgcctcctttcatcatgcccgcgcgtatcgcggcgacgcccgccgatacagccatcaccgaacatataggttctgggccgttcaaattcgtgccgggtgagttccagcccggcgtcggcgtgagctacgtcaagaatgaggattatgttccgcgtaaggaaccagcaaactggatggctggcggcaaggtcgtcaatgtcgacaaggttcgctgggtgacgatgaccgatgcgcagacagccgtaaatgccctgaccagcggcgagatcgactatatcgagcaggtaccggttgatctcgttccattgctcgaaggtgacgatagtgttgtgctggagcagcgagatccgttgggataccaaacgatgggccgtctcaacttcaagcatccgcctttcgacaatcccgatatccgccgggcagcttttctcgccatgtcgcaggagccggtgcttgccgctctgatggctgatccgaactattacaaggtttgtggggcgatttttggttgcggaacgcccaatgccactaatgtcggctccgagagcatcacagggcagggcaatatcgaagaagcgaaggcgctgttgcagaaggcgggctatgacggcaagccggttgtgctgatgcagccgacggatgttaccagcctgtcgccgcagcccgttgttgccgcacaacagctgagagccgccgggtttaacgtcgacatgcagccgatggattggcaaacgctggtcggccgtcgtgcgtccaaggacgaaccgtccaagggtggatggaatatcttcttcacgaactggcagataccggaaatctggacgccgctgaactcggtcatgttgaatggccgtggcgatcaaggctggttcggctggccgcaggatgacaagatcgaagcgctgaagaaagaatatatttcagcccagacgcctgaagatcagaaagctgtggtcgagaagatccaggcgcacacgcttgagaatgtgctctacatcccgctcggcgaatacaacccgcctcagggacgtcgtgccaatatcgttgagatgcttggttcgcccgtgccggtcttctggaacgtgaagaagaacgaagagtaa

SEQ ID NO: 28657 - DNA, 276 bp, Glycine max
  Peptide Sequence Number=SeqID_145435
atgggtctctctggagcttgtatcaccacatatggagcatttcatgcaatcttggtgcactgctttgtcaatattaacaagggttgtgatcaagtcttctgtatagaccctctttttgttcggagacagagagtcatagcttgtagagtaatgtatgcaaacagagtctgtgaccctgggttagttgtttgtagtcaatgtcccaaacgggctttggtagttcaagtccatggtcgttacaacactgtgaaatcatgttttggagcaagtaattag

SEQ ID NO: 28658 - DNA, 298 bp, Glycine max
  Peptide Sequence Number=SeqID_145436
gaatccattgatgaagaagatcctaggcctacaagctccaatggagcttgcatcagtatgggtcacaatcaaaagagaaagtgggcccttcttgctccactcaaacggagacatccaaagcagaaaaattcagaagctctccctctctctcacgcagccttcttcttctcttcttcctccaccattgttgcccaacaaagctccaacctttggccatcatttctgctccaaatcacgaaaggagggcatttccggagtcgtgaagtgcgtgtctacgagtgggacttcgaaatttcag

SEQ ID NO: 28659 - DNA, 306 bp, Glycine max
  Peptide Sequence Number=SeqID_145437
atgtttaacaaccatcgccatggaatccgtaaagtttcaggatgtttcggagagaaaccgtccaaaaacacgaaaatgggagtgtatttagcaaagtgggggtgtgtaaatagattgttacaacctaatttcatccggggactgttgttgatcgctttggaaggcttaacacccatcatcgtggaatctgtaaagttccgtgaggtttcggaaggaaatcagcccaaaaacatgaaaatggggtggaagcaacctagctcgcttgggcgagctgggcggcaaccacctcccccttttctcctataa

SEQ ID NO: 28660 - DNA, 396 bp, Glycine max
  Peptide Sequence Number=SeqID_145438
atgtttcagtttatgttcctatctactatctgggatataccaagaaaagatgtacggtctaatgaggctactacgaaatatttactcatgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgatgctacatagttggttctcatccttcagagactacgagtataataggagcatccgtcaacaaaaggatcaccctaagatga

SEQ ID NO: 28661 - DNA, 765 bp, Glycine max
  Peptide Sequence Number=SeqID_145439
atgactacacaactagaatccaacttgatctcaaaaggaaaggggaccaatgactacaattttcttttcatcaaggaatttttggagttattgaagtgtgacgttttaagattattgaaggaattccataggcatggagtcctacctagagtgaatggtagtcctacacaagaattcaaatgctccaaaggtcttacgcaaggagtccctttggtaccatttcttttccttggggtggccgaagggttgagtggtctaatgaaagaagtaaagttactgaaagaagtttggaggaagcttgtgggtatggaaaggagattcttatggggagggaatgatgagaataaaaaaattgttttggtgaattggaaggaggggcttatgagggatggtgagctttcaagggatcctttgtggtggagagatttgaagaagattatacctaatctcgaaacagaaagaggaattaattggtggaataggtttttggaagggggacatatggtgttaggatttaaaatggagaagggagtgtttgagtcagaaaatagattatttcaggactttaacaatgttttgcaagctatccaggtcataaaacatgttgcagattcttggttttggaggcctatctcgtcaagtgatcacacaacaaattcaacttatgttttgtcggttcaagccattggtgaagacaacaacaatgatctcatttcccagacttggagcatcataattccaaacaatgtcacttttcttatatag

SEQ ID NO: 28662 - DNA, 3273 bp, Glycine max
  Peptide Sequence Number=SeqID_145440
atggagctagaggtgcaggtggtgggaggcatagactcctgcttcgtctccctccctctctctctcatccaaactctccagtccacgcgctcatcaccgatccctcaaatcctcgctctcgaacttcgctctccgactcacccccctcacacctggttcgtcgcttggtccggcgccacttcctcttcttcttccgccatagaggtttctcctcaatttgcggagtgtgtttcgttgccgaatcatgctactgttcaagtcagagctgctcctaatgttccacacgcttcactggtaacgatagagccgcacaccgaggatgactgggaaattttggagcttaacgcggaccaagccgaagctcaaatcctcagccaggtcaggattgtccatgaagggatgagatttcctttgtggttacatggtcatactgtcatcacattccaagtggcttctgtttttccgaagaacgtggtggtacaactcatgccaggaactgaagttgctgttgctccaaaaagacgcaaaaaaagttcagattcagcaggagattcacatctagactcctctaataaagagcatactgctaagatgctgcttcgtttacaagatccagatggattatgtagtaccagtactcatgtcaaaggagttgagcttcatgtagggcttacttctgttgcttttgttcacccagaaacagccaaaaaatactcattcaacatgcttcagttggtttcgatagtacccagagtaaccaaggagaatgttaatatttccagatctaatattatgaaagccaaaagtggtccagctactaatgaagttgagaatggatatactgacaagacagaatatcgacaaacaattgttcagctgttgatttcagaatctgtggctgaaggacatgtgatggtagccaagtctcttcgcctttatttgagagctagcctacattcatgggtttatttgaaggcatgcgatattattttggaaaaaagtattccttccacctctctttttccgtgccaattcaaactattaaagcaagagaatgctgttgagaaagatggtctagaagtttttcatggccacaagaatcacattgatgaaaatttgcatgcaaaacctacatcaggtgtctttgtggatactatagattggtcaatccaaaatgaagttgcagcagctctctctgatgaatccagttacaaagcagaggaagaggctacaaatcaatctcagaatcaaaggggattacagagtcttgtacgactatggtatatcatgcaacttaaggcaattacttccatttcgggtatggaggttagttcgttgattataggtaataaaaccttgcttcattttgaagtaagctgttacaagcttaggaataatgggaaggttcagttagcctataattcttcagagaacagtggcaaggcagctgagatgttgtttttattgacctttggtgaagaatatctgcatcatgggaaacttaatgcatatgaagttgctcttggtggaagactcaataacatcaatattggggacttgaagctttttgaaaggatgaaattgtgtgatcctgtgtctattcattctatagaagagagagcctccgaagaccacattagttcaaatgtatcttcccttggttggatggagaaagctgcagatgatgttatcaacagtagaatttttgtttcctgctcaaaacttgccctggagaaggtcccagttattcgccaagaacttgcaaaccatgtaactgaagctttaaaccatgctccttctgttgtcatctttgatgatcttgatagcataatttctacccctgattctgaaggatctcaactgttaatgtctgttgctggactcacagattttctaattgacatcatggatgaatatagggagaagaggcaaaaatcatgtggatttggaccaatagccttcatagcttccatacaatccctagagaagataccacagtctttgagctcttcaggacggtttgactttcatataaagctgcctgctcctgcagcttctgagcgcagggctatgttgaagcatgaaatacagaggcgtcagttgcaatgtgatgatgacatcctgcttgatgtggctgtaaaatgtgatggttatgatggttatgatctggaaatattagttgacagaactgtccatgctgctgtttgccgttttctgccatctaatgctgccatttatgagcatgagagtcctgctttattaagggaggatttctctcaggcaatgcttgattttcttccagttgcaatgcgtgatatcacaaaatcagcttctgatgatggccgttctggatgggatgatgtgggtggtcttgttgacattcgaaatgctattaaggagatgatagagttgccatcaaagtttccgaaaacttttgcacaagcacctttgaggttgcggtcaaatgtccttttatatggtcctcctggttgtggtaaaactcacatagttggtgctgctgctgctgcttcttcacttcgattcatatcagtgaaagggccagagttattaaacaagtacattggtgcttctgaacaagctgttagggatatattctctaaagcagctgctgcagcaccatgcctacttttttttgatgaatttgattctatagcccccaagagagggcatgacaatactggagtaactgatcgtgttgttaatcaatttctgactgagttagatggtgttgagattttaactggtgtatttgtgtttgctgcaaccagtagaccagatttacttgatgcagcactgttgagacctggtaggttagatcgtcttctgttctgtgactttccgtctttgcatgagagattggaaattcttgcagtactttctagaaagagtggaaattgggagagcccaggggccaggtctctggattacctggaagagttatgtactatcgtgtatcttcatttcctcatttctgatcttctccctattgaaggagtcttccatgatgcatatgaacatggaggccagattgacagcaagccaggaatgatatggatactcaagaaaagctgtcagaagaagcttgaagacattcttgaagggatgtcttgcaatttccaaggagatgggaaccaaatgaacctgcctatagggaccaacacttcaggtgctgggtgtgatggaaaacatggatcaaggttgggtaatgggatcaagactgaaaatgggataggagcactggaggcagcttga

SEQ ID NO: 28663 - DNA, 366 bp, Glycine max
  Peptide Sequence Number=SeqID_145441
atgccggtcagcaaatgcattttgagtagttcaagtgtgcctggatttccggtggaagggtctaaaagggaaggaggctgcggcggagtttcggaagggggaaggggggctctcggcgaaggggaaggaggaggaggctgtggcggaggggaatggggaaagaggccgctgccgcggcggaggaggctgaggccgaggaagaagaggctggctagtggtagagttgcattagaaaatggagtcccattaccactgttgcctgatcctaaagcaaatttacaatgggatgaggttaaaccactttcaggaaaaccatactggcatagtgttctttcgcctacaaatcttcaaccccgttataacttg

SEQ ID NO: 28664 - DNA, 480 bp, Glycine max
  Peptide Sequence Number=SeqID_145442
atgattaaaaatggactcgaaggaaagaacaatgaagttgaagaaaggaatggaagtgttggagcagagagggacgaagtcagcgagaaaataggtgtcatcaaagttggagaggatgaaggcgccgatgacaaggatgtaggccatggtgaggaaggtagcgacgtcgaagttgtgatgccatcaaaggggcgtgaaagtcatgaaagtggacctcgaaaacgtgacactgtgacaaattcacactccactgtgacatattcgcgaaggactttgtgggagaagagcgcagaggatgaagagaagacaaggaaagggaacaaattaagaatgatcatgaagatctcaccactcttgatgacgccaggaagatgttatttgatgatgttacattttgtcgtggcaccatcgtcgttgtggtccttgacggtgggaaagcaaaaaggtgaagagaaaaagatgaaagaggaaaaaaaatga

SEQ ID NO: 28665 - DNA, 303 bp, Glycine max
  Peptide Sequence Number=SeqID_145443
ctcgcgcagcatctcggcctcgcgggctttgcgcttgaggtcgcggcggtattcctcgtagtcgttgggccgggccgggtcgtactcctcgaggacggtggactggacgccaacgagggcgggctggaggggggagtcttccgggggaagggcgggggtggtggaggagaggacgggcttggcggtgggcttgggcttgggggaggcgggcttgcggagcgtggcgggagccatcttggtgctggaggaccagacgttgggggtgggcttgttgtcttcctcggcggaagaaggtggaggaag

SEQ ID NO: 28666 - DNA, 165 bp, Glycine max
  Peptide Sequence Number=SeqID_145444
atggccgtcgaatctatatttgaaggtgtcaactgcatcttttgtggaatcttcttgttcatggcaaatccggtgttaaaacaactagatgtggtgtcaaaactcactcgatcaagttccaaaaatgagactaaagctacacgtgcttgggatatgaaagtatga

SEQ ID NO: 28667 - DNA, 594 bp, Glycine max
  Peptide Sequence Number=SeqID_145445
atggagggagtcttgcttcctgtgtgtccttccccttcttcttcctctgcagctcctaaacccagaatccccattcctcaacgctcttctttcccttcttcactaccaacccatctctccctcccccaaaacgcagcgttttcccttcgcacctctctccgcacttccaccttcgcactcgcgccacacgaaactcccgttctggacaaacccgacaacaacagttcttctccctctctgcccaaaatcgacaagaccggccgcttctgcagcccccgcgccgccagagaactcgctctgtcgataatctatgcagcgtgcttggaggggatggacccggttcggctcttcgagaaacggatgaatgcccgacgagaagctgggtataaatttaatgaggaaaagttgttggagtataatcatatgagttttggagggtcgcctgttactgttggatcggatgaagaagcaaatgagcttctgcggcacattgaagaagagtctgccattgttggtgaagatgcttggattgtgttagaaagttcaatgtctctattttgcttttctttttctttaacctttgcaacattttaa

SEQ ID NO: 28668 - DNA, 102 bp, Glycine max
  Peptide Sequence Number=SeqID_145446
atggttgattctagtggtaagaaccacataggcttgacattatggctatgggtggaagtaggtcggactgcctattgggagcctatggctcagcccgtttaa

SEQ ID NO: 28669 - DNA, 357 bp, Glycine max
  Peptide Sequence Number=SeqID_145447
atgatgacatataacaacaacaacaataacaacaacaacaacaacaatcagttcattgttgagggagcatccctcacgaggccaccaggtttcataggagaagactatccttactgcatcaactatgaaggaacaaaagatgttcaacttagaaagcctgcaactctaacacatcaatacgaaagtttctccatgaaagaaggagaatatgcggatgacatgtttggaagagttcaagtgcttctgaatggccttaaagctctaggacacacattcaccaaaggtcaaataaatttgaagattcaagacagttttcccaaggtgtggaaaccaaaaacaagtcatccaggaagctag

SEQ ID NO: 28670 - DNA, 153 bp, Glycine max
  Peptide Sequence Number=SeqID_145448
atgtggaggtctctcagtggtagtgcggctttgtggaggtctcaccgtctcgccctctcgtgtggtagtggtgaggaggtggaggtctggcgtcgcatcgtgagtgaggactacgaagtgtttatcttatgtgctaaggactgttacccttaa

SEQ ID NO: 28671 - DNA, 1243 bp, Glycine max
  Peptide Sequence Number=SeqID_145449
gagaaaaccatcaaaggataatcggtatcgaccacgtcccaagcaacctccagagtttggtgttaatctgttcttgaagaagcctagcaccacctctaaaccaactgaggatgatatggatagcaatgaagagaatgatgaagaggaggatggaaatattggtgttgtttgggaatcagatgagcttgaagccatctcatcacttttccaaggtagaattccgcaaaaacctggaaaattggatcgagaaaggcctcttcctcttccagttccctacaagcttcgacctttggggctacctacaccaaaaacacaagtaaaattgacagctcctgctgtggtttcttcccgggcttctatggctaagaaagtgtataaaagcccgaggttcctagttgggttggcaagagaaataagtaggcttggtccagatgaagatgtatctaaaattcttggaaagtgggtgcagttcctgaggaaagggtccttgtcattgacaataagggaattaggtcatatgggattccctgagagagctctgcaaacattcttatgggcacaaaatcaacctcatctcttcccagatgattggattctggcctcaactgtcgaggtcttggccaggaaccatgagttaagaattccattcaacctaaaccagtatactggtttggcaagtcgtgttgtgttggaggcaatgattaagggttttataaaaggaggaaaccttaggcttgcatggaaggttctaatagttgccagaagggataaaagaatgttggattccagcatatatgctaagctaatattagaacttggaaagaaccctgacagacacaggcatgtgttgcccttgttagatgaacttgcagaacgcgatgaattgaatttaagccagcaagattgtactgcaataatgaaagtctgcgttaagatggggaaatttgaagtagtcgagtgcctgtttagttggttcaaacagtctggctatcatacgagcgtagttatgttcacttctgtgattcacagtcgttacacagaaaagaaatacagagaggcattggctgtagtttgggagatggagtcttcaagttgtctttttgaccttccagcttattgcgtggacatgcttcatatctacatggcctctgggaggatagcaaagtgcaaagagctctgcaaggaagctgagatgtctggtttcaagctagataaatatcttgtgtcacagttagatagatga

SEQ ID NO: 28672 - DNA, 1833 bp, Glycine max
  Peptide Sequence Number=SeqID_145450
atgcaggtagattctatacattccggttctatctcatttgggagatttgagaatgagactttatcttgggaaagaaggtcctctttctctcacaataggtacttggaggaggttgagaaatgttcaaaaccaggttcagttattgagaagaaggcatattttgaagctcatttcaagaagaagggcatatttggttttattccatctacaggtcatgagggatcatcagttagagcaatcagtgaaaatgatggctcagagagaattggcaagcaagaggattttgagtccaatgatggccattatgttcaatttgatgaaatgtcccaaaaggattttgagctagatgaaggtgaccattatattgaaatggaccaaagttcccaagaggactttgtgacaattgaagatgatcattatgttcaatttggtgaaattcctgctaattcaaattatcatggagaatgtggtatggatgaatatgaaagagaagagaccgtcacagaatctctgatggattcattttcaggtctgcagcagatggaatctgctgcaaacgattctaatgattttgaggatcctggtaagataagtattactttggataaagctcatcatcaatctgaaaatgaaacaagtaatattctcttagatgatgacaaggtgattatagaagtgaaaaagaatgatgatgttacagtaaatactgatgaatcgtcaacaaacatgattatgcctgtgaatgaacctgcacagggtgttgaggaaacaatttcgcatgatcctgcaaatccttctactaaggaaagaaagatcaagcctcaacggaattctgaagtcaacaatgttcaagttcggaaaagcacccctcctagatcagttaaggatcctgctaggattcccagaggagagagtccaaggagaacaaatatggaaaagaattcatcaaaacttgcaacaccaactacttgtttagctagcaaaactaccaaagaggtttctaaaagtgcagagaaacttgttcgtgaaagcaaaagtgaaaatgcatcaaaagtaagaaagggtgcagaatcccaactttctgcttcaaaaacagcttcgagaggaattcaagaagcagagagcctagggctgcggctttcaacttcaaatgtagcgagcgagcggaaagacggaaacaggcaattctacatgaagctggaagaaaaaatgtatgcaaaggaagcagagattaatcaaatgcaagcaatgtcacaggaaaagacagaagctgatattaaaaaactccggaagagtctcaactttaaagcaacaccaatgccttcattttactgcacaccttcaccgtcacaaccacatgggaataaggctgtgtcaaataacaccagaagtaagaaagaacataataaaccaaaatgtccagggagtggagctgatgcagcatttccttcgagatcgaaggtgggaaatgatctagaaaccgatgaatccgtaacagcgagagaaccacatggtatctcagtcaaagagtgtgccaaaaataaagcatccaaagctagtttgatttctccagctccatcaaccaacaatagctgccttgcagattctacaacaagtagtcatacttctggaaagaaagaaggagcaaaggtttctttgcaaaaacatagggtaactgatagttgtaaaggagcaaaacagcaaagcaatgaaagaaataaaaatggcgaaaccgcaaaacatagaaatgatataatgcggaaaggtgtggggaatgttggtttgagaagcagttctaaaagtggtaatcttgctgtacgtgttgcctcctga

SEQ ID NO: 28673 - DNA, 354 bp, Glycine max
  Peptide Sequence Number=SeqID_145451
atgcccttatccatgttacccaccacccattggaacggttactcccacaactccttcaggtggttccactgtccaccagctccacctcaacccggattactatatccaccaccttccgggaattacccttattaccccacaccacctttcggcggcggcggtgtcggcggcaacgacggtagcggtggcggtggttttggcaccccaccaccaccggaccctattctaccctactttccattctactacagaaagcctcctcacaagccagaagataattcagcgtcaacaaccgctatgcacaaatggacagggatggggaaggggaaaaacataggaggtatgattagatga

SEQ ID NO: 28674 - DNA, 654 bp, Glycine max
  Peptide Sequence Number=SeqID_145452
atggctgacaatgttgttgtcaataatgcaacttttgcaaacttgttgaatccctattatactcatcccaatgagaatcctggtgttgctattattgctcaggttctcaatggtgccaattaccactcgtggtcgcgtgctatactccttgccttgaaaaccaagaaaaaggtccaatttgtggatggttctttgcctcgccctactcttaatgatcctaatttcactatatgggatcattgtaataccttggtggtttcatggcttcatcattcacttgatccagatatcttgcaaaccattatgtggatggagactgcatcggatatctggaacactctcaagaaatgctattatcaaggagatgtgttttgcattagtgatttacaagaagaaatctatctgcttaaacaaggtgatactaccatcactatttactttacgaaattgaagggtttaatccaagaattagacaattttcgccctattccttcctgcacatgtgttgttgtttgtgcttgtgatctcattcctgttattaagagttacagagaaggagattatgtgattagattcttaaggggcctcaatgaacaatactctacagttagatccaacataatgatgatggaccccctccttgatttagatcaa

SEQ ID NO: 28675 - DNA, 526 bp, Glycine max
  Peptide Sequence Number=SeqID_145453
atgggttgcactgtggggttagcgaaataccagaaggatactgtgttattttctggaacaaggcgaaaaagctatgatccgtcaagtgacaaatacaaggttgtagcaattgcgttgactatgctctcacttgaagtatctgaaaagactgagatgaaagtttatggcgcgggtgacagtagttggagaaaccttaaagacctggagaaggagacttgcagatcactgtttcttctcgacgatttttgcttttttgatacaaatattggagtttttagagactcgatgtgcgtttggcaagatagcaacacccatcttggcttgtggcagatgaggaagtttggagatgacaagtcttggattcaattaataaattttagttatttacatcttaatattcgtccttatgaagaaaaatcaatgattttaccattctgcatgtctaacaatggagacttcttcatgctgaaattcactagaaatgctgatgatgaataccaaacaattttgtataaccagagggatg

SEQ ID NO: 28676 - DNA, 228 bp, Glycine max
  Peptide Sequence Number=SeqID_145454
atggaatatcgaacttacatcacacgattccatgtggatttaagggatggatccgaggcagacattttttatcaattgaagggttctgaaatcaaggagttccattccttgcacacacacttgaattggatcaaaggtttcatgggaagacgagacaagatttccttgttgatttcgttacagaggagtgacgaccatggtttcttctctggtcacatgtttctatga

SEQ ID NO: 28677 - DNA, 756 bp, Glycine max
  Peptide Sequence Number=SeqID_145455
atgttttttacgtcgcacattctaaggcaattagaaagaaccgtcttagaatactctccgcttaccgtcgccactgctcccgctccgccgccactgtcctccagcctccggggccggggtcggagcccttcacctccggggcctcaccagactttggctgcatcctctacaccagcaacttcaggtgggaagccatgtgcaagcgagcaaccaagtcctagcatgttcccgttgttgacgttgttcaccttgacaacacctactccaatcctatctatgattttccgccttgccatgtcgcggctcaacagattatcgatatcatcgcatcgcatcccaatcacgacgtcattatcaggattaacacattggggaagcaagatctgctggttgagatttcacatttgggtgtggccacagcggttgcggactatgcatcttcttggttatgatggtatttttacaatgaacacgtcttttactagagttatagcagttcctgtatatagcttcagcatcaatactttagaggaactaaattatgtgtgcccaactataggaattatgccattgggtcttccatggataaagaaatcccttcaaaagaatgagcttcaaaccgattccaaatggattcctgccaacaatgttgtcaatcagtatgcagaggccttggctaaagcttggagtgagtataataaccccagatgtgcatatgtggggattttggtgccaaaagatgctaaaaggctttag

SEQ ID NO: 28678 - DNA, 630 bp, Glycine max
  Peptide Sequence Number=SeqID_145456
atgagggtgtctttctctactaatgttagttggccagttcgtgatcaattaagcattgctcttggtttcaaatgcattgatgatctagggaagtatctcagagtcaagcttaatcatgatagggtgttcaggggattgattggaaaagttgtggaaaatatgaaacatagactcaacttgtggaaagctaaaattctatcctttgcagtttgtttaactctcaccaaattgattatgttttctatttcattatatgttatgcaatcagtccatttgcctcagagtgtttgtgatgaaggtgaccaagtctatagaaatttcctttggggagatttagagaatgggaggcagattcatcttgtcgcatgggatagagtttgtcaaccagaggaagctgggggactaggaattttcatgttgtgtgagcggctaaacgcatctggcaacatttcttatttcttgttgaaagcatcaaaggggttgctagagaagttcatctcgacccctgagttattaggggttaaggaagttggttggtggagtcctcaaatggttggttggcacaagttaaatcttaacattgcggttagatattcagataatgaagttgctagttgtggtgtgatctaa

SEQ ID NO: 28679 - DNA, 858 bp, Glycine max
  Peptide Sequence Number=SeqID_145457
atgttgttcacatggtttaatgaaataggttgggacaaggaagggacaaaggagaacacacatcttttagaagaaattgaaaagaatgtcacaggtagagatgctgagttttgggcagaagtcacaatcattgccagaatgcaccacctcaacttggtgaggctgtggggattctatgctgagaagggccaaagggtacttgtctatgaacacatccctggtggatcattggacaagtacctcttcaggagcatgaggtacataatagcccttggtatggcaagggccattgcctacttacatgaggagtgtttggagtgggttttgcactatgacatcaagctagagaaaattctactatgtgatgacttttgtcccaagatatcagattttcggcttgccaagttgaggaaaaaagaggacatggccaccatgtctaggaggaagggcacactagggtacatggcactagaatggatcactgcagacccaattacctcaaaggctgatgtgtatagttttggcatggtgcttttggagcttgtgagtgggattaggaactgtgagatccaaggttttgtggttaggagtgaggagtggtacttccctggttgggcctttgataagatgtttaagaagatgagaggggaggagattttggatgggcaaattagggatgcttatgatagtagggcacactttaagatggttaataggatggtgaagactgcaatgtggtgtttgcaagataggcctgagttaaggcccactatggggaaggtggccaagatgttggaagggactgtggagatcactgagcccaaaaagcccactgttttcttccttggtgaagagtag

SEQ ID NO: 28680 - DNA, 198 bp, Glycine max
  Peptide Sequence Number=SeqID_145458
atgaaggtgatcaatttgagagctaaatccagaccccagaacttactgccacaaaacatcaacttatcagacttcaaccctcaacaacaccaaagtccaaccataaacaagcctaactcaaattctgttcatcatgcaaacccaatgtctgtgtctacccctcacacaaagaccagtaccaataaagccattctctag

SEQ ID NO: 28681 - DNA, 1383 bp, Glycine max
  Peptide Sequence Number=SeqID_145459
atgatcccagagctaagaccttcctgtcaatcactcatgctaggttgcaactctgcttcagctgcccaactagctgtgttgttcctttccctgggattaatttccattggagctggttgtgttagaccttgttccattgcatttggagcagatcaattgacaatcaaagtaaggtccaatgatgagaggctcttggatagctactttaattggtattatacctcagttggagtatcaactgtgttttccatgagtgtaattgtgtacattcaagaaaatcttggatggaaaattgggtttggaatacctgctgtgctaatgttggtatcggctatcagtttcattcttggttcaccgttctatgccaaagtgaagccaagtcacagcttactcactagttttgcacaagtagttgtggtggctgtaaagaacagaaaacttactcttcctgattgcaactttgatcagtattatcatgaccgtgattcggagctgatggtccctacggatagccttaggtgtttgaacaaagcttgcataataagaaatcctgagacaatctcaaaccctgatggatcagtttcagatccatggagccaatgcacagtggaacaggttgagtcactgaaatctatgctcagaatccttcctatgtggtccactggcatctttatgattactgcctcccaaacctcattctctatcatccaagctaatacaatggaccgaaggttatttggcaatttcgagatgcctgcaggatcctttagtcttatcagtgtaatcaccctaacaataatcattcccacatatgagcgcgtaatggtacctctactagcaaaatacacaggcttgcctagaggattcagttgcaaaactagaattggggtaggatttttgtttgtatgtgtaactaaggcaacatcagctatagttgaaactatgagacgaaatgcggccattaaagaaggctttgaagaccaacctaatgctgtaattcaaatgtcagttttatggcttgttcctgagttttttttccttggaatagctgaggctttcagctcagttgggcagcttgagtttttctacagttatattcccaaatccatgtctagttttgcaatggctattttcactcttgaactagctgctgctaatacagtggcaagtgtgttggtgagcattgtggacaaggtcactagtgtaggagggaacaagagctggctatcaactaacattaatagtggacatctgaattactattatgcactgctcagtttcttaagtataattaactacctctactttcttgctgtttgttgggcttatggtcctgctccggggccaaatcttgaagcttctgcaggcaaggaagaagagtaa

SEQ ID NO: 28682 - DNA, 342 bp, Glycine max
  Peptide Sequence Number=SeqID_145460
atgtgtaaactggcgttattaagtgtcctctacttctcgacctcttgggttgagtatctaactgttacagaggaaaagatcctatcaaagcaagcaatggaagaaggttaccccaccaacaaacatcctttgttcaaaggaatcaaatatgattactggcaggaaaggattattgcacattttgaatccatgcacatcgacatgtgggatgttgtagaaaatagagatcacattccccttgttgaagagttaaatgagttttctagaaaccggtgggcggatgaacagaaacaaagattctacttaactcaaaagcacaaaatgatcttctatgtgcactag

SEQ ID NO: 28683 - DNA, 351 bp, Glycine max
  Peptide Sequence Number=SeqID_145461
atggatgagtctactaaagactgtgatgcttgtaaaactctcaggataaaagagaccaagcttagtctagaaaatgagactatatccaaggaaaagactactcttttggaagactttcaggaattggaaaataagctaaaagtcttgcaaaaagagcttaatgagcttcatagtcatcaaaaagatgaaagagagccaatagacaaatctagaaatgggtatgaaggagatgtgtacaatcatgataaggaaacaatagtttgttacttttgtggcaagatatctttgacaacaggaagaacacgcccatcatggtacctagataatggcttctcacgacacatgacatga

SEQ ID NO: 28684 - DNA, 237 bp, Glycine max
  Peptide Sequence Number=SeqID_145462
atggaaagatgcaagaagattgaaggaagaggtacactacggtatagtggacatagaggttcaaagaacttgggggaattagcaagtggtgactactcggcatttggtgcactcatttggcacgaggaactcacaggcctcactttgctactcctaataggctctgagactatacattttggatttgggagctcgaggatcgatatacgttgtacctgtatgtggcaatcactttga

SEQ ID NO: 28685 - DNA, 261 bp, Glycine max
  Peptide Sequence Number=SeqID_145463
atgaagcctagcttccaaagacaacaaggccagggttcaagaagtggaaagaccccccttaccttgatgaaggttgcacgaaaattctcatatgaaccaagaactcagatctggagctttgagggaaaaagcctcaagaacacttgtatgaggcttagaagaagaagaaaatggattcttctccatcccttgaagaacatgtgcaaaacaatggagaatgaaggttccaagtttgatttgtttggagaagtaaagagataa

SEQ ID NO: 28686 - DNA, 110 bp, Glycine max
  Peptide Sequence Number=SeqID_145464
gggaaaagaaggaggtggttgctgcccagctcgctcaggcgagctgggttgcttccactagaaggcaccaccttctgttggaagatcctggaaggcccaagttggcctga

SEQ ID NO: 28687 - DNA, 309 bp, Glycine max
  Peptide Sequence Number=SeqID_145465
atgagtcgagtggtgggcagagacaaattatggtcattctgcccacccttttgccatccagaggcgatcgtgtccgatggcacgcagagacaaattatggtcattctgtgcctttccatccaagctcgatcgtgtccgatggcgcgcagagacaaattatggtcattttgcgccttgtgtcaagaggaacgaattcggcagtatcaggatgatgttggtcgttcggtgctgatcattttcaaaatttttgcaggttccgctggcggggtgattgaccggccgaatggtgtttcactcgaacgaaattag

SEQ ID NO: 28688 - DNA, 591 bp, Glycine max
  Peptide Sequence Number=SeqID_145466
atgaagctgctcattgctctgcttctggtgttgtgcgcgccgttttcatcttcttccaaacccaaagacccgttcctcggaatctcccccgaagatgacaagtattacaaggcttccgatgtaataaggtgtaaagatggatccggaaaattcaccaaggcgcagctcaacgacgatttctgtgattgcgctgatggcaccgatgaacctggcacatcggcatgtccgggtggaaaattttattgtcggaatgcaggacattctcctgtttacttgttttcatctagagtgaacgatggaatttgtgattgctgtgatggaactgatgaatatgatggtcaagtaaagtgtccaaatacctgctgggaggctggtaaagttgctcgagatagactggaaaaaaagattgccacttatcaagagggcgtcaaattgcgaaagctagaaatggaacaagctaaagtagctatggagaaggatgaggcagaactttcaaaactgaaaaaggaagaaagtatacttaaagggattgtgaaacagctaaagggtatcactttttggttgtcctgttcttgtgaatgttttacttaa

SEQ ID NO: 28689 - DNA, 513 bp, Glycine max
  Peptide Sequence Number=SeqID_145467
atgaccaaaaacccctctatagctcagaaaaaggccaattcctccaagaggaagcaaggagagtgctctcaggcatctatcaataggctcgacacatggttcatagacgagaataagaagaacgacttcaagatgatatacgccgttaagaatatgaaaggaactttctactcggagctagtgaaagccttctacacatgtgcttgcactgatatggaagagatggttatcgatgttgcagtttggaaggcaatagtcagactggacatgggtggagtccgcaactttgaagaattttttaatggttatagcaagatgcagacttacagagatatcatgttaaagagccatcagttagtggattatgagtttccatatgttgtgttagcctctagatttatttattactttaatatcaacttctctaatgagatagtagatttcatcaaagcatctaatgagataaccgaaaggcatctcaagaagcttgggatgagatttgctgaacattaa

SEQ ID NO: 28690 - DNA, 1470 bp, Glycine max
  Peptide Sequence Number=SeqID_145468
atggaagaagtttgtctgaatagtgagccactttttgatgaacgcaatgaggttgatgttgaggggaactcttctatcgcagaacatgatcttgaatctttaaactcacaaacgaataactctccacttccaactgtggcaattcatggtttagatcggaaaaaaaaagagtgctatagagcaaaacttagctgcagtagtgctggttttaagaaaaaaagtgaagccaataatccaagaccaaaaacaagaactggttgtcctgcaatgatagtgattagaatggttgagtccaagagatggagaatagtggaagttgagcttcaacacgaccatcaagtgagtccacagagcaaacggttttacaagtcacataaggaaatgattcttgaagccagcaaatcacgaccactgccagagcctgtaacagaagtacacaccattaggccaaggattgcttataattactttaatgacacagttacaatagacacaaattgtttggcaaacaaatatgagatccctttgatgtcatttgttggtataaaccatcatggacattctgttctattgggatgtggcttccttggacatgaatcagtggattattttgtatggatattcaaggcatggcttcagtgtatgcttggtcgtcctccacatgttattactgaccagtgcaagccattgcaaattgcagttgctcgggttttccctcatgctcgtcattgttattctttgcagtatatcatgcaaagagttccagaaaagttgggagggttgcaaggatatggaccaatcagaagaaagctgtataatgctgtctatgagtcattaaagatagttgagtttgaatcttcttgggctgatatgattaaatgtcatggactgaaaacagggccttacgacgtttttgatggatatgtgcataaatacacatcctttaaggaatttcttgacaagtatgacttggctctgcacaggaagcacttgaaagaagccatggcggatttggagtctagaaaagtaagctttgaattgaaaacgagatgtaattttgaggtccagcttgcaaaggggtttacaaaagaaatctttcaaaagtttcaatctgaggttgatggcatgtactcttgcttcaacacaagacagggagttaaaagttttgaagacttatacgagactacagaattggatattcgttgcatttgcagtttgttcaattacaaaggatatctgtgcaagcatgcattgaatgttctcaattataacagcattgaggaaatcccatctcagtacatcctgaaccgttggagaagggatttcaagcaaacgtttaatcaattccatgtctctgataacattgatacctacaaccctgtggacttgtatactcatctgttcaacagtgctcttccagtgttagaagtaggggcacagtcacgggaacattatatggttgctgtataa

SEQ ID NO: 28691 - DNA, 885 bp, Glycine max
  Peptide Sequence Number=SeqID_145469
atgggttctctgtcattggcacagaatacaatcaccatcagccttgaaggtggttatttccaacaatatactgggaatgatgcatctgaaaataccgagggattatcaagggaagagttgggccggcttgttgcttcacgctggacaggagaaaatactgataagtcaagtgctgaacctgatacgacattagacaatgaagatcacgaagatcttccaaaggggacaaataatgaggaatatgaaggctatgcttctgaaactgatgatgacattgacagcaacaaatatgatgatgacagtcacaaatatgacgatgaagatgaagttgatgaagagtatcgagaggatgagcatgatgaccttacttcctcctacaaatctgattctgataatgaaccagacttgtcagataatccttcttggttagagaaaatacagagaactgtgcggaatatttttcaggctgttaatttattccaggctccagtgaaccagtcagatgctgctcgtgttcgcaaggaatatgatgaatcaagtgccaagttgtctaaaatacagtctagaatatcaagtctgaagcaaaagctaaaacatgattttggtccagcaaaggagttttattcattctatgatcattgctttgagggcaaggagaacaagtacacttacaaagtctgcccctataaacaggcttctcaggaggagggctattccaacacccgtttggggagctgggacaaatttgaggattcatacagagtaatggtgttttctaatggtgataaatgctggaatggtcctgataggagtttgaaggtcaagctaagatgtgggttgaaaaacgagattactgatgtagatgaaccaagccgttgcgagtag

SEQ ID NO: 28692 - DNA, 432 bp, Glycine max
  Peptide Sequence Number=SeqID_145470
atggaggggaactccggcggaggaggcggcggaaacgacgtggaattgctctgcaagacgctgcaggtggagcacaagctcttctacttcgatctgaaggagaaccctcgcggccgctaccttaagatttccgagaagacctccgccaccaggtccaccatcatcgtccccttctctggcatttcctggttcctcgatctcttcaattactacgtcaattccgatgatcaggacctcttcagcaaggaattgcagctcgacaccaaggttttctattttgacattggtgagaatcggaggggccgttttttgaaggagggtgatacttctgggaccaaattgatggtttgttcagggaaaataagtgaagagagagaaactgatggatgtgtgtctaagcggaaggaagatagaaatagaggtggagattaa

SEQ ID NO: 28693 - DNA, 168 bp, Glycine max
  Peptide Sequence Number=SeqID_145471
atggcactacccagaatgagtcaacatcatctgctgaagtttctctcaagtcaaccatgggaagatctttccaggcagcggatttgcaaggaactagatttaaaacagtttaccaagaatttcggtcaggaagagaatgggttaatcatcaagaaggaaatcgtttga

SEQ ID NO: 28694 - DNA, 732 bp, Glycine max
  Peptide Sequence Number=SeqID_145472
atggacatagaaatagcagagttgtttttgctttctgatggattgatgattgcaaaggagaatccagctttaagtgctggtttagctgtttctggtgcccttctggccatgcgagtttcccttgtactaactagtcactggttagcatttgaacttttaatgactggaaagctgggtttagatgtgactaatgtaatttggcttggacttggtaatatgcaattcacctgctgtaattctgttacgaagctgctattttctactttccttgcatcaaatggtactaaagacatgctccaagaaggtttctgtttcgtcatacattgggtcgattccaaagtgaggaggtattactcagttgaacaatcaagatgcatcccttacctatgttcttacgtacggtatgctagaactgagaagaatgtaaaggacttgggcctttcggtggatttactgaagaaggagagtgtaaaattgcttcaaaggacagctcttgctgagaaggaaatgaaatatgggcataccgaactagtgagcgctggaacccaatttcaacagctggcaaaatcagcttacaaggttgaaacccgagctgctgatttgcttgacaagctgcggtatatacctagtcgtgaagctctggttgcttctatggcttcaaatttgaagcgtcagagatcttcactgaacaaacggataatgaagatcaacgagttaggggttcctgtgtga

SEQ ID NO: 28695 - DNA, 240 bp, Glycine max
  Peptide Sequence Number=SeqID_145473
atggcccggttttccactcatccatcttctcaactccctttcatctggtcatccctttcatttgtcttccttatggctcctgaaaactgcaaagcaccttcatattcagacgctgcagaaagtttttttagaatttttcctctctcaatcccaaatctcccacccaaatcaaatcttaagtcaagctcgaatcactggaaggtgtggcagaatggaaacttggggacaacaacctgctaa

SEQ ID NO: 28696 - DNA, 240 bp, Glycine max
  Peptide Sequence Number=SeqID_145474
atgcaaactgtggttggtccgcagaataatttgaattgcttggcaagggtttggtttccatctagcatgaactttgctttatcgtcgtatagtttcatctgtataaaacaccccttggaaggagagatggagggaatgctaaatgcttttgggaatgaaattagttgcatgaaatatcttgtcaggacaatatcaaattgttccatggaagtcaatgcacttgaaaataaggagcgttag

SEQ ID NO: 28697 - DNA, 459 bp, Glycine max
  Peptide Sequence Number=SeqID_145475
atggggcacaaaagattcaatatggtggcgggatttgatgttgttggagaaagatttgtcacaaaaccagaatttttttcaaagagcaggtccgagccgttgaaggatgcttttccggagctgtttgcaatttcatctcagcagttggtgtctgtaggaaacacaggttcatggaggagagaccaatggacgtggggcttgacttggaagagacagttaaattcgaatgaggaagagtcacttcactctttggagaccattctggttgatgtgcatctagtggcagaatctcatgacaggtggaagtggtccttacacaactccaaattattcactgtgcacaataatagcatcttcaaggaggaggaaaaagacattcccaagactatcaatcaaattaagcacatatgttgggcctggttcatgggaaaggtaggaggggtaggttttgcctcttaa

SEQ ID NO: 28698 - DNA, 326 bp, Glycine max
  Peptide Sequence Number=SeqID_145476
ggtggtggcaatggtggcatgggagtggcgtttgcaataatgaggacaacccttatggtagaggtggaatggtggtggtgacagtgatgtcggtaatatatcatggtggtggtagcgatgttaatgacaatgttatgattgtagtagtaataatgaccataacaataatgatgggagtgacaataatagttgatggtgatagcagtaccatcaatagatgtggtgatggtggttttaggggtgacaatgatagggatgacattaataacacggtggtggtaggagtaactttggcaacgatgatgatagtgatggtgatgaattga

SEQ ID NO: 28699 - DNA, 711 bp, Glycine max
  Peptide Sequence Number=SeqID_145477
atgaagacaatggctggtgaagatgacttctttgccaaccctttaagttattcatatggctctgacttcagttataaccactacaaggaaactcttgtcttagttcccaaaggagatgagttagagtacagagacaatctgatattggtgagaatgattgatctttcaagtaataagctgtctggagcaattccatctgaaatttccaagctatctgctttgcggtttttgaacttgtctagaaatcatctgtctggagggataccaaatgacatgggaaaaatgaaattgttagaatcccttgatctctcactaaacaacatttcaggtcaaatccctcaaagcttatctgatttgtccttcctcagtgtcctgaatctatcatacaacaacttatcaggcagaattcccacgagcacccaacttcagagctttgaagaacttagctacactggaaatcctgagctttgtggtcctcctgtaacaaaaaattgcacagacaaggaagagttgacagagagtgcttctgttggacacggtgatggtaatttctttggaacatcagagttttatatcggtatgggagttggatttgcagcaggattttggggtttttgcagtgttgttttcttcaacagaacttggaggcgtgcttattttcattatcttgaccacttgagagatctgatttatgtgataatagttttgaag

SEQ ID NO: 28700 - DNA, 693 bp, Glycine max
  Peptide Sequence Number=SeqID_145478
atgcattttgagcattctgagtattctgttgctggtgattctgaatattctgattttgagcatttgactactaattttcatactgagaacatagctcaacctccacctcatgagaggactcttagggaaatgactgcacctgatttcacttatgaaagcttgtgcattcaatatcctgatgagggtgttccatatgttctcaagactggactaatacatttgctgcccaagtttcatggtcttataggtgaagatcctcataagcatctcaaggagttccatattgtttgttccaccatgaagccccctgatgtccaagaagatcatatctttctaaaggcttttcctcattctctggaatggcaaaagattgactatactaccttgctcccaggttggaggaatcatccaaatctgagatggacaagtcctccacaacaacaacagtctatccctcctttccagaatgctgctggtccaagcaagccatatgttcctcctccaatgcaacagcagcagcaacaatcacaacaaagacaacaagcgactgaggcccctcctcaaccttccttagaagagttagtgaggcaaataaccatccagaatatgcaatttcaacaagagacaagagcctccattcagagtctgacaaatcagatggggcagatggctactcagttaaaccaagcttag

SEQ ID NO: 28701 - DNA, 563 bp, Glycine max
  Peptide Sequence Number=SeqID_145479
atggataggttgacgaccatgatgagtgcactcctgtcagcccagaactctcaagctgccgccgctgctgtagagcagcctttggtgagcacaaccccgctatctacagtgacttctccacccctctttttgcctccaggttgtacatggggaatgccacctccagtctgtggaagcccccagcccgctgtatctgaagttccacttccttttgctcagcagtcagcaccggttccgcaacccggtacctctttccctcaagctgcaatgacttattcagcaccactgatccacactattcaacaagaggttgagccaattttccaagctgaaaatgttgtagccttcgacaagatggaagaactccaagaaagatttgatggtatgcaaagagaagtcgaagccctccgaggaagagatctgttcgggaaggacgcctgtgaattatgcttggtcccaaatgttactatccctcacaagttcaaggtgccagacttcgagaagtataaagggaactcttgtccccacagccacttggtgatgtacgcgcggaaaatgtccat

SEQ ID NO: 28702 - DNA, 192 bp, Glycine max
  Peptide Sequence Number=SeqID_145480
atggtcaaaagggaaaaaattacccaattcagagctcagaactcaaatgacttggtttatgtgataaaaactattgatcattcatttgatgagattgagtttgacaatgaatgggatgatgatggagatggtgatgaaagtgatgatattcatggaaatgatcctattagaggatgtgacatggttctttga

SEQ ID NO: 28703 - DNA, 825 bp, Glycine max
  Peptide Sequence Number=SeqID_145481
ggacaccaggatttattattctgcgaagtgatctccgtcacaggtatttattcggcgcaaagtgcgtcggctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcttgtctggcccttctctatggtggggctttgatccctgtgcagagaactgacacagggactgagaaatggccagagcaggctctaggcagccttgctctgcaccctttccaggtttctgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 28704 - DNA, 343 bp, Glycine max
  Peptide Sequence Number=SeqID_145482
atgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacag

SEQ ID NO: 28705 - DNA, 597 bp, Glycine max
  Peptide Sequence Number=SeqID_145483
tgggaagaagaggatgaacctgcattacaaccagatccaccagacgaggttgagacagctggtgaccccaatagtgggagttcagataacttcctccagcctagactagctcaatgcctgaagttacctgtagaaccaattcctaatttgcaggttttggttggaaatggaaatgccttgactattgaaggattaattcaagacttggaggtgaaaatccaaggtcatacactgaagctaccagtgtacctacttccagtttctggtgctgatctagtgctcggggctgcatggttggcaacaattgtgcctgatctttcagattatagtactctgacattgaagttttacttgggtaatcaatttatcaccttgcatggattaccccctagaagaactcacaatcattcaatcccattggttcaaggtgctggaccagtaaaagtcaagccatataggtatcctcacagccggaaggatcagattgaagatggcacttggagattttgcacagattacagggccttgaatgccatcacaatcaaagatagctttcctattcctactgttgatgaactaattgatgaacttcgtggg

SEQ ID NO: 28706 - DNA, 534 bp, Glycine max
  Peptide Sequence Number=SeqID_145484
atgccttcgagttttatagatctagtgtttgctggcgagagaattgacgcaggtccgaggaaagagaaatttagttatgttgcttctatgaatcctggtaatagggaacctgacaggagtggtgagaggaagaaggagggagaacttcatgttgtggctgaagttccagcgtggccaaactttccactacccccttataatcccatgtaccaatatcctcctcagcaatatcaccactcagccaatatcagtcctgctcattacccaccaccctaccaaccaagaacacccaatcaaccacagaggccacccgtaaattggccacaaaatccacccgttgcacagccaagactgaacaccacccctaataccaaccaaaacaccaaccagagaaggaattttccaaaaaagaagtctatagagttcaccctaatcctgatatcatatgctgacttactcctatatcttctcaataatgcaatggtagccacaagcccgacaaactcaacctctattcatcaaggatacaactag

SEQ ID NO: 28707 - DNA, 427 bp, Glycine max
  Peptide Sequence Number=SeqID_145485
atggcgcaggcgctggtgaagttccttgataaccagtatctggaggtggacggcgaagcgcagaaattcgtgaaagggattttcgctatttttggtcacggcaatgtgttgggcttaggccaggcgctggaagagaacagcggcgaactgcgggtttaccaggggcgtaatgaacaaggcatggcccatgcggccaccggctttgcccgccagtcactgcgccggcagatcattgcctgcacttcttccatcggtccgggagcggccaacatgatcaccgccgcggcgacggcaacggccaaccgtatcccgttgttattactgccgggcgatgtattcgccacccgccagccggacccggtactgcagcaaatcgaacagagctacgatctgagtatcacgactaacgacgcatttcgcgcggtga

SEQ ID NO: 28708 - DNA, 403 bp, Glycine max
  Peptide Sequence Number=SeqID_145486
gatgagacttttcaatgggcctcgcaatgtcaatgggtcgtcaggtaatgaatatgaccatttcaatgatgaagattgtgggagtgagatacatgacaatgatttcttgagtgactttgaagaaattattcatattgttggaaatcatcatcattctaatgatgagattattgaaatctacaaggaaaatgggatttttggaaaatcgcatgagatcccacaaaatggaaggatacatctagaagttggtcaattgtttatggatttgaatcattttaggcaagttccgaaggatttttctatacaagaggggtttcagctaaagagaattaaaaatgtaccatctagggctacagagttttggatgatgccagtttcggagaggaaagataagtcaggatag

SEQ ID NO: 28709 - DNA, 1940 bp, Glycine max
  Peptide Sequence Number=SeqID_145487
atgcaagaaacagatcaaaagattcttaacaatttttcatctgatggaatcagatgggaagccagatgtgcttaccttacttgtagggtggctggtatgcagacacttttggcagctttaagattagatgaagataattgtgaagaaaaagaaatgatggcgaaacgggggcgagggcggccaccgaatacggtgcctccgccaccggtgaatcatcctcaaccggcgactaatctggtagtggagactgagaatcacgagttacagaagcacgaagaaactattgaggaatttgaagcaacaacgaagtgtcccgaaatcctaattgaagaaccgaaggaggtcactgatcgaaaactgtgggtagatgttctaaacaacaatcataatccatccaacggcgtaacaatggagtttgtagcacccaaactgatcaatggtgaagtggaagtggaaattgaagcggaggacattgcgtcagaacttctattttgggaaaacgcgatgatactgtatgtgctgggaggtagtttgagcatgaatatgttgaagaactacatggtgaagatgtggaatttcgttactcttccagatatgttgtatcacgatgacggttacttccttctctgtttcaagaatcgcgaagacagggaaactgtgatgatgagaggaccctacaccatccgcaacatgccaatcatactgaaggaatggacgccagatttcaatctaagtaaagacctggagagaactatgccgatttgggtaaagttaccacaattgcctctatgcctttggggattgaaaagcttgaacaagataggcagcgcaataggcaatcctttgatgactgatgaatgcacagctcagaaacttagagtttcttatgctcgcatattggttgaggttgatattacccaaaaattggtagaggaaatcaccatatctgacagaactggaggaaagataaagcagattgtggaatacgagtggaagccagaattttgtgagaaatgtcaaaaggctggtcatcaatgtggaaagaagaaagttgtcaagaaatggatacctaggaataagcaagcagatgaggtaaaggcagatccccttccaaagatacctgtgcagaatattgaaactgaaggagaggacaaaccagaaggttggattacaatgggcaaagctgcaagacatacaggcaaagctatagaggtaattggaaagctaaaggagattagctctcgtctcctaaagcttaggcctaccattgctattttgattgaaactagagtgaaaaataagaatgctaagaaaataagagataagcttaaactccctcacaactacctggacaattacaagtggtatgataatgggaggttgtggattgaatgggataatagtaaaattgatgtgaggcatgttaagtgttctagccaatatgtgcacgtgggtgtgtataacttgcagggggagttcaaattctggcttactgcagtgtatgccttaaatcagttggatagaaggaaagttatgtggaaagatttggaggctatccataaacatcaacaaggtccttggtgtgtgattggtgacttcaacaatgttactaaggctcaagatagaattggaggaaaagctgtgacagaaagtgagtacattgatttgctgaacatgatggagactacaggcctggctgagatggataccactggtgagttttatacctggactaacaagcaggtgataggaaccatctactctagaattgatagggttctgggtaacttggactggtttcaagacaacttggatactgtgttgacagtgctgccagccagtgtttcggaccatgccctgctctatgttagtaaaaaagatcccattatcaagaacaataaaaacttcagattcagtaattgtctaattgagatggaagg

SEQ ID NO: 28710 - DNA, 411 bp, Glycine max
  Peptide Sequence Number=SeqID_145488
atggatgctgaaaaagtgtggcatactggagggtgccattgtaagagtgtaaggtggaaagtgattgctccttccagtgttgttgcatgggattgcaactgcccaaactgctacatgaaagtgattgctccttccagtgctgtcaattttgagcttttgggagattctcacaagtttcttacaacttacacttttggcactcacactgcaaagcacacattctgtaaaatctgtggcataacctcattctattatcatccacgctcaaacacagatgggattgctgttacatttaagggtgttgaccctggaacgttgacacacgttgaaatcaggcatgctgatgggaagaattgggaaagggcagttattgagacagacatcgcttcatattcaaaggtgcagaagtaa

SEQ ID NO: 28711 - DNA, 192 bp, Glycine max
  Peptide Sequence Number=SeqID_145489
atgtcaaaagtccacccatacctgaaattcgaagtcccacaacgtagaggtgtgcttcacgactccgaaaatggcttccttttgcaatttggagtagaagtgatgagcaattttggagctttaatggaggcttcaatggagaggaagaagaagagaaaagcaatgtgggaagggggaggaaaagctttctga

SEQ ID NO: 28712 - DNA, 426 bp, Glycine max
  Peptide Sequence Number=SeqID_145490
atgcctcttgagcttgaggttattctgcaagtaaaggagttgttggatgagggtttggttcgtaagagcttaactccttgtgctttgttggtgcccaaaataggtattatgaggcaccaaatccctatgataggtgatatgatgcatgtgttgagtggtgcaaccctcttttgtaaaatcacccatgcatccaacatcttcatgattcacatacatagggactcattaggtaggaataatcaacataaaaatacagagaaagctgtctctagaatatttccattggatttaatgatgaaatctgtgcaatttcagttgtcttcagctaggcttagcacacaactggcactaagcttaaatccacttacttgcgctaagcgcaagggtggcgctaagcgcaaaatcatgggttcagagcctatttaa

SEQ ID NO: 28713 - DNA, 357 bp, Glycine max
  Peptide Sequence Number=SeqID_145491
atgtatcaatatccttttcagggtcatcacactgatacttctgcaagccagcaatcgttcggtggtgttgcggaaacacaagctcatttttcatggcccacaatgaccccttcacagcaatatcatggcccaattccaacacctaatgccccgttaggaacacaatggaatgtaccgggacaaatacctaatacgggcgacttattcggtgttgatttgcggcacgcattttctgcggaggctgacgaagaaaaagcggggaggcatcggggcagaagaaatcctgatcgccaagcacgaagatgggatcgaccatgtggcacatcctcacgacatcacggacaccaaaatgaatga

SEQ ID NO: 28714 - DNA, 228 bp, Glycine max
  Peptide Sequence Number=SeqID_145492
atgaagaatggtgaaaccatctccaaactccaaacaagattcacccacacaatgaatcacttacttagtcccggaaagatgtttgaagatgatgagttaaacatcaagatcctcatctatcttacaagaacctgggaaccaaaaatcacagcgatcaacaaattcaaggacttggcatcaatgttgatggaagctctcttcaaaaaaactgcttacgtatcaacatga

SEQ ID NO: 28715 - DNA, 468 bp, Glycine max
  Peptide Sequence Number=SeqID_145493
atggccggtgaacagctcggaaccggcgatgatcaccagcgtcagcgcgatgccgaaggtggcgcccatcaccagcggtcgcacgcttgggtcgaccaggttgccgagggtgaagatcaggatgatgccgaggccgacgtaggcgcccgccatcgccgagctgatccaaaagccgagcgggctctccttcgccaggcggacgatgcgcgccgcgttggcggcgcatttgttgatcgtgtcggtaaacatgttgcctcccgaaaggttatgccgcgacttgcacgatgccgtcgaccacccggctggcgaagctggcgacggaacggctgtcgtcttccagacagtggccgtcgtacaggcggaaatgctgtttcttcagcgggctggcgacccatagttcgccctgatgctcggcgatcaggccgcgcgacagcacgctggcctgggcgaacgggtcgatattgctga

SEQ ID NO: 28716 - DNA, 171 bp, Glycine max
  Peptide Sequence Number=SeqID_145494
atgcagccagaattggagggtgccaaactttgtgaacagcaagtaaacgatatcaacgttaatgttgggagctataccaacaaaattcacggaaagattcggaaagatattgatactactcagggtgggcaaattcgcaatggtaatgaggccactagtttggccaagtaa

SEQ ID NO: 28717 - DNA, 132 bp, Glycine max
  Peptide Sequence Number=SeqID_145495
gcttggcttagcgcgaggataagaccgcttagcgaggtttacagattcgaaaagctgcaactctcgttaagccaggctctagctggcttagctaaaatgatgcatcttaagtacagaggagcatgcgcttag

SEQ ID NO: 28718 - DNA, 126 bp, Glycine max
  Peptide Sequence Number=SeqID_145496
atggtagaagctaaaatcatcaaaacaagccagaaggctgaaaacaataagtcaaaatcttcaaaatcttcagaagcatttaatcaaacaccttgttttggattggggatcacattcaattgctga

SEQ ID NO: 28719 - DNA, 480 bp, Glycine max
  Peptide Sequence Number=SeqID_145497
atgggtcaagatggtggcaatgttatggaaaatctaccgatcctcgacgacaagaattggcatcggtggtatgcacatataaaggtgatacttaggtatcaagaagtcctcgagatcgtggagaaagggtattcatcacttgcagaagatgctacaaaagaacagaagagtgtggacaattcccattttgaaaagatcattggagaaaaaacctcattggaggcatggaagatcttaaagaaaggaactgaaggcgcaaaacagttgaagaaggtgcatcttcaaacgatgcgcatgcaatttgaattgatgcagatggaggaaaatgaaagagtagttgagttctttaatcgtgtctttactctgaccaatgcaatgaagtcctgtggtgagaagatcattgatctcaccatcttagagaaagtcctacgtaccttgaaccccaaatttgactacattgtggtggccatagaagaataa

SEQ ID NO: 28720 - DNA, 851 bp, Glycine max
  Peptide Sequence Number=SeqID_145498
atggccaaggaagcagattcagaagatgatgttctcttgaaaagccagataaggtttactaacaataggattatacaagcagaagtcactggagacattttgatcaggagaaaggatggcaaccaggcaatgatcaaagatgtcttgtacgttccagcaatgaaaggcaatctcatcagcattaatattggtcaattgattgaaaaaggctttagtatgaacttgcatcagggaatcttggagctgtataagcatagaaaggttctcaaaaaccccactcccagccaacagaacattccaaatgtatgtggcccctttaaagtttcttctctaggtgggaacaagtattttgtctcatttgtaaatgaattcagcaagaagttatggacctatccacttaaagctaagagtgaagtctttgatacctttaaggtgttcaagatactagtggagaaacagtcagggaaaaatttgaagatcctaagaataaatggtggaggggagttcacttctggagaattcgagaacttctatagagataatggcataatccatgagatgacaactcaatatacacctcggcataatggctcatacaaactctacaatcccaagaaaaagaaagtaatctacaatagagatgtacaatttgatgaattaaaatattggaaggataaacacaaccagaaggagcaagcaactgtcaatgtccaagtgcctatggaaaattcagttaaacatcaagatgaagcaataccacatggagaagataagggtgagtttatgaatatagccttgatggctgctacagaaccagtaaaatttcaggatgccgttaaagagaaattgtg

SEQ ID NO: 28721 - DNA, 543 bp, Glycine max
  Peptide Sequence Number=SeqID_145499
atggacacgcagattgcacgtgatcatcttcagtacttcctaccaaatttccaacaccaatacggactgcgatcgcctgggcggagcagcgcggtcgccaccgtcgtcgccgcggttccggcacggtcggagcaagagcagaggctggggttcgtcgaaggagagcaattccatggagaagttggtctttattcttatgtcggcagttttcagaaggcgagtataaagaacggtgtcgttcttgtacacaagcgtgctcctcccggttctgtttataggagtcctcagctctttcaaaacttgtggcctctcatggaggctgataatggaactacactcaatgtgttgatgaaagcatggactaaaaacgagcttagagagtggaagccctgtgccaacgcaagtcttcctgaaacagaattgccaaagtcaaatgggttccttataattgaagcaaatggtggattgaatcagcaacgcttgtcggcctcgttatatagaaccatgaatgaagcatggaataccattacctcagagaaatag

SEQ ID NO: 28722 - DNA, 1107 bp, Glycine max
  Peptide Sequence Number=SeqID_145500
atggatctgtgtgctgctcatgcgaagaaccttttccacacaaattcgttttaccacagacccattccctccaatttgggaaggagcagagtgtttgagatcactgtttcgaggagaaacccttactctaaagggtatcgcctatttgttgtcagcgccacggggaagaacaatcatgaccacaactcctcttcttccgtatttgtcatgaatgggagtaatatttatttattgcttccttctaacttggaccttcattttccattagcaatttcaggtcaaagcaatgatgaatggtccattccagaagaagatggtactagagggaataattcttctgatggcaacaaatcagataacaactctgagaaatgtcatcatactaatctggattggcgcgaattcagggcaaagctatatagggatgagttgaaagaaatatcagatgctgacacgcataatcaaggtggaacattgcctatttccaaacctcttggagcacagtgggctcatcctattccagtacctgagactggttgcgtacttgtggctaccgaaaagcttgatggtgttcgcacatttgaaagaactgttattctccttctcagatctggaactagacatcatcaaggaggaccttttggaattgtcatcaaccgtcctcttcacaaaaagatcaaacacatgaaacctacaaaccatgatctattaactaccttctctgattgttctctgcatttcggcggacctcttgaggcaagcatggttttgttgaaaacagaggagaagatgaagcttccaggatttgaagaggtaatccctgggctatgttttggatctcgaaacagtttggatgatgctgcaggacttgtgaagaaggggattctcaagcctcatgacttcagattctttgttggttatgctggatggcaactggatcagttgagagatgagattgagtcagattattggtatgtagctgcatgtagctcaagtttgctttgtggggctttatcagattcttcagaaagtttgtgggaggagattttgcagctaatgggtggtcattactcagaattgagccggaagccaaagcaagacatgtag

SEQ ID NO: 28723 - DNA, 1332 bp, Glycine max
  Peptide Sequence Number=SeqID_145501
atgggggatggaggtggtaaaaacaagaagctttggcatgaggatattattgtggagtttattggaaagagtcttagtttcttcatgatgcatggtaggttgaaaacaatatggaaattgacaggcaattttgaagtggttgatgatagggaaaatgtgattagcaggggtctttggatgatctttgatcattacattgttgttcaaaactgggttcttgactttgtgtcttcgaaagaaattataaaaagcacattagtttggttaccatttctcagtttagctatggaggaaaacttgttattagcattggtgatagtaatttataggcccgttaaggtggacattaggaccgctgatgctttgagaggcaagtttgtacggggagttaagtggaagatggggttgtcaacagcaaggacaagcataggatcagtttgtgtttgtgccatctcaaagcctctccgccgtcactgccatttcctcccaacctctgtttctcctgtcttctcatgtcttcagaaaaagtgcaaattgaattttcaaaaaccagttcaagatgctgcagactcaaaaatatcatgtagcttagtgaatgtggaagatgggatagatgatgaagcatgtgaattagtcagtggagtggagctttcacttgaggagggtgatgaaaatatccgtgcttatctgttcaaggcagtaaaaaataacaatggaactggcctattgcttctttcagatgttttcgggtttgaggattctttcaccagagattttgcatatcgagtagcttgcaatggttacaacattctagttccagacttatttcgtggaaatccatggacaaaggaccagcaagatccagatgtgtttgaaaaatggattgctagacaaaacccagagaggatcgcagaagacattaccagatggacaaaatggctggttgatgaattcatggctgtaggaatttccaagaaacttggcattattggattctgctttggaggtggccaagtgttgaaggtgctggccaaagaccaaggtgcttgttttggcaccggagtctccttttatggtacaaggatagatccccttgctgcttctgatataaaagctcctgtcttgtttattttaggggacaatgacccactttgccaggtaagtgaaattgagaatgttgagaaaaaaattgctagcggctccaaagtagtcttattccctggtagaggtcacggatttgcccaccgacctggatctcctgaagaagatgtggatgctgaacaagcctatgtgattatgagagactggctatatgatcgtttggtcgtataa

SEQ ID NO: 28724 - DNA, 234 bp, Glycine max
  Peptide Sequence Number=SeqID_145502
atggaagttgaaatgcaggctgttcgcattgcacctttctccaatagattagctcaagcagtaccctcaaaaatccaagggcttaggtgctttgccaattttggagctcttagattttcagaacctatacgaacacttgcagaaagcttggttgatcggatggttaaatacagctcccaaagtggagggaaatatgtttcggtgcatcttcgtttcgaggaggtgtttttctaa

SEQ ID NO: 28725 - DNA, 135 bp, Glycine max
  Peptide Sequence Number=SeqID_145503
gaacaacaagctgagtgggtaaacacgcagagacagattttgtgccctttatcattcaggaacagcgaggcgagtgataaacgcgcagagacaaattatgcgccctttgtcattcagatttcgcgagttgggtga

SEQ ID NO: 28726 - DNA, 282 bp, Glycine max
  Peptide Sequence Number=SeqID_145504
atgatgaaagatgagcccgcattattttcattaatgggacaaactggagttcagccttttagatttgtctgctttctaagtattaatgtcaattctcaaatagacctatgggaagtattcaagcagcaaatgacagacatgcttcgtcatagtgatcaaaagggaactgaaataaaaaaggctggtgggtctctatatacttttcccatgccagattgcatgtgtaaacaggtagaacccaaaagtgaaaacggtaacatgacgaaatatattaagctataa

SEQ ID NO: 28727 - DNA, 1547 bp, Glycine max
  Peptide Sequence Number=SeqID_145505
atgtcagcagcgttcacttcttcttccctcaatccccaactttcttattctcgctatttggctctctctaccaacacttgctctgtctgcaggtgtctcagtctaacccactcccacaccaggaacaacaacaagacccttcttcttcttaacccctctagaaacctctccttacattcggcttcagaaggctccttcatcacccaacatgaccctgttgaggacgcaaaagagaagaagccctttaacttcaggctcaataggaggcaaaagggttcttcttcttcctccccagctccgtcaaatcctgatttgctggccatccccggtgtgggtcccagaaatttcagaaagctcgttcagaaaggcatcgctggtgttgcgcaactcaagcaactctacaaggataagttctttggaaaatctagtgacaagatggttgagtatctacagagttccgttggaataatccacaagaaccatgctgaaagtataactactttcattaaaaagagtgttgacgacgacgaggagaagttggaagacaattcctcctcctctgtgcagaagaagcgcttaacattctgtgttgagggtaatatcagtgttggcaagactactttccttcagagaatagcaaacgaaacaattgaattgcgtgatcttgttgaggtggttcctgaacccattagcaagtggcaggatgttggacctgatcacttcaacattttggatgctttttacgccgaaccgcaaaggtatgcctacaccttccagaactatgtgtttgtcacaagggtcatgcaggaaagagagtcatctgttggaatcaagcctcttcgtttgatggagaggagcgttttcagtgacaggatggcttatgctcttttatctcactgttcgatgaaggtttttgtacgagctgtccatgaagctaactggatgaatgggatggagatcagtatctatgactcgtggtttgatcctgtagtatcctccttgcctggacttattcctgatggttttatctatcttagggcaagtcctgatacttgccataagagaatgatgttaagaaaaagagcagaagaaggtggagtcagccttgactatctccgtgaccttcatgaaaagcacgaaagctggttatttccctcccaaagtggtaaccatggagtattatcagtcaatcagctgcctcatcatattgacaactctttacaccctgatataagagaccgtgttttttatctggagggtggtcacatgcattcaagcattcagaaggttcctgctttggttttggactgtgaacccaatattgatttcagcaaggatattgaagcgaagaggcaatatgcacgccaagttgcagaattttttgaatttgtgaagaaaaggaacgaggtttcatccaaggaaggaagtagccaagcccaaccacaggtgctgctacctcatgagggtggcctgtggctaccagatggaaagccttttccccaggaagccctcaaatctttggacttcagacgagcagcgtcgttcat

SEQ ID NO: 28728 - DNA, 534 bp, Glycine max
  Peptide Sequence Number=SeqID_145506
atgaagcaaattcaatctcaatacaagaataacctttatcatttacatcaagcttatcttaaagaaaagggtagaccaaaatacgtatctccagaagattggaattggctaattaaaaacaagtggagtggttcaaaatttcagaaagaagattcaatatttggtgaatggctagatgctgtggaagtttggaaggccacacacatgagatctaatggaacttggtgcattccaaaagaagaagaaatcatggaagctttggagaatgtgggtgatatatatcaagaggaaatttcaaaagctcctgtaccacttgttgaacattttgccatggtattaggaagaaagtcaaaccattctttaggtgttggtagtgcaccaataacaaagaagttttcacacaaaaaaattattcaaaatcaacttgaaaatgcacaaaatcgagttaataatttggagttggaagtgcaaaagttgacaaatattacaaaaaagcaagaggatgtcattacccaacttcatattgaagtataa

SEQ ID NO: 28729 - DNA, 845 bp, Glycine max
  Peptide Sequence Number=SeqID_145507
atggagttaaacaaaagttggatgcaaataattgataggatgactcctctatatgacaaaggagttcaagaatttcttgattttgcattcaatagttttgaaaaaggaaaggactatgttatatgggagcatcatggagaagtgattagtgagcctgatgatgatgatgatcaaaataattgcaatgatggggttcgtgatatgttacatgatcttggaagtgctatgaatattgagaacatcacaggagctgaggaaaaaaactatacaactagcacggacactaatagtgtgaacgaagaagaagataatggaaaagaaattgacgccttgctttctttgttggcaaaagcatttcaacagggaaataaaattcatgtgtcttactatgaggctcgaaaatttattcgtgaactcgggctagcttacgttaaaatagatgcttgcttgaatgattgcatcctttaccgaggtggcacaaagagaaaaattgaagatgggctattgagacatccagctgattcaattacttggaaaactcttgactcaaaatattcatcttttgtggcggatccacgtaatgtaaggcttggattagctagtgatggtcctacggctcctggaaatgatattgatgtgtatttacaaccttttattaaagagctgaaggaattatgggagaaaggtgtagtgacatatgatgcatcaaccaaagaaacgtttaggttatatgcatcaattttatggactattaatgattttccgacatatggaaatctatcaggatggagcactaaagggcgatatgcttttccttgttgtaacatggatacatggtcttcatg

SEQ ID NO: 28730 - DNA, 939 bp, Glycine max
  Peptide Sequence Number=SeqID_145508
atgaggggacattattggaaaggggggatagagaacagagagggggacatgctgaacagtgataatcagaggcacgtatccaatgcttcaaagacagtgcatggtattgaaggtcccttttctggaatttcactgacttctgactcaggaaagaaaaaaatccttcttcttaaagggaaacagcgggaaattcccagtgctattgagggcacagtaaaacagcaaaacatacaatctggaaattctcctatttctgctcctgcaaaacagaaccagagacgtgaagctagtggaagattgattaggagcatacttctaaataatgaatctcgtcagagtctgtctacaactggtgcccaacataaaattcaaattttaagttctgaaaatgggaagcgaccccctcgtacttttggctcaaggtctgggttaaatgatcaagtctcgaataatgatgctgcacaagttaattctgaaggggattccaaaatggcattggacaaaaagttcgtaaaaagggatctgcatggtttgggtagcggtgagaaaacagaaaaacgtactagaaacaaggatagacctgatcgtggtgtttggacaccccttcgccgttctgatgtttcaaatgctggtaatgaccattcatcatcctcattggcacagcctactcagtcaaatcctgaatctgctgaaggagaagtaaaagaaaatgttccttctggaaacaggggaggcgaattctctgcttctgcaggtggacgtgggaatccttccattgagaatgattctcagagaaattttactcgccgtggcgcttcctatatagtgaaggatgatggtgcagtcagtataagtgaagggaaaccttccaagaaaagtgttgggcatagcgctcacgagaagcaagtctgggttcagaaatcttcttcagggtcataa

SEQ ID NO: 28731 - DNA, 273 bp, Glycine max
  Peptide Sequence Number=SeqID_145509
atggaatcctacacaacattctacactttgtccatcaaatcattggcatggcaggacttcaaggacctttctatgggggaacaaacgccttccatagaagaaatgctatttatggcctttatcttgaagaaattgaaagtgagagaaaaggtcattgagtcattcgctaacttgaccttcacgttggtgctaacaagatgttgcaaatcacctctaggccaatgcaaaggatataacggagaagcgggagaggaggcaagtagtcacaaatga

SEQ ID NO: 28732 - DNA, 759 bp, Glycine max
  Peptide Sequence Number=SeqID_145510
atgaaggtccgttcggaaagggaaaagacgaaagttgtgattaggcatttgcccccttctctctctcaatccgatctctcccaacacatcgattctcacttcgcttctcgctacaattggttctctttccgtcccggcaacaacaggtatcaattaccattcattcaaaccatcaattcgctcgctaccattacctctgtctctctctaccctaaccctaaccctaacccttattgcagtcacactcgtcagaggcattcccgtgcctatatagacttcaagtgtcccgatgacgttttcgagttcgccgagttctttgatggacacgtttttgttaacgagcgaggtgcccagcataaagttatagttgagtacgctccttctcagcgtgttccaaagcctagtgccaaaaaggatggacgtgaagggactatatacaaagatccagactatcttgagttcctcaaactaattgcaaagcctcaagagcatcttcctagtgcagaggtacaattggaaagaaaagaagctgagcaagctggggctaacaaggaaacacgaattgtcacacccctgatggaatttgttcgtcagagacgtgctgttgacagtggtatgcagttaatcatgtgcaatagttgtgctattgtgccagagtgtcgcgtcatggcactctactgctcctccaagggtcatcgcgtcgcacctggccatcatggctggaggcctggagcagtgcttttgaggccaaaattgtga

SEQ ID NO: 28733 - DNA, 273 bp, Glycine max
  Peptide Sequence Number=SeqID_145511
atggtgcagcaaagcagcagcataccaaagatagaggacacaaagcaaatattctgcgcttggctggaaaaggatgaaagagaggctgagggacaggaaaatgcagagggtacagagacaaacacagcaagaaactacatgaaacaggtgttttggtttggctgctgggaacttgtgagatgtaaagtacagagagtgagaaacaggcatatgcagctttgcaattgcaaaaacaggggtgaagtagtggcaatctgctgtaccaggtggtga

SEQ ID NO: 28734 - DNA, 312 bp, Glycine max
  Peptide Sequence Number=SeqID_145512
atgactataatttgtctctgcgtgtcatcgggcccgccgcctctggatgacaaaagatgcagaatgaccataatttgtctccgcgtgtcatcggccccgccgcctgtggatcacaaaagacgcagaatgaccataatttatctctgcgtgccatcggacatgattgtgtctggaaggcaaaaggtgagcggaatgaccataatttgtctccgcgtgtcatcaggcccgccgcctctggatgacaaaagacgcagaatgaccataatttgtctctgcgtgccatcggacacgattgtgtctggatgggaaaag

SEQ ID NO: 28735 - DNA, 305 bp, Glycine max
  Peptide Sequence Number=SeqID_145513
gacttgtaaatgcattgaaacttcttcagccgatcaaagacaaatattctggtgtgacacatgcagacttatttcagttggctggtgaggaggaagctagaggcccaaaaatccttatgaaatatggaagagtggatgtatctggacctgaacaatgccctgaagaagggagacttcctggtaataaccatatatcctgtgggagcttaactgctatagaaaactctcttctttgcttgtcagttggccgaatgacatggattgagcaatctactgttaattttggaataaataaaataagataa

SEQ ID NO: 28736 - DNA, 378 bp, Glycine max
  Peptide Sequence Number=SeqID_145514
atgttgcgaccttcatttcctactctttcttatgaaagtgaaaagcttgatgtgaataccatatcagaagtgattgctattgttaataacatggaagattggggacttgggttacatgaggaaagaagctatagcttaggacctaaatacaaccagaaacagctttataaaagctttacaacagatataagcagcttttctaacagatatgatttacgacagaaaattgtgacattgtttgatccatatcaaaggattgatttgctacctcctccaatgggtgaagagttatcctacgatgcattaggcaaggatctgcgcccatctttggactggtgtccagaaaaaggttggactatgcctgtgcctatgcctatg

SEQ ID NO: 28737 - DNA, 165 bp, Glycine max
  Peptide Sequence Number=SeqID_145515
atggaggaggcaatgcaagatggtgttgtttttcttcctccttcacgaggccacctagaagagaaaggcttccttcaggttcttccaactctaactagaacctttcaagaactcacaaactctcttctatctcaagtgaagcttgtggtgttgagtgagaagtga

SEQ ID NO: 28738 - DNA, 223 bp, Glycine max
  Peptide Sequence Number=SeqID_145516
tattggtgatgggcactttgtgtctttctggaaccagtcttggcttccttcagggattcgattttggcattttgacatccttaatgatttactcccaaaagagattttgttggaaatagctggaaccttgtctcctcgtcaattgttagcgcatgattgtcccatttgggccccactcctgatggggtgttcactacagcttcagcttatcattcctttgaag

SEQ ID NO: 28739 - DNA, 156 bp, Glycine max
  Peptide Sequence Number=SeqID_145517
atgttggaagggtttgagccgtctatagatcgcgttgaagagaaccggcagtcgcgcgtttgtcttcggcgcagagcggtgccggtgcgaatgccgattgttgactggcgccgcttgtgcaagcaggaaccgcagctcgccagttatatagtgtga

SEQ ID NO: 28740 - DNA, 620 bp, Glycine max
  Peptide Sequence Number=SeqID_145518
gagatgacatgatactccttcttggcctcaccgataccaaagcagaagagctggtcaacgaagaaactaggcatggcttgtctccgtttcactcgttagagaaatggaatccgacattgagaccaggacacggactggtctgggttcaatgctggggcattccattagtagcatgggatattgcgcaacttcgcaaaatcgtggcagcaataagggacctggtggaggtggatgacgacggagaagagttgcggaggttagacagggcaagggttctcatcagaaccccatggaggcctatactccaacacacatttgacattcacatggcggggagcgccctttggtcgtcggatgaaatcgattcagacgacagcgacaccggcaccctgctgtcgaagatgatcagagcatttggaactgagtacatgcccagaagtttcaccggcgactgcatcggcagattcacgaaccaggacaacgcgacgatacccaatggaccacgagacgaggaagatccaatgagtaaggatcgtggtaggaaactcgtagagcacaaaaacagcaacatcacgggagcagaggcacaacagtcatggtacattggtgcactgaaatag

SEQ ID NO: 28741 - DNA, 345 bp, Glycine max
  Peptide Sequence Number=SeqID_145519
atggacaagggaagctctgatcacacttcgatggcaaagtttggattatctccactcttggtgctttccatattgttgctgatcatgagtggtggtgcagtgagaggccaaagagaaatggtgcctgccttgttcatatttggtgactctctcattgacaatggcaacaacaacaaccttccttcctttgctaaggccaactattacccttatggcatcgacttcaatggaggccctactggtcgcttctctaatggctacactatggttgatgaaatagtaaatggtgcattaaagaggatatgggctcttcctgcatatttagctacactacacagcccttga

SEQ ID NO: 28742 - DNA, 1131 bp, Glycine max
  Peptide Sequence Number=SeqID_145520
atgaagcatttgagagacatgactttgacattcacattgacatggatcttctggctaagcctaataagtggcagatgcttgtctcaggtggtgcagccgcgggttccgccggggcaacaggtgccatgcttctacatatttggtgactcattggttgacaatggaaacaacaatgggatcctaacccttgccagagcaaactacaggccttatggcattgacttcccagggggtgcaactggacgcttcaccaatggtcgaacttatgttgatgccttagctcagcttctgggtttcccaacatatattgctccgtactcaagagcaaggggtttggaactattaagaggagctaactatgcatctggagcagcaggcattagagaagaaacaggaagtaaccttggggctcatacatcattgaatgaacaagtggctaactttggcaacacagtgcagcagttgagaaggttcttcagaggagacaatgaatcacttaatagctacctcaacaaatgtctattcttttcagggatgggaagcaatgattacctgaataactactttatgtcagatttttattcaactagctcagattatactgttaaagcttttgcaactgtccttcttcaagattactctcgccagctatctcaactatattcgctaggagcacgaaaagtgatggttacagcagttggccaaattggctgcattccatatcaactagcccgttttcacggtaacaacagcagatgcaatgaaaaaatcaacaatgccatctcgttatttaactcaggccttaagaaaatggttcagaacttcaatggagggcagcttccaggagcgaagtttgtgtatctggatttttatgaaagcagtcaagatttatcttcaaatggaacatcatatgggtttgatgtgatagacaaagggtgctgtggagttggcaggaacaatgggcaaattacttgccttcctctgcaacaaccatgtgaaaatcgtcagaagtacttgttctgggatgctttccaccccactgaactggccaatattttactagcaaaggcaacatacagttcacaatcatacacctatcccattaatattcaacagttggcaatgctgtaa

SEQ ID NO: 28743 - DNA, 198 bp, Glycine max
  Peptide Sequence Number=SeqID_145521
atgactaaagaaggaaactctgtcaaagtgtgcaatgtgtactgttataaggtttttggaggtgctcggctcatggctatttttagtaaggttcctttgatggacatgtggaaagactgtcgggctttgcagagatgtgctataccagttcagttgtctgtttggttttatttttttcaattctttggttcatcctag

SEQ ID NO: 28744 - DNA, 408 bp, Glycine max
  Peptide Sequence Number=SeqID_145522
atgatccggaagatagacgagcttcgccaaaggttgcgaatgagaggcttacgctgtaatctggtctatacacatgcaggattgagattaaatgtgataccattatttgcttcaagaaaacaagcactaaggtatctgtcagtcaagtggggaattgatctatccaaagtggttgtatttgtgggagaaaaaggtgacacggattatgaagaactagtggctggcatacagaagacacttgttttaaagggggctgttgaatatggcagtgaaaggcttcttcgcagtgaagacagttacaaaagagaagatgtgttctcccaagatagccccaacattatttatgcagagaagagctatgaggactgtgatatttcagcaattttggagcatctcaaagtatcatga

SEQ ID NO: 28745 - DNA, 690 bp, Glycine max
  Peptide Sequence Number=SeqID_145523
atgatgcagagttcaagatcacgaaaagcagcgttgagagtcagagttccttcgcggaagctgatgattctctctctggccattttcgccattctccctcccattttcttccacttccgcctccgacgcctccaacagctgcaattcacaaagtgccgttggctcaacgatcctcctctggtctgcgcccacggtggcgattcttccaaggcttctccaaacaccatggcgtcctatttccacgctcttcagtctcgcgtcgactgcattgagatcgacgtttctcgttcttctgacggagttctctttgctctccatgacagggatttgcagcgcttaactggaagcgctacttctaaagttggttacttgaactcaaaagagattagagagcttagtgcttcacgtcagtctacctccaagtttactgatcaaagtatacttacaatccaagatgctctgatgttgactgcaaattcagtacgccagatagttctagatgttaaggttgggcccccattttatgagaaagagcttgccaaagatgttctctctattgcttgtataattgtgtttgttgtagacttctttcctataaatatgacaatacgcttgaggcctgagggtaaaatacagtttttcctcctgatcttaaggagtattaccataaacttaacacaccaactttaa

SEQ ID NO: 28746 - DNA, 2371 bp, Glycine max
  Peptide Sequence Number=SeqID_145524
atggacatgatgcaggtaacagctagaaggaatacccgtgaacgtagtaataggttggagaatatgtgctggcgtatatggcatctaactcgcaaaaagaaacagattgcatgggatgatgctcaaaggcttgcaagaaagcgtcttgatcgtgaacaaggccgtaacgatgctgcaaatgacctttctgagctctcggaaggtgagaaagaaaaagcagatgctaatgctaatgctaatgctttggaacctttcaaggataataatatttccagaatcacttctgaaatgcaactttggtcggaggaggatgataactctaggaacctttatgttgtcctaatcagtgttcatggtttggtacgaggagaaaatatggaacttgggagagattctgatactggtggtcaggtgaaatatgtagtggaacttgctcgtgctctagccaacacaaaaggaatttaccgtgttgacctattgactagacaaatagcttcaccagtagaagtggactctggctacggagagcctattgagatgttgtcatgcccctctgatggcagtgactgtggcggagcatacatcattcgtcttccatgcggacctcgtgataggtacataccaaaagaatcactttggcctcacttgcctgaatttgtggatggtgctctaggtcacattgttaacatggcaagagttttaggggagcaagtgaatagtgggaagccaacatggccttatgttatccatggtcactatgctgatgctggggaggtagcagcacacttatctggggccttgaatgtgcctatggtgctcacagggcactcgttaggtcggaacaagtttgagcagttgttgaagcaagggaggctctctagggaggccataaatgcaacctacaagatcatgaggaggattgaggctgaggagttgggtgtggatgctgctgaaatggttgtcactagcacaaggcaggagattgaagagcaatggggactgtatgatgggtttgatctcaagttggagaggaagcttagggtgaggagaagacgcggagtgagttgccttggaagacgcacgccaaggatggtggtaattcctccaggcatggacttcagctatgtcacaacacaagactcagtggaaggtgagggggacctcaactcattcattggatctgacagagctcaaagcaaaaggaacttgcctccaatttggtctgagataatgagatttttcacaaatcctcacaaaccaacaatactagccttgtcccgtcctgacccgaagaaaaatgtcacgactttgctcaaggcttttggggaatgccaggccctaagaaaactagctaacttgaccctcatacttggcaacagagatgacattgaagaaatgtctagcagcagctctactgttcttaccatggtgctcaaactcattgacaagtatgatttgtatggtcaagtggcttatcccaagcatcataagcaatctgaagttccagaaatatatcgtctggctgcaaagactaagggagtttttatcaacccagccctggtggaaccatttggtctcacactaatcgaggctgcagcttatggtttacctgttgttgcaacaaaaaatggagggccagtggatattctaaaggcactcaacaatggactcttgattgatccacatgaccagaaagccatagaagatgcactgctaaagcttgttgcagacaaaaatctttggctagaatgccgcaaaaatggcctaaaaaacatccatcggttttcttggcctgaacactgccgcaactacctctcccatgttgagtatggcaggaaccgccactccacatcccgcttggaaattacaccaatgactgaagaatcaataagtgactcattgagagatgtagaagacatttcttttagattctccacagaaggagactccaagcagaatggagagatggacactgcagcaaggcagaagcaaattattgaagcaatcatgtgcagggtctcttccactggcaagtctaatgccagttactttcctggtaggaggcaaaggcttgttgtggtaggtgctgattgttatgatagtgatggaaatatagctgaggaggattttcaggcagttatcatgaatgtgatgaaatccgtgcgaccaggcatcagatcaggcaaggttggtgtggtgttgctaaccggtttgagttttcaggagacaactgaagcattgaacagcttccaagtgaacatagaagaatttgatgctgtggtttgcaacagtggaagtgaaatgtattatccatggaaagatttaatggctgatgctgattatgaggcccatgttgagtatgcatggccag

SEQ ID NO: 28747 - DNA, 1755 bp, Glycine max
  Peptide Sequence Number=SeqID_145525
atggttgtccttggagctttgcttagaattgaacttttcatcttttattggggtgtagcagtgaattgggttgatgtgcaatgcagagatcacggaaagctcttctggaaagaagggctatacagaaggctacaagtgggaggaactatgtctatctgtataaagtttctctgtcgttggtttttgttttgtggggtctggtcttcctcttcagcttatggacaagccatggccatggttatggagtgttatcaatggtggaaggatgaaattctgccatataaacacgctaatgcgccttatggcactgccatggcgggcttcccttcacaaattgcctatggcgatcatgaatctagagaagttccagttggtgtatcaaattggaatgaagatgaacacagacaatgtaaaaaatctaattctgctgatgaatatttaactaaagagactgatgatgtctacattccttctgagactttctgctctgatggtgctaaaactgatggtttaatcggtgagtcactttccagtggagaaagcataaaccgtgtagaaacgggttataaagaaaattatatttctcctgatacagaggagcatgaagttgagagatctaaatctgctgcgaagcatcaaaatgatgtgcagaagtataatcacttgtctcaggcaatgcctcttggtcttgatgaattcaagagcagggcaattggttctaaaattaagtcaggcactaatccatctggaagtgtaatacatagattagagcctggtggtgctgaatacaattatgcttcagcatcaaagggagccaaagtgttagcttctaacaaagaagccagaggtgcctctgacattctaagcagaaacaaagacaaatatcttagaaatccgtgttcttcagaggagaaatttgtcgttatagaactttcagaagaaaccttggtaaaaacaatagaaatagctaattttgagcaccactcttccaatttcaaagagtttgaattatatggcagtttggtatatccaacagatgcttggattttccttgggaatttcacggcctcaaatgtgaagcaggctcaaaggtttgttcttgaggagcaaaaatggatgcgatatataaaattgaatcttcaaagccactatggttcagaattttattgcacattgagcatagttgaagtttatggggtggatgccattgagagaatgctggaggatttgatatatgcccaagataagccatttgcatctggggaaggtaatggtgagaagagggtagcatctcccctttctaacgctgccaaggctgacaatgttaggccaaatactatcacagggatcaattctgatcctgcttcagaaatctcttctgaaaaccaagaagctataattgtgaaaagaaatgttcctgatccagttgaagaaatccgtcaacaagttggtcggatgccgggggataccgttctcaagattctgatgcagaaagttcgttatctggacttaaatttgtctgttttggagcagtatatggaggacttaaattctagatatatcaacattttcaaagagtacagcaaagacatgggagaaaaagatctacttctagagaagatcaaagaagaaattagtagattccttgaacgacaagatgttatgatgaaagaatttagtgatcttgactcttggaggtcccatttttctgtgcaactggatcatgtactaagggacaatgctgttttaaggtga

SEQ ID NO: 28748 - DNA, 883 bp, Glycine max
  Peptide Sequence Number=SeqID_145526
atgtcaaggcaaactgagacaccgttcctcgaagaatggctaagcattaggtgcggcattaacgccgccgccgccgccgccgccgccaccatcacaaaacccaccgcgcgagccatcgttcaagcatggaccgcactccgagactctctccaatcccagcagcagcagcaccttcaaaccctagtcaattcccaatcctccctccacgtggcagaaccccaagcaaagctcctcctcacccttctccaatcttctcccacctcctccttccctcccctcttcacactcctctacacgtggctccgaaaatccccaaaccctaattccaatataatcgattccgcggtcgagattctctcgcacttccatccagatgataccttttcccccgaaggtgttcttctcttgggcgcgttttccttcgtgccttccgtttccgaaaagaccaagacgcgctgtctggacatgatgctgaaagtactgttggcggcggagaagggtaaattgctcggtgaactgccgcgtgttctcgctggaattggttacgctctgtcgtgttccgtcactgtttgttgcgtggagatgttggatttgttgtttcgaatttgggggaagggagacgggtgtgttgctcatggactcatggtgctttacctgtttgattgggttgtgtccaatttgattggtttcgggtattcggacaagaatcgtgttttggtccaagaaggtttcgggagttttaaggagaagagtcatgcttcgttgtttgtggttttcatggctggggttggagtgttgcgggctttggagagacgcggtgtgaggttgtcagagcatgtgtctggaatgaggataaaggattgtgtggttggtaggatcgaag

SEQ ID NO: 28749 - DNA, 531 bp, Glycine max
  Peptide Sequence Number=SeqID_145527
atggcttggaagcggatttgtcagcccaagtgtaatgggggtttgggtctgcaaacatccaaggaagctaatcaagcctacttaatgaaaggtggttgggagttatccagcaggaagaatgatctctgggtgcaaattattcgatcaaaatataggtactgtccctctattcgagccattcctcctcccaatgtgataagaggggaggatcagttatgttggaaaggaaatgctaatggacaattctctgtagcttcagcttatgagtccattactgagcctttgcttgttgagatttggaagtggaggggccctgaaaggatcaaaatcctactttggaaatttgcatccaatgcattattaacgaatgagagaagagttaatagacgtatagcttctgatccatcttgtcctcggtgtggacagaatgttgagaatgatgatcatgtcttcagatggaatggaaacagtaaagctatttggtacttagattcaaggagatcagcagcaggtggggtctttagaaattag

SEQ ID NO: 28750 - DNA, 183 bp, Glycine max
  Peptide Sequence Number=SeqID_145528
atggaatcccaattagttgatggtaatgatgatatgggagtttctggggatgtgggtttgagtacgtatgaagttcagatgcatcaagaaacatatgaagtcacaattgatgtagaagggaagaggggcgagttcactggtttgaatcccccggtaacaaagactgataatactaacaactag

SEQ ID NO: 28751 - DNA, 231 bp, Glycine max
  Peptide Sequence Number=SeqID_145529
atgccgtttctctggtttcagtccctcgtgtttctctgcacctgtcgaggccagttttcgaaagtaggcaatatatatatcaaaacactcagaatgaaaccccgagcgtggttcagaggatgtcacaaagaagctcaccaccataggaggccatggataagagcttggaggaagaaggagatgaatgaagggagagggagagaagagcacgaaaatttgtgctctaaatga

SEQ ID NO: 28752 - DNA, 669 bp, Glycine max
  Peptide Sequence Number=SeqID_145530
atggaacaccctaatggaaaagtagcccgagcctctcattctgtgttcatggcatttatgactatggggaaggattctgaaaagaacgatgaagtttcattgaaggagcaacttgttttccattacatgcaaagatccttattgggatatcctggcattactccttttgagggtatggcttctggggttgtaggaatggtccaacatcttcctgctggaagccctgccattttttattgcgttcacagtcttgttgaaaaagccaaccagctctgttctgaagttttcactaatgaggctgatgcgtggaagaagtggcaaggagagccagaaccaagcaagaaattattggacttgcttttacgcttagttttcctcattgatatacaagtcttgcccgacttgatgaaactgttggcacagctgataactaaattaccacgagatgcacaaaacattgttttaaatgagttatattcacaagtggctgattctgatgatgttgtccgcaaacccacactggtttcatggctgcagtcattatcttacctttgcacaaaagctacaaatcaaaatgcagccaaccgaaaaagtgaaagtgaagataatccaactttgtctagtattgcagacccatataacagtggaagagcaactgcacggctctaa

SEQ ID NO: 28753 - DNA, 801 bp, Glycine max
  Peptide Sequence Number=SeqID_145531
atggtgctgaagaagataggatattgcttcaggcattcgtctttgtttgtctgtcttggtttggcgttgttgactgagatatttccgttgccacgtttgtatcgatcggtgtttgagagttcatgtgattcgggtggagtggaacttagggagatcagggaacatctggatggtgtactgttcaaggaagcaggaggtgtgacaggggtgttgtgcagtcaatatgttttggctgatgaggaaagtaagaatgtggtggagaatcttatgtgggaatattgtcgggatgtctactttggacataggcgagtggctgtgatgcttaagggcaagaaggatgagttgcttgagggtttggaaaaacttgcagaatctgctttcctcatggttgtggtatttgcgttggctgtgacaaaacacaagttgaactccaattttgctcaagaaatacagatggacgtcttgttgaagatactagtttcgttttcttgcgtggagtattttcgccatgttcgcttgccagagtatatggagaccattcgcaaggtggttgcgggtattaagaacgaggatgcttgtacttcttttgtgaactccatgccctcttatgccgacttgacaagcagcccagattgtgtatgtcttctagaccagaaaaccaattacttatggtccaaggatgaagtgcaaacggctcgcattttgttttacctacgagtgattccaacttccattgaatgtttgcccagccttgtgttcagaaacatggtagctccgactatgttcttgtatcctatatga

SEQ ID NO: 28754 - DNA, 735 bp, Glycine max
  Peptide Sequence Number=SeqID_145532
gagttctacgccaagctctacagtcccgaggggccttcacctaaacaagtcagaatccgaggccacttaataacgattgatgcagacagcctcaatgcctttctagaaacacctgtggtgcttgctgagggtgaatctttgcccgcctactcaagatactacaggatgcctactgacattagagaaattaaggttgcactgtgcatacccggccgagggtttattctaaatgttgaaggtcacccggggaagatcctcagaaaagatctaaccacccttgctcaggtctggagtgttctatcctacttcaacctggttccgacctcccacacatcggatatgactatggatcgagctaggttaatctttgtcctagttactcagctggacatgaatgtcaaagccctcattgctaggcagatcacttctatggcccagtctaactcctcaagactcaggtttcctgctcttatcacagttttatgcaggaccagaggagttgcctctgacagtcttgtctttgaacgtctgagcccggtcattaatttggcctacataaggaagaattgttggaaccctaatgatccaacaattattatcaggggggctagaagaccaagggcaaggccagttgaggctccttctacatcagcagctcctcctccagctcatattgtagcagcaccttctaccctacctcctgcagattttcaatgtttcgaagccaagctttga

SEQ ID NO: 28755 - DNA, 201 bp, Glycine max
  Peptide Sequence Number=SeqID_145533
atggtggttatatcactgtcaatgaaactcaaggaaagagcactgttctattggtttttcgaggccactcacaaaccagaacaaaaacccgttcttttatggctcaatggagcgaagcataaaggttatgtgagtggtagcttgtcggatgaggggaaggttgtacttggaggacattctggtaaattagaaagttcttag

SEQ ID NO: 28756 - DNA, 135 bp, Glycine max
  Peptide Sequence Number=SeqID_145534
atggataaccatgagcatgcaaatcatcgtgatacagcacaagccaggataaagaataaagtttcttcacttgagaaccaaaattatatgtcctcaactaatgaccccgcaattaatagagaaggtaacgattaa

SEQ ID NO: 28757 - DNA, 773 bp, Glycine max
  Peptide Sequence Number=SeqID_145535
ggagtgcgagacatgcgatcatgggtgaggggtctgtggattccctttgatgcagatgccctcagccagttcctgggtgacccgctagtgttggaggaaggccaggagtgtgagttcaatcaaaggaggaacagggccgatgggttcgatgaggaggccattgcccagctgttatgcacctcggggcaggatttcacccggactgctgcagggaggcaggtgcagatcatgcacaccaacatgaccaccttgacccatatgtggatggcattgctgctcagcaatgtcttgcctagtgatcataactctgaccttcctctgtcaaagtgtcagttggtgtatgccatcctgacacggatgagcgtccatgtggctcagttgattgttgacgccatctatttatttacaagtatgccacccaccaggcaccctctagacctggataagtctaacagggccctggggtttttggcattgatcacgggcctctgccaatcattcggggttcccgtcactcctaacaaggctgatgcacctcaggccgcagacacaccaccaccacctcatcaggctgatcccgccaggtcactaggcatggagcgttatctacagcacttgggtttcgctccttttacgtgccctactccagagcagtttagcccgaggcccatacaggggaggcacctgccggattcccccgccgatgcagaggaggcccgcatggatgaggagatgacggacttgctcggtttcttgggaggaagcggagccac

SEQ ID NO: 28758 - DNA, 435 bp, Glycine max
  Peptide Sequence Number=SeqID_145536
atgactttacaacttgctgaccgctccattaccagaccatatggagtaattgaagatgtgctggtcagagtaaaacattttatcttcccagcagactttgtggtaatggatatctctgaagatattggcatccctgtaatattgggaaggccattcatgtttaccgcaagctgcatagttgatatggggaagaggaagttggagctaggttttgaagatcagaaaattgattttgatttgtttgttgaagacaagcctactccagaacacaatgttttcttacaggtaatggaaggaggtcaagaggttctgaaagtaagaaccaaaattcctttcattaagcgcaagcctcgcgctaagcgcttctttggtcatgcactaagccaagagtctctagcgcttagcgctcaacccttgcatctcaggctgatttga

SEQ ID NO: 28759 - DNA, 560 bp, Glycine max
  Peptide Sequence Number=SeqID_145537
tccaaactcaggagcacaggtcgcttgagcaaatggaccaatggcttgcactcaattctggatttacatgcgattctcctcaaatttcagccagcccgcatcaattagaccttgcaccttacgcttcaggcccctacaatgctcaatggaatgccccggggcttctcaatgacaagcacacgttgcgttcgagtcgtattctcggagaaatggaggttgatgaaccttggttggggctttctcgctgcaaaattcatttcttggttgggatgacctttgtggataactgggcggtgggtaaggagaaggttggttattggctgagtaatgacattgttgggttggtggaaacttggctgtataggaatggcagtcacagcatgggtttctccctcatcctcaccctcttcatttgccccatgaagaccaaatctgcaaagattgaagggaaaaacttgggctgccagatccctccacctttgggcgtattctttgaaagatccgtgcccccttttcgcacatgttctgtagttgcatcctatccgaagccattatactga

SEQ ID NO: 28760 - DNA, 285 bp, Glycine max
  Peptide Sequence Number=SeqID_145538
atgacgtggatatggcatggtgaaatgacagacatgcagagtaggccccaatctgaaccgttttatgtagaaatgggagatcggttggaagatatgatttgtgaccttggacaagagtcttttcagcaagcatatgcccctatgtatgatacattacaaagtgattcaaaacttcaaggtcaatggacaccggctgaaaccattcctcacaaatccttccttggtggatgtagtggtggaagagacctccttacttcaccctacttctctcccgccatgacttag

SEQ ID NO: 28761 - DNA, 246 bp, Glycine max
  Peptide Sequence Number=SeqID_145539
atgatattgcacgagattagaaggcctaactctctaaaaacaatccccagtggagtcgccaactgttgcagcctacccttcggcgggagggcgacgcggggctcacgagtgcgtcttccatgggaggaaaatgcgtggagtcgccaccaacgtttattcgaggaaaacgtcggaaaaactggaaaagggtgtctccctcgctcctacgtattcctcaattgtgataaggaaatcagacctacgtag

SEQ ID NO: 28762 - DNA, 264 bp, Glycine max
  Peptide Sequence Number=SeqID_145540
atgagtgaagaaggtgagttgcaagagcagataaaggccgacataaaggccctgaaagagaaaatgaccacaatgatggaggccatgatgagcatgaaaaagataatggaagtcaatgcggctgcagttgctgctaccagcgctattgctgaggtgaacccgactccctcatctgaccttaaccaaataaatcgtccaatctcggatatggtagggcagggaggcaaagaattgggaagtacaagcggccctcattttgtgcaa

SEQ ID NO: 28763 - DNA, 672 bp, Glycine max
  Peptide Sequence Number=SeqID_145541
atggttgagtctgaaagacttagctacatcaggacaaccttgaaaaacttagagttgacaagttatgacagagtcactgttgttgttgtttatgatgctaatggtgcacttgagaatcctatcactcaaaatgatgagattaaagaatatgtagattacagatatatttctccttgtgaagctacttggagaatttttggttttccaatacatgctagaaagcctgttgtggagagattacattttcatcttccagggcaacacagtgttctgtatgaagacgatgatgatatagatgatatcctatcaaagccaagcatttcagattcaaaattcttagcttggatgaatagcaacaaatgtttttcagaaggtagaaatcttacttattcacaatttgtttccaaattcatgtacaaccaaaaggctagatcatggaacctcagaaagaaaggcaatacaattgacaggctaatatgggttcaaccaaccactggtgaattattttatctaagaatgatgcttactacatgcaaaggacctacttcatttgaggtgttctataccctacatatagagaagcatgcttcgcaatgggttttttgcaagatgacagagaatttgtggaagcaatcaaagaagctaaggactggggaacagctaattatttga

SEQ ID NO: 28764 - DNA, 135 bp, Glycine max
  Peptide Sequence Number=SeqID_145542
atggctctcacaatgatgaagattgaaaaagaatcagaggaaatatttaacattgttcatgttattgatcagctttacggtgaagtcagtaggtcatttgttgtaaagtggaaggatgaactagagcctacttga

SEQ ID NO: 28765 - DNA, 433 bp, Glycine max
  Peptide Sequence Number=SeqID_145543
tctagtgcagaatgcgttctggatgttgccagtagatcccaacggtcaaaatgtaggcttatgcactagagacttccaagttttctgcctttgctctgttttgcttggttgtgatagcttgtgctgtttgaatgttgttttgcttggatgttgtggaagcttgggaggattgatggggacccggggatggtgggtttatgcgcgcattgtggatgtggaaaacttgttgtgcaccatcgcccgaccgccacctagtaccacatgtgatggggtgaaacttcctgcttttattgttgaccacagagtggtacctggagatatgtcgcgggggtcaggagaccttggggacgtcaggcgagctcctggcagtcaacagataaaaggaaaacaagaccacaaagcaaggaggcttgtggtggctggccagctgtga

SEQ ID NO: 28766 - DNA, 333 bp, Glycine max
  Peptide Sequence Number=SeqID_145544
atgacacaaaaccctaccttcttccctaggatagaaataatcaaggatcctttcttggattacaccaatcctaaaattcattataaaaaatcagcacttcttaaaatgcctcttgtcgcaacctacccttcggtgggagggcgacgcggggctcgagggtgcgtcttccaagggagaaaaatgcgcggagtcaccactaatgtttattcgaggaaaacgtcggaaaaactggaaaggtgtggtctacgaactttaagtgtgaaaggttcgggagttgtatttacgcacggggaagtcgacaagggtgtttcccttgctcctacgtatccttaa

SEQ ID NO: 28767 - DNA, 104 bp, Glycine max
  Peptide Sequence Number=SeqID_145545
atggctgggaaagatagaatcctgattttgggacccactggtagactactaattgaagaccagataaagatcaatgcagcaataaaagaagctggaacatcaag

SEQ ID NO: 28768 - DNA, 192 bp, Glycine max
  Peptide Sequence Number=SeqID_145546
atgaacattcctgaagttaaagcaagagctccacctcgtcgagtgataaagcaagaagttcaagcgtatggatcatctggtttgacaatagttcgtcccccaagatttgattgcagagaagctgcagaacgtgtggctacccctgaggtcactgttgggctagtttggactgcttttggtggagaagtttag

SEQ ID NO: 28769 - DNA, 552 bp, Glycine max
  Peptide Sequence Number=SeqID_145547
atggagaaaatcaatgagggtgttggcataaatctggatgatgcacttgcgttttggaggtcagagttctctaaaaaggttggtttggagaagtttgagaaacaatatgcatacaacatacgccataattatggaaaggaagggaagagaactgactacactccctattcttgtcaaaagattatttcatcaactcctggagctggagatcatcatggttgcccttatcgaaatttcagtgaagagaatctaagagctgctctcagcagaatgggggtaaacagttgggcaatggaagatgtgatggacaaagtgaaaaatagacattatcagttggcttgcaccttgacatttgaagctcttcatggcatgacgtgtgatgcagggattaaccatccaaatcaatacttcagtgacagtcaaaagatattaaagccaaaggtgtgtcacacgtcggtgcctctggtcatggatttgcagagagacaataaggttaatcatttaagccttcccaactcaactgaggtagggaaacctttcaaggaaagatag

SEQ ID NO: 28770 - DNA, 639 bp, Glycine max
  Peptide Sequence Number=SeqID_145548
atgggtttcataatggaattcgcggagaacttggtattgaagttgatggaggatccgaaggaaagggatcggaggttccgggagcacgtttatagagtgaaggacaggtgcgagaagacgaaggagatgtggagctaccctatgcgaccctatgggttttggactttcgaacgccacaattctcagcttgcttgggatgcacagattagccaagtggctgggaggagggacccttatgatgatatcctccaacatttctctaccccacctaatatgtctgattttgagcatgagaatccctccttgcctagtcctaaagatttatcttcaagtgttcctattacatatgctttctcagctgtgtgctttgttatgggaatctatggagcctactattttgggcaatttcagaaccttaaagatgtttttaagcttcagaaacaaatcaaagagttggtgccccgatgcattcatgcttttgctggtgatatagtgctagttggagagttgagagaagaacaaatggggaaggtgcaccagtttgagcttagagctaaaatgggtggccataccggggttggagtagcatccattgtggaaaagaagggtagtgcaatagttgagatagagggagattaa

SEQ ID NO: 28771 - DNA, 1545 bp, Glycine max
  Peptide Sequence Number=SeqID_145549
atgaaacccacggcaacattcttctttctcctatccacaacaacactccttgtttgtctttgcctcggaacaacaacgttccaaaccactctctttataaccttcttcactatttcccttaactactggcttgtccctggaggctttgcatggagaaactatcactcttatcacaccaacgaaaaaccaaacaaaaaacttactgggcctatgggctggcccatacttgggtctctgcctctcatgggctctttagcccaccaaaaactcgctgccttagccgcgacgttaaacgcgaagaggttaatggcactgagtctgggacccactcccgttgttataagcagccaccccgagaccgccagagaaatcttactcggttcctcgttttcggatcgtccgataaaagaatccgcacgcgctctcatgttcgagcgtgccattggcttcgctccatccggaacctactggcgacacctacgtaggatcgcggcgttccacatgttctctccgaggaggattcagggcctggagggtctccgacagcgcgtgggtgacgacatggtgaagagcgcgtggaaggagatggagatgaaaggcgtggtggaggttcgcggtgtgtttcaggaagggtctctttgtaatattctggaaagtgtttttgggagtaatgataagagtgaggagttgggggatatggttagggaagggtacgagctgattgcgatgttgaacttggaggattattttcctttgaagtttttggactttcatggggtgaagagaaggtgccacaagttggcggctaaggttggtagcgtggtggggcaaattgtggaggatcgaaaaagagaagggagttttgttgtcaagaatgattttcttagcactttgctatccttgcccaaagaagaaaggttggctgattcagatatggcggctattttgtgggaaatggtgtttcgaggaacagacacagttgcaatactccttgaatgggtcatggccaggatggttttacaccaagacgtacaaaagaaagcccgcgaagaaatcgacacgtgcatcggccaaaacagtcacgtgcgagactcggatattgcaaatctcccatacctccaggctatagtaaaagaagttctccggctgcacccacccggcccactcctatcatgggcccgtcttgcagtcaatgatgtccacgttgacaaagttcttgtgccagctggtacaacagcaatggttaacatgtgggccatatcacatgactcatccatctgggaagacccatgggctttcaagcccgagaggttcctcaaagaagatgtttctatcatgggatcggacttgaggcttgcacccttcggggctggacgtagggtgtgtccgggccgggccttgggtttggccacgacccatctctggctcgcgcaacttcttcgccacttcatatggcttcccgcgcaacccgtggatctttcggagtgtcttaggctttccatggaaatgaagacacctctgcgatgtctagttgttcgtagataa

SEQ ID NO: 28772 - DNA, 1248 bp, Glycine max
  Peptide Sequence Number=SeqID_145550
atgtccaagctcattcaccgcccgtgcacaccatcaccactgagatccacctctatgtgctcgcaacaacaacgacctagccatcaccaaccatcgcatcatcatgcacaactccaccctcaacacctctatgtgatcattgcactgtggcaaggttcgagacaaggggtggctgttaacgacgacatcttaggcgcgatggatgtgcatgacgacaagtttcatggctttgatgatcttttgcatggtttgaatagtcaggagagtccacatagctcatggagagcttggtcgatggtggtgcggcacggtaacgacgattttcgttggaaaagggaaagaaaaggtgatgatgtgacgcaagatataagtgataagggatattcaatgcaattagcgaatgagagaatgaagagccggtggttcgtgtggcttttggcggtactaggcatcatcggagccacactcttcatagtgagcttgatccaaacctcggagaacaacttcctatgttccataacaagaacgatgcagcagcagcagcagcagttcaccgatggccccacatcgatgcaactcaaagccatcctccactacgcgacctctcagattgtccctcaacaatctctttccgagattacaataaccttcgacgtgctccaaagcctccaccgccccgccaacttcctcgtgtttgggctgggccgcgattctctcatgtgggccagcctcaacccccacggcaccacgctgttcctcgaggaggaccctaaatggttcgggatcgtcaccaaggaggcgccctacctccgggcccacacggtccgttaccggacacagctccgagaagccgacagcctcatgtcctcgtaccgatccgaacccgcgtgttttccggccaccgccacgctccgcggcaacgagcggtgcaaacttgccctacataacctccctgacgaggtttatgagaaggagtgggatttgatcatgatcgacgcgccgaaggggtactttgcggaggcgccggggcgcatggcggcgatattctcggcggcggtgatggcgagggacaggaagggatccggtgtgacgcacgtgttcttgcacgatgtggatcggaaggtggagaaggtttacgcggaggagtttctgtgtaggaagcacttggtcaaaggtgttgggaggctctggcatttcgagattcctccaatgggtaataacactcgtgactacgcacgtttctgttag

SEQ ID NO: 28773 - DNA, 165 bp, Glycine max
  Peptide Sequence Number=SeqID_145551
atgggatggacagttggtggtgctggcattcttcaagctgcaagcagcctgcccttgtgctcgcagcagtccttgctcggaaccaaagggacactatcactactctcatttttgactgaggatggggaattagatatgaaaataaatgctaaattcaacgattaa

SEQ ID NO: 28774 - DNA, 450 bp, Glycine max
  Peptide Sequence Number=SeqID_145552
atggcgtgcaggggtatgcttcgttccaccattctcatagaacccagcctactccgttctttaaatttcaattctaacaaacatcacatagcttcactcaaccaatggtcttgccggtttcattctccaaaacccccttattcttcctctcagaacgaaacgccgttgtctcaggaccctgtcttgaaggccatttcagagatttccaaaggcgaagggagggttggccaaacaacaaacgtaattattggaagcactgctgccgatgattctaacaatgaatggttggctttggaccagaaggtgaactcgtacccaaccgatcgaggatttaccgccattggaactggaggtgaggattttgtgcaagccatggttgttgctgtcgaatctgtaatccaacaaccaattcctcaggataagtttttctatatcagcatcgcaggataa

SEQ ID NO: 28775 - DNA, 174 bp, Glycine max
  Peptide Sequence Number=SeqID_145553
atgcacacacagacatacaaagtcacgagtgatgtgagcatttttggaaccgcagaggctgctagattcgctgcaaacaatggaccggagaaaggaagttgcaaaagcagaaagctgaaacagacacagttagcgttagttgaagcttattacagagttgatttgaggttgtga

SEQ ID NO: 28776 - DNA, 462 bp, Glycine max
  Peptide Sequence Number=SeqID_145554
atgggcatttcactaaattcacaagccacaacagagagtgtatacaatgctgccttggccctaggaattgcaaatcagctaaccaatatacttagagatgttgaagaggaagtattagaccattacaagtcaatatctaactcgattcctgaagattatgatatgcatatcacctcattgagacatatgatgtccagactgtatcgtctcaccaaaaagaaaaagcttgatgctaacggaggaagagtgtatcttccacaagatgagttggctcaagcagggctttcagatgaagacatatttgctggtaaggtgacagacaagtggaggaacttcatgaagaaccaaatcaaaagggcaaaaatgttttttgatgaggcaaaaaagggggtgactgagcttaatgaagctagcagatggccaccttttcaggatcagtggggttggcttcgggaagcttaa

SEQ ID NO: 28777 - DNA, 936 bp, Glycine max
  Peptide Sequence Number=SeqID_145555
atgtccccggcttatctaattcttctgctatcagaaggttacgagtatgatattaatgatctgcatcaagaggctcaagccagatggttgaagcctgcagaagtgatgtacattttacagaatcatgaaaagttccagttcacccaagaggtcccacaacagccaaccagtggatccctgtttctgtttaacaaaagaatcctgcgatacttccgtagagatggtcataactggcataagaaaagtggtggaagaactgtgggagaagcacacgaaaggctgaaggttctaaatgttgaagccttaaattgttactatgcacgcggagagcagaaccctgctttccagaggcggagctattggatgttggatccggcatatgagcatattgttcttgtgcattataggaacacaagtgagggaaagctaagttctggagctggggcacaattgtcaccaagttcttctgtctatactcagagtcctagcccatattctactcagaatccagggtcaacatccatacttggtgattcatatgaacctaatcagagtttctccagtcctgggtctacaaaagttacatctgagatattcgttctgaacaataaaatgggtcacatggattgggcagatacagaatcaggaacctcatctgaactcgaggttactcaagctttgcgccgattggaggtacagttaagtttgaatgaggacaactttgaagatattgtttccttcggcagtaagcatgaaactgttcatgattcaaatcccaagcacgatcaaagggtgatcagcaatcaagagcaatctgcagctttctctagacccgatgatcaagggctattttatgatggatgtaatggaaggcaagatatctctgtcttctacttgtttaactgtgcttgcagcatcttacacctgcacagctag

SEQ ID NO: 28778 - DNA, 320 bp, Glycine max
  Peptide Sequence Number=SeqID_145556
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctggggtttgttggtgatttggaggggacgggacgaatcaaagcgacaagggctgatctcagtggatcgtgcagcaagccactctgccacttacaataccccgtcgc

SEQ ID NO: 28779 - DNA, 177 bp, Glycine max
  Peptide Sequence Number=SeqID_145557
atgttcaaccctcctggtatctgtgaatcacttaaaattagtgagaaaaattgtttccgtgaagaaaatctaagtcgaggcacttccgtaacgcttccgagacgtttccgtgggcgatttcgtgaagattttccaccgttcttcatcgttcttcgttcgttcttcagtcttcaaccg

SEQ ID NO: 28780 - DNA, 222 bp, Glycine max
  Peptide Sequence Number=SeqID_145558
atggacttaaagcctgagatgaagcatatgagttttggaattcattatgatgaagggaaagaggcattcaaacttcacaatgaatgtaggctttgtcccagtaatgtaatgcaaaaggacaaaacttctgataaacacactcctggttgttttcttccttcagaaatggaagaaattgcgcagtttctcaaaagatcattttcaaggatgagaaatgtttaa

SEQ ID NO: 28781 - DNA, 784 bp, Glycine max
  Peptide Sequence Number=SeqID_145559
tggccctgatcatcacgctgctgttttctgtcgcgatggtggtcggtatttccgcttagcgctgacaccgttgaataaccggggggcacgtgagcaagcggttgacagaccttcttattctacttttctgcctgataaatctggcattcatgctccagctgggatggcgaatgatgacatcggaaaaattcatgacgcgcactggtttggccgctatcaagcggcgaaaaacggcgaaaaggcgcacgggtataaagtcggcgaatgggcgatcggtgccgagctgctggctaacgcgccggaagccgcagcgctcggcaagatagccggcctgctgttcagcgacaacgccaaaaaaagcctggtcatcgtcgagcatggcggcaagcaaaccggttatggcgttggcgaccgtctggccggcagcaatgccgttatcgtgcggatagtgaaaaataaaatactgctcgatgaaaacggctattacgccacgctgacgtttaaagacgccggcttatggcgcgcattagcggcggcggccgtcatgatcgcgctgggcggcgcggcgcgcgcggagcaattctctgccaatttcaaaggcacggacattcaggaatttatcaatacgctcgacgagaaacagtattaccagttctttctcaacgtgctggacgtctatggctatacggtcatcggcatgcccaacaacgtcctgaaggcgatcgccgaatgggatgaggtggtgatgcgcgtggtgccgctgcgcaatatcgcggccaaggac

SEQ ID NO: 28782 - DNA, 754 bp, Glycine max
  Peptide Sequence Number=SeqID_145560
caccggcggccaggtgcgcagcctgagcgcgatcgaagccaagaccgttgcgctgtgggtggcggacaaccagttgacgctgctgcagctcgacccgcatccgccgacgctggcctggcattcgggcactgcggcgatggccggatcgcaacgcgcttgtggagatgctggcctacagggcactgccatgaaacgcggttcgcaatgcggttttacgctggtggaaatgctgctggccatcgccctgttcgccatgctgtcgctcaccgcgctggcgcgcttgccggcggtgccggagttcgcggtgcggcagacggtgggcgaggacgcggatatacagctgctgctgatccgaaacggctggccgaatccacacgctcggctgccgcgcgccacgctggagcgggtggtgtatcgctaccggcaggggcggctcgagcgtctcagctatccgagtttggacagcccgcaggcggcggcgcgcagcgtgctgctgctgccggaggtgacgcggttccgcctgcgtttttacctgcagggcgaatggttgacggcctggcgcgccggcgggctgctgccgcagggggtggagatcgtcgtcgaaacccccgcgctgggggaggtgcgccgcatcgtcacggtgcccaccgcgaggccatcatgaaaaaacaacgcggtatggcgctgttgatggtgctgctgctgatgtcgctgatggcgatcgtggcgatcaatatcaacgacaactggcagc

SEQ ID NO: 28783 - DNA, 351 bp, Glycine max
  Peptide Sequence Number=SeqID_145561
atgaagagctctgatgcaaactcaacttggattgctaagaagcttacaagtttgttggttgctgatccacatattaactaccccacaatgaggcaagtcttacttgaaaaatatggaattgtgccttcaaatgatatgcaattgtcttgggttaagagaaagggctttgtaagagtgtgtaggccatggtttggtattgatgcatgcaataagggatgttccctattgcggttacagtggttgagatcaagaataaagactcttgaagggactttcatgaaacagtggtcgatgtttttcccaatacgagacatagtagggaatgagaaagtagaaggtgtagaactatag

SEQ ID NO: 28784 - DNA, 279 bp, Glycine max
  Peptide Sequence Number=SeqID_145562
atggttcctataattgaagatgatgtgtgtagcaatggaaattgcccaatgcgggttgatgaagtgtatgtaaatgataaagatgtaacttatgaggggttgagtgaaggatattcatgtgacaatgagtatagtccctttggtaagcatgtagaatcgatagatggggatgccctaaatgactctgatgaattagtggatgtcattggagctgaagttgtgcattcaaattcagacatggaagaaatttatgaggagaacgaatttcatggaaaatag

SEQ ID NO: 28785 - DNA, 207 bp, Glycine max
  Peptide Sequence Number=SeqID_145563
atgtcaggatttacacgcgattctcctcaaatttcagccagcccgtatcaattagacttcacactttatgcttcggggtcatacaatgctcaatggaatgcccaggggctcctccatgataagcacacgttgcgttcaagtcgtatccttagaaaaatggaggtggtcttcgtcattggaagtgcggtagacaggctttgtggttga

SEQ ID NO: 28786 - DNA, 297 bp, Glycine max
  Peptide Sequence Number=SeqID_145564
atgggggcaattttgaaagttgttgttaggatgtctctaatgactcatcaggattttcaagtgcaagccattggtcagtttgctcaagcgacctgtgctcctgagttttggacttccaagaccgtttcaatcagagattactcgtcttgcacgttggtgggggttgccgtaaaacaacgagcaaataaaaatatagacgttcatgtgacttcattttatcattccggaaagtttgtcttcttagagaagcgagttgtcaagaataggatgttggacaaatggcctcagttatcttaa

SEQ ID NO: 28787 - DNA, 306 bp, Glycine max
  Peptide Sequence Number=SeqID_145565
atggttgaaaaggtgaggaatttcatcacgaatcatagggagacccaaaaaaatagcaacatcttgcagcttaatggtcatgaagctgaaagggaacacaaaagtgttcatggtagtggaccaaaagctcaagaagctaaagatcaatggataatgtttgaggaaggtagtggagctgattacatcatcaatgcaaggatgacggtagaaatgtccttcatgggccttgagaaggttgataaaaccaccaagggttatgggtcgttcttgatcatcttgattgttcaaaaagctagaaaaggatga

SEQ ID NO: 28788 - DNA, 321 bp, Glycine max
  Peptide Sequence Number=SeqID_145566
atgaataagcaagtaccaaagaattgttctagacatgggagtgataaatatgtaaagtttgatgttcatattgatgatgatgaagataatttgagtgaaccagaacagacagagtttgtgggaacttttgttaatttgttccatggacaaggccataatatcaaagtaactagttttaaggtagggatatcaaaagtggtcgattgtttagaagctgaagaagacgatgttgtgctagttactttggtgcctaaggttggaaaaggagatgtcatcataggaggcatcaaagttgagtttattccaaagtacaaggattag

SEQ ID NO: 28789 - DNA, 144 bp, Glycine max
  Peptide Sequence Number=SeqID_145567
atgtgggcaccacgctacagaaaaattagaaatcttaagtggaccaagctgaagcctagtcagcaacaatgctgctggggtggggtggcttcatccaaaggtcacaatttcacttgggaaaatactaggaagagtagcacttaa

SEQ ID NO: 28790 - DNA, 1041 bp, Glycine max
  Peptide Sequence Number=SeqID_145568
atggccgaatcgcttcttttcacagttgcagaatcactgatagggaagctcacttctcgtgccattgaagaagcttctttgacgctgggtgtgtaccgtgatctacaagacatgaaagataaaatggcccttatcaaagctttcatgttagatgctgagcacaagaagccacacaacaatgtgctgagcgaatggctgagacagatcaagcacgtgttttctgatgctgaagacatagtcgacgattttgagtgtacagcattgcggaagcgtgttgtcaacatggtagctgctcaagtaagaatggcgcgtgagataaaagatatcaaccagaggttggccaaagttgcggctcaaagagacatgtttggccttcaaatcaatgagaaggatacgcatgttgtggacatgagagaaatgactcattcccatgtaaatcatttgaatgtaatagcgagagaagatgacaaaaataaaataataaagcttttgctgcaagatggtcatgacaaaagtctctctgttattcccattgtgggaatgggaggcttgggaaagaccacacttgcaaagttggtgttcaatgagatcaccaatattgatgaatgtttccctttgaagatgtgggtgtgtgtctctaataattttgaacttaggattgtgcttattaaaatccgcaattctgctccaaaccccactagtgaaaagttagaaaactttgaaacggagcaacttcaaaatcatttgagacatacacttcaagatcagaagttcttgctcatcttggatgacgtgtgggaagatgataatgctagatgggatgagttgaaggaaataataatagatactggtgttgaagggagtaaaatactagtgactactcgtagtccgttaatagctaccttgatgtgctctaattcttcaaactcttaccttttagaaggcctctctaaagatgattccttctatctgtttctcaaattggcttttaaagaaggagaagataaaaagcattcacaactattggaaatcggaagataa

SEQ ID NO: 28791 - DNA, 189 bp, Glycine max
  Peptide Sequence Number=SeqID_145569
atggttacggatttgatttggtgtgcgaatgagactttctgcaaattagagttttggaacttgttgagtggtgtcttggttgagtggcattgcattgtgtcattgggatcagcatttcagtttgggtcttcctccactatgacagctttaagctggaagtcagatttggccaccccgacttccatttaa

SEQ ID NO: 28792 - DNA, 546 bp, Glycine max
  Peptide Sequence Number=SeqID_145570
atgggtgccaagcacctcaaaatgaccaaatacaagttgcatgccaccaagccaaggtccccggacgaaattaggggtgcagaagacgatgtcagtctctgcaggctatcaggctttcgtcttacagatagaaaaaagaatgtttatacggataaccactcgggtatctccgcccgtcagcgtgactcaaaagtcagtatgacaaatcttgtgagcgcggaagatgacatagcaaaaaagaatgtttatacagataagcactcgggtatttccatccgtcagcgtgactcaaaagtcagtatgacagatcttgtaagcgcggaagatgacgcttttcgtattacagatagcaaaaaggtttatacggataaccactcgggtatctccgcccgtcagcgtgactcaaaagtcagtatgacaaatcttgtgagtgcggaagatgacatagcaaaaaagaatgtttatacagataagcactcgggtatttccgcccgtcagcgtgactcaaaagtcagtatgacagatcttgtaagcgcggaagatgac

SEQ ID NO: 28793 - DNA, 336 bp, Glycine max
  Peptide Sequence Number=SeqID_145571
atgccgatctccccctgcgaaagtatcggttggtctgtgccgtcacgacataggggtcacgtccacaagacacccagtggacccggaaaagcctatgtcagtcctatagggtgcccatcccccccagcaaggtcacgccgtcgtgagataggtaaggatcacgcccgcaagacactcagtggacctggagaagtccaaaagggtcctgggttctacgaagcgcccgtcgcccccaacaaggtcattaggccccccattaaccgggctttccttgagaagcactgtgcccccaggcaggcacagggcgaaacaccacagcagcctagggatggctga

SEQ ID NO: 28794 - DNA, 183 bp, Glycine max
  Peptide Sequence Number=SeqID_145572
atgaagcgagaccaagccgctaagcgagacaacagtggcttagcgactaaggataagcctgaagaaagttcttcttcgctagcacgcgctcagcgcatatgcaactcgctaagagagacagttttctcttctgcgctaagcgcgagattggcgctaagccaaatctcacttgctcgcgcttag

SEQ ID NO: 28795 - DNA, 315 bp, Glycine max
  Peptide Sequence Number=SeqID_145573
atggagaacataagaaacttacttttcaccgttgagttgaacttaaagctttctttcacagatcgtagctcaggaatgaaggggtttagaggtgctttaaccacattgaaggagggagtcaagaattcctatgatactaacacacaaccatgcgagatacagagaagacaaagtcgcgagaaatacggttgcagcaaaatacttgggtacgatggcgaggtgtcacggtggcagcagagggagatatcagagtcgcgaatacgaagcttagacggagaagaagagagtgtgaggaaaatagggttcacgttctaa

SEQ ID NO: 28796 - DNA, 2155 bp, Glycine max
  Peptide Sequence Number=SeqID_145574
cgcatctcaacccaaaagcctcatgatgaacaacttgaccattgagactgaggattcttttgcaagcttgcttgagcttgcagctaataacgatgttgaaggtttcaagcgaatgattgagagggatccttcctgtgtagatgaggtaggactatggtacagtcgtcaaaagggatctaggcggatggtcaatgagctcagaaccccattgatggttgctgctacttatggtagcattgatattctggatctgattctctcactttctggctgtgatattaataaaccttgtggccttgacaagagcactgcccttcattgtgctgcttcgggtgggtctgaaaatgttgttgatgttgttatattgcttctagcagcgggggctgatccaaattctgtggatggcaatggtcatcgtccagttgatgtcattgttgttcctcccaagcatgagtctgttagaaacaatcttgaagcacttcttcaaactgatgactccattgcagtgtgtaatctcagggtgatcacggctccatcaaatgcatattctccacctttgtcaacatcatcagagaatgggtctccttctgcaccagatttccaattgaagtcaaagttaaatgatggcttcatttcttctgcatcagacaagaaagaatatcctgttgatccatcccttcctgacatcaagaatagcatatattcaactgatgaattccggatgtattctttcaaagtccgaccttgttcacgtgcttattcacatgattggactgaatgcccttttgttcatccaggggagaatgctcgaagaagggacccaagaaagtaccactacagctgtgtgccttgtcctgattttcggaagggtgcttgccgacgtggagatatgtgtgaatatgctcatggagtttttgagtgctggctgcatccagcacaatatcgaactcgtctttgtaaggatgggacaagttgctccagaagagtttgcttttttgctcacattgccgaggagcttcggccattatatgtttcaactggttctgctgtaccatctcctcgctcaagcacatctgctatggattttgctgcagccatgaacatgttgcctggctctccttcctcaatgtctgtcatgtctccttcacggttcactccgcctatgtcgccctctgccaatggcatgtcacacccttctgttgcctggccccaaccaaatgtcccagccttgcatctaccagggagtaatatttattccagtcgtttgagatcttcattcaatgctagagatattcctgtggacgactttgacttgttgcctgactatgatgttcagcaacagctccttaatgagttctcttgcctctctaaacagcctatgaattctaatgctatgaaccgctctggtcgcattaaaaccctgaccccttcaaatcttgatgatctattttcttctgagagttcatctcctcggtttgctgatcctgcattggcttcagctgttttttctccaacacataaatcagctttccttaatcaatttcagcagcagcaaagcttgctgtcacctgtgaacacaaacttttcttctaaaaatgttgagaatccactattgcatggtgcctcttttgggggtcaatcatcaggaaggatgtctcctcgaaatgtggaacctatttctccaatgagctctcggatttctgtgctagttcagcatgagaagcagcaacaattccgaagccttagctccagggaacttggctccaactctgccactgttgctgctgccgctgccgccgctggttcccctgccaattcttggtcaaaatggggatcctccaatggtacgctggattgggctgtcaatgcagatgaattagggaagctgcgtagatcatcttcatttgagcacgggaataacagtgaggagcctgatttctcatgggtccagtcacttgttaaagaatctccatctgagattaaggagaatccgacgatgatgacgacgacgacaactatctcaagcgttgcagcagctggatcctccagtgaggtttcaaatatgagcacacaaatggatgctgttgatcatgcggtgttaggagcttggcttgaacaaatgcagcttgatcaacttgtggctcagcaaaattaa

SEQ ID NO: 28797 - DNA, 213 bp, Glycine max
  Peptide Sequence Number=SeqID_145575
atgaatcatgttgttgatgttaactctaatgaaaatgatagtgaaaatgacaaggatattggtgttgtaaacattaaggacaaggaagatgcagtgaatgatgaatataaaagaatagctgatttgatgaatggcagcagaatggagaaggaagagagagaggagacgccacttcaaggagaagatgagtctagaagaagctcaccaccatag

SEQ ID NO: 28798 - DNA, 306 bp, Glycine max
  Peptide Sequence Number=SeqID_145576
atggaaaatctgaaagctaatgatattattgatcatatgtctcactcgtggaacttggaattcattgagtcaatcttcaatgaatatgacattatatccatcaaatccactcctttactgtccttgcaggaagatgataatatggtttggaaatacacatcccatggtgcatatagtgtcaggtctgcgtatcattgtatcatggacaacactctaaaagttgatcacctcaaggctgttggagattggaaggctacggaggtttggatgacgccacttccagtgaaggaagataagtcagggtag

SEQ ID NO: 28799 - DNA, 243 bp, Glycine max
  Peptide Sequence Number=SeqID_145577
atgtatattgttgtggtaaaacaggggcaggatcaccttgggctaccttctgaggtagagacaaaacgtgagcggcagaaaccaatcaaggtagggtacttaaggacggatgcaagtggggatggggtcacgaccgaccgatcgttgccccttctctgtgcggaacaagcagagaatgtcgctgcaaggcagccccgtatcctttgtattttgcagctttcttttactatttgtttgttttaa

SEQ ID NO: 28800 - DNA, 342 bp, Glycine max
  Peptide Sequence Number=SeqID_145578
atggtgagcgcgatggtagaggatgcgaacttcgaagatgaccagctcgcgaatatgaccatcgacgacattgtcagagcttctcgtcttctcaacaacgagattcgcatccttaaggaagagttgcagaggaccaatttgacattggaatcatacaaggacaagatcaaggagaatcaggagaagattaagctcaataagcagttgccctacctcgttggtgacatcgttgagatattggaaatgaacctgaaagacgaagttgaagaaaatggtgccaatattgatcttggctcacaaaggaagggaaagtgtgttgtactaaagacttcttttttataa

SEQ ID NO: 28801 - DNA, 757 bp, Glycine max
  Peptide Sequence Number=SeqID_145579
atggacaacactgagaaagagacccacgacttcatgaacgtcgattctttctcccagctccccttcctccgccccgcaccaccctccaaagacaaagccgccattcgcctcttcggccatgaattcggcgacgcgcaccactctaaccctacccacaactcatttattatctccaacaacaacgttagcgcctccgaacataccaccaacaaagacgtcaacaacaacgtagaaaacggcgagagcagccgcagattcgagtgccattattgttgcagaaacttccccacttcccaggccttaggcgggcaccaaaacgcgcacaaacgagagcgccagcacgcgaaacgacaccttcaaagtaccctgatctccgatgcaaacgcgtatagcttcatgaactacaggttcggttccacggcaatgtctaattactcttactcttcttatccaacgtggaacagttccaactcgtcaagcgctatgcttgggaacactggtggaactggaaggttctacggaaactcctattctcagcaacttcaaactatcaatggaagccctttgggtttgtggcgaatccccaccgccactaatagtactcattcccaaagtaaccctattttcaaccgcgaacgctcgttgcaacctttgcctttgttttctggcgaggaaatggtgaacgcgaggatcgggcactctggttcgcagaaccggtttggtaaattatggttccaagcccagcgtaaacgaccat

SEQ ID NO: 28802 - DNA, 1911 bp, Glycine max
  Peptide Sequence Number=SeqID_145580
atgactggaaaagcatcagcttcaaaacctaatataggtctgagtggatctgatggtctttcacatgcttacattcagtatccgccacttcggttcaatgttcctggatcaagtggattattttatgatgatggaaataagtttctactctctccaacagctgaccaggttttttcttggaaagttggtccctttgatcctctcagtgatccaaacactgattcaataagtgaaggccccattatagctattcggtattctttagacacaaaggtaatagcaatccaacgatcaaaccatgagatacagttttgggatagagagactggggggacttttagccataaatgcaagccagaatcagaaagtatacttggattcttttggacagatagtcaacagtgtgatattgttcttgttaagaccagatcacaggtccaaatcctagatattgcctctaaggttttggggataaggctgcatacagcctcatgctatgggttaccccttgatagtgattggagaattggtagctgccagcgttcatggggacagacccaattggttggattgctagggctgaaaaattctgaggtacaagaaattccttcgttcaataagctgcaatatgcattcatgagcatgaaggctttgatcaaaagattcagagatcactatggtagccatgtctttgaaagattgaatatcttgaagcaagaaaagcaaattgagacagaaacccacatcaaaaaatgggagacttccacaaagttcttgaaagagaggaccaacatttcagagttgaaacacatgttgcgcaagatattgaatgaagaagttgattcccatgcctctcaacaagacaaaaataacatggagggaagtgggtcagaattcagtgaagcaaaggctagttcttgggcaagaaaggtggaactacccagctttgatagaagcatagaagggggacctgatttgaagggtagcagttttgagtgtgacagtgacccattgcagttcttgaaattagaaaacagaagtaaagaaggttcagaagaagttgatccatcaataaagagggagaagcacaaggaaaatggagtgacgaatgtgggctgcgaagacgattttcttgataacccaattacagatttgatcaagaaggaagtcgaatatggtgattcaaccaagccacattgttttcaagattcagatttccataaaaagattgttatggtgaaacaaaaatcattcatgaaggtggttggaacaacaatggtgctggaatcttggaatgtcaacttgttgggtgagcctttagcattaaattttgttgcatctatggctgacagcttagccatggagctaaggcagaaggaatgtattgagccagtcaagctacaagggggctctttaccaatttattccagtaggattgccgtgagtgtggtcgacaatgtacttcttattcatcaagttgatgcaaaggttgttatactttatgatctgtttgcagattcccgagcaccgatatctgcaccacttcctttattattaaggggtttccccagatccagcactttatctcaatctagtggcagagaaagtgagagttcagacggtaatgttttgagtaatcatgaagcagttacatatgccaatacatggactttcctagtgcctgacctcgtatgcgacgtggccaataaattattgtggaagttcaatttagacttagaggcaatttctgctagtagctctgaggtcccatcaatattagagttcctgcagcggcggaagttggaagctaacaagtccacaagtcagctttgctgtaattgtaactggaattatgccgaggaatgtgtattgaaaactttatttataggagctgctactacagtcccagtg

SEQ ID NO: 28803 - DNA, 582 bp, Glycine max
  Peptide Sequence Number=SeqID_145581
atgcgtattaccgagcggatcgcagtccgtttgcagcaactgcggtctttttttagcaataaggagaaaattatgagcgatcaaactgtcatcaacccaaccagcactgcggcgcaacaggaattgtcaccgctggagagttttgccaacgaaacggccagcgcgccggctgccgctgacagcgcagctgacagcgttgcccagccagcgatgccgccggcagtcgcaacgccagctgcgcaaccggcagcgcccgccagcgctgagcaaccgtttcatgcggatgctccggtcgatctcgatcagcagctggcaacgcaggatacgcaggcgaacggctcggccagcgcaggcgcctcagcggccgccacgcctggcgtgcgcaacgcgcaggccgccgcaccggcggttgcccccgacgcgccggtggctgcgaccgccgccagcgatgcggtggcgcaggatatcagcgccggggtgaaggactttgtccaggccttcagctttgttgaacagggcgtgctgaagctgggcagtgccgcaaaggatgaactgattgcgctggcgaagaagtatctgtaa

SEQ ID NO: 28804 - DNA, 543 bp, Glycine max
  Peptide Sequence Number=SeqID_145582
atggcatcgaagcacggtgtgaaatcgagaaggttcggattgagtggctcaaaagctgcgaattcgccttcatcttccaccgcgtcgtcttctaagcagtttcaggagtcatcggctgatggtctgagctcgtcggcgaggagtaagccgcagcattttgctccagaaactgttgcggctgcgccacctttggatggacagagagtgaaggaaaatgtcacggtgacggtccgatttcggcctctgaattgttgtgactgtgttcttcggatgcctgttaatttgattgaggtctgtgcgtgggacagtccaagggaaattcgacaaggagaggagattgcttggtatgcagatggagaaactatagtgcgaaatgagtataatccgtccatagcatatgcatacggtataatatgcaaaactgacatttatggatatgggttttgttctttacatatttgttcatttgggatggagggtgaagcatatattatgagtatggtgcttttcaggttgaatgaactagaacaacattccatataa

SEQ ID NO: 28805 - DNA, 609 bp, Glycine max
  Peptide Sequence Number=SeqID_145583
ggcacctatgttgagggaataaaggaagaggttgtactctcccctgctcatgcactgtcccttattgcagctggagaagagcacagacatgttgggtctacaaacttcaacctactcagcagcaggagccatacaatatttacgctgactatagagagtagtccatgtggtgaaaatagtgaaggagaagcagtaacactgtcacaactgaatctcatcgatctagcaggttctgagagctcaaaagctgaaacaactggtatgagaaggagagaaggatcttatatcaataaaagtcttctaactcttggaactttcttcttcatgagatgttcagcaaccagttgtgtttccactgttattgatagaatgatggttatttcaaaattgactgaagataaagctagtcacataccttacagggattccaaattgactagagttcttcagtcttcgctcagtggtcatggacgtgtttctcttatttgcacagtaaccccttcatctagtagtactgaagagacacataatacattgaagtttgctcaccgggcaaagtacattgaaatacgagcagcacaaaacaagaattatattcctaccaaatga

SEQ ID NO: 28806 - DNA, 516 bp, Glycine max
  Peptide Sequence Number=SeqID_145584
atgactactctgactcagatatggatgacgctgctactcagcaacatcctgcccaacgaccataattttgacctccctgtgcctaagtgccagatggtgtacaccatcttgacacggatgactgttcacgtggcccagataattgctgacgccatttatttgtttgcagggacggtgcccactaggcaccctttggacccggagaggtccaacagggccttgggattttcggccttgatcacgggcctctgccagttctacggtgtacttgtcatccccagcaaggtaatccggacgtcgatcactcaagctttcatcgagaaatattgcacccctaggcaagtgaagggtgacgcacaacaggctgcggatgcaccaccacctcagcagcccgatccggttataccactaagtgtggagcggtatctatggcatttggttcgccagcaaacggccaaccaccacgggcaggtgcaattgcatgagtacttctaccgtttcagcctcagccagtag

SEQ ID NO: 28807 - DNA, 1710 bp, Glycine max
  Peptide Sequence Number=SeqID_145585
atggttctcaattttaattatttaaagttagaagatggtcaagttaagttgcaatcccgattggaacaagaagaagaagctaaagctgctttattaggcagaattcaacggttgactaagttgattttggtctccacaacagcatcatcgtccacaagatttcctaacagacctggtcctcgtagaagacattccttcggggaagaggagctggcataccttccatacaaaaggcgggatttaatcttagacgaggaaaatattgatttgtatgttaatctggagggaaatgctgcaacagctgatgattcttttaagggcgagaaaaagatgaagaaacatggattactaaattggttgaagttacgtaaacgagacagtgccttgactggcactagtgataaatccagtggagcaaaatctactagcacaccttccacacctcaagcagaaagtggtaatcatgtggagtccagactttctcattctcaacctgcagaaagctctccctctgctgatcttgcatcagaggcaagagaggataaatatattcatgaggacagtttattgggacaggagactcctttgacaagcatcaaatcggttgatcagattgatcttctgagggagcagcacaagattttatctggagaagtggcacttcattcaagtgctttgaagaggctatctgacgaagcaacaagaaatcctcagaatggtcatattgatgtggagatgaaaaagttgaaggatgaaattacagcaaagagtgaacaaatagatttgctggaaaagcaaatttctaattctttcattgcttcagataagacagaacactcaggagcattgcagactgttgctgagctgatggcacaattaaacgagaaatcctttgaacttgaggtcaaagcagcagataaccgtgtaattcaagaacagcttaatcagaagatttgtgaatgtgaaagccagcaagaaacgattgcctctcttaaacagcaacttgctgatgcattggacttgagaaatttcagccatgtagtcaatcattcacaaaatttctctggaaccaaagattattgtggtgaacttcatcttgacaaggggaatgtgacaataaacaattcaaatgaagggattcaattgcaagcacagataagtgagatagaagatctgaagcagagagtggcagaactaacagaatcaaaggagcagttagaatttagaaatcagaaattggcagaagagagttcctatgctaaagggcttgcttcagctgctgctgttgagcttaaggcactgtcagaagaagttgccaaattcatgaaccagaacgagagactagctgctgagctagctgcatccaagaattcacccgctgaacgtagaactagtggcacagtccaaaatggacgaagggaaagtcatgctagagttagacgaaatgatcagggtgcatcaaacgccaatatcaagagagaattagccttgagcaaagaaagggaactttcatatgaagcttcccttttagagaaagatgagaaagaggccgaacttcaaagaaagattgaggagtcaaagaaaagagaagcatacctggaaaatgaacttgccaacatgtgggtccttgtggcaaagctaaaaaagtcacaaggagctgaaactgatgtttcggtgtcaaccatagagaatttgcagttggatggttga

SEQ ID NO: 28808 - DNA, 537 bp, Glycine max
  Peptide Sequence Number=SeqID_145586
atgaagttaggtggcaggcaaagatacccaagtggttatccgtataaacactctttcactatccgtaagacacaaagcacgatagcatgcagagacaatcgtcgtcttctgcaccctttgtcaatcgcgaccaacgagcccgttgacacatgcagatttacgtcatcctctgcgcttcctgtcatcctaacccgtgaaggcaggtttactctagtcatccggagacgttcaagcccgacgacgcacgagattcttctctgctgggtgcgggcgatcaagttcaatggagtgggtgtcgcaacctacccttcggcgggagggcgacgcgtgactcgcgggatgcgtgttccacgaaaggaatacgcgcggagtcgccaccaacgtttatttgaggaaaacgtcggaaaaaccgggaaagacgcgatctacgaacttttaagtgaaaggttcgggagttgtatttacgcacggggaagggtgtttccctttgctcctacgtattcctcaatttgcgatgaggaaatcagacctacgtag

SEQ ID NO: 28809 - DNA, 342 bp, Glycine max
  Peptide Sequence Number=SeqID_145587
atgaattcatttcctagcgctgttcatgtgtcctccaccatcgagtctggagccccgcgaattcattgcctagcgctgttcgccaattctccattctccaatcttattcggagacccatgaattcattgcctagcgctgttcatgtgtcctccaccatcgagtctggagccccgcgaattcattgcctagcggtgttcgccaattctccattctctacttttattcggagacccatgaattcattgcctagtcttgttcatgtgtccttcgttatcaagcgtggaacctccgaaaaaaaaaagagagaagaaggagtagagacgagagtcgtcatagactaa

SEQ ID NO: 28810 - DNA, 660 bp, Glycine max
  Peptide Sequence Number=SeqID_145588
atgggtttcccggaggtgacgacgccgctcggtatcaccagcaccgtgctgtcgcgcattgaggaaattactttaggcattgtgtgtagcagcctggtgcacgcgctgttgtttccggtctcgatgcgcagtctgctggagcagagcgtcagccagtggtatctcaacgggcgcaagctgtgccgcgatttactctctggcatttccgctgaccgatcgccagaacgcgacgaaatcctgacccgcatggccactaatccgcagcaggtcgagatcctgattacccattgcgtgtacgagggcgacgcggcccggcggctgattcgcctggtcagcacgcagtatcagcatctttcatacttaatccccacgctgacggcgattgagatgcggctggagcggttggcagcgcgccagattgcctttcctgcctgggttgagcagaccctgcagcagttcctgctgtggctgaatgacggcgaagcggtgggcgatgtcattggcattcagctggaactgagcctttgtcaggatcggctgaatgcggcgtggcgcaacggcgaattgtctaccgaacactgtctgctgtttaccggcctgctggagcggctggtggattttgtgcgtatcgccggggcttaccagagcgtgggcgggctg

SEQ ID NO: 28811 - DNA, 336 bp, Glycine max
  Peptide Sequence Number=SeqID_145589
gattgtatggtcctggaatatgggtgtccgatccttatggactaactggaaggatacaatccgtaaatcccgcgtggggcgtggaaggttttgatccttttgttccggggggggtagcttctcatcatattgcagcaggaacgttgggcatattagcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagttcaatggacaatggagatggaatagccgtcg

SEQ ID NO: 28812 - DNA, 276 bp, Glycine max
  Peptide Sequence Number=SeqID_145590
atggaggctagtctgtgcattccgggcaagggctttattctaaacacagagggccaaccatggaggctcctcagaaaagatcttaccaccctggctcagacatggagcgtcttctcgtactcaaacctagctcctacctcccgcacttcagattttaacacagacagagctaggttggtctatggcttaatcacaaagatggacatgaacattggcgatcgaggggaatgggatctgatgcccttacctcccatgaaacctaaggccgaccattga

SEQ ID NO: 28813 - DNA, 632 bp, Glycine max
  Peptide Sequence Number=SeqID_145591
atggggacaaatcaaaacggcaaaaggttttatcaagtcaaggttaaaggtctagatgtcactagcctcaaggaattgggacgattgatgggacccctccaaaggcaagccttccgcaaagtttacgggaagattctagatttgaccgtagcggaagtatttacggaagctgtcgtatccctcgcccaatactatgaccagccgttgaggtgtttcacgtttggggacttccaaatggtcccaactattgaagagtttgaagagatattaggatgccctcttggggggagaaaaccgtatcttttctccagctttcttccttccttaagcaaggttgcgactgtaattggagattcagcaaaagagttggatcgcatgaagcaaattcggaacagcgtagtgggcctgcctcggaaatacttggaaggcaaggcaagggatatggcgagccaagagaagtggggcccgtttgcggatgttttagctttgctgatatttggggttgtcctctttccgaacgttgacggcttggtagacttagctgccattgatgctttcctcgcatatcaccatagcaaggaaagtccagtggtagctatcttggcggatttgttcgacacctttgaccggag

SEQ ID NO: 28814 - DNA, 637 bp, Glycine max
  Peptide Sequence Number=SeqID_145592
atgggatcaaatcacacaccctcttttaagaaaagtttctatcaggtcaaaatcaaaagcctagaagtagccagtttgcaagagttagggcagcggatgggccaactccaacgtcaagctttccgcaagacatatggaaagatctgggatttggcgatgatagaagtatctgttgaagccatcgcatccctaactcagtactatgaccaaccgctaagggatctcgggatgcctgctaggaggaaggaagccatatctgttttttgggttgtacccctctgtggtaagagtagcgaaggtgaatgggcctcattcattgatggtataacactcttagtgtttgggatcgtcctctttccgaatgtggatgggctagtggttctagcggcgatcgacgctttccttgcttatcaccatagcaaggaaagtccggtcgttgctgtgttggctgatgtctatgacacatttgatcggagatgcgagaagagcagcacaaggattgtctgttgcacacccgctctttatgtatggagggtctttcatatctttcatcatgaaaatagacccgtctatcccctacaaggtcaccgcatgtgtgccgagaaagggaaagcaaattgggagcatctcttggctg

SEQ ID NO: 28815 - DNA, 321 bp, Glycine max
  Peptide Sequence Number=SeqID_145593
atggggattgcttgccccaagaatcatctgaaaatgtattgtccaaaaatgggggcgcacgcgaaagatgaaaatttgttgatgcatttctttcaagagagccttactggggcagccgtcacatggtacactaatattaaaccctcccgagtcgattcttggaaggacctaatggttgccttcgttaggcagtatcagtacaactctgatatggctctggataggatgcaactacagaacatgtgcaaaaagagcatgaatccttcaaggtatacacccaaaggtggagggatctggcagctcaagtggcacctccaatga

SEQ ID NO: 28816 - DNA, 342 bp, Glycine max
  Peptide Sequence Number=SeqID_145594
atgagcttagcccagataggcttggattcagcctcgcctagccataggtatctcaacaggaggatgagtgttcatcctcataagatgaactcgcttagcgtgcactactgtcgcaacgtgcccttttgcgggcgagcgaaggcgaggctcacgggtgcgctttccaaaggagaaaagatgcgcggagtcgccaccaacgaaggtattagcacctctcacgtcgacaaaagcgggactcttgctcctatgtaccctccatcaaagaggaaatcagacctacgtagttcttccttatgcgtgaatcaagcgattctttttactttgaaaggtgatcacttaaag

SEQ ID NO: 28817 - DNA, 450 bp, Glycine max
  Peptide Sequence Number=SeqID_145595
atgaagggtcaagacatttatagtagtcgagaggggactacttcttccccttcctctagtggaaatgaagatgaagtaaaggtgaagagtctagtgaggaagtctgcccctatgaagaaagtagctaaggatcaagtacaaataaaactcaaatgggatgagaaaaagaatagaaaaagaaaagaacaacaacctttaatggtcaaggagaagtgtaaggaggtaagtgtctcctcgaagaggttaactaagaaggaaagccattttgcaataaagaaaaacattaaagaaacttcccttcttagacaacactcacatcttctcctttgtaaaagaacccttgttagcattgtcatacctcttgagcttgaggttattcctcaagaaaatgagtcgttggatgacggtttggtgttgaggaaagaaccccaaagtttcaagaacctctag

SEQ ID NO: 28818 - DNA, 279 bp, Glycine max
  Peptide Sequence Number=SeqID_145596
atgcgtctaccggggaaggagagtctgctgatgaaatctcccataaccataaatgagattttggatgttagcatttcgtttctaaatgatcatttagaggaaacactgggttcgacaaaaatagaagaaatccactcaaagtgtatcaatctcgcacagggtaaggattatggtgagtcaggattttggctcaaggcttgtagaatggctagacatgatacatgtcagggtttggtttggttcaaggataaaaagggatgccccacattatttccatga

SEQ ID NO: 28819 - DNA, 534 bp, Glycine max
  Peptide Sequence Number=SeqID_145597
atggttggtttcacacctttttcgtcaagaggtgagacatgcttgcccgctagaaggccaccactcatgcacagagaaaaagaggcaagttgggaccgactcttagcaagcaaagaaggagcgtctgtcaattggttcccccgatggaaagaaggaagaactgggattcttatttcgtgtggaggatttccaaatgttcccttgatggggacaaggggttgcattaattacaatcccatcctcgccataagacaactgggctaccctatgagaggggcaccattagaggaagacctcacacctattattgcacgaggtttcaatagcaccaacgtggaggcacttcagaaggttcacaaggcatgggagatggtgcaaaagaaggacaagaaactcagaggcagtagcaacgggcccatcggcgactaccataggtggttaaaagcctacacgcaaggtttggattggctcccgaatttgagaaccactaagggggtggaagttgaagctccggaggagggcgaagaggtttag

SEQ ID NO: 28820 - DNA, 660 bp, Glycine max
  Peptide Sequence Number=SeqID_145598
atggctaagaggtttcaaatgaagaataataagaacaagaccaacctattttccaatcagagcatcgacagatatctgactacaaaccagactgtgtcggctgctaccaactctagtgttttagatggttggaagaagtgcaggatcaaccaaacttctgtgtcacaagattggaccctgactacctgcatgagtgacaacttagatgttgtgaacaagggggatcaacccgttggttcagccttttttggggatgtgaagtttccacatcaaaatttgattcaagaagagcttctacttgataaagatgcaaaagctttgagcaaattgtctgcggagattgaaaaaataaatactgagaaaaatgaggccattgccattgttgtggaaaatatgagagaagaaaaggaattattgaacaaaaagcttaaattggtggatgccaaattgaaaaaagttgaagaccaagtgaatagattttctttggcacttaaggatgcaaaagatgatgtggttgaaagctttaccaaggattttgatgctgtcaaggatcaagtgaaatttttccacaaagatattgacctgactggacttggatacttcaaaatgatccatggcaaccaaatcattgatcatatggtagtcgatgtagtgaattga

SEQ ID NO: 28821 - DNA, 1002 bp, Glycine max
  Peptide Sequence Number=SeqID_145599
atgtatgcaagctctatagcactttttggcggtgactggatcaaacatgaatcccttaagattaatgattgtattagagaccaactcaatagggccttaattacaaggatcgggatacaatcaggatccacaaccctccaacctcaagcacttgattcgctggtgttggtagtgaagttcgtgaccacacaccaagtttttggagacaagcctggagcccgttactccttggatcaacaagggggagaagctctcgtactaggagagaggtcgcaattgaggggagatattggagaaaagaactcatattccaaacactatccctatgtgaaggcggatgttcttgagaagcactcaagattcatcacccaagaggttgtcaatcaagttaaaagtagttttgtactaactaggagtggtgatgatcagtcgattgtgtgtatttcagctgagacaggcaaaccagtgtttagaactaacccctactttggagaagttctctatttctttgaagcaagggtgaataaaaggattagttggtggtctctgaataatgtcagtggtaatatggatccccataagatggaaaaaaggttccaactgaaaacaagaagaacaaaggtgatcttgctaatcaaggtgtcgatggatcttcgattcccaaccaaacagttttggctgctgctaactaaggctaaaatcaaggcaaaaaggaaaaagctaggtgatcgagaaaaagaattgcttgctgaaattgagaagatgaagactgggaaaaatgtggttatcactaatgttatggctaagatgaaagaggaaaaagaattggtcgatcaaaatgttgatgcgattaagatcaaactagaaatggctaacaagaaagtgaatgagttgactccagtgcttgaggatgccaaggatgatgtcgttgaaagcttcactaaaggttttgatgctgcaatagatcaagcaacttttccacaagggaatcgacttatctag

SEQ ID NO: 28822 - DNA, 668 bp, Glycine max
  Peptide Sequence Number=SeqID_145600
tgcttgaggatgaagggttgtgtacctattggattggatcataccatgatccttacaacttagcctctatgcaccaagtgcttgaggctggaaggttgtataccttcgaaattgaatcatatcccaatccttacaacatagcctctatgcaccaagtgcttgagatgactaacagtgatggaggatgtgatgcaaaagttaaaaacaataagggagcaacatgtgaactcaaggagaatcccacacgaggccttggcggcaaactaaaaactacagaattagaacgaggagatcagaaggagagcaagggaggtacaagtggtgtgaagacgattggaggtagaggttatggtcgaaccgccaagggatttccaacctctttcagaaatgatcatggtggagaaaattccgcaaagctatttgtttcccatgatcactcgctgcttgtacatggggttgcatgtaagacagttctaggaatcattggttcggcgaaatgttgcgaccatggcagaggtttgatcccatgtaacatgccacatagaggcggaggaggtgtcatggtgtctagttcagtgaatcatgatgttcttgataggcctagggttgttgttgaggctgtggagatgatccctttaaatacaactagaagggcgatcttgaaagac

SEQ ID NO: 28823 - DNA, 219 bp, Glycine max
  Peptide Sequence Number=SeqID_145601
atggttccttgctttgcattgttattggtgttgaacatcataaaggcgaggactttgagtcctatgaaagataaagatgaggactttaagtcttgtgaaaaggcaaggtctttgagtcctgtgaaagataaagatgaggactttgagtcttgtgaaaaggcgaggactttgagtcctatgaaagataaaggcgaggaatttgagtcctatgaaggataa

SEQ ID NO: 28824 - DNA, 315 bp, Glycine max
  Peptide Sequence Number=SeqID_145602
atgtacaaagataattggacccaaccttggcccatgggctcagaaatctaccctaaggttcatgagaaccctagggccttcttcagcagctctagcccaatcttcttggagcctcttgctcatggttctagtgattggtcccttcctagggaggatttcatcacattgggggcgctacttgagttgcctgatcctccacctttgggtgtattctttgaaagattcatgctcccttttacacatattatgcaactgcattctatccggggccatatcagaattgtattgatactacctgaggaaagctgccattag

SEQ ID NO: 28825 - DNA, 444 bp, Glycine max
  Peptide Sequence Number=SeqID_145603
atggaggccatgaaagagcaaatgactacaatgatggaagccatgatgagtatgagaaaaatgatggaggtcaacacggctatagtcgttgccgcaagtaccaccactgaggtggacccgattcacccatctggcctctatcaagtaaatcgtccagtctcggatatggtccagagtaagcattccttctcaccatatggcttgcctcccaactatacaccacccaatgtcgataactccgctctcatacccattaagagccaacaaccccaatccagtcatgaacgggtccctcaacccatggaagagacacttgaagtaccccgagaccacactctagccgacttcaagcctcacctcggatatgccactgaggggcaaacatttggtggcatacccctaccaaatactttggggggacctcagtattgcccacaaccataa

SEQ ID NO: 28826 - DNA, 807 bp, Glycine max
  Peptide Sequence Number=SeqID_145604
atggtactactcaggtgtgtggataagcaagaagcagaatttttgatgcacgaggtacatgaaggctcctttggaactcactccaatggacatgcaatggcaaagaagttgttgagagcaggttactactggatgtcgatggagacagattgttgcaagcacgctaggaagtgccacaaatgccagatttatgctgacagaattcatgtaccaccaactacacttaatgttctttcttctccatggcctttctctatgtggggcatcgatatgattggtagaatcgaaccgaaggcttcaaacgggcatcgtttcattctagtggctattgattacttcaccaagtgggttgaagcagcatcttatgcaaatgtgactaagcaagttgtggtccgctttatcaagaatcaaatcatctgccgttatggtgtgcccaacagaatcattacagataatggaacgaacttgaataacaagatgatgaaagatttgtgtgaagagttcaagattgagcatcacaattcttctccttacagacctcagatgaatggcgcagttgaagctgcaaacaagaatatcaagaagatagtgcagaagatggtggtcacatacaaagactggcatgagatgctaccgtatgctttgcatgggtatcgcacttcggtgcgtacttcaacaggggcaacccccttctctttggtgtatggtatggaagcagtactccctgtggaggttgagattccatcaatgagagttctaatggaggcccagttatcagaagctgaaatggtgccaaagcagatatga

SEQ ID NO: 28827 - DNA, 665 bp, Glycine max
  Peptide Sequence Number=SeqID_145605
atgggttcgatcattcgctacttgaatgatagtgatctgccattggatcagcacgaggatgtaaagcttattaaagagtcagcgggattcataatgctcataacaagttatatagatgggggtttagcatcctttactaagatttacgagggaacctgtggaagtcacattggaggacaagcattggagaacaagggtacatcctttgtggtacaagtagagggtacatctacttgggttgttgtaactaagaacaagagatggtacatctcttgtggatcagttcaagtggagggtacatccacttggttgttcaaagagaacaagggaaggtacatcccttgtggatctttgcttgtaaaagattttacaaggttgaaagaaatatcaagaatcggtggttgcttggggactggatgtaggcacagggagtggcagaccaaggtaactgccatttttgaaagtaaagatctttcttctatgtatcttgccactttgtttggaaaattgcaggaacatgaaatggaacttcaacgacttaatcaaaatgaagaaaccgataaaaagaaaagaagcatagcacttaaagcctcctcatcaatgcaagaagaaaatgaagaagaagaatcagaagatgaagaagacttctcactctttgtgaagaa

SEQ ID NO: 28828 - DNA, 978 bp, Glycine max
  Peptide Sequence Number=SeqID_145606
atgaacaaagatgatgagaacgacgatggaaggacagatgaggccaatgcagctttgaaaaggatgaaaggagagattgtggtcaagcaatcgagggattttcaaccctttgcggtggtgatcgtggtggagcaaattctacaaaactattttctccctacgattacttgttatgatggtactcggaatcttgttcaccatggagaatcactgaaatatttcttggtaaggttcaatgaggtgttagtttgggttttcaatttggatgagcacatggtggttgcaaccttttgtaagggattgcttgctggacaatttggggagtgcttggttcgacaatgtgttgtgaccatcgcagaggccgctggtccaatagtggaatggagaccaacctcagtgaaggatttgaaagatgtcatgattggtaagggaaagattgcaaaggtcggtttgactttatctttggcagtagaatcaacagaaatgccagttgggaaattccttggtttcatgctctcacataggggaattgaggcaaatatggataagtgctccacaatcctcaacatgcagagcccaaacaacgtgaaagaggtgcaacagttaacaggaaacattctactgactaaaatattttttggcctcacattcgatcatgaccaagcccgttctaggagcgaagatcagataccaaaggctgaaggccttagtggttttgtgaacaattcggaagctgagacattatttctaaagtcatcagagctctctgagaatgggatcttgtatgaatcaagaggatccatcaagaagtcattaaagtttgatttcaatgtcaacaataatcaagcagagtatgaagcattgttgaggaggatgattttagcatgggatatgagagttacttccttagtagctcggagtgattccaccctggtgatcaatcaagtgttgggaatctttcaggctagagatctctaa

SEQ ID NO: 28829 - DNA, 255 bp, Glycine max
  Peptide Sequence Number=SeqID_145607
atgtctcttggaaattattttctgaaaatcccctctgaatcaactgcttctttcattcttcctcactacgaggtcgtgaaaacaagacaacaattggtacctctaagccctacactggggcgacgaaaggcactatgcaaaaacttcaagcgaacctatgggcagattagaagttctcacccaataggttccctcctacaaggtcctgacgaaaggcaacgattgatgcctcaaagccttacactggggcaatga

SEQ ID NO: 28830 - DNA, 213 bp, Glycine max
  Peptide Sequence Number=SeqID_145608
atgacgaaggaagtgatccacggtcacaactctacaacgcctcgactccacttttcctcttctccttcttcttcaatgtttttctttggtttcaggctgctgaaaaatccatttagagtagacaaattcacccaggcgagttgtagtttgcccaggcgagtttgtgacttagtgctaaaagtacaaattcgctcaagtgagttgcttgcttag

SEQ ID NO: 28831 - DNA, 162 bp, Glycine max
  Peptide Sequence Number=SeqID_145609
atgaggaggaggaaatggaggaaggaattggagtatcctgagcctcggagtgtcgttggcttctacttgaagaacccttgcgcttcttcgatgaaatacaaattgggaacgagggttcgtgagaggaatgagaggtttcagatttcagattttgaaatctga

SEQ ID NO: 28832 - DNA, 273 bp, Glycine max
  Peptide Sequence Number=SeqID_145610
atgtcacaaaccatcgcatttcattatgtgtgtgaagagagtttgttccctcgactcgagaatcattcttctgttgaaaactctgaagagcttgctgaaaacactaggggattggctggttctgctgtggattacatggtctgtcttctttctgacattttcatgccaacttatgatggcccaagcaactttgccacaatctccttggacatcgcctttactatggcttccggactactatcagctgatagaattctgcccctatcttcgtga

SEQ ID NO: 28833 - DNA, 1359 bp, Glycine max
  Peptide Sequence Number=SeqID_145611
atgacaaataacggtgatgctgttgagatcaatattgaggagatgctgaagggggcatgggcacccgtaactactgagtgttgcatctacaaagtgccgtttagtatccgaagacacaacgaagaagcctacaccccaaaggttgtttctattggcccttttcaccacggccatcctcacctccaagacatggagaaacacaaactcttctactccatggcttttctcaaacgaactcaaacaactgtgggtagtttgatcggcaacattcaagagatggagcccgagtttcgtcgctgctattcacacactcttgagttcagcaatgagcaactggtcaaaataatctttgtggattgtgcttttatacttgagctcttttgcagagtccatgatcaattattgaaagaggacgacgacatgtgtctttcaaaaccttggttgtcgaataacataatgtatgatttgttgttacttgagaaccaggttccttttttcgttcttgagagactctttaatctgtccttctcttcaccttcattccttgcgcttacgtttcacttttttcaacagttcaatagatcaggcttaaactttaacaatattaacagaataatgcacttcacggatctgataagaacttttcacttgcaagatcctctgccgtctaggattgatggtaacataatagaacatcttcctagtgtcactgagttatcagaagcaggattgaagtttaaggttcttgaaagtgagtcttgtttactaaagttagacttttcgggagaggttcttgaaatcccgcagttggtagtggatgatcggactgaaactttgtttcgcaatatgatggcattggagcagtgtcactatcctttccaatcttacattacggactacgttgattttttggacttccttgtaaacaccaacagagatgtggatatactagttcgagagagggtctttcttaattggctagggaacactgattgtgtggctaccatgattaatggccttatgaaaaatattaccatatcaaataatatcagttctcaataccttgatgtcagtgagaagttgaatgcttttcatgaaaatccttggcataagttgaagtcgactctgaggcgagattattgtagaggtccttggcaaactgctgcttccactgctgcggttattcttctcattctctcttttgttcaaacagtttgttctatcttgcaactatttcagggaggaacaaaagttccaagacagccgtatacctatttacagtttgatcaaaagagaggtgaaattgggaaagttgtatcactttctataaactataaaaggctttcagaacaatattaa

SEQ ID NO: 28834 - DNA, 1683 bp, Glycine max
  Peptide Sequence Number=SeqID_145612
atggaatacaagggtgatgttgttaggatcaatgttaaggagatgctggagggggcaagggcacccgtaactgctgagtgttgcatctacaaagtgccgtttagtatccgaagacacaacgaagaagcctacaccccaaagggtgtttctattggcccttttcaccacggccatcctcgcctccaagacatggagaaacacaaactcttttactccatggcttttctccaacgatctcaaacaacttcggacagttttatcggcaagattgaagagatggagcccgagcttcgtcgctgttattcacacactcttgagttcagcaaggagcaactggtcaaaataatctttgtggattgtgctttcatacttgagctcttttgcagattcggtagtggagaatggaaagaggacatgtatctttcaaaacctttgacgatgaggagcatgagatatgatttgttgttacttgagaaccaggttcctttttttgttcttgagagactctttaatctgtccttctcttcacggggcgatgacttcccttcatttcttcagtttacgtttcacttttttagatggatcaatagatcaagcttaaactttaacaataacaacagaataaggcacttcacggatctgataagaacttttcacttgcaagatcctctgccgtctaggattgatggtaaaataataaaacatcttcctagtgtcaccgagttatcagaagcaggattgaggtttaaggttcttgaaagtgagtcttgtttactaaagtttgacttttcgggacgggttcttgaaatcccgcagttggtagtgcatgattcgactgaaactttgtttcgcaatatggtggcattggagcagtgtcactatcctttccaatcttacattacggactaccttcattttttagacttccttgtaaacaccaacagagatgtggatatactggttcaagagagagtctttcttaattggctaggggacactgattctgtggctaccatgattaatggccttgtgaaggatattgtactaccaaatatcagttctaaataccttgatgtcagtggaaagttgaatgctttacataaaaatccttggcgtaagttgaagtcggctctgaggcgagattattgtagaggtccttggcaaactgctgcttccactgctgcggccctctcccaaagacctgcggctcgccgtcggatcccaccggcggcggcggagagggtaatgctggcggcagcatgctgtacgtggcattggtgggcttgcttccggagcagaggaggatacggtggaggacgcggaggaggcaccgctggagcagggaaacgcggtggtggaaccgtcgccggaggattggaagaagttcctgttgaggagaagaacaatgagagcgtgcagatcaagagcaccacagcagcaactgacaacttcacgatcattcctttgaatcctgagcctcctcctctgctttgcctcttattcaataatgcctctgttgtgttacgcttccgtggtgaagtagggattggaatggtggttgcggctgagagcgccggcgatctaagtggcggtggccgatggatatgtggtggtgggagaaagaaggggggtatgggcttatgggtgggtttggagtgggctatagagattgtattggactaa

SEQ ID NO: 28835 - DNA, 222 bp, Glycine max
  Peptide Sequence Number=SeqID_145613
atgaggagaactggctttcacaagaggcaaagcagaggaggaggctcaggattcaaaggaatgatcgtgaagttgtcagttgctgctgtggtgctcttgatctgcacgctctcattgttcttctcctcaacaggaacttcttccaatcttcaatccaactattgctctgaggttcgtgcaattcgttcagaatcctttattgacacgaacacgaaaacgtga

SEQ ID NO: 28836 - DNA, 1440 bp, Glycine max
  Peptide Sequence Number=SeqID_145614
atgaggagaactggctttcacaggaggcaaagtggaggaggaggctcaggattcaaaggaatgatcgtgaagttgtcggttgctgctgtggtgctcttgatctgcacgctctcattgttcttctcctcaacaggaacttcttccaatcttcaatccaactatcgctccgagatccgtttagaagagctttggagcaacgcaggttccggtggttggcggccgtcgtctgctccgagaactcattgggcccctcctccgactgagagcaacggctatttgcgtgttcgatgtaatggtggcctgaatcagcagcgtagtgcgatctctaatgctgttcttgctgcgcgaatcatgaatgctacacttgtgctacctgagttggatgcaaactccttttggcatgatgacagtggtttccatggtatctatgatgttgaacatttcatcaaaacactgaggtatgatgtaaagattgttgaaagcattccagaaaatcagaaaaatggcaaaaagaagaaaataaagccatttcagcttcgtcctcctagagatgctcctgtaagttggtatactactgatgctctgaagaaaatgaaggaacatggtgccatctatcttactcccttttcacatcgcttagctgaagaaattgacaatcctgagtaccaaaggttgaggtgtagagtcaactatcatgctttaagatttaagccacatatcgtgaagttaagtcaatcaatagttgaaaagctacgcgaacaaggtcccttcatgtccatacatcttcggtttgagatggacatgttgtcatttgctggggctattgggaaatgcccgttgactcctcaggaggttggtcttattttgcgtgcattgggttttgacaattctaccaggatatatcttgcagctggtgaattgttcggcggggatcgatttatgaaaccatttcgaagtttgttccctcgactcgagaatcattcttctgttgaaaactctgaagagcttgctgaaaacactaggggattggctggttctgctgtggattacatggtctgtcttctttctgacattttcatgccaacttatgatggcccaagcaactttgccaacaatctccttggacatcgcctttactatggcttccggactactatcagacctgatagaaaatctcttgcccctatcttcatcgatagggagaatgggcagacggctggttttgaggaagctgttaggaaagtcatgctcaaaacaaactttggagaacctcacaagcgtgtttctccagagtctttctacactaattcttggcctgaatgcttctgccaaatatccgcacagaaccctgcagacaaatgtcccccaaatgacattttaaatattatgaacgacgaattacagaaaacagagaccgacacaaattctacaatatcctga

SEQ ID NO: 28837 - DNA, 183 bp, Glycine max
  Peptide Sequence Number=SeqID_145615
atggtggttgcgactgagagcgccggcgatctaagtggcggtggccggtggatatgtggtggtgggagaaagaagaaaatggaatggactaatcgattgtggacaggggggtatgggtttctgggtgggtttggagaatgggctacagattgtattggactaagaattttgggctttaactag

SEQ ID NO: 28838 - DNA, 1437 bp, Glycine max
  Peptide Sequence Number=SeqID_145616
atggcatacagcggtgatgttgttaggatcaatgttgcggagatgctggagggggcaagggaacccgtaaccactgagtgttgcatctacaaagtgccgtttagtatccgaagacacaacgaagaagcctacaccccaaaggttgtttctattggcccttttcaccaccgccatcctcgcctccaagacatgcagaaacacaaactcttttactccatggcttttctccaacgaactcaaacaacttcggacagttttatcggcaagattgaagagatggagcccgagtttcgtcgctgttattcacacactcttgagttcagcaaggagcaactggtcaaaataatctttgtggattgtgctttcatacttgagctcttttacagattcggtagtggagaatggaaagaggacatgtatctttcaaaacctttgacgaggaggagcatgagatatgatttgttgttacttgagaaccaggttcctttttttgttcttgagagactctttaatctgtccttctcttcacagggcgatgacttcccttcatttcttgagtttacgtttcacttttttggatggttcaatagatcaagcttaaactttaacaatattaacagaataaggcacttcactgatctgataagaacttttctcttgcaagatcctctgccgtctaggattgatggtaaaatgataaaacatcttcctagtgtcaccgagttatcagaagcaggattgaggtttaaggttcttgaaagtgagtcatgtttactaaagtttgacttttcgggacgggttcttgaaatcccgcagttggtagtggaagatgggactgaaactttgtttcgcaatatggtggcattggagcagtgccactgtcctgaagaatcttacattacggactacgttggttttttagacttccttgtaaacaccaacagagatgtggatatactggttcaagagagagtctttcttaattggctaggggacactgattctgtggctaccatgattaatggccttatgaaagatattgcgacaccaaataataccagttctcaatactttgatgtcagtgaaaagttgaatgcttttcataaaaatccttggcgtaagttgaagtcgactctgaggcgagattattgtagaggtccttggcaaactgctgcttccagtgctgcgattattcttctcgttctctcttttgttcaaacaaatatctctccaggccctctcccaaagacctgcagctcgccgttggatcccaccgcggcggcagagagggcaatgccggcggcagcatgctgtgcgtggcattggtggccttgcttccggagaagaggaggatacggtggaggacgcggaggaggcaccgctggagcagggaaacgcggtggtggaaccgtcgccggagggtggaggaacggctga

SEQ ID NO: 28839 - DNA, 1080 bp, Glycine max
  Peptide Sequence Number=SeqID_145617
atggagcccgagtttcgtcgctgttattcacacactcttgagttcagcaaggagcaactcgtcaaaataatctttgtggattgtgcttttatacttgagctcttttgcagagtccatgatcaagaatgggacgatgacgacatgcatctttcaaaccttcggttgacgagtagcatagtgtatgatttgttgctacttgagaaccaggttcctttttctgttcttgagagactctttaagctgtccttctcttcacggggtgatgacttcccttcatttcttaagcttacatttcacgtttttaatgacttcaatacatcacgcttaaacgttaacaatattatcagagtaaggcacttcacggatctgataagaacctttcatttgcaacatcctctgccgcctaggactcctggtaacacaattaaacatcttcctagtgccactgagttatcagaagcaggattgaggtttaaggttcttgaaagtgagtcttgtttactaaagttagacttttcgggacgggttcttgaaatcccgcagttggtagtggatgatttgactgaaactttgtttcgcaatatggtggcattggagcagtgtcactatcttttccaatcttacattacggactacgttggttttttagacttccttgtaaacaccaacagagatgtggatatactagttcaagagagagtctttattaattggctaggggacactgattctgtggctaccatgattaatggccttatgaaaaatattacgacaccaattaataccagttctcaataccttgatgtcagtgaaaagttgaatgcttttcataaaaatccttggcgtaagttgaagtcggctctgaggcgagattattgtagaggtccttggcaaactgctgcttccactgctgcggttattcttctcattctctcttttgttcaaacagtttgttctatcttgcaagtgttgaaacagattaatttattagtccttcccgaaattactatgggtatgcatcaagttattcagtgttgcctcttgaagtctgtctatggtgcaaaatatgatctaaagtag

SEQ ID NO: 28840 - DNA, 367 bp, Glycine max
  Peptide Sequence Number=SeqID_145618
atgtctcacacatacaacattgtccacacaaacatcaaactaagaaccaccatcgacagggtcagcatgtgcctaagggactacttcatgtacatggatttgatgatgatgatgatgtgtgttgcgatgtgtgacattgaaaaggcaagaaaatatgcaaaggccctcaatgccaccttgttcttttcaagtgcaacctacaacatcaatgtgaacaagatcttcaagttcatcacagctaaactctttgacctaccatggacagtggagaggaatctacctgagtcggaggaaaaactggaggaatctcagggaatcgctagagatgttgttatcgctgtcggaagacacgtgagtccgcttagag

SEQ ID NO: 28841 - DNA, 219 bp, Glycine max
  Peptide Sequence Number=SeqID_145619
atgaagaataggtttaatgaatcaaattctgctccacatatgcagaatttgtcttcaatccttacacctgagtgtcttgatgatacaagttatcctgaatggcaccaaaaaggaaaaaaggtgaagtctcctaaggacaactccaccgttgctactggatttgttagaacatttcaaccaatttgggatttttctgttactattaaggggattggataa

SEQ ID NO: 28842 - DNA, 288 bp, Glycine max
  Peptide Sequence Number=SeqID_145620
atgaaggtgttggagaaaagggcattggatgcaaaggcttcgaacaagcttaataaggaggaagtggtgaggttagaagttgctttggtcaagaacactttaatcgattacattgaggatctaatcgattacatcgttcttgagaggctatgccaaaccctaaaaggtctttcccagttagctgctaattttccttctgatgaatcttttcgggtttcaccccaggctctccagacaagatctccctccttgaattgcctaagcatcaattttgagttaaaatattga

SEQ ID NO: 28843 - DNA, 584 bp, Glycine max
  Peptide Sequence Number=SeqID_145621
atgggtgaccaagaggagatacaggaacagatgaaagccgacatgtcggctttgaaagggcaaatggcttccatgatggatgctatgttaggaatgagacaactcatggagaataacgtggccactgctgtcgctgttagttcggctgccaaagcagacccaactctcccagctaccgcgcaccatcctctcccaaacgtggtggcttacccttatggattaccacctaattacacgccactagtcatgcgtgatgacgcgggtcatgtcccttcccctatccttgaaggggagcctcctcgacagtcggacgaggttcacgaggatcgtagagagtatgcccaaagagacatcgatttctaccccgggaaactcgatctcatcgaaaagagattgagggctgttgaaggctttggcgactatccgttcacggacatggtggatctttgcttggtaccggacgttgtcatccccccaaaattcaaggtacctgattttgataagaacaaagggacgacttgtcctaaggaccatctcaagaagtattgttgcaagatgggggcgcattttagggatgagaagtt

SEQ ID NO: 28844 - DNA, 228 bp, Glycine max
  Peptide Sequence Number=SeqID_145622
atggagaacaaaaacaacaacagtggcgagtcggagctgcgggtggtggttgtcatcttcctcttgaagggcagatcgatcctcctcggtcgctgccgctccgctgtcggcaatgccaccttcacccttctaggcggccacctcgaattcgaatcatctaatcacaattcatcaggtatggagagttttgaggaatgcgctgcaagagaagtgaaagaggaaacatag

SEQ ID NO: 28845 - DNA, 120 bp, Glycine max
  Peptide Sequence Number=SeqID_145623
atggattacctagatggtaatcaatacacacaagcccaaggtctagagcccaataaggttgatataaaaaaggtaggactcccaggccaaggtgcacctgacgctgacactattagctag

SEQ ID NO: 28846 - DNA, 474 bp, Glycine max
  Peptide Sequence Number=SeqID_145624
atggtttggacagaggcttcattaagggaaaccgaaggggttggctttgaggttcggggtgtgaatgaggaggtgttggaggtgtcctccagcatgtccactttggtcattgtttcctcaatttcctttctagaaaaggattcatcttctactggcaatggggagtctagtgacttctctaccttcttgaatcaacttctagagaaggtttcgaggcccctttctccagaagctgcaaaagaggaggcggattctcctcatccttctgatgaagtggtgcgagagaaacatcggtgtctgttcacagagaagaaagtgtgccctccaatttctcttttgggttacacatgggtcgaggaggaatgtccctgtcagtatgacgagtatgccaaggagtatctgaataatgaagaactcctagaccttgccttcctcgaaaatctcttgcttgttgtttccttgcctaaccaatag

SEQ ID NO: 28847 - DNA, 1185 bp, Glycine max
  Peptide Sequence Number=SeqID_145625
atggcatacaagggtgatgttgttaggatcaatattgaggagatgctggagggggcaaaggcacccgtaactactgagtgttgcatttacaaagtgccgttaagtatccgaagacacaacgaagaagcctacaccccagaggttgtttctattggcccttttcaccacggccatcctcacctccaagacatggagaaacacaaactcttttactccaaggcatttctcaaacgaactcaaacaactttgtacagttttatcggacagattgaagagatggagcccgagtttcgtcgctgttattcacacactcttgagttcagcaaggagcaactggtcaaaataatctttgtggattgtgctttcatacttgagctcttttacagattcgatagtggagaacggaaagaggacataataaggcacttcactgatctgataagaacttttcacttgcaagatcctctgccgtctaggattgatggtaaaataataaaacatcttcctagtgccactgagttatcagaagcaggattgaggtttaaggttcttgaaagtgagtcttgtttactaaagttagacttttcgggacgggttcttgaaattccgcagttggtagtggaagatccgactgaaactttgtttcgcaatatggtggcattggagcagtgtcactatcctttccaatcttacattacggactacgtttgttttttagacttccttgtcaacaccaacagagatgtggatatactagttcaagagagagtctttattaattggctaggggacactgattcagtggctaccatgattaatggccttatgaaagatattgcgacatcaaatgataccagttctcaataccttgatgtctgtgaaaagttgaatgcttttcataaaaatccttggcgtaagttgaagtcgactctgaggcgagattattgtagaggtccttggcaaactgctgcttccactgctgcgattattcttctcattctctcttttgttcaaacaaatatgtcaccaggctctctcccaatgacctgcagctatttcagggagggaggaacaaaagttccaacacaaccgtatacctatttacagtttgatcaaaagagaggtgaaattgggaaagttgtatcactttctataaactataaaaggctttcagaacaatattaa

SEQ ID NO: 28848 - DNA, 507 bp, Glycine max
  Peptide Sequence Number=SeqID_145626
atggctcctatccctccgcaaccattaacagtcgaatccgctatcttaacctccaattatgtgtcatcttccaaagagaaatgcaacaacatcaagatccaagagtttttgtacagtgacctcgatgctgccatcaatggcttctccaaccgcaagctcctcggcaaagggagccacaactatgtctacaaagccgtcgttcgtggttgtcccgtggcggtgaagcatccttcgcggccacaacatcatcataacaatgtttcccaacggcctatctcttgttcttcttcctctgcaccctccgaggtcaacaatgagattgacatcttcctttgcattcatggtgtcgcggaggtagttggtgtcgagggtcatgactacgttaatggtggcggagggagaggagccacagtccttgtcgatgagggtctcccgaaagagagggagctcccgggaaggacggctagtaataataatttaacggtcctattgaaaattaaatggtaa

SEQ ID NO: 28849 - DNA, 1428 bp, Glycine max
  Peptide Sequence Number=SeqID_145627
atggcaaacaacggtgatgttgttaagatcaatattgaggagatgctggagatgctggagggggcaaaggcacccctaattactgagtgttgcatttacaaagtgccgtttagtatccgaagacacaacgaaaaagcctacaccccagaggttgtttctattggcccttttcaccacggccatcctcgcctccaagacatggagaaacacaaactcttttactccaaggcttttctcaaacgaactcaaacaactttggacactttgatcggcaacattcaagagatggagcccgagtttcgtcgctcttattcacacactcttgagttcagcatggagcaactggtcaaaataatctttatggattgtgcttttatactagagctcttttgcagataccactatcgagaatggaaagaggacgacatgtgtcttccaaaaccttggttgacgagtaacatagtgtatgatttgttgttacttgagaaccaggttcctttttttgttcttgagagactctttaatctgtccttctcttcacggggtggtcacttcccttcatttcttgagcttacgtttgacttttttgaagagttcaataggtcacggttaaacttcaacaatattaacagaataaggcacttcacagatctgataagaacttttcacttgcaagatcctctgccgtctaggattgatggtaaagtattaaaacatcttcctagtgtcactgagttatcagaagcaggattgaggtttaaggttattgaaagtgagtcttgtttactaaagttagacttttcgggacgggttcttgaaatcccgcagttggaagtggaagatgggactgaaactttgtttcgcaatatggtggcattggagcagtgtcactatcctttccaaacttacattacggactacgttgattttttagacttccttgtaaacaccaacagagatgtggatatactagttcaacagagagtctttcttaataggctaggggacactgattctgtggctaccatgattaatggccttatgaaaaatattacgatatcaaataatatcagttctcaataccttgatgtcagtgagaagttgaatgcttttcataaaaatccttggcgtaagttgaagtcagctctgaggcgagattattgtagaggtccttggcaaactgctgcttccattgctgcaattattcttctcattctctcttttgttcaaacagtcaaagagtttagcagtgatgaacttgaagatcttgttcacattgatgttgtagggctcaatgaatcatcaaacatgccttggtggccttgcttccggagcagaggaggatacggtggaggacgcggaggaggcaccgctggagcagggaaacgcggtggtggaaccgtcgccggagggtggaggaatggctga

SEQ ID NO: 28850 - DNA, 141 bp, Glycine max
  Peptide Sequence Number=SeqID_145628
atggctgcagatagtctacattgtgttgccattgcatatagatcatatgaaaaggagaaagttccaactaatgaagaactactttctcactggtctttaccagaggatgatcttatttcactagccattgttggtcttaag

SEQ ID NO: 28851 - DNA, 2790 bp, Glycine max
  Peptide Sequence Number=SeqID_145629
atggttatggggagaagaacactgttgctcttggttttgtgcttgtgcttgtggattccctttgaagtggtggggagaaaagaaccttttttttcacctaccagtgtgaattccactgtttcttctagacccaaggttgtgaagtttggtgctctctttactatggattctgtcattggaagatcagctttacctgcaattatggctgctgttaaggatgttaattccagcaccagcattctccctggcattgatctgcaagtaattttacgtgatacaaattgcagtgcttttcttggaacaatggaagctctgcagttgatggagaatgatgtggttgctgttgttggtccactgtcatctggaatagctcatgtcatatctcatgttgttaatgaactccatgttcctcttttatcatttggggcaactgatcccactctatcttctctacaatatccgtatttcgtccgcaccactcagaacgactattttcagatgtatgcaattgcagactttgttgattattacagatggaagaaggtaattgccatttacatagatgatgacaatggaaggaatggagtttctgttttgggggatgcaatgtcaaggaaacgtgccaagatctcttacaaggctgctttccctcctggtgccacagaaagtgatatcagtgacttgttaaatgaggtgaacttaatggaatcgcgtgtctatgttctacatgtaaatcctgatcatggtttagcaattttctctattgccaagaggctaagaatgatggacagtggatatgtttggattgcaacagattggcttccttcagtgctggattcctttgatctaccagacactgacacaatggatctcttgcaaggtgttgttgcatttcatcatcacattccggatactgatctcaagaagagttttctctccaggttgaaaagccaaagagacaatgagactgtgagcttcaattcttatgcactttatgcatatgattctgtttggttagcagctcgcgccctcgatgcttatctcaatgaaggtggaaatatatctttctccagcgaccctaagttgcgtgacacaaatggaagcatgctgcagttagcatcgcttcgtacctttgatggcggccctcagtttctcaagacaattttgggaatgaacttcactggtctgagtggtcaagttgagtttgacatggaaaagaatttagtccgtccagcctatgatattctaaatattggtggcagcggatcccatagaattggttattggtcaaatcactctggtctatcagttatagctcctgaagttttgtatgagaaaaaaccatccaagacttctttaaagagcaatcaacaactctacagtgtgatatggcctggagaggctacaactacaccaaggggatgggtttttcccaacaatggacagccactgaggatagcagtgccgaaccgagtgagcttcaaggattttgttgctaaaagcaagaacccccaaggggtacaaggctattgcattgatgtctttgaagcagccttaaacttgttgacttatcctgtcccgcgacaatatatgttgtttggaaatggtgaaaggaatcctagctacaacgagcttgtgcagcaagttgcacagaataactttgatgcagttgttggagatgttacaattgtcacaaataggacaaggattgtggattttactcaacctttcatgccatcagggcttgttgttgttgttcctgtggaggaggagaagtcaagcccttggtctttccttgtgccgttcactactcaaatgtggttggtcactggtgctttctttctcttcgttgggactgttgtgtggattcttgagcaccggctcaatcctgagttccgtggttctccgaggaaacaactcataacagtgttttggtttagtttctcaacaatgtttttctcacacagggagaatactgtaagtggactcgggcgattggtgctaataatatggctctttgtggtgttgatcataaattcaagctacacagctagcttgacatctatcctcactgtgcagcaactgtcatcacaaattgcaggaattgacagcttgatctcgagtactcaaccgattggaattcaagatgggtcattcgcgcgcaagtatctgatagatgacctcaacatagctgaatctaggatagttacattgaaaaacatggaggattatattgatgcccttcggcgtggccctaaagctggaggggttgcagcagttgttgatgagcttccttatgttgaggttttgatgtctagcattgactgtaagttcacaattgttgggcaggagttcacaaaaagtggctggggatttgcattccaaagggactctccccttgccattgacttgtctactgccatccttcaactctctgagagtggggacctgcaaaagattcatgacaaatggcttaataaaaaggagtgttcaaccgttgatactgattcaaacaaactagctttgacaagcttctggggcctctttctgatatgtggcattgcatgtgtcattgccctgaccattttctttgctagaatcttctgtcaatacaacaaattcagcccagagcctgataagatcgacgacaaggaaatgcaaccggtcaggcctagacgtccaagtcgaactcgtagcatcaagaagttgatggtatttgtagatagaagagaagcagatatcaaagagatacttagggaaaacaaaaaaaggagactcagcattggataa

SEQ ID NO: 28852 - DNA, 939 bp, Glycine max
  Peptide Sequence Number=SeqID_145630
atgcaagatggtgctcctctaaaagtccctagacctttagaaaaaggtttcaatttgcaaggcagggatggtcttgatgctagaattgcaaggatgtttttctctttagggctaccatttcatttagcaaggaatccttattatagggaggcattttcttatgctaccaatactcctaatctcagtggatataagcctccaagttacaataagttgagaactaccttgcttacaacagagagaagccatgtggagaacctcttgcaaccaataagaaatttatggaatcagaaaggtgtgaccattgttagtgataggtggagtaatcctcaaggaagacctcttatcaacttcatggctatcactaagagtggaccaattttcttaaaggcggtaaattgctttggtgatataaaagacaaggatttcatttctcaacagatcaaagatgcaattatgaagggtgctaagaaaaacaatgtcacttatgatcaatgttcttggatcacacaaattgcagactatgctaattttatcatgagacactctatgagattatcaatgtacaacaacttcaactcattaaagttgctttttgttgctcctacaagattttcttcaactattgtgatgctcaagaggtttagaagtttgaaagaaggactccagaagatggttattagtcctgaatggtctacttacaaggatgatgatgttggaaaggcaaaaaaagtgaaagaaactttattggatgatatttggtgggacaagtttgattacatactttctttcattgctcctatttatgatgttcttagaaaaatagatactaatatgacttgtctttacttgggtggaatccttgaaatagccaatttatttcttgatgaaacaactttagcagctgcctttttcaatgaagatgaccaaaggctttga

SEQ ID NO: 28853 - DNA, 339 bp, Glycine max
  Peptide Sequence Number=SeqID_145631
atgaagacccctgaggaagcaatgaatttaattgaaaacatggttgctagtgatgatgccattttgagagaccgagcccacatctcaaccaaaaatagtttattggagcttacatcacaagacgctttgttggcacaaaacaagttgttatctaagcaactggaggcactaacagaaaaacttagatgctcaatctgtggtggagctcatggctctgggagttgcattcctaatgaagaacaaatgactcaagaggttaattatatgaggaatcagcccagaggcaatttcaatccaggtggatttttcggattccaaaatagccagcaatatcaatag

SEQ ID NO: 28854 - DNA, 252 bp, Glycine max
  Peptide Sequence Number=SeqID_145632
atgaacaacaatcccaaagtgaacattaagaagaaagttgctcctcacttcagaatctcaaaacaaaaaaagcttcaatgcaaccaaagagagagagatagagaagtgaagtgcaaagtgaagaaaatgcaagaaaccccttttcactgtttttcactaacaattgagttcagagttgagagagagaagagagagagagctttgcaacttgccaggcatattatcagggatgatcacgtgagaggcacgtga

SEQ ID NO: 28855 - DNA, 840 bp, Glycine max
  Peptide Sequence Number=SeqID_145633
atgcagtttgaaattagagtgcagcagtgtaacactggtgagttcaatgctatggtaagaaggtccttgtcagatggaaaccatagcttgcctgggccgaccgctaggatcaatgattgcaagaatattgtccttcgttggctggctagtaaacttgacccatccactgcaaatagtgtttttagaggactctcaaactgcaacctaaaagaagttaactcagtatgcccattggtttttccaaatgtcacaagtgttgtgaaagaatgcgggaatctcataaataaccaaacagcttgctgcaaagccatcaaaagttatgtgtcctatttgcaagagcagagctttttaaccaatctgcaagccttgaaatgtgctacatcacttggaaagaaattgcaggaagcaaatgtctccaaaaatgtttattatctttgtcgtataagcctgaaggacttttctcttcaaggaaactgctattttactcttttcgcaagtactgatactgatactgacacttctcgtgttatgttgctaatggccgatggacttcccttggatcaatcagttgggttgcaagaatctggctgccttttgacgagtttgccatcaaatgcagtatttgatggaacttctgggatcggattcatttgtgaccttaatgacaacattgtagctccatggcccacaacatcatattcacttccatcctcatgcaatagaactacaaaacttccatctcttcctacagcaacgtcttcacaaaatggtctttccattaattcattggttttgcctctcctctttacctctatactacttcccaagaggcttctttaa

SEQ ID NO: 28856 - DNA, 240 bp, Glycine max
  Peptide Sequence Number=SeqID_145634
atgtatgcagttatgaacaagtctcacggctcttcaatcaggttcgcaaaatattcgttttctatcactaataaggttgatgcactgcctcctgctatctctccaagtagtacacagccacagccctttattccccttctagctccttccccattgatacctttcacaaataaatcggtgccgaagttatcaggtataaagggtggaagagaggtaaaagagaatgaagcactaaattga

SEQ ID NO: 28857 - DNA, 450 bp, Glycine max
  Peptide Sequence Number=SeqID_145635
atgggaaactgtttgaggaacaacaaaatatcatcacaagatcatgagaactatgcagaagccccagtaattgatggaaaggttgagaaggtaaaggcactttcattgtccaagttggaagaagcgccaaggatggatcaacaaggcatgaagaaggtgagattcaagatgcaaaatgatgatagtacttatgaaggtgagagaggaagtgagggtaattctagaagtgtgaggattagagtggtaatgactcaagaagagttgaaaaggatgatgaggtgcaaggatgaacacacttcattggagcaattattacatgctgtgaagttgagaggaggaaaaatttcagaggttggtgaatttgatgatgatcagggactgaattcttcttggaagccatctttagacagtattccagaggatcactggcttgataaatttataaagtag

SEQ ID NO: 28858 - DNA, 405 bp, Glycine max
  Peptide Sequence Number=SeqID_145636
atggtagcgatttggcgatggaagcgttcgacgacgggagcgacggcggtgatcggaggacggggagagagcggagaggtggaatggaggcggtggctccagcgcggaacggagcagcggaggagggaaggagcggcggagaaggaagaagtgcgggaagcgaaggttctagaaggagaaggagagggaaagaagagtttaggcctggttgctctgaggagcgaagagaccgttgttatatacatgttggtgacgatcagtgatcacgcattcggaggcaggaaggataaggatgggtggtggcggttttggctgcgtgccttcgtgatgacaattgattgggatgttatagcaatggcaacattgaggctgagttctattaactactactgtgaggtgacataa

SEQ ID NO: 28859 - DNA, 1932 bp, Glycine max
  Peptide Sequence Number=SeqID_145637
atgtatctcgtttggttgaccaatgaaaatcctttcaaaggaaacttgaccagtctcccaaagcctggtggcggcgagtttggaaagttctacagtcttccttctctcaatgatccgagaattgacaggttaccatattccatcagaattctccttgaatctgccattcgtaattgtgacaattttcaagtcaaaaaagaagatgttgagaagattctcgactgggaaaataattctacgaagcaagttgaaattcctttcaagcccgctcgtgttctcttgcaggattttactggagtcccggctgttgttgacctggcctgcatgcgtgatgctatgaataagcttggcagtgattcaaataagatcaaccctctggttcctgtggatcttgtcattgatcattcagttcaagttgacgttacaaggtcagataatgcagtgcaggccaatatggagcttgaatttcagagaaacaaggagaggtttgcttttcttaaatgggggtcaactgcattccttaacatgcttgttgttcctcctggttcgggtatagtacatcaggtcaatcttgaatatcttggaagggttgtattcaacaatgagggcctactctatcctgacagtgtagttgggactgattcacatacaactatgatagacgggcttggtgttgctggatggggagttggaggtattgaagctgaggcagcaatgcttggtcagcctctgagcatggttttgcctggtgttgttgggttcaagttatctggaaaactacacaatggtgttacagcaacagatttagttctaactgtgactcaaattctcagaaagcatggtgttgtggggaaatttgttgaattttatggtgatggtatgggtgaattatctttggctgacagggccactattgccaatatgtctcctgaatatggtgccaccatgggcttcttccctgtggatcatgttacattacagtatctcaagttaacaggaagaagtgatgagactgtggccatgatagagtcttatctcagggcaaacaaactgtttgttgactataatgagccgcaacaagacagagtgtattcatcatatcttgaattaaacctttctgatgttgaaccatgcatttcaggaccaaagagaccacatgatcgggtacctttgaaagaaatgaaggccgactggcatgcttgtcttgataacaaagttgggtttaagcttgagcaccaagctattagtgaccacttatgcatgatatgttttctggcctttgaaaaagtcaagactcgttcattcttatctatgactcatgttcctatttttgcaagactttgttctggggaccttaacagcagcaatgatgtcaaaatgagtgtttgggagatccatggatttgctataccaaaagaggcacaaggaaaagttgcaaaatttgatttccatgggcagccagcagagctcaagcatggcagtgttgtgattgctgcaatcacaagctgtacaaatacatcaaacccaagtgtaatgcttggtgctggtcttgttgcaaaaaaggctcatgagcttggtttgaaggtcaagccttgggttaaaacaagtcttgctccaggctctggagttgttacaaaatatctactccagagtggactgcaaaaatatctaaatgaacaaggttttcatattgttggatttggctgtactacatgtattggcaattcaggagagctggatgagtccgttgcttctgccatctcagaaaatgacgttgtagcagctgctgtgttgtctgggaaccgtaattttgagggtcgagtacatgcattgacaagagctaactaccttgcttctcctcctctagttgttgcttatgctcttgctggcacggctactcacaagctgttgagtctattgactgctagttag

SEQ ID NO: 28860 - DNA, 489 bp, Glycine max
  Peptide Sequence Number=SeqID_145638
atggccaaaatacaaggcccaaaagaagaaaaaaaacctattctaatatttacaaagaagagtggacccaaccttgacccatgggctcaaaaatctaccctaaggttcattagaaccctaaggccttctttatcagctctagcccaatcctcttggagcctcttgctcatggctttggtaactggtcctttcctcgggaggattgcatcaagaagcgtcgtggttaggtccatcaagaaaaagataatctgctggtgcaggttacctaggaagattatcactaacaatgccaccaatctaaacaacaaaatgatgaaagaaatgtgtgaggatttcaagatccaacatcacaattccacgccttataggctcaagatgaatggggcagttgaggctgcaaacaagaacatcaagaagatggttcagaaaatgatcgtgtcatacaaagattggcacgagatgctccctttcacgttgcatggttactga

SEQ ID NO: 28861 - DNA, 234 bp, Glycine max
  Peptide Sequence Number=SeqID_145639
atggagatgcagcggaagacaaaggagaatagaagagaggacccaaccttggtccatggctcagaaatctaccctggtattcatgagaaccccaaggccttctttagcagctctagcccaatcctcttggagtcttctatccaatacccttgcgaggaaatgactccaaagaagctcccagccaagaggtcaaggaaggataccgctggagagggttccagtgtggccccatag

SEQ ID NO: 28862 - DNA, 174 bp, Glycine max
  Peptide Sequence Number=SeqID_145640
atggggggaggttgcaacacagctcgcctggttgcttcctttagaagcaacatgctcgcccagatagcaatggagactacaatagtcttgaaagtaatgaaaatggacgaccatgatggtttccgcgtgccaacggactcacttgtctctggatggcaagggagactacaatag

SEQ ID NO: 28863 - DNA, 342 bp, Glycine max
  Peptide Sequence Number=SeqID_145641
atgtacatttttgcagtggtccaacttgagagagacggttcatcttgcaagatcatccaacaaatatgcaaagataacttgatcgaaagcaaggcatcacagattgaatgtgtcttgagagttcagaacaaacaagaaacgtttgcatgctttgaggaaagtaggggtatggtaaggactaaagctgaaagagtaatagctgggagaatccataatcctctacaagagatcaaggaaatggttgagccagagtttgattctttggtaaagaaaatgagtgaccaatcagagattgaagaacttattgttttgaatcctagagctgtactcccttgctttttg

SEQ ID NO: 28864 - DNA, 243 bp, Glycine max
  Peptide Sequence Number=SeqID_145642
atgatgattggatgtagaattacctggatgttgtggaagcttgggaggattgatggggacccggcgttgagaggaacgaggataagggctgcgtgggagtacgtgagctcagttggaggtgggcaacaagggatgagtggtacctggagatatgtcgcgggggtcaggagaccttggggacgtcaggtggggtgctattgcccaaaaccaagcttgagcaatcccgacccaacccgggcatag

SEQ ID NO: 28865 - DNA, 867 bp, Glycine max
  Peptide Sequence Number=SeqID_145643
atgacaggggcgtccattagttggttcccatggtggaaagaaggaggggcaggagtgctatgcttatgtgaaggatttccaaatatccctttgataggaacgagaggttgtattaattataatctcgtgttggccataagacagttgggttaccctatgagaggtgcgccatcggaggagaccatcgtgcctttcatcgcgcgaggtttcaatgaagctaatacaaagacacttcagaagatccggataacttggctcccaaagctaaaaagtctgagtggggaagagattgaaatgcctgaagagagtgaagaggtgcaagctttgaaagctgagctcgaaaagacaagagtggtgaatgagaagctgaaggtggcagtcattagggttaggaaagaatgtgatgagctgaaagatatcaacatgagcgcggctgaagcgctagagcgggaaatgaagaaggccagaaaggaagagtggagtagaaacaagtttcgaggggctttgctaggaagtagtaatgagctcaaacttagaaagatcgagagggataaatcaaggatggaaagcctgatgttagaggataagttaaagagttgtcagaggtcgaagagaagtttgaaagaacagttgagaaaaatggaagaaaatatgttgataatcattgaccaatataaaaagagggaagcaaaagaaggggtgatagagttattgcataaagaagccatgaaatggatggacatatttgctctcactctgaatgagaatcaagagcttccaaggttgttagccagagccaaggcgatggctgacatatactctactcccaatgaagttcacagtcttttcaattactgccaacacatg

SEQ ID NO: 28866 - DNA, 189 bp, Glycine max
  Peptide Sequence Number=SeqID_145644
atgaaaggcacgatggtctcctccgatggcgcacctctcataggcactcctgcccctccttctttccaccatgggaaccaactaatggacgcccctgtcatgcctgccaagagttctttccaatttgctctgtcctttcccaagcacatgcgatggccccgtatggggcagacaaatctactttcatga

SEQ ID NO: 28867 - DNA, 486 bp, Glycine max
  Peptide Sequence Number=SeqID_145645
atgacttacagaaatttagagcaaaaaaatgacgtatcatctactactcaaactaataggtttgagttagcagaacgacttcaatcttcaagaaaccttgagcaaatttatgaaaagattagagaattttcattatcaaatagaattgaggaacgagtccaaatgaaattgttaccagaaaatcttggaaatctcgatatagaaatgagaaaagaagataaagaagcttttttaaagttgctaatcacacaactcaagagccaagatcctctcgagcctatgaaggatagagacttcatagctcaaatgtctcaattatcatcacttgagcaggttatgaacatgagtaaatcggtccaaagtttcgttgacaccgccgctcaactttacagaacgcaagctgtatctatgattggtaagaccgcagttgtgaaaacaaatgttatcaatgttgaaaacggtgtctcccgaatcaaaagtatttaa

SEQ ID NO: 28868 - DNA, 861 bp, Glycine max
  Peptide Sequence Number=SeqID_145646
atgccagaagaaatggaacaacaacaagaacaaggtggtaaaaaacctaatccgataatgggaattttaaagttggtaggaatacctttgatagtttcgttggtcgttactttagcagtattctttcttcttggccaaaataaacaaccacaacaacaacaagaacaacaacaggtaacagctccaactcaaatcaaagccgttgtgattcaagctggaaaatttcaaacatttatgttaaagggtggaagagatgttgttgtaatcgattcattaacacttctcgttggtagcgaaccttgtcgtgcagcagttgctgaaaaaaatgacgaaataatggatgcgttgagcataatttttctaagcaaagaaagattcgagttaacgacacctgcagatgttctcagccaggaagaaatagaccgtttattggctgcgttatctcaaggagaagttaatatagaggaagtaaaaaaggagggcgaagagaaaaaaatccgtacctatgattttttgcgccctcaaaagttttcaaaggagcaaattagaaccgttcaaatgattcatgaaaactttgctagaagcgtttccacttatctttcaggaaagttaaggtcattcacatctgtaaatgtcgttggaatagatcagctaacatacgatgaatacatgaaatcgattggaaacccatcatttataaccatcttcacagctagggaattcgttggaagctctattctgaacattaatttagagatattctatggtatattggacgtattgctcggtggacctggggaagttatcgatgctaagcgagtaccaacggaaatcgaaataggaattataaaaaaggaaata

SEQ ID NO: 28869 - DNA, 507 bp, Glycine max
  Peptide Sequence Number=SeqID_145647
atgaatcaaaatgaaaccattcaagacatgcaaaagaggtttactcatattgttaatcgtcttgccttattgggaaagacaattccaaatgaggatcttacaaaaaatttcaaccctaagaagaatttgaagaagagtgaaaaatcctctccaaatccaagatgctatgaatgtaatcaactaggacacatgaaaatgaaatgccctacttacaaaaataaaatggaaaaacttgagaagaaatctctcaaagaaaagaaagcatacataacatgggaggagaatgccatggactcatcaagtgactctgaaaatgaagttgcaaatctaagtctcatggctagagattgtgaaagtgatgaaaagaaaggtcgtaaagtatcaacttgttccattagaaagaatgaaaatacaataggaaaaatgatatgggttctgaagggcacattgcccaaatctaaccttcaaggacccaaggaaatttgggtacctaaatcaaaattgtga

SEQ ID NO: 28870 - DNA, 264 bp, Glycine max
  Peptide Sequence Number=SeqID_145648
atggagttagagaacaaggaagaggaaaacaaaaaggaaactccatttcaagaggaatcaagaaacattgatcttccaaaagaatggaaagcttcaaagaatcatccacttgacaacatcataaatgatatatcaaaaggggtaacaacttggaactctcttaaagatgcatgtaataatatggcttttgattttgtaattgaacctaagaacattgatgcagctatcattcatgaacattggattattgctatgcaagattaa

SEQ ID NO: 28871 - DNA, 156 bp, Glycine max
  Peptide Sequence Number=SeqID_145649
atgtctatgatggatgaattaaatttctttcttggactccaaatcaagcaaaccaaagaagaggaaattgttactcccatgagcagtgcttgttacttggataaggatgaaggaggcaagtcagttgacatcaagaaatataaaggtcaatcctaa

SEQ ID NO: 28872 - DNA, 720 bp, Glycine max
  Peptide Sequence Number=SeqID_145650
atggatcaagtggttgatggttgggggacttttgttcataagaagaaattgaagggggtgaaaatggttctaaagaaatggaatatggaggaatttggtatgctacatacaaagcaacaacaaattgctaaagagatgaatgagttagacttaagggaggaacaaggagacttgggagatgaagacatcaaaaagaggctctatctacaacaagagttttggaaggtggaaaaattcaatgaatctttgctactccaaaagtcaagagctaggtggatcaaggaaggggataacaattcaaaattatttcattccataatcaattggaagagaaggaaaaatgcagtgaagggaatacatgtggatgggatttggattgaggaaccaaatagggtgaaagatagggtgaaaaatactttgaaaatagatttttggaagcaaatattgaaagaccaaagcttgatggagttaactttcaacaaatcaataatgacaataattgcatgctcttgggggactttgggatggaggagccatacacaagaattcaaatgctacaagggtcttcgacaaggagattcattggctccatttctattccttgtggtggttgagggcttgagtggtttaatgagagaagcaaaggcaaaggatttgtttagtggtaacaaagtggggggtgggggggtattatgttgtgagcatgctacaatatgttga

SEQ ID NO: 28873 - DNA, 255 bp, Glycine max
  Peptide Sequence Number=SeqID_145651
atggaattggacattggagtcactcactcagatctgactcttgcagagtcttggtttgcatctgacacatctactgggtaccttgaagatgctattgcaggttggggtatttggtgcaagcaacacaacataccatcctattctcaagatcaaaagaaaagccaatatttggttgatcaggaggacttattgccaacattttcttcaacttcccaaatccttcatgttcagtttatctctacccatttgctttag

SEQ ID NO: 28874 - DNA, 225 bp, Glycine max
  Peptide Sequence Number=SeqID_145652
atgcttccaccgcaaggcagcttcttcctcctccgtctctgcgttatagttgtcacgccgtcgccattgtcagtttccattggctccgttcaggctatctacaccattgtcgtgcttttccgttgtcgagagtcacgtgcggcaatggaggtagaagaagtgtttgttgagaatgagaggaatacaatgttgtacaaaactattaaccctaatgattttgattaa

SEQ ID NO: 28875 - DNA, 1794 bp, Glycine max
  Peptide Sequence Number=SeqID_145653
atgaatgctttgatgtttcagcccaatacagcatcttattatccacgtttggatgtcccacaaatcaaggcatgcaagagcatgcgagaattgaagcaagtgcatgcgtttttggtcaaaacaggacaaacccatgacaatgcaatagcaacagagattctcaggctcagtgccacctctgattttcgtgatattgggtatgccctctcggtgttcgaccaattgcctgaacgaaattgctttgcttggaacactgtcataagggcacttgctgaaacccaagataggcacttggatgccttgttggttttctgtcaaatgctgtctgaggcaacggtggagcctaaccagttcactttcccgtcagtgttgaaggcctgtgcggtcatggccaggttggcagaaggaaagcaggttcatgggttgcttcttaagtttggattggtggatgatgagtttgttgtcactaatttgctaagaatgtatgtgatgtgtgggagtatggaggatgctaatgttttgttttatcggaatgttgagggtgttgatgatgtgaggaacttggtgagagatgagagggggagagagtttaatgtggttttatgcaatgtgatggttgatgggtatgcaagagttgggaaccttaaggctgctagggagttgtttgacaggatggctcaaaggagtgtggtttcttggaatgtgatgatttctgggtatgctcaaaatgggttttataaggaggccattgagatttttcataggatgatgcagatgggagacgtgttgccgaaccgggtgactttggtcagtgtgctgcctgcgatttcgcgtcttggagtgctggagttggggaaatgggtgcatttgtacgcggagaagaataagattcggattgatgatgtgcttggctcggctctggttgatatgtatgccaagtgtgggagcatagagaaggcaattcaggtctttgagaggctgcctcaaaataatgttataacatggaatgctgttattggtggtcttgccatgcatggtaaagccaatgatatctttaattatttgtcgaggatggaaaaatgtggaatatcccctagtgatgttacttacatagccatcttgagtgcttgtagccatgcaggtttagtggacgagggaagatcattttttaatgacatggttaatagcgttggattaaagcctaaaatagaacactatggatgcatggttgacctcctgggtcgtgctggttatcttgaagaagcagaagagcttatattgaacatgccaatgaaaccggatgatgtcatatggaaggccttgcttggtgcttctaagatgcataaaaatatcaaaattggtatgcgtgctgcagaggttttaatgcaaatggctcctcatgatagtggggcatatgtggctctctccaacatgtatgcctcatcagggaattgggatggagttgcggcggtgaggttaatgatgaaagatatggacataaggaaagaccctggatgtagttggattgaaatcgatggtgttattcatgagttccttgttgaagatgattcccattctagagccaaagacatacactcaatgttggaggaaatttcaaacaagttgagcttggaaggtcacatgccagacaccacgcaagtgttgctcaagatggatgagaaacataaagaaagtgtgctgcactaccacagtgagaagattgctgttgcttttggcttaattagtacacctccaaagacaccactttgcattgaagcgttttcaccattttga

SEQ ID NO: 28876 - DNA, 447 bp, Glycine max
  Peptide Sequence Number=SeqID_145654
atgtactcaaagacaagttctatgacaagactaaagcttcaagaaggtctccacccaaagaaagctccaccaaggtctccaccaaaagaaaatactaagccacaagaattcaaactccacacccaagaaagagctgtcaagcgtgcaatgttcaattatgctgtgacaacaaaattctatatcatggagctgcaaaagaaacaagaggagaagctgcaaaagttgattgaagaggaagaggttcgtttgctgaggaaggaaatggttccaagagctcaattgatgccttattttgataagccattcctcccacaaaggtcaagcaggggtgttccaagagaatcatgcctccacatgatgagcagcaagtgctggagctgcagcattgccaatgaaatgtacaacttgcaccactatggtcatcaagctctcaagcccattaagtag

SEQ ID NO: 28877 - DNA, 1425 bp, Glycine max
  Peptide Sequence Number=SeqID_145655
atgaagcttgacgtagatgtcttgagatatctctccaaagatgattttagggttctcactgctgttgaattgggcatgcggaatcatgaaatcgtacccactgaactcatagaccgaattgcgcgtctcaagcatggaggcacgtacaaggttttgaaaaacttgctcaagcataagttgttgcaccacgactcctctaaatatgatggattccgccttacctaccttggttatgattttcttgccattaagactatggtgaacaaaggagtgtttgtggctgttggacgtcagattggcgttggaaaggaatctgatatatttgaggttgcccgtgaagacggaacagttctagctatgaagttgcataggcttggtagagtctcttttagagctgtcaaatctaagcgtgactacttgagacatcgcagtagttataactggctctatttgtctcgccttgctgcgcttaaagaatttgctttcatgaaggctttggaaacacatggattccctgttccaaatgcaatagaaaacaatagacattgtgtagtcatgtcactcgtccagggttaccctcttgttcaggttaagcagttacagaatccagagacagtttttgaggcaattcttggtcaggttgttcggttggcagaacatggtctcattcattgtgatttcaatgaatttaacatcatgattgatgatgatgaaaaaattacaatgattgattttccacaaatggtatctgtgtcacaccgtaatgcgcagatgttcaatctttcttttcaagaaagcatagatgataatgatgattctgatgaagggagagatgaagctggaaaaccctgtttttcttcaatagaaagaagtgctggttttctagatagggaacttgctgccagtggctttactagaaagaatgaagaagatattcaaaggattgtcagcctcaaaggtcttcaaatctatgtgcagttcattgaaggcggggcagaaagtgatacaaattcagatagtgaaggggttgacttagtggaagacctgaatgaagcagacactgtagatggtgattcttcacatttgtcagtggaagagctgaatgaagcagacactgtagatgatgattcttcacatttgttagaacagaatgagggatacaaatgtcaagggaaagaggagagttgtgaagcacgtgaaagcagtggatctgaaaaggaagttgtaagtgacaatgaggaaaacaatgaagaagcattgcaaagtgaagctgaactcgttaagaacttgagtaagcaaagacgatgcgccatagcgaaagctcataagggacggaagactgttgctgccagaaattcctacaaagacaaaggtggtaggtcatctcacaattctaaaatccagaaacagttgagcagctggtga

SEQ ID NO: 28878 - DNA, 288 bp, Glycine max
  Peptide Sequence Number=SeqID_145656
atgtctcacacatacaacattgtccacacaaacatcaaactaagaaccaccatcgacagggtcagcatgtgcctaagggactacttcatgtacatggtgtacccaactataagcagctatgctgcaagaaattatgcaaaggccctcaatgccaccttgttcttttcaagtgcaacctacaacatcaatgtgaacaagatcttcaagttcatcactgctaaactctttgacctaccatggacagtggagaggaatctaactgttggggaacccatcattgacttctaa

SEQ ID NO: 28879 - DNA, 198 bp, Glycine max
  Peptide Sequence Number=SeqID_145657
atgtttgatctaacaagtcgatgcacatcaaacagtgtcgtggaatggtacaaagaagccaggaaatggaatcaaacgacaattccagtgttgattggaaccaagtttgatgatttcattcagctctgtattgatttgcaatggaccatagccaatgaggtaaggattccaatatttaacatcaaaattgcactttaa

SEQ ID NO: 28880 - DNA, 303 bp, Glycine max
  Peptide Sequence Number=SeqID_145658
atggccaacaatggtgatgttgttaagatcaatattgaggagatgctggagggggcaagggcacccataactactgaatgttgcatctacaaagtgtcatttagtaaccgaatacacaacgaagaagcctacaccccaaaggttgtttctattggcccttttcacaatgaccaccctcgcctccaagacatggagaaacacaaactcttttactccaaggcttttctcaaacaaactcaaacaactttggacggtttgatcgacaagattcaagagatggagcctgagttttgtcgttgttaa

SEQ ID NO: 28881 - DNA, 1269 bp, Glycine max
  Peptide Sequence Number=SeqID_145659
atgtttgtgaaaagcaggatatggaccatacctgaaaacaacaaaggactagcacgaccaacagcctcagaagctgaaaaattgagtttagtttctgaaggttgcaattcgagaattttgcaagagatggaaatgaagcgcgataaagacatttatggtgaagttttcaagagtcataattccatacaaacattggacaagactatttcgaacttagagatggaattggctgctgctagggtaactcaggaatctctacgaagtggtgctcctatttcagatgatataaggttgagtgaatcttcttcgggtaagagaaagtaccttatggtcgttggtattaacactgcattcagcagcaggaaaagaagggactcggttcgagccacttggatgccacaaggtgagaaaagaaagaagctagaggagaagggcattatcatgcgctttgtaattggacacagtgctacatcaggtggtattctagacagagctattgaagcagaggacagaaagcatggagatttcttgaggctgaatcatgtggaaggataccttgaattgtcagcaaagacaaaaacctactttgccactgctgtgaacttatgggatgctgatttctatgtcaaagttgatgatgatgttcattgtcatattctttcggtttcagcaacactgggacaaactctagttaggcatcgatcaaaaccacggatatacattggatgcatgaaatctgggcctgtcctatcccaaaaaggggtaaggtaccatgaacctgagtactggaagtttggagaggctggaaacagatacttccgtcatgccacaggacagttgtatgccatttcaaacgatttggctacatacatatcaattaaccagaatgttcttcacaagtatgccaacgaggatgtgtcactaggatcctggtttattggacttgatgtggagcatatagatgatcgaagactttgttgtggcactcctcctgattgtgagtggaaggcccaagcagggaacatttgtgttgcatcatttgattggagctgcagtggaatttgcaggtctgctgagaggattaaagaggtacataggaggtgtggagaggttttgtgcagtgtagagaaaaatgtcattttacacgagaaaagcaggagtgaaagagagtgtgtgagagagaaatatgataatgcttgccccatggaccttcaacattttaagaggagattgaccatgggagcaagagatcgatatatatatatatag

SEQ ID NO: 28882 - DNA, 147 bp, Glycine max
  Peptide Sequence Number=SeqID_145660
atggagaaatcaggctctaacagtcctaaatctgctttgaagtttgtgaagaccacatctcagtctgcagctcaatggagcagtactaattcaagaggaatggtgagattatgcctagctttaccctcacatatatataagccttaa

SEQ ID NO: 28883 - DNA, 1263 bp, Glycine max
  Peptide Sequence Number=SeqID_145661
atggcatacaaccgtgatgttgttaggatcaacattgaggcgatgctggagggggcaagggcactcgtaactactgaaactactaagtgttgcatctacaaagtgccgtttagtatccgaagacacaacgaagaagcctacaccccaaaggttgtttctattggcccttttcaccacggccttcctcgcctccaagacatggagaatcacaaactcttctactccatggcttttctcaaacgaactcaaacaactgtggacggttttatccgcaagattgaagagatggagcccgaatttcgtcgctgttattcacacactcttgagttcagcaaggagcaactcgtcaaaataatatttgtggattgtgcttttatacttgagctcttctacagaggacatgatccagtattgaaagaggatgacatgtgtctttctatccctcctttgagggataacataccgtatgatttgttgttacttgagaaccaggttcctttttttgttcttgagagtctctttaatctgtccttcccttcaccgggtgctgacttccgttcatttcttgagcttacgtttcacttttttgcacatttcaatatatcatgcttaaactttaacaatattagcagaataaggcacttcacagatctgataagaacttttcacttgcaagatcctctgccgcctaagactactggtaacacaattaaacatcttcctagtgtcactgagttatcagaagcaggattgaggtttaaggttcttaaaaatgagtcttgtttactaaagttagacttttcgggatgggttctcgaaatcccgcagttgatagtgcacgatcggactgaaactttgtttcgcaatttggtggcattggagcagtgtctctatcctttgcaatcttacattacggactacgttgattttttggacttccttgtaaacaccaacagagatgtggatatactagttcgagagagggtctttcttaattggctaggggacactgattctgtggctaccatgattaatggccttatgaaagatatttcggtacacaatatcaggtcccaatactttgatgtctgtgaaaagttgaatgattttcataaaaatccttggcgtaagcgaaagtcggctctgaggcgagattattgtagaagtccttggcaaactgctgcttccactgctgcgattattcttctcattctctcttttgttcaaacagtttgttctatcttgcaagtaatacatcaatag

SEQ ID NO: 28884 - DNA, 309 bp, Glycine max
  Peptide Sequence Number=SeqID_145662
atgacgaaaatctccgcgtgtcaacgggcttgtcggccgcaattgacgaagggcgcagaagacgacgttagtctctgcgtgctatcaggcttttcgtcttacagacaacaaaaaagaatgtttatacggataaccactcggacatcaaaaaagaatgtttatacggataaccactcgggtatttccgcccgtcaacgtgactcaaatgtcaatatgacagatcttgtgagcgcggaagatgacgtaaatctccgcgtgtcaacgggcttgtcggccgcgattgacgaagggcgcagaagacgacgttag

SEQ ID NO: 28885 - DNA, 267 bp, Glycine max
  Peptide Sequence Number=SeqID_145663
atggcttgcttggatcagcagcattctggaaaggagggacaagttgttgttgttatggaggacttgctcatctcagatttggatgatttctccaacctgtattgtatctgttgcttgaaagatcataattattccgttgttgttggttttgttgctgagggggtctattataaatgtttgcaacataagcttcagaagaacatagaccacagactcttgcaacaggtgcagatttctgattcatggcaagctgagttactaggttga

SEQ ID NO: 28886 - DNA, 855 bp, Glycine max
  Peptide Sequence Number=SeqID_145664
atgttactctgtaaggataagtttatgtggaatcctgaagttcagaccgcgttccaacacttgaaaaccttaatgactcaggcaccaatcctcgcatctccagacttcactttgccctttactttggaaacagatgcttccggcacaaccatcgacgttgtcctactccagaagtcgcggtccatcgcgttcttcagtaagcaactatgtcccaagttgcagagagcatctacttacttctgcgagttgcatgctattaccaccgccgtacaccaccgaagcttaaaggagttgatgtcacaggtcattcaaactcccgagcaacagcgttacctggccaagcttcttgggtatgactataccatccaatacaaacctaatgcgacaaatgtggttgtggatgctttgtctagggttccggctcaaccatctcttatgcttttatcggtcccacataatctcttcatggaacagctccgacaatcttgttcgcaagataccgcgtaccaggaattgctccacgaggtcctacgttgtccagtggaccacccaagattcacagttaagcaaaatatgcttctttttcgggataagctatggcttcctgccggtcatgatctttcgaaggtgttgctggaggaatgtcatctcacaccgttgggcggccatatgggtgttacgaaaacactccatcgcattcaacaacatttatgttggcccaagatatccgcccatatattgctcatgacttatccatggattttattacgggtctttcggcttctcaaggatacaccaccatcatggtggttgtcgaccattactccaagggaacccacctcgggcccttactaa

SEQ ID NO: 28887 - DNA, 450 bp, Glycine max
  Peptide Sequence Number=SeqID_145665
atgaaccttgagaagggatacatgaaatattgggtggattttggaagttggtggcagctgcaagcggcggacataaacccaatcaccaatgttgaaggtgaggtcccgacggtgcgaatcggctatacgtttcatcgaatcctgatacttttggagcctgcatgtgaggcttcaacagtggaagttccggcagaatacaaaggaagagccggtggtggtttaccatacataacctcaaatggtgagaagccgataccactatggacagaggatgcggttgataacctctgtttgaccgtctgtttgcggatggtaagccgtgctgaatcgaagcttggtaccacttatgtgaaagagctcatgccacaaaccactgatgaaaatgggatccctgtcagaaacgatactacgcgcaaaattgtggtgcttgcaaacagtatccatgaataa

SEQ ID NO: 28888 - DNA, 187 bp, Glycine max
  Peptide Sequence Number=SeqID_145666
atggctagggcggatcatatctgcttccaacatggcggcaacctgcctctcaagttcatacttttgggaatagaggtgggagctgggtgggttcctagaatatacttgtttatcgttgaagaagacgatctagggaggggctgggatacatgggaacgtccacatgaagaaatatgggctgatcctc

SEQ ID NO: 28889 - DNA, 369 bp, Glycine max
  Peptide Sequence Number=SeqID_145667
atgcagtcattgcctggattttctttgggtccggtgcgacgccctgcggggacacaatgtgtccgagatagttcagttgttgttcgacaaaggtacattttgaacggcggaggggctgtagacgaggatttcgtcgaaaaggacagccgcaaacttcctcagaaaaggccggagaaggccgttcatggtggcctggaaggtagagggtgcattggtcagaccgaagggtatcaccttgaattcatagtgaccatgatgggtgcggaacgccgtttttgggatgtcatcttcgtgcattcgaatttgatggaacccttaatggagatccaacttcgaaaaccaagaggcgtttccaatctcatccagtaa

SEQ ID NO: 28890 - DNA, 198 bp, Glycine max
  Peptide Sequence Number=SeqID_145668
atggatagtgcaagctctaatggccgacctgatacgccaattttacctactgctgaccagcgtgctttggaggaagcagaagatttgagtactcgtggggtagatgttttggttcccagggttaattatagagatgtgagaagacaaaagataccgaatctaggtggagaagaaaagttggtggcaagtaacacttga

SEQ ID NO: 28891 - DNA, 318 bp, Glycine max
  Peptide Sequence Number=SeqID_145669
atgcaagaaaactttaagcatcaaaaaccgcaacagattggaataatagaaaacacagaagacgaggagggtaaacgaagcgcatcaacgtcggagcaacaaagaaaatgtcgtttactcatcaaaatcaaagctttactacggtggaaggaagccagtggtgagataagcaagagcatgagcagcaaaggagaaacgacaccaacacattgtcttccatgtttttttctcacaggagagaaaataaacacgaaaccaagcaacatggatgcaactggaatgcgaaatggcagtgtacccgaaaatgcaaaatggtaa

SEQ ID NO: 28892 - DNA, 1257 bp, Glycine max
  Peptide Sequence Number=SeqID_145670
atggttgagactcaaaacccacttcccaaaaccactcctttccccaacaagaacaggttggatttcaggacttggtctattgctggttttgattatggaaactttgaagggcctcagtctgtgcttgaggctgctgcagtgttgacagcaatcattgttgtgcatgagagtggccacttccttgctgcttctctccaaggaatccatgtgagtaagtttgctgttggttttggtccagttttagcaaagtttaacgccaaaaatgttgaatattccatcagggctttcccccttggtggctttgtggggttccctgataatgatccagagagtgatatccctgttgatgatgaaaatttgcttaagaacagaccaatattggatagggtgattgtggtttcagctggtgttgttgctaacatcatttttgcatttgttattatctttgcacaagtcctgtttgttggtttgcctgagcaagaggtgtttcctggggtggttgtgcctgatgtcagacctttttcagctgcttcaagagatgggttggttcctggggatgtgatccttgaggtcaatggaagtgagtttccaaaaccaggtcctagtgctgtttctgaagttgttgatgccatcaagaggaaccccaagagatatgttttgctcaagattaaaaggggggagcagaattttgatataagggtcaccccagatgagaattttgatggaaccgggaaaattggagttcagctagcccctaatgttaagatagctaaggttaggccaaaaaatctggtgcaggctgtggagtttactgggcaagagttttggggtctggcatctaatgttttagatgggctaaagcagacttttttgaacttctcccagtcagctagtaaggtttcgggtcctgtagccatcattgctgttggtgcagaagtggcgcggtcgaatattgatggtctcttccagtttgctgcgatacttaatattaaccttgcggttataaaccttcttcctttgcctgctttggatggaggtacattggcattgatcctcattgaggctgctaggggtgggagaaagcttcctttggaagtggagcaaacgatcatgtcttctggaattatgcttgttataattctgggtgggcttcaaaaaaagtacttcatgattcttatcttcaatgctgttgcacaccagtgtcttagccggtggtatatctgtactagaggaggcaagatcattttaaacgattga

SEQ ID NO: 28893 - DNA, 109 bp, Glycine max
  Peptide Sequence Number=SeqID_145671
atggaagacaatgtgttggtgtcgtttctcctttgctgctcatgctcttgcttatctcaccactggcttccttccaccgtagctgcatacacgcataaacggacccttc

SEQ ID NO: 28894 - DNA, 1530 bp, Glycine max
  Peptide Sequence Number=SeqID_145672
atgctcaattatgtcactggctactatctctcacatccacatgcaaatgcaagaggtggttcccttaatgatccattgcttctgttaaagaatcctttgaaacaaaaattgtcattttcccatttctgcatttttggtttgggagaggagaaaccaagaattaagaaatgggttgctccaggggaggacccttatagattctacacttggaatgtcacatatggagacatttatccacttggtgttaaacaacagggtattttgataaactggcaatttccagggccacaaattgaggctgtgaccaatgacaacttgattatcaatgtatacaacagcttggacgaacctttcctcttatcttggaatggagtgctgcagaggagaaactcgtggcaggatggagtgtatggtaccaattgtccaattctaccagggcataacttcacttatgttcttcaagtgaaggatcagataggtagctacttctactacccttcccttgcttttcacaaggcagcaggaggttatggtggattcaaaattgctagtcgccccgggattccagtgccttttcctactccagcaggagatttcaccatattggcaggagactggtacaagagaaatcacacagatttgagggcaattttggatggtggaagtgaccttcccttccctgatgggattatcatcaatggtcgtggttccaatgcttacacattcacagttgatcaaggcaagacatacagattcaggatatcaaatgtagggctcaccacttccatcaactttagaatccaagggcataaaatgacaattgttgaggtggaagggacccacactctccaaaacgtttatgactcacttgatgttcatctggggcagacttactctgtgttggttactgctgatcaaccaccccaagactacctcattgtcgtcacgacacgattcacctcccaagtgttgaatgctacctccatttttcgttacagtaactctggtggaggtgttactggccttttcccttgggggccaactattcaagttgattggtctttaaaccaagctcgctctcttaggaggaatctgacagcaagtgggccaagacctaatccacaaggatcataccattatggtttgataaacacaactcgtacaattagacttcaaaattctggtccagttatcaatggcaaacagagatatgctgtcaatagtgtgtccttcatacctgctgatacaccacttaaactggctgattactacaagatccaaggggtgttctcccttggaagtatccctgactaccccactggtagtggtggctaccttcaaacttctgtcatggaagccgatttccgaggctttatagaggttgtgtttgagaacactgaagacactgtggagtcatggcacgttgatggccacagcttctttgtagtaggaatggatggagggcaatggtcatcagcaagcaggctaaattacaatttaagagatacagtttctcgttccacagttcag

SEQ ID NO: 28895 - DNA, 570 bp, Glycine max
  Peptide Sequence Number=SeqID_145673
atggagcttatactattccttttggctgatacttctggatatgggaggagagactatttagataatgacttgagggataaacttgacagaaggcatgtatctcctcgaagagagagatatgcacatgctgctttacctaatgattttgcacctgctgttttcctaatgttccatgaattaaaaattgcagaatacagtcctacaagatctttggagaaaaaaagtgacaggagatataggagaaaacaggatattactggccaaagtaaagtttctggaaatttgaaagtctcagatagagttcaagatcgagttaaagaaggaaaattgctttcctctggttctaggaataatcttgaggagaagctgaagaaagtagattcagatatcagcactcttcagaaccgaaaattccagctagagaaatgcatatttttgaaggtcttccttgatgagaatgttcaagaagtggatagtcttaattctagaattcgggaacttgaaggtcaattatccaaagaggatgaggagtgcaaaaggtactggaatgtttcattatgcaaatgttga

SEQ ID NO: 28896 - DNA, 222 bp, Glycine max
  Peptide Sequence Number=SeqID_145674
atgctgcgcgcaccttccaaaccttttacagctctcgtcccatatagccatgttcctgtgtactatgcaccactcttgttttgctggggaggttgttcttgtggtccattgtatcagtcagtagccccagcatcagtgaaaaaggtggtttttgataacaacattagcttcttgtccttgatctatcggatcaaagttcagtgtccctcaagaaccaaatag

SEQ ID NO: 28897 - DNA, 309 bp, Glycine max
  Peptide Sequence Number=SeqID_145675
atgtataaacagaatcataaggactttctcaggcttgtagtgaggcttggctacaaaaattcattggtttttctaggattcaaagcttataaaaggagcaaaggatacaattatcttgcaagagattcatgcaaagattattactcccagctagccattcactcacagagtaacgtcacactcttaccggttttggttcaagcttttctttcacaatcaatttgtctactgactaacaattctactgcatatttgttcaaactcatgaaaagaaacacaaacttcatcctaatcatgcattcaatctaa

SEQ ID NO: 28898 - DNA, 351 bp, Glycine max
  Peptide Sequence Number=SeqID_145676
atggttgatgttagtacatgggaagggagaaatatcgaaagatgcaagatggttggtttgcattacaacattgagagggtaaaaggttgttggacaactttggttgtcctctttgattctaggagaatatttgagataaatgttacaggggaatcccgaagaaaagaccagtatctgtgttttgctgaaaatttttgcgcttgttattcgttcttctatgatgttgtcaacagaggagaacaactttgttgtaaacatcaactagctgcaagacttgctgcatctttgggatcttatgttgaagttaaggtgtctgatgaggagctagctgtgctactgtccaaagtatag

SEQ ID NO: 28899 - DNA, 837 bp, Glycine max
  Peptide Sequence Number=SeqID_145677
atgatgaagacttcggctcgattttacaataaagggatattggtattcagtgaagtgaagttaacatttgagatacagaacaagagaaaagcaaatttgattggtggagaccaagaagatgagaatgtcgcagccttgtgcttggagagggctcctcctttccacaggtggtattttgagacaatagatgggtatgtttacttcacaattgttgataaaggttttggtaacccggttgttcttcagtttctggagcatgttagagacgagtttaaaaagctgtctagaaaaggttcaagaggaattttgccaaacatgaattcaatttacattcaggaaaaactggttcctgtcatccgcggcctgatcacttcattggagagtgtttcacatggtagtagtaattggagagatgaaacttccttgtcttttcaagtggatctgtctccgtcaccaagtaatttgaatggacaaattgaaggtgctagttcaacaaaagccccgttattgggaaaatctaacaagccagataagaagaaagtaaaagatcatgtgattgctatgagagacgttgagttggaggagcatcggaaatctacagatagaggagcaagggtcgattcaggcaatctggatggtgtaagccaaggtggtgcaggtgcatcagtctctttgcaaaaggatatgggttcaatgaggatgagatcagcccctcaaaacattcgtaagaaatggtggcgccaagtacgcattgtcctagctattgatgcagctgtgtgtatattattatttatcatctggttagtaatatgtcgtggtatatcctgcattcgatag

SEQ ID NO: 28900 - DNA, 750 bp, Glycine max
  Peptide Sequence Number=SeqID_145678
atgggatacagcggtggaaaaggcattgatattctttttattgcacttatcttgctattattatctaaccattcgcttacccgctacggcctgattattccgtttattctgctgtgcgcgctgtatgcgccggtcggggccatttacgggtctccgtcagcggccgtggtgtctgccctgctgcaaaccaacagtacagaagcgagtgagttcctgcataccctcccagccaggtttatttggcgacaagcactaccaaaaaaaatcatattgcctttgctggcgttatttgcggttatcgtcatcaccagaatattcagcggtggcttggttaagcttaaattacctgacttctttttatccacctactccgcttacgatcaatatcaacagcaaattgatgaattaaacaccggcgtttcagaaccgtactcttggtcgatcacctctggcgcaccgaagaatgaaaactatgtcattatcgtcggcgaaagtatgcgcagggatcatatgtccttatttggttatccggtgtccactacaccgtttctggataatgccaagggacggttttacagtaattatatttccaccgcgccgaatacattcgaatccctcccccgcacgctggctttaagcaacggccacagcattgccctcggagataatatcatcaccctggcaaaagccgccggcctcaatacccactggctgtccaatcagggcatgttcgggcaattcgatacgccg

SEQ ID NO: 28901 - DNA, 246 bp, Glycine max
  Peptide Sequence Number=SeqID_145679
atggctgagaagaaggaaatgattccgcaacaatttgacatcgatgccaaatgggacgcctgcattgatctcaccgtccgtcgcttcgtctactccgcaaccgccgggagtcctgtgactcgatgggcatctattgcttttggtgctggagttggaattggatctgcatatgcagaatgttctcgtctgttcgatggacctccaacaaatttacccttacctaaggtctccgaaactgctactcag

SEQ ID NO: 28902 - DNA, 1123 bp, Glycine max
  Peptide Sequence Number=SeqID_145680
gcttagagatggtgagatgcactctaggctaaagggtgttgatattatgttgaatgaggtagtatgggtagggattgttggttttcttacatatggtatgaaagtgattgaaggattaaatggatttgacaaggttgagatttacaaggaatgtttaacgaaaagaaatcatgctacacttaatactaaagatcacactctgattgatgcaatgacgcttggaatgaagatatgttcgacttcttgtgtagtagataatatgaagactagaaggctattgaacaatcaaattccttatgcagtctttttcacaaaggtcatggagcattatagaatggacttcacaaatgagaagttcaagattcttataagcactaataaggtcagcaacgcattgatgtttcatatggctcttattgagagaaacagtcattggttctataaggatgaggcattgaggttgaaggttaaggttggcagaagccttcagtctaagtctagtgaggaaaaggaaaccttagaaagggagggggaaaagaaggaacaaatttctaaggaaaataaaaaggatgaggaagatcattctgagcctcagaataaggtgttagcagctgacaaaggtggtcaacttgctcagaatgaagaagctgaaattcaaaagaacattgtgggctttgaacctatacaagaggatctcaatgtggagatcattgttgatgcattagctaagctaaggaccattgctgctactgcaaaaacttctcagattgcaccaaaagttacagttagtaagagaactcatgttaggtctgtgaaggattccttgttctacattgagaacatgcataatcttttcatctcttctatctttgacacttatctcaaaattgcttgtggccttggtcccttacacggggaacccttaacgtttaccattcctttccctcaatccccttttgagttagctattgcagatccttctaaggttcaggaggaggttagacctgccttaatccttaaagtttcccatttgcagcacaagcctccaccaccaccaagagctaccaccatgccttcaccttcatcatccttagaaaagtattctcctaatgagcatgattga

SEQ ID NO: 28903 - DNA, 201 bp, Glycine max
  Peptide Sequence Number=SeqID_145681
atggcacgtagagacaaattattgtcatccaggggtagcgagtctggtgataaacgcgcagagacaaattatggtcattctgcaccctttgtcatccaggggcagcgagtcgggtggggcagcgagtcgggtgataaacgcgcagagacaaattatggtcattctgcgccctttgtcatccaagggcagcgagtcgggtga

SEQ ID NO: 28904 - DNA, 489 bp, Glycine max
  Peptide Sequence Number=SeqID_145682
atggccacaaggatggaggccatgatgagcataaaggagataatggaggtcaatgcggttgcaatagccgttaccaacaccattgttgaggtggacctgaccccctcatatggcctcaaccaaataaatcatccaacctcagatatggtaggtctggaaggcaaagagttgggaggtgcgggcggccctcatttagtgcgaaaaacaggcataccttcccaccatatggcttgcctcccaattatatgccacccaatgtggcgtacactcccaatgagaatgtcaatagctccactcctatactcattgagagccaacaacctcaatctgatcatgcacattttcgcaacctacccttcggcgggagggcgacgcatgactcgtgggatcatcttccaagaaagaaatatgcgcggagtcgccaccaacgtttatttgaggaaaacatcggaaaaaccggaaaagacgtggtctacgaactttaagtga

SEQ ID NO: 28905 - DNA, 174 bp, Glycine max
  Peptide Sequence Number=SeqID_145683
atggagaggtggtacaactacttgttgtcagtgaccccttcctcgtcaaagagagaagcgatagatggggttggagttgtcggggggaaggaacatgtcgaggctagtaggcttgaccgaagagaagtgagcgaagaacacatagacgttgtagaacagaacaaattatgttga

SEQ ID NO: 28906 - DNA, 387 bp, Glycine max
  Peptide Sequence Number=SeqID_145684
atgggggagagattaacttacaccaagaggtttgtactgttcctctctctgatgattgatagactgcaccattacataagagagcttcggtcactcaggaagaccatggaagccattaagaaacaaagccgaagttttgaagatggtaaaaatggcaatttagaggaacataaagcattgaatgaagaaattaccacattgaagtctaaaattaagaaactagaatctgaatgtgaggcaaaaggaaatcaagctaagactttggaaactgaagtagaggctcttaaaaagcaatccgaagggttccttatggaatatgatcgcctcttggaagacaatcagagtcttaggagtcagttgcaggccattgagcagaaccctttgtaa

SEQ ID NO: 28907 - DNA, 123 bp, Glycine max
  Peptide Sequence Number=SeqID_145685
atgaagctgtctaatagttttccatctatcaaatttgtggttgcaaagaaggtcaatagcctttactccattgtcagtggtgcaaacatagttgcaaagttattaagtgtggaaaaggtttga

SEQ ID NO: 28908 - DNA, 546 bp, Glycine max
  Peptide Sequence Number=SeqID_145686
atggcaccatcactttcaacaccaatgaaattcttggccctctcaatgttttttatatccatcatttatcaagataatgctcaatttcctacacctaaccctaatcaaacaaccatggtgttctacctacaagacctagcagcagggcctaatgccacagttgttgccccagtggctggcatcaatggaagagtttggagcttcaccacatttggatccatatttgtggtggatttcccagtcacgctgagcataagcccagcctctgagctggtgggccaggcccaaggcctgctcatagcctcagcccttgatggggctagtgtgaatgttgccctttcaattgtgttcaacaatttgcagtacaatggaagcaccttggagctccaaggtattagccgtcggcatgagaattatagagaggtctctgttgtgtctggcactggcaagttccgctttgcaagaggctatgctgtgttggaaactgcattttttgatatctcacgctccacccttcgcttgactattactatacaaactaattga

SEQ ID NO: 28909 - DNA, 153 bp, Glycine max
  Peptide Sequence Number=SeqID_145687
atgatgatggatatcaatatcataaccattgagaggaacacggatttcattggtgttgaaaatgatggtgtcattttcgatctttttgagggtgctacagaatctttgagatgtgaagagggacatcccatgccatcttcatcaacaacttga

SEQ ID NO: 28910 - DNA, 228 bp, Glycine max
  Peptide Sequence Number=SeqID_145688
atggaaggatctggcagctcaagtagcgcccctaataatggagagggagatgataacaatgatagtggacacgttaccagtgagaagatggtgggttacatgtcttcaagctttgcagatttagtgtttgctggcgagaggatcaaagtgggtctgagaagagacaaatttgattatactgctttgatgaataggcagcctggggcaaatggagagaataagaaggag

SEQ ID NO: 28911 - DNA, 348 bp, Glycine max
  Peptide Sequence Number=SeqID_145689
atgggtattcggtgctcaaaactcatccctgctgtgtcgattcacaacttaaggcatctattattgaaactccagatgctggtggaaattgaggatagtaatgaggtcagtaactggcctacattccgtgaatatacacttgagcaactcaagaatgctacatctggttttgttgtcgagaacattgtatctgaacatggacagaaggatccaactgtagtttataaaggaaagctggagaatcaaatgaggattgatgttaagaggtttaataagaatgcttggccacatgctctacagtttttggtaaattcacctgcctctattggttacttaccttgctcttaa

SEQ ID NO: 28912 - DNA, 492 bp, Glycine max
  Peptide Sequence Number=SeqID_145690
atgggttggaaagagagtgcactttgcatgttttctttgggtattacacattatttggtgcttttcgtgacactctatcagagattggcagggaacaatagtgtcccttcaatgctgcgtccagtgttcttcttgttctttgcagcacatagtatggcaagcttggcttggaactccatttgtggcaagtttgacaccacatgcaagatgctgttcttcctctctttcttccttttcatgtccctggtttcaaggcctctcctatttaagaagtcgatgaagaagttcaatgtggcatggtgggcttattcttttcctctgacggctttggcactggcttcagcagagtatgaacatgaagttaagggagtcatggctcatgtgattatgtttgtcttgtcatcggtctcagttttggtgtctctcattttaatggttatcactgctctcaacattagcaagcacgtccttagtcgctcgcaaccatcttag

SEQ ID NO: 28913 - DNA, 333 bp, Glycine max
  Peptide Sequence Number=SeqID_145691
atgaaaggttttgcttctcttgaagcaaaaatgaaattcagagctccttgggtgtcacctactgctattaatgaaacaaagaactctactgcatcggttattgactctgataattggggcagtgtccctcctcttaatagccatattggatatagttgtgccacaagcatttctaaatttacaaagtctccatgtcatgagaagaaaatccttgaacatacagtactacaacagcccaggcagccaattcataaactgtgtttgtggttgcatgggcacacaaatgtcaaagacacagctaaaggaaaaactagggaggaggaaacaacaaag

SEQ ID NO: 28914 - DNA, 1530 bp, Glycine max
  Peptide Sequence Number=SeqID_145692
atggcttctatcaaacaaggtgatcaaagcattaccgattacttcacaaaattgagaattattttggatgaattggaaagttacaggataatgcagtttcttagaggcttaaatgatcaattcaatactatgagatccaatgtattaatgatggacccattaccaaacatagccaaggttttctcatatgttgttcagcaggaaagacaaatcaatagcaatgaattaacaggaagcatgagtcttatcaatgcagcaggcagcaattcatcgaatactaggccttcatgtacctattgtgggaaagataatcacactattgatagatgctataggaagaatggtccacctcagaattatccttcaaaagggggaaagagaactcaaagcaattccgacaaaggaaactttggagcaaaaggaaacaaggtctgcacacactatggtctttctaaccatactatagatgattgctacaagaagcatgggtacccacccggacacaaattttacaaggtacaaaatccaaacatcaacaatgtcaatactataagggaagaaggtgatggttcacccttagatcaaaatcaagagacacaaaatgaagatgtaagattaactactcaacaatataaagccttgatgtcattgatgcaacagcaagctccagctcaaagcaattcacaaataaatcagattggtacagtcactaacaaaggtagtatattatctgttacttgtagtgttagcaagactagccaagatgagtggatccttgattctggagccacagatcatatcacagccttcccacatttgttttctttatgcaagaaaataaaacctgtaatggatatgaaccagcagaagattggtacagttgagatggtggaaggactctacagactcaagatgattcctatcaagtctaagtacaagtctgattttgctggttctagcatttccaatttttttgccttttcatgttttaaaccaaacaccaaaggattcattatgtttgatcttaaaaccaaggccatatctgtctctaggaatgtgatcttctatgaggattgttttcctttcattggtcaagacaaacctgatgctatcagtgtccttcctattccttcttctcatgccattgatcaacctaatgatgtctcattagaattaccatttgataatatcatgcctgtaccaaataatgctgattctgatcccttaactttagagcagtcctctaatacaaccagaagatctctgagacaaacacacaaaccaagtaagcataaggacttccatgtttcatactcatcttcaactatagctagttattttgcaagtacttgtctctatcctcttaattctgttctttcatatagaaaattgtctccttcttatcacaatattgttttatccattacacaaagtcttgaacctcggtcatataatgaagcttctaaggatcctgtctgggtagaggcaatgaatgcagagattaaggctttagaacttaatgatacttga

SEQ ID NO: 28915 - DNA, 156 bp, Glycine max
  Peptide Sequence Number=SeqID_145693
atggagtttttgccaatggttacactttgggagtatggagtggtgacattcgatggccagtggctacaggggcggcacataattttgttgagagggaagggccaagagagaacgggggcagtggctgttacccatttgacgcctaaaagaaagtga

SEQ ID NO: 28916 - DNA, 198 bp, Glycine max
  Peptide Sequence Number=SeqID_145694
atggtgactaaaggttggatctttaatggagaggaagaagaagagaatggaaactccctcgcgtttctctgcacccgtcggggccagttttcgaaagtaggcaatatatatatcaaaacgctcagaatgaaaccccgagcgtcgttcagagccattcaaaatgcaccgtttacaaaaattccgggtagaaatttctag

SEQ ID NO: 28917 - DNA, 363 bp, Glycine max
  Peptide Sequence Number=SeqID_145695
atgacatctaagaaaaggaagacaccctctacacctaggaagattttacctgaaaggaatgtcattctccatcactctgagttttatgcaaacctctatgaccctaaggataaaccacctaagcaggtgaaggtgagaggtcgtttagtgaaattcgatgcagacaccttgaacttattcttgaagaccccagtgatacttgaggagggggagaactttctagtttactccaggttctgtcattcgaagccagaaccacgggaactggtagctcgattatgcatccctggaaggggattcaagttaaatgctgatggactgccattaaagatcttacggaagaatctgaccatgcttggttag

SEQ ID NO: 28918 - DNA, 210 bp, Glycine max
  Peptide Sequence Number=SeqID_145696
atgaccataatttgtctccacatgtcatcgggctcgctgcctctggatgacaaaagggcgcaaaatgaccataatttgtctctgcgtgccatcggacacgattgtctccgaatggcgaaaagggtcagtatgacagagattgtggggtggccgacaaaagcgaggctcttgctcctacgtatcctcaatgaggaactcatacctatgtag

SEQ ID NO: 28919 - DNA, 342 bp, Glycine max
  Peptide Sequence Number=SeqID_145697
atgaccggacacgattggccacggattttgtttcctacttgcaggtacatggggacggatgcaagtggggatagggtcacgaccgaccgatcgttgcccttccccggcgctaaacaagcagagaacatcgctgcaagttttggtttgctttgtgtcgcaacctacccttcggcgggagggcgacgcgtggctcgcgggatgtgtgttccacgaaaggaatacgcgcggagtcgccaccaacgtttatttgaggaaaacgtcggaaaaaccagaaaagacacgatctacgaacttttaagtgaaaggctcgggagttgtatttacgcgcggggaaggtattag

SEQ ID NO: 28920 - DNA, 759 bp, Glycine max
  Peptide Sequence Number=SeqID_145698
atgtattcccacttaagtaaacactcaagaaattcattatgtgggaaatcaacagtgacaagggtatactcaaggaggatttttggcttccaacagggtccctataatcaacaaggacagtggaggacacaccctggcaaccagttcaacaaagaccagagtgggccttcaaacaggccaatccaacaagggcctaacatattccagaggactactaagctggaggagaccttgactcagtttatgcaggtaacaatgtcaaatcataaaagcactgagtcagcactgaagaaccttgaggtccagatgggacaactggccaagcagatagctgacaagtcatccaacaattttgtggcaaatacaaaacagaatcccaaggaggaatgtaaagctgtgatgacaaggagtaagaggtttgtggaagctgaggatgaagaaagtgtagtgcacaaggagaaagcggctgaaaagaaaggtgtggaagtaccatatcctgtggtaccttccaagaaggaaaaagatcgtcatttggcaagatttttagatattttcaggaaactggaaatagccatgcccttcggagaagctttgcagcagatgccactctactctaaattcttgaaggatatgttaacaaggaagcataaatatattcatcaggaaaacatcatagtggaaggaaattgcagtgctgtgatccagaagatccttccacccaagcataaagatcctggtagtgtaatattccttgtttaa

SEQ ID NO: 28921 - DNA, 702 bp, Glycine max
  Peptide Sequence Number=SeqID_145699
atgagactaaaagagtttgagagaacttcaattagatcagcatcaagtagtcctgtgatttatgcaccaccctctgttgataagcctcctctgcctagaaaaatcaagtcattcgaagctcatgcaactggagctggaaattgggatagcaagaaaggtctatatatgggcaatgtattagatgctggctatataggatcaacattagaaacaataaatccagtttacccaaggttatccgaggttcgcatgttggactttcatgcccttatgccaagtgatgggagttatacagaattgaagtttgtagagttgttggattctgtaattgctatggcaaaaactacttttgatagagtaagcatgcttgcccaccaaactggtaatctttcccaggttgggtcaagcctcgtggctgagcttgtagatatacaaattggtaatcttagtgtatctgagctggagtcaaataaatatgtccacgaagatatacaaactgtccagagcttggatggtgataatgcaggcttctatgcattcatggacctttctaaagggaaaatcagaaacaacttcgagactggagtcattgagcctgcaatgagcaaagtaaaaattattcagtttgcaactgaagctactatccttcgaattgatgacatgatcaagcttatcaaggatgaaagtcaaaatgaggaataa

SEQ ID NO: 28922 - DNA, 135 bp, Glycine max
  Peptide Sequence Number=SeqID_145700
atggaaataaaggcagaccccgaaccgagttcggaggaagggggaactgtggcagaagatgaagctctggaagccagagacacggtcgaagtaggtggtgatgggagcgagggttccaaaatcaaaaggggatag

SEQ ID NO: 28923 - DNA, 246 bp, Glycine max
  Peptide Sequence Number=SeqID_145701
atgcacattgaacgttgtagttgtagggatggcaaatataaaaaggcaactgtgggtctaggccaacaagctgctcttggtgtcacccctgacaaaggagatttgatttttgttgttcgtctcacgggcctcggcaacggcaacaacaacaacaacgatagtgagtcaccggtttcaggaagaaacaagaaacataatcccttctgggatgtttcgcacaaggttccctttattgctagctattag

SEQ ID NO: 28924 - DNA, 264 bp, Glycine max
  Peptide Sequence Number=SeqID_145702
atggtcactagaagtagagactacattacaaaaggaaacaaggcagtcacatcttctcaaacaagaaaaaaggcaatcacatcatcgcctaacacaagcttaacctacctaatcagaccaatgtctttgttgccgacgttggatcgaaagccttgctggtggtggaacaggggtgttgcgtggaatagaatcaagcaggggtgctgcgaaagccttgcagggaaggttgaactcgtcgaaaggaaaaaagaggctgtggaatag

SEQ ID NO: 28925 - DNA, 456 bp, Glycine max
  Peptide Sequence Number=SeqID_145703
tgaaattgttgggaagtttgattggaggagagaagaagacttaaggtgtgggtgggatgaagaagacttaagcaccttcgtggcacctcgacccaaacagcagctccgcttcacctcgacatcagcgtgttgccaccagcatcacagtgtcgttgtgtgggggcaacgctctgatatccacaaccttccaccaccatcaaaaaggagtagcaccaagaatgtcgccatattgaactcatcaagaaggaaaagcatcgcgatggtgtttggactcggtgatgcaggggtggttttctgggggccacaaggctgggtgttagggttgttggatgtagatttagccggggcaggcgtggaggtgttccatggtgatgatggctgcacgagttcagatctagacggaggtgacaagttaggagagaaaaaggtgattggaagagggaagggtaaaaaaag

SEQ ID NO: 28926 - DNA, 558 bp, Glycine max
  Peptide Sequence Number=SeqID_145704
atggtcagggtggaaactctaaatcatctatttttcttcatttaccactattatcacattgtggatattctagaagctcagtccatatgtcaatcattgtcatatggccagtcattgaataaggaggccctagctatacaaaaccaacctttgggttggggagggtatgctctaaaatgcaaacttcaaaacctaaaacatagactaaaatcctggagtagagatatctgtggagatctaggcagcaaggtgaagcaaactcagaataggtcactgcaaggaaggcatagtattttttatatgtacggaagacttaatgccccacgacactttgggaatgataatagaaattatttgccatcatctgtgtttatggaacaaacaccttatgaaatcagtgctcatggctcttcaagattacacccgacagcactcttcaatagtaaaatgatgataagatcaagttcagggtgggacaaagatttatataattgtcagtcgtatcaacgtagtttctgcagtcctaacctcactgggcacgcgaagtttgatgctgag

SEQ ID NO: 28927 - DNA, 285 bp, Glycine max
  Peptide Sequence Number=SeqID_145705
atgtgttggaggggactgattgttgttgatggtgaaacttggatacttgataccgaccatgagagagatggtgtttggtgggccctcagtctagtgttggaggtttttgtggtggctaacaccaaatgggctatagaatggataggtgggcgaactcctagagaggttatggttaatgcatacctttaccgagggtgttgcccttgctcctacgtatccccaggtgcaatgaggaaatcagacttacacaattctttaagtttgaatgtttgtgtgttaaattga

SEQ ID NO: 28928 - DNA, 603 bp, Glycine max
  Peptide Sequence Number=SeqID_145706
atgaatccctatacggccccgaggccatatggtttccagcccatcttctcccaaacctattgggatactattcatgatgatgtctggaagatggtatccatggttttctctacaggtttcattaatccctctttgattgatactttcattgtacctattcctaaggtggataataccacatgtatgagagatttcagacctattagtctttgcaaagctctcttgaagatcatctccaaagttcttgttttacgaattagacctcatcttgacactttcattggcccttgccaaattagtttcattcctggtggaggcatggttattatgaattgtatcacctcaacttcccttgcttggagatggaatagtgaagtccaagaaggtttcaaaccatctaaaggccttaggcaaggtgaccacatgtctccatatttatttgttctctgtacggagaagttggccttgatgattcaggaacttgttactagtaagaaatggcaccctgtgaaaattaccaagcaaattccaaccatctctcacctcttttttgcatatgatttcttgctttttactatggctaagttttctcagggagactag

SEQ ID NO: 28929 - DNA, 231 bp, Glycine max
  Peptide Sequence Number=SeqID_145707
atgtatgatggtgacgaggatgttgtgggttgttctactatcccatcacaaggcggtgaagttagttatcacatgctgcaaatggttacggattcggataaagatgatggagattatgttgtgtcaaactcattttttgagaaaacatatgatgaagaagatgtagttaatgatgactcttctaacacaaatgatgaaacaacatttattgagtcaagtgagcttatttga

SEQ ID NO: 28930 - DNA, 651 bp, Glycine max
  Peptide Sequence Number=SeqID_145708
atgtccggttggggtgacttcgagacttgtatcagagccagtgcagggccagacgatggggacctggcccaggcagggggattcgcctggggagcggctgcattaatccacatgtacgaccatctgaatgacgcgtcgcaggcctctacacggcagttgggcggttatattacacttctccactgctggatatacgagcactttcttacagtgcatacatccgtcgttgatgatgcttatgatgaggggagcccacgagcctgcaggtggcttacaggtaaggctcatattacggggatcaagggagccccgtatcggagacgtttggatgccctgagtgtgactgacgtgtgttggatgccctatgatgagcaccagcgagtcagggcctttgacttgatatcgtcgtacaccggccagctcagatggggtcagattgtggtgtacgttcgacctgagcaggttcttcgacagtttggctaccttcagacggtcccttcgccgccggttcactgcgaaggatgtcagggcatggctcaggatttaggagcgattgctgaggatttggagtgggtcatcaacctcaggatggtcactgagggcactgacttacatgacatcatgactcattcgttgtctaaggagagctag

SEQ ID NO: 28931 - DNA, 258 bp, Glycine max
  Peptide Sequence Number=SeqID_145709
atggacttgggttgtggaccagaactacttttcaatgtgcagaataggttatggttactgatatcaacatctatgtgcatgttggatatgctatgcagaataggttctctatacatgattgatgttgccaaggagaaccctcaattagcccagaagcttcatgatgttttagttgaaagtggtgtggttgctcctcctcgaaatctattttacaaaatttatgatgaggaattaggttcctcaattgacaccaactaa

SEQ ID NO: 28932 - DNA, 792 bp, Glycine max
  Peptide Sequence Number=SeqID_145710
atgtatgataatcttagcagcaaaatagaattggattcatccataatatctaatccatgtaatggagactttgcggttttctcgaacactgagagaacaaatcacccatcgataatccaggttatatgggagaacaaggaacacatagcagatgggttgccgcatttgatttacatatctagagagaagaggccaaaacagcctcatcattacaaagccggtgccatgaatgtgttgacaagagtctccggattgataaccaatgctccctttatgctgaacgtggattgtgacatgattgtaaataatccaaagattgttcaccatgcgttgagcattttgcttgatcacaaaggagaaaaagaagttgcatttgttcaatttccccaaaaattttatgctactttgaaggacgacccttttggaaatcagatgacaattttggctaagtacttggcggctggaataggtggactccaaggacctttctacgggggaacaaactgcttccatagaagaaaagttatttatggtctttctccagaaaacattgaaaaggacaaattttcaggaaacagcatatcagaggaggaattaaaacaaaaatttggaacttcaaaggagattatgaaatcagttgcttgtactttggaagggagaacttattcgtataatgatattaatatttcgaacgttgttgacgtagcaagccaagttgctggttgtgcatatgaatatggcactggatggggcaaacaggtctttaaaacaaacattttagagagtttttag

SEQ ID NO: 28933 - DNA, 621 bp, Glycine max
  Peptide Sequence Number=SeqID_145711
atggtttggtcctatattcactatgaggaagttcctgcacataaaggcaatttatatgctttggatgccatagttcctgagacaaggctacctgtaaagccagaaaattggctggagatcaaactccccaaagttgagcccataattgagcaaattagaagtgaagctttagatggagtatcagattctaaggctgccacaagtgctagtgaagattctaataagaaggataaggaatttagcccaataaaggatgactacttcaaagactttggtgttgaacctggcctaggaaaccttcaagagtctgacaccactttagaccatcaaattaatggaattggtatagagacaccgctgcctattaagccacaaaattggccagacaaaaacctcattgaagttgagcatagcagaagtgatgctttaaatagattatctgattctaagtctgccataaatgccagtgaagattccagtcagaagaataagaaatttggcactacagaggatgactaccttaaagacgctagtgttgaacctggaataagaaaccataaaaagcttgaaccagcaacagagaatgacactcaacccaaatgttgctcaattggctgctga

SEQ ID NO: 28934 - DNA, 354 bp, Glycine max
  Peptide Sequence Number=SeqID_145712
atggtcattctgtgtttcaccgcccaggctcaatcgtgtccaacaaaacgcagagacaaattatggttccgctggcagggaggttcactggccgaatggtgtttcgctcgaacaaaattagtgtcttatctttacttcccttttatctccaataaaagacaagtaaagaggggcaactgtcataccctaatttcatccggggaccatccattgttgggatgcgaccctcgtttgaccacttcgaggtacttggcacccatcgttaggcaattcgtgaagttccgtgacgtgccagaagtcaaaagaaggcattgtagcacaatccgtggagttccgcaacatgtcagaaattaa

SEQ ID NO: 28935 - DNA, 204 bp, Glycine max
  Peptide Sequence Number=SeqID_145713
atgggagctagcgatggcaccgtgggaggaagaaatgatttgtgggtaagtgttgcattcatagctcgtgtagctcagtattatagccaccaatattcatatactgttattaacatgccgatgctgtcgttggattggatgatgtacgtgatgtgctggcttttagtccaacaagtgatattgatcccacacccatatacttga

SEQ ID NO: 28936 - DNA, 225 bp, Glycine max
  Peptide Sequence Number=SeqID_145714
atggagcatgaaattgatgtagtggaactgcgacaagagatcttcaatgtagaatatagcagcaactggaagagaaggtggcttgtggtggttattgtcaacaaggttgtggcaatcatcttcctcgtcagagcctccaatattttgaaattattaatggtgtcaactttgaatgaccggaaagaccattttgaaccatttgaaaatgataaaggattgaaataa

SEQ ID NO: 28937 - DNA, 270 bp, Glycine max
  Peptide Sequence Number=SeqID_145715
atggatctggtgatgggtcccctccttggtagaattgcatcagaaggtgtttggatgtccaacatactatcatgtaagtcaaggttaaagaggtctctttatgggcagaagcgatctctaaggccatggtacaataagtccaatgagttcattatttctcattggtacaacagaagtccatatgattcaattgtctatcatagtaaagtggaggatggttgccacatctatctacaactttatgcgggcaacatgctcatagcatcttaa

SEQ ID NO: 28938 - DNA, 207 bp, Glycine max
  Peptide Sequence Number=SeqID_145716
atggaggatacttgtagttggggactttatgaggatcgccatgcattacaaggaagggatgaaagaacaagttcaaaggaacttgggggaatgttgagtggtcataactgtcgcaacctacccttcggcgggagggcgacgcgagactcgcgggatgcgtgttccacgaaaggaatacgcgcggagtcgccaccaacgtttatttga

SEQ ID NO: 28939 - DNA, 192 bp, Glycine max
  Peptide Sequence Number=SeqID_145717
atgtctcattttcaagggtttttcaaaggaatagcaagcaacggcggctcatggtggccaccggtggtcgtgggtgttggaggaggaggatctcgcttaggagctcgtctcgctaagcaggagtccacttatggtgctaagcatgataattcacgctcagcgcaattccctccgggttggaattgcgcttag

SEQ ID NO: 28940 - DNA, 349 bp, Glycine max
  Peptide Sequence Number=SeqID_145718
tgccacgaaacgtcttaaagaaagagacattgtccgtgactcagccaaggcggatcaacactctgaagggcgtgtgcggaatgtcatcgtacacatcattcgaggtgttgggatgcatgcagacaagtgcgtgggagttgggggagagagggatctggtacaggttgggtctggtgtagtgtgcgaaggagaaggtggacagcgagcatgtgcagagggctgggtcttgagagggttgaactcgggattgggaagcctctgcatgcgatatctgcaagcaactcaagaagacaacaagcacaagaagatggctcctcttactggccgagaacgccgtcttcattccaag

SEQ ID NO: 28941 - DNA, 198 bp, Glycine max
  Peptide Sequence Number=SeqID_145719
atgcagctttcttttgatgccagagggaatagtgtacctacaatactgttgttaatgcaaagacatttgtatgcacaaggaggtctacagatttctcaaaccgaactctctttggatgttatggttaaagctgagctattatcggagtccattgctttccatgttcagccccttgattcagttcagatgaatttttaa

SEQ ID NO: 28942 - DNA, 1143 bp, Glycine max
  Peptide Sequence Number=SeqID_145720
atggctaagctcaaagttggtgccgctaagcgcaatcctttaaggagcttagcacatatccttgcggcagatgttcagcttagccagctaagcggaccatgtctcgctaagaggccaatggcttccagaaagagaaagagtattggaagacatatactgcctaagaggaaggtagaaatataccatattgagctggacgagtttaaggctgaattggagaggcgtaacttccataaacgcctcaccaatttagttgacaacagcatagatctagctttggtgaaggagttttatgccagtctttacagccccgaaggaccttcaccaaagcaagttagggtcagaggccacgtggtgaagattgatgcagacaacctcaacacctttctagagacacctgtggtactagctgagggccaccctaggaagattctcaggaaagatttaacaactctttctcaagtgttgagtgttctctcgtactccaatctggctcctacttcccacacctcggacctgacaatggacatgaatgtgggagctctcatctctggtcagattacatctatggcccagtgtaactcttctagacttgggttccctgctcttatcacctctttatgtaaatccaatggggttgcttctgacagcctggtctttgaatgcctgagcccggtcagtaacttggcctatatcaggaaaaactgttggaaccctgatgatctgacagttactatcagaagggccaggagagcgaggacaaggccaactgaggccccttccacatctacagctcctcctccagcacgtaccctagcagctccttctgcctcaactcctatggttgcacctccagactctatttccgtagagcagtttaatgagtgggtagcctggcccggaactcagtcttctcttcatagggaagatgaaggtcccacagctcaggcagcacaagaagctgtagccacttctgagaaatcttttgaggccacttctgagcctttagaaccagtggcagatacaaattcaattcagcaggcagcagacccctccactcctgaggatcagactacaccagtcctgtctctgaacacctctcctacagctacccctgtgcttcatttaacagacgaggaggat

SEQ ID NO: 28943 - DNA, 243 bp, Glycine max
  Peptide Sequence Number=SeqID_145721
atgattggctttaaaacaccttattggtattatttatggcctctttcagctaaaacccttgctctaaaagcttcccatgattctgattccttgtcttctgcgattgccaaatttgataaagtacttattcctcaagatcaagataactctgcatccttgacagatcaacttgaaactcctgatataaccttaaaggatacacatgtgcttttctcctactccatttcgaatatgttaatgtaa

SEQ ID NO: 28944 - DNA, 114 bp, Glycine max
  Peptide Sequence Number=SeqID_145722
atggttgatgtgtcatccagtatgcatgttgaaacagctgatgacatggtgatgagttttcaacgactccggctacaacaacaggtcataaccgatgttgaaactgccaaataa

SEQ ID NO: 28945 - DNA, 417 bp, Glycine max
  Peptide Sequence Number=SeqID_145723
atggagcatcaaatcttcgcacaaccttaccttcaaaacacagccgtgttacgacccctccaaaaaggggtactcactggcttcggcggtgccaccacaagacgagatgccggacgaggtgacgggggtgtgggcaaacgccacaagtcatggcgaggtcacagtacacagaaatttcagacacacagggaagcgggagctcgagcgagtgttcacgaaatagcgcaaattacaacattatatacatcaaccttaacgacgcgcgccacctacaaagacgggcacccatggccaacgtcgttgaatgtgtcacgcgccatgcacatggcacataaaatgctcacttatttacggaattgccaccgctactcctattacgacatttttggcagaaacgatgtggaacgcgcgtcgtaa

SEQ ID NO: 28946 - DNA, 168 bp, Glycine max
  Peptide Sequence Number=SeqID_145724
atgggtattttcaaaggtcttcagctggtttgggagatgggatttcggaatcaagttgatgagtgtaatttgaaatattcagagatgtacttgaacaggaaagatgtgcagaaggctctccatgcccggctggtgggaaccaccaaatatcgtttgtgcagcaagtaa

SEQ ID NO: 28947 - DNA, 774 bp, Glycine max
  Peptide Sequence Number=SeqID_145725
atggcctcccgcaaacgccgagctgtgcccacacctggggaagcatcaagctgggactcttcccgcttcacctcggagatcatttggcatagataccaggataacattcagctccggaacattcttctggagaggaatgtcgagctcacacccaggatgtttgatgagttcctccaggagctccagaggtgcagatgggaccaggtgttaacccgacttccagagaagaggattgatgtcgctctggtgaaggagttttactccaacttatatgatccagaggaccatagtccaaagttttgtagggttcaaggacaggtcatgtggtttgatgcagagacgattaacgacttccttgacaccccagtcatcctggcagatgtagaggagtacccagcctactctcagtacctccgcactcctcccgatcatgatgccatcctctccactttgtgtactccagggggacgggcccgtctcatatatggcttggtgatgaagatggacctggacgtggacagttttatttcccagcaaatcagtcagatcgcccaatccaacacatccaggctcgggttcccagcgttgatcacggcactgtgtgacattcagggggttgtttctaacaccctgatttttgagttactcaatcctatgattaaccttgcgtacattacactactaaaaaaaagctattttacgacgcgcgttccacatcgtttctgccaaaaatgtcgtaataggagtagcggtggcaattccgtaaataagtga

SEQ ID NO: 28948 - DNA, 297 bp, Glycine max
  Peptide Sequence Number=SeqID_145726
atgaagaagaagaccaagatccaccgaatgtttcaagcaaatgctgagggagattccgatgagcttgtagatccaccgaaggtggaggatgagattggtgctgtgcctcatggcctttcaaccgatttagatgtcatcaagaggtggaggcatagtcaatctcaaagagatctctctagggcaacgcggagaagtttgagttccaagcggaagtgtcatggcttatggatcatgttccgccctagaaaccctaatcgaaagcccattcagagcctcaagagccatcatgggcgataa

SEQ ID NO: 28949 - DNA, 303 bp, Glycine max
  Peptide Sequence Number=SeqID_145727
atggtggtggaagcgaggggagaggcgagatgctgcaggccagcaaactacagccaccgtgccatgacaacgtcgccaacatctccgccgtggtccagcagcgctgctacggcagaggcattgccctacggaatttgcatggccactcgcgtggtgctgcgaacgtcgttgagatttgaaaccgaggggttttgccttactggggtcgagctcccaacagtggaggaggaggcagacggtggtgccgacgccgaagccgaggagggtgaagggaacaatgggagggaacactatttatgctag

SEQ ID NO: 28950 - DNA, 546 bp, Glycine max
  Peptide Sequence Number=SeqID_145728
atgagttcatattttgaggaaagggcaccttgttgtcgaagtcacttttggattttactaagcatttgttgggcatctctgttatttgctgctatcacatcaggtcttgctctaggactcttgtccttcagccaagttgatcttgaggtttttattaaagctgggcagccaaaaattcagaagaatgcagcgaagattatgtccattgtgaagaatgagcatttacttttatgcaccctcctcctagctaaatcaatggcactggagttgttggattggctttttggcaaggggcatactgcacttttaggacgagcagagctcaagactttagtccatttacatgctaatatttattatgatatgctcaagttcattatcaggcagggaaaggtggagagttgtcacttcatgaaactaataattgctggagctttggacttgacacagaagactgctaaagatggtatgacaccgataagtgaaacattttctcttgacataaactccaaacttgacatgtatgcccctcatctctatatctga

SEQ ID NO: 28951 - DNA, 297 bp, Glycine max
  Peptide Sequence Number=SeqID_145729
gtctttgatggtgcacgtgctagggagagggaaagggaactgctttatcctgatgcttgtggcgggggaggccgtggttggataagtcaaggaatagttagttatggcagaggacatgggacaagagaaacgtgtgccctgcatactgccagactttcatgcgatacactagtggatttttggtcagcactgggagaggagactcggctttctcttttaagaatgaaggaagaagattttattgagagacttatgtacaggtgtctatcgattttttcgttccttacactgtcctaa

SEQ ID NO: 28952 - DNA, 2320 bp, Glycine max
  Peptide Sequence Number=SeqID_145730
taatttagttattgaaacagatgaaactaatctattgagggatgattctcctaacatcgaagatgaagaattctctagtgagtgtagtactttgaaaccacaagacctctcttatgatgattgtgaggaagaaatttcaaatgcagaagatgagatgggtcagtctacaattgaacaatcaatgtcttctcatcgaaaactaagatgtaggaaagaatttcaacttgatatgcctatgaagtggtctgacagacgacgatatgcagttgtttcagaaaatagtgtgatggtttgcagatctgagccaagacattatggagagagttttgtgacatcatccagggtaatgaatgggttgaataggcaatcaagaataaatttcccaacaaaatccaattgtcgaaatgttggtcctcccaagtataatgagaagttttatagttccaagaaccggatgaatgaaaaatgtgatattcattcttgcagttgtagcttgaataatgaatctaagactagggttgagcaacattctcctatgaccagagttaggcgggagacaaaacctacctgtcagtctgaatctgcaagagatacatccaagcaattttgtcgtggtaataagaataatcaagtagcctatatgcatgagagtaatggaagacccaaaagcaaaatcatctcagggaactgccccaccagggatttgtttcaatcgaagaaagtttgggagcctatagaatctcaaaagaaatatccttgcagtaattctgattctgatgctattttgaggtccactaaagttgaaggaactcagtctgatctggtcaagttgtctattggagaagctgttgattcaggtggaaatgatgacaaggaatgtaattcaaaaagatttagtggaatggatgaaagctgtcaaaatgattttcacgtagaagctgaaggttcttgtagctctacggaaattgctttggaggaatctggaatttgtccaactggaggctttgccttaaataattcttctgatccaactcaaagtagcacttttagttctgataactgctcatcatgcctaagtgagggtgataataatacaacctcgtcaaaccatgaaaatacagaatcctcaatcacatcggattcagaagatgttagccagcaatctgaagtaagaaataattcggattgtgtggaaactgtcttgtctcattgtcatgaagttgctgtagagaatagccagaatgcaagtggtgagggtttgacaagaaaatcaagttcactgattggtctgtccttggatggtacaagaaattatgcattggggaatcttgtggaaactgcccaaaattttgacaattgtttttccaccactaatgtgtgttctcaacttcaaagtatgcttccaccgttgtcaaaccaaaatatacattttccagtgtttcaagctccttcagcaatgggttatttccatcaaaatccagtttcatggccagcagctcccacaaatgggttgatacccttcccacactcaaatccctatttatttgctggccctcttggatatggcttaaatgaggacccacgcttcagcttgcggtatggagccttacagcaaccaacgtccttattcaaccctggtgttccagtttatcagccagttgccagagctaatgtcttaaatgcagaggagcggactcaagtttccaagccagcttctttgccagagcatcttaacggatctgttgcagaaatggtctttccagctggacctatttccaagagaccagcatcacatggagaagttaggcatgataattcttccaagccacttgagaataaaaatgatttttccttgtttcattttggtggacctgtagccctatcaactggatgtaaatcggcattcacttctttgaatggtgatactgttggcgatttttcctcaaaaagttcagcagatcatgtcgagaaggttcataattgcaataagaaagagactcccgccatggaggaatacaacttgtttgcagcaaaccaaaaccctcgaactctgttcgatgtttccggaagctataatgcggtcagtggttcggtgttcggcgcaatcaagcacggaccagtccttctcgatgatttctgggatggaaacgaaggacgcgccctcggggagggaaatgggggcgtcgatgttcgagtctgtggctcgaagaaaagtgggtttttgtgtcaggggaattggggagagagtgcggaatatgggttggtgtttggtttgaagaaaagggcggaacttgcatggtgtgaggatgaaggaacctaa

SEQ ID NO: 28953 - DNA, 387 bp, Glycine max
  Peptide Sequence Number=SeqID_145731
atggaaggtggtttggaacatttaaaggcaccgtttttgtcaagtaatagtggtgagctcagtgaagtcactcgtctcaaatgcgattttttctccaaattgcctgataaagttcggtgtggtctcgatcctgatctctcttttcacattgactactcaaaggcaactggcttaacagaaggggagaaagagtattacgaaaggcaattttccaccctaaggtctttcgaggaggttgattcaactgaatcgtccaatgtcattgaggatggctcagtgcacggggaacaagtgcaatctgaaagggcaatgaaaatatccaatttggcaaacgttcttttactcgcttttaaggtaccgtttctctcatttttaattgagctataa

SEQ ID NO: 28954 - DNA, 165 bp, Glycine max
  Peptide Sequence Number=SeqID_145732
atggatcaccagcaacagagaactgtggattttttgtctaagatggagggtgcatcgaatcacgcacgccaccctgttggtgccactttctcaccatcatataagtttgatggaggcaagaagatcgacatcggttcaaattcggagggttttccctctgaataa

SEQ ID NO: 28955 - DNA, 762 bp, Glycine max
  Peptide Sequence Number=SeqID_145733
atggaacaaaatgcgtgcaaggaattgtcaaaaattgcttcgaatttcaagtgcgagaaggttctcgaaacagttgatgaatcaatcgtatgccccactccacaaaagaacgaggaacccctaactgtcaaatccaaagagggacaaaccaaccttcctgaaaaatactctacgcttgctgatttgtttggtcacatgagttgttcactcagattgctgtatctgtgtaaaaaggctccaattttcaaaatgtttgccgccaggaaattctcccatgcccatcttacgcagatgaagtatatactccctaaaagtgtgtatatagatagggtgcttgttcatgataagaaaagcttgtgtatggtgcctgatatgaagatcaccttgaaatttgaggttgtgaaagattgctttggcgaatctgctgatctggctcttcgacgatattttaaatctaagctgattgatttctttgatatgcatcctgaggacatgcctacccaaaagtcaacatcatcttataagccagcaaaaagagtgcttgacttttccctcatggaggacaatgatggcttgggcattgaaatggacaagttagaatctatcagagctctgcatgaatctagcagaggatgttatgaggattgcaactcttttggttctgtttctgcacctcaggaggagggcacacatgcatgcatacttgaaaaaagtgggataaatgagatgtttatgacaactggcaagataatgatgaagtga

SEQ ID NO: 28956 - DNA, 267 bp, Glycine max
  Peptide Sequence Number=SeqID_145734
ccaacaaggaaagtgtcgtcggcattatatgcgaaaagtacggcattagcaaggagaagtgagttcaattttgtcaaacccgcagagacccttcgtgggaggattcgttggaggagcaggcctctcagggttcctttgtcgctcatggacgtcaggatgtactacctgctgccattggatgaccagaacaccctagtcgtgtgtgtgttgctagaaggacttcctgcatgtcttcctccatggctcccgaagacatggagcagttga

SEQ ID NO: 28957 - DNA, 174 bp, Glycine max
  Peptide Sequence Number=SeqID_145735
atgttatctttcagccagatgcagtctcagtttcagccgcagatgcagtctcagtttcagtcacagatgcaatcacaaggactcacactgcctcctaagcctgagggaatgatcaagaaacgggtgactcagaaaaatacgggttgtgcgtcgaagaaaatcctccccgcctag

SEQ ID NO: 28958 - DNA, 435 bp, Glycine max
  Peptide Sequence Number=SeqID_145736
atgttgcctaaagttcttgagaaaatttggctggaattagagatgcaagaggtctggtctatgggcaatggaaatgttgttaatatgcagagtgatgagtggattaatgaatacttgaggcttaaggatgtggttgctaatatccaggttcaaaattcgacttatatcccttacgaagttatagaggtgatcaaacctattcttcctccttatgaagtggatgacatgaaaattggtcagtcctccctctctaagcccaactccatcactgagttactcgatgttgatggtccatttgactctctgggtaaactcagccatgcggccaccatagtcgaggccatgccatgccacttcgacatggcacttggcaaaaactcagccatgcgagggcctagaagaaactacagaactccaaatgaaacgtgtgattag

SEQ ID NO: 28959 - DNA, 255 bp, Glycine max
  Peptide Sequence Number=SeqID_145737
atggattggttctacatgatttcacatccattcatgaagctggcacaacctggtgatccacccagacatccagctgtcatgcaagatgagacatatatggaaccagatatgcctaagtacccggtggcaacaatagctatagaggaagcacctgcacaagcaccttctgatgtggaacagcctagacatgtagtgttaactctaacaacgcatgtaagactaaaccctaagtattatagtaaccctaaacaatga

SEQ ID NO: 28960 - DNA, 150 bp, Glycine max
  Peptide Sequence Number=SeqID_145738
atggagaaaggtacaagtcttcctatggagaaagatcaccaccgatcttttatttttccgaagaaaagggagaaagctcgaaaaaccctatttttgagagatcaaaggtccgggggttggttacgcaaagggaaggtactagcaccctaa

SEQ ID NO: 28961 - DNA, 636 bp, Glycine max
  Peptide Sequence Number=SeqID_145739
atgggggagcagtggagacaattcaagtatgatttgacatcgaaatgggcatttgcagccgacaaggaaagtgtcgacgacactgatatgcgcaagaaggcacaagccaaccagaaacataacattgcccctcacgtgttgtctcgtgagggttatgaatattcagaaaacaagttgatggatgagaagagaaagaaaaaactagaggaagttgctcaatccggaagcactgacaccgtgattgatcctctatctcccatcagacaacacatgaaatggaagatggcccgcacaaagaaaactgggcaaatgacgtctgaggcagcaaaggaaattgctgagaagattgaatcgttggaggagcaggcgtcatacggtttcttcgttgccattgggcgaccagaacaccgtagtcgtgtaggtgttgttggagttggtgtcacgatcaagaaatactttggactggctccaaggacctcccgtatgtcttcctccatggctcccgaagacctggagcagctgatgcaacaaattagggaccagttggaggagtcgatcactgaaaaagtgactcaacggctaatgttatcctttcaagccacagtccatccagagatccgagcaattgaaatttga

SEQ ID NO: 28962 - DNA, 678 bp, Glycine max
  Peptide Sequence Number=SeqID_145740
atggcggtccagcatcttatcttcctggagtcgtgcgagatcgatcgcctgaggaagagaaagagggcgcagagcttgaacttcccggtgaagttccaaaatcaacccttggatgaagcagctcaacaagatggaaggggcaaggcccacaatccgattcgccaatcattcgaactccataaggtactcactaacaatgccgatctattggagtttgaacaaagcgccttgagggtcatcgtagaaggagggaacaaaccggccatccatgtaaaaggatgcagcgcagtgggacaacactgcagtgggaggaggcgccggtgccaaagggagaggggtgaggaaaacaaccggcaaaaccactcccccagccacgttcgtccttcgcttctaggactgactctctaccgaagaagaagcaccattcactgtgttggcgactgcactgtccaaatcctgtcccttgtcttcgtccgtgttggaatcgctgattcaacggacgaagaaaggcatggagaacatgagaaagccttaagtgccattctttccttgatcactagcacttcttttgcaatgatatggaaggtgcttctagaatacatgactttcatggagtctctagctaagaggcgaaaatgtaaggaagttgtgttctttgtgaccttcatggcactttga

SEQ ID NO: 28963 - DNA, 454 bp, Glycine max
  Peptide Sequence Number=SeqID_145741
tgatcttgagcaacttacttatttgaagttggtgatcaaagagacattctgggtacacccacctactcctttattgctccctagagaatgctctcaaccaaccatcattgatggctatgaaatacctgccaaaactaaagtcatggtaaatgcatacgcaatttgtaaggattcccaatattggattgatgctgataggtttgtccctgaaaggttccagggtagttctatcgatttcaaagggaataactttaactatctcccttttgggggaggacgaagaatatgcccaggcatgacattgggtttagctagcattatgcttccactagctctactactgtatcacttcaactgggaactcccaaacaagatgaaacctgaggaaatgaatatggatgaacacttcggattggctattgggaggaaaaatgaattgcatttgattcccaat

SEQ ID NO: 28964 - DNA, 303 bp, Glycine max
  Peptide Sequence Number=SeqID_145742
atgccggagatgcggatgctcaaacttggagagggccaagcgtgggtcagattcagtttctctgcggtgttgctgtttctttccatggaggggtttgtgtgggatatgatgttgggtgtttatacatcagaagaaggagatgaccgaagtgggggaggttggtggatgaaggtgttctttgcggctgataggaggagaatagcggtgctcagtagtgatgggcggcctcaagccaatccaggggtcatcggaaacagtggaaaggaagggagagtaaaatttggtggggaaggtgtacaatag

SEQ ID NO: 28965 - DNA, 2706 bp, Glycine max
  Peptide Sequence Number=SeqID_145743
atggaagcatatcttgatgctaatgatgtatgggaagcagtagaagaggactacgaagttcctcctttgccaaataatctcattgttgcccaaatgaaaagtcacaaagaaagaaggcttcgaaagtccaaagccaaatcaattttgttcacagtttggatgaaagattcggagacaatcaaagattatgcggacaagcttcttggcattgaaaacaaaatacgtcttcttggcactgaaattcctgactctcgaattgttcaaaaaatacttgtaacaattccagaaaaatatgaagccacattgacttccttggagaactcaaaagatcttactactatcaccttggcagagcttttgatcgcacttcaggctctgaaacaaagaagactcatgagacaagaaggtactactgaaagggctttggtagctaaatcactggacaaaaaaaagaatggcaagtcaggaagtttcaaccacaaaaagggtagcaaatcctctcatgattttccatcatgtcctttttgtaagaaaaacaatcatccacagaagaagtgttggtggaggccagatgtgaaatgccataaatgtggacaattagggcatgtggagaaaatctgcaagtcatcacaaaaacaagagaatgtacaagctgctattgaaggggtcgatgaagaagaactttttgttgtttcttgctttgctaccgcaagatcaataggaagttggctaattgacagtggttgcacgaaccacatgacttacgatcaagaattattcaaagatcttgatgcaacctacaacacaaaagtcagaattggaaacggagcaaaaatagcagtgaagggcaaaggaaccatgatgatcgaaggttgcataagtctgaaattaattcctgatgttttatacgttcttgagattacccaaaacttgttgagtgttggccaatttctagagaaaggctataaagttctatttgaagataaaagtggcatgattaaagattcagataataaagaattattcagagttcaaatgaaaggcaaaagctttgccttgaatttgattgatgaagagcagcttgatgtgcacaaggttgaagacaacacgttggtttggcataaaaggatgggtcattttcatcatggctcgttgctctatttgaggaagaatgatcttgtacaagggatgcttgaattggaagagaaatcactcgtatgtgctgcttgtcaatatggaaaacaaatgaggttgccttttccaaaaggcaaatcttggaaagcaacaagcaagctacaattagtacatacggatgtcggaggacctcagaaaaccccatctctgaatggcaggatagaacatcaattgacatcaccttataccccacagcaaaatggggttgtggagcacaaaaacataatgttcttggaaatggttaagagagacaaacttgataaaaaggcgaaagcgggaatctatgtaggctatagctcaacatcaaaaacctatagaatattcttgccacaaagtaataaagttattgttagcagagatgtgcaattctttgaagaagaaaaatggagcaaggaaagtgagaagcttcaagttcaggaggagagcaaagaagatgtggatgaccagctagttagaggaactagatctctatctgatatttatcaaagatgtaatgttgctgtaatggagcctgtagactacaatgaagctgcaactaattcgaagtgggtaagtgcaatgaaggaggagcttgatatgattgaaaaacatcaaacatgggagctcacggagaaacctaaagataaaaatgtcattggagtgaaatgggtttatagaacaaagcttaatgttgatggttctataaacaaacataaggcaaggcttgttgtgaagggatatgtgcatatgttcggggtagacttctcaaaaactttttttccagttgccaggttggataccataaggctgttgttagctcttgctgcacataaaggttggattatacatcacatggatgttaaatcaaccttcttgaatggacacttggaagaagaaatttttgtagagcagcctgaaggatttgtagttcgtggacaggaagagaaagctccaaggtcttggtacggcataattgatgcacatttgataagcttaggctttgaaaaaagtctaagtgattttaccttgtatgtcaagaagacgaatgttggaatagtcattgtttccttgtatgttgatgacttacttatgacaagaaattcaaaggagctgattgaagagtttaaaggaggaatgaaagaagccattgaaatgactgatcttggaaaaatgtcatttttccttggtatacaggtgcaacaagatagaggtcaagtatttgtaagtcaagaaaaatatgaaaaggaaattcttagaaatttcaagatggaggaatgcaagccaagtacaacgccaatgaatcaaaaggagaaattcagcaatgaagatgaagctgaaaaggcagccaaaagaatcttgagatataccaagggtactattggttatggagtgaagtttcagctagtaaaagatttcagtctttatggatattcagatagtgattgggctgggagtaatgatgacatgaaaaacacttcaggctactgtttcacatttggttctagagttttttcatggcgttcaaagaagtaa

SEQ ID NO: 28966 - DNA, 192 bp, Glycine max
  Peptide Sequence Number=SeqID_145744
atgtatagggaagaggctaaagacttagaatcacgacatcaaaaaagtgaaattccacttacttctggtgatattcctgttggcattaagagaaaaatagatcggtcttaccaagagttggaagcaaggaggggtagacttagccaactagagaaaatctacatggatatgacaatgcagaaggataactga

SEQ ID NO: 28967 - DNA, 4158 bp, Glycine max
  Peptide Sequence Number=SeqID_145745
atgggagaccgaattgatgcgttggaagctcagatgggtgacgtgcaagctatgttgcaatcattagctcaacagatgcaacaacagagtttgattatgagtgaattaagcaaacaaatcgctcagaagggagtgaatcgggagagtgagaactcggtgggggaatcatcacaagaggaatcttgtctttctgtcaagaaggtgaagttgccactgtttgaaggtgatgaccctaacccatttgaagaattgtcaacattgaggcagaaagggagtgttgaggagtttgtggaggcattcgaattgttatcctcacaagtgggtaggcttccagaggagcaatatctgggctatttcatgagtggattaaagcctcagatacgaaggagggttcgaacgctaaatcctctgaacaggatgcaaatgatgcggatcgcgaaggatgtggaagaggaactgaaagaagaagatgaagatggggagagaagcgatagtaaaagggggaagagccggagcaggttgaacccgagagacccaactcgttcacctaatttgggttggtctaacccaacgcagaaaacgggttctagcggatctaacacgatctcaacgatgtcgttagcatcaacaggaaggaaaggggagaccgatgcttgcactggggtgtcggagaagtggaagggagttcggagcatccgtaacgacgagatggctgagaggagagccaagggtttatgcttcaaatgtgggggaaagtatcaccccactctccataagtgtcccgaacgagccctaagagtattgattttaggagaaggagaggctctgaatgatgaaggggagatagtggcgatggaagctgtgcagtctgacagtgaagaggagattgaagtagaatgcaaatccgtgggagtactaggaagtatgggagaacaccgtactatgaagattgaagggaaaattgaaaatgttgatgtgttggtgttaattgatagtggggcaagtcacaatttcattttgccccaagtcactactgctctagggcttactattaccgtcggcgttgcgaagcacattaaattgggagatggccacaaagttgtatctgagggagtttgctacgggctcaacatccaattgggacctattgtggtgaaggtggatgctctggtgttggagttgggaggtttggatatggtgttaggagtgtcgtggttgagtaccttaggaaaagtggtgatggattggaaagttttgtctatgcaattcctgtatgaggatcagtgggtgaaattgaaaggtcaaggtggcacacaagagaaacaaagctacttgaacacattccttgaagacaaacaaaggaggttgggaacagattggtggtggtctcaagaagagcaaagcaaaactgtgataccaggagacttgaagggtatattagaacagtttcatgaggtgttcaaagagcagattcaattacctccagaaagaacccaagtgcatcagattaaattatttcaggatcatgggaccatcaatgtgagaccctacagataccctcatcatcagaaggaggagattggaaaacaagtgcgtgaactgctgaaggtaggagttatcagaccaagcatgagtgcgtattcgagcctggtgaatttggtcaaaaagaaagacaagagttggaggatgtgtgtggattatagagctttaaaaaaagctacaattccagataagtatctgattcccgtcgtagatgaattattagatgagctttatggagcaactattttttcaaaaattgatcttaagtcgggttatcatcaaattagggtgcacgaggatgatattcacaaaacagcttttaggactcataatggccattatgagtatcttgttatgccgtttgggttgatgaatgctccagccacttttcaggccaccatgaatgatatttttagaccatttttgaggaaatttgtattggtcttttttgatgatattctagtatatagcagagatactcaagaacatcaagatcatttaacacaagttttgtcggtgctgttagcaaattgctttgttgcaaacccgtctaagtgcaaatttggctgcaagcaaattgactatctaggccatgttatctctggagatggggtggcagtagatccagagaaagtcaagtgcattctcgagtggcctgagccaaagaatgtgaaaggagttcgtggatttttaggccttacaggttattatagaaagttcataaaagactatggtaaagtggcaaaacctctgacagatttgactaagaaagacaactttgtgtgggggacagatgcaatgaaagctttcaatttaatgaagcaaattatgacttctcctccagttctagtgctcccaaattttgaactcccatttgaagtggaatgcgatgcggctggtaggggaattggtgcagtccttatgcaacagaggcaaccaatagctttttttagcaaggcattatctgatggcaatttagctaaatcagtgtatgaaaaagaattaatggctttggtcttgagtattcaacattggaggcattatttattgggaaaacagttcatcgtctacactgatcataagagtctaaaacatttcttgcagcaaagagtctcctctccggaccaacaatgttggttagccaagctgttaggttatcagtttgaggtaaaatataaacctggcttagataataaggctgctgatgccctgtctaggtgctatgatgaaactgagttcagcaccatgatttcttatccacaatgggtgcatagtatgaaattgctagaggaagttgctatggacccagaaattcagaagctgatcccgaaattacaagcctctcctgaagctaaaccgggattccatgtcaaacaggggattctattctaccatgggaggttagttctttctctgaaatcaccatcaattcttaacttattggaagaatatcatagtacccccactggaggacactctggttttcttagaacctatagaagtttggcagacaatttgtactgggtaggaatgcagagaagtgtgagagactttgtcagggcttgtgatgtgtgtcagagacagaagtatgttgcgactacacccggagggttgctgcaaccccttcctattcctaatgccatttgggaagacttatcgttggatttcattacgggattgcccaagtcgaggggttatgaggctgtgctagtagtagtggacagattgtccaaatatagccattttatactgctcaaacatccatataccgccaaatccatttttgaactgtttgttaaagaaatagtgagactccatggtatccctaagacccttatcagtgatagggatctcttatttgttagcaatttctggttggaattatttagattacatggtacgaagttgcagatgcgttcagcataccatccggagactgatgggcaaacagaaactccgtttgaagtggtttatggcagacaacctcctagtattttgcgatttttaaccaacgagaccaaggtggcagctattgcgatggaattaagtgagcgagatgaggctcttaatcaactcaaattgcatctttcaagagctcaagaccagatggctagctatgttaacaagaagaggcgggatttgtcttttgtcataggggaatgggtctttttgaagctatgccctcaccgacaacactctgtggtcaagaggatcaataaaaaattgtctgctcgtttttatgggcctttcaaaattttggcaaaaattggagaggtggcttatagattgcgactccccgaacaatctcgtattcacccggtctttcatgtgtctctgctgaagaaagccataggagagtatcaagttcaaggtgaactccccaaagacttggaaataacagatgttgctgatgtgtaccccgagcagtctttggatgatgttacttgggaagatgatgccttcttgcgtggtcaatttccagattttagccttgaggacaaggttgtttctaaggagcagggtgttgatagaaacatagatccaaaggtgggccttgatattgggccatcaaagatatggagggtttacaaaagaaagaaaggaaagggaatatag

SEQ ID NO: 28968 - DNA, 876 bp, Glycine max
  Peptide Sequence Number=SeqID_145746
atgtctcgaaaagaaaatcttatatctgaattgcatccaaggaaagggacatggaagatagcagtgcgtataaccgatatgtgggatgttaagaagcacaatgggagacaagcgattgacatgggtgtaaagattgaggcaacgctatggcaagagttgttccctgaatttcaaccgaagttagctttaggttgttcctatttgatccaaaacatcaaagttgtggacaatcaatctgaatataaatttatatattcaacctatgttcaacacaacttaattctattcatttatgttggtttgaaaatagatgtcgtgggtgttgtcgctaaagttattgaacaaaaaatagtgaatcctgcatacaaggttacggtgaagttgagagataatagtgatgctgagatcctcatgacactgtgggaggattatgctcttcagctagatgatgctattgaaaaaaaccattttgttagggagccgttggtgcttatgttaacattgactaagatcaaagatgccaaagacaagtatcccctcagtgtccaaaatataaaaaatggttccaagttgtatgtaaactccgatgatattgctgagataaggaaattccttgatagtttttgtgttccattttatgttggtggattaacagaagaagggagtggtttgcaatcccagtataccagtaattcacaaagaggtgatcgtgataagttcttgcataatgctcagatggtcaacttaggtgacataagcagactgagagacgactgtttctgtttgaccgttgctacggtggatgatgtcctgattgatacaccatggagttatgatagctttccaaattgcactacaacgtttgatccattataa

SEQ ID NO: 28969 - DNA, 279 bp, Glycine max
  Peptide Sequence Number=SeqID_145747
atggtgtttgtgggttatatcatagatcccgactattatgcactttacaaggtttacaagaaaagtggacctggtccaaaaaatggtgaacaatatggcgcaccatttaatgaagaacagtgggcagatgatgacatagtagattttaatatcaacccagcttatcaggaggctccaaatgatgttcttgataatgataatgtattgcagcctttgcttgatgatgaaatcgacaacatcattagaggaattttggatgatgagcttgttcttgattag

SEQ ID NO: 28970 - DNA, 210 bp, Glycine max
  Peptide Sequence Number=SeqID_145748
atggcttctccacctggctcgcctcttcctcctcctcctccttcagacacatgtgctttgccgtctgccgtgaaaccacctggtgctgagagaccagtggtccatgttgatcctactaccggcaaggctgacgatccccacaggaagaaattaaaaacatatttggggattgtggcgcgtgataaggtgtacgtcacgtacgagaactag

SEQ ID NO: 28971 - DNA, 345 bp, Glycine max
  Peptide Sequence Number=SeqID_145749
atgcggggttaccttatgattacccgcacctgttgtcagccaagggcaaacgagcccattgacgcgcagagactaacatcgtctcctgcaccttttgttgtccagacccgtgaagtcagtcaggtgacacgcgggattaccttatggttacctgcacctttcatcaaccagggggcaaacgagcccgttgacgcgaagagactgacatcgtcttctgcaccttttgccatccagggacagcgagtcaagtggcagagggagataccttacggttattcgcgcctttcgtcaactgaggggaacaagttcgacggtatcaggatgatgtgggtcgttcggtgctga

SEQ ID NO: 28972 - DNA, 239 bp, Glycine max
  Peptide Sequence Number=SeqID_145750
taggtaacaatgagagggttaaacgagagcaactgggagggtgttctgcagcacggatctttgacgtggttggcagcacaagctcggatctacgaccgcgaccaagaacaagggtggatacatgtgatcgggtggctgggcagtggacgcatgtgaccaagaacaagcgtggttgggcggtggcctggtggcaactagcaccgttgaacgaagcaaacaccgccgatgcagtgaaatag

SEQ ID NO: 28973 - DNA, 363 bp, Glycine max
  Peptide Sequence Number=SeqID_145751
atggagtgccaccaaagacaaaccttaaggcaatccatactactaattagctttggacagcttctgcaattcagatcgtccatacttaataatgaacccctggagaagcttaggaaagggggattgagatctcaaagtgagcttatgcttgatgcttcaactagtgggaaaatctctctcaagactccaagagaagctatagagatcattgagaacatggctaccaatgctaatgaatttaaaagatgccatacaacaaatgagtgtgctatgattcaagaggaagttcagtacatgaataacaaaggtgaaggaactacaacaactacaaccaccaaggatacaaacctcatcctagcatag

SEQ ID NO: 28974 - DNA, 894 bp, Glycine max
  Peptide Sequence Number=SeqID_145752
agcatctggcgcagcggcatttttcgctatagtgtatttcaaaagcccagctttgcttgaacaaaatcccgaatctgcaagtaaacctgtgccgcctaccgtgattgatgcatatgccgttaatagttccaatcgcgatagatacctcgaattatttcgaacaggacagtttggtcagcgggacaagctgcgcatcggttgtgttgagtggagtgaatcatcgtgcgtggctgctggtaattttttgcgattgttaagtgacgctggctgggaaatcgattctgacgctgtattcagaatgcaaccatccgtgccagttgagggcgtatcgattgtaagccgcggcgatgatctggtcggtttgccgaaagtaccaccccacatgggccgctggagtcgatcagacattagctatgaaattttgacagcggcattcaaattgatgggagttccggtttatttttccagtgacccagcattacaaccaggtactaccggagtgtactttggaccgaaaccgaaactggatgtaccaatcaagcaaaaagatgagaatgcacgacgtgagcttctccgctacgtcggtttgggaatggctattcagcgagcttgctctcagcagtccgtcgaagtttgcgcggatgagcttttttcctgggaaacctctgtatcttcgtttctaaggctgcagcgattcaactccgatgccgtaaacagatggcttgccttgccgcatgctaatgcggctgcggcaactgcagacatgaaaataaagccacgctttctttttgtgaaagcctgcggaatcgaactggtgttctacgatgcgtggtttggcgaagacctcggtgactcggttcgtcaggaagcccatccagaggctgcttcggctat

SEQ ID NO: 28975 - DNA, 350 bp, Glycine max
  Peptide Sequence Number=SeqID_145753
cagtgaagacttgcacttctctatggatcaagctggtgaggaaagaaagtgcactgagtgagttagatgaattccgcttagaagcttacgagaatgccaagttctacaatgaaaagaccaagaagttccatgatagcatgatagttaaaaaggacttcatggttgggcaaaaagtgttattgtataattttaggctgggactcaggagtgttgagatcaaaagggattccacaaacaagagcttcaaggtcaacggacatggacttaagccattcctcacgaacctttttttagtggaggtagtggtggaagagacttctttactcccccttatttttcttcccccatga

SEQ ID NO: 28976 - DNA, 318 bp, Glycine max
  Peptide Sequence Number=SeqID_145754
atggtagccacatcggaggatggagctaatgatgctaatggtgatactgctacagaagagcctatagagcctaagatcaaaattttttttgagggaattgatattggtggcaataatgataaccaagaagctaatgagcatatggagcctactactaaagttgtacctgttgtagatgtagagcctaaagagggtgagcttaatgatgttgtggttaaggagaatagtgcaaaaggtatcattgttgttgaagttgcttctaaggaaattgatgaagttgatagcattattcgaagtgtcatttcttccattgattga

SEQ ID NO: 28977 - DNA, 651 bp, Glycine max
  Peptide Sequence Number=SeqID_145755
atgtcagcgaaatgcagccaaatccgacacattgtacgtctccggcagatgctgcggcggtggcgcaacaaggcccgaatgtccgcgaaccgtgcaccaccgtccgatgtgcccgcggggcacgtggcggtgtgcgtgggcagcaacctcaccagattcgtggtgcgcgccacgtacctgaaccaccccgtcttcaagaagctcctcctacaagcagaggaagagtacggcttcaccaaccacggacccttagccatcccctgcgacgaaacgctcttccaagacgttctccggttcatttcccggtccgacccggccaaatcgaaccgcttcttaaacctcgaactcgacgactttcagagacaccactgccacgtcggcatcagcaacaacctcgacttctggcctgagtccagaccactcctacatggccccactgacaaaaccatctggattggtctagtggtgacggttgagatagatgtacgaggatttattacatgttgggtccttgttatcgtcattgtacaccaaaaacaaagaatggtttcacaaaaatgtcgatccaggagatggcaaagggttggagtcgtcccgggttcggattggagtggaggctgtgatttcatggctattttcaagctgagatga

SEQ ID NO: 28978 - DNA, 360 bp, Glycine max
  Peptide Sequence Number=SeqID_145756
atggcatataagaggtcgtacatgcagatgaggtatttccaatcccaatatgtccattctccacatggcgaagggccaaggggagctcagactatgaaggttatcagcaggagtgtgtggtacatctataaactcttgacatcgtctacatctcctggtgaagtccagggcatctgccctaagggtgttgttaaccctcttttgaatagccttccgtttaaggtccgctcaggtgttgatgcaatcctccctaggaagggaccaatcactagaaccatgagcaagaggctccaagaagattgggctagagctgctgaagaaggccctagggttctcatgaaccttagggtagatttctga

SEQ ID NO: 28979 - DNA, 318 bp, Glycine max
  Peptide Sequence Number=SeqID_145757
atggggtcatcttggttggcgggattgatgcccttgaagtctctgtccgtaaaggttactattctagtggagctggtcgttcgccctgttatggttgttgtctctatctgcctcaatcttttgctcttctcttgtctgcttcccgactcccttgctgctcctcttgatgtcctttgggtcttgatcctgcctggtggttgtctggggtgtgtaacactcatacatgggccctttggagagaggctggtgcttatctggcttgtgcctcttgtccgacttgtgcgagtcggccttgacatttgcttcacgtttgtctag

SEQ ID NO: 28980 - DNA, 675 bp, Glycine max
  Peptide Sequence Number=SeqID_145758
atgaaggacaagatcgaagagcttatacaggttgggtacttggccaagtttgttaagagaccagacaaccaccaggcaggatcaagacccaaaggacatcaagaggagcagcaagggaacttcaagggcatcaatcccgccaaccaagatgaccccatggttgtctccatcatagaaaacttcatggtgcctagggtcctcatcgaccagggcagttccactgacatcctgtacttgaaaaccttccaaagacttgaggtctcatctgacactgtccaccctcatgctagtccactcctcgactttgcaagtggaagagttgaggccaaaggctacatgaacttaatgaccacttttggtcagggaaagctctccaggagcttcaccattagatatctactggttgatgccgccacatcagactttggcttagtcagcagaaaaacattcaacgagcttggagccatagtctctatgcccaatgaaattccttacactgataggggagatgagagcttaaaggtagcaccatatcctcccatccgggagctgaccatgccttaccccataatggctagaggcactcaagtcatgacagtggacgaagggtctccaatccaagctctgactgtctaccaagccagcttgggcagtgaatttgacatagatctgtga

SEQ ID NO: 28981 - DNA, 306 bp, Glycine max
  Peptide Sequence Number=SeqID_145759
atggagcttgcatcaggtgttgctttccctgggtatgtaatacattttgaaacatttgaaattgtcaatgagagacttcactatgtgagagtacttgagcatcactgtttccttggtctgcatcgttgctgcttgactctgacttctttggctagcttcaaacctacaatgagcgcctcatactctgtctggttgtttgaggctttgaagtggagcttgagggctttctctagagtaatgttatcagggccttcgaggatggtccctgccctacttccttttatgttggatgcaccgtcaatgtaa

SEQ ID NO: 28982 - DNA, 621 bp, Glycine max
  Peptide Sequence Number=SeqID_145760
atggttggatttttggtatctttgtctttgaatcagtttctggtggggtttgtctgggagaaagtgtgggaagtttctcactttctgtcttgtctcattctgcaacttttgaaggactacatgtttgctaaacgaccaaaaacatttgttgtttgtctctttttctttcttgattttaacttaaacactgctcaagtgactcatctattgggggttcttagctttgatagtgagaagagtcttatttcttatcatcaagtccttctagcaccgatcctggatggaaatattgcacttaatgacagttgtgtatgcaatttatgtggcaatgttacaaaaggtggaattactagagaaaaagaacaattgatagcagactcaaggaatgttgcagcctatgccaaatgtcccaaagaagttagagaagaactatggagatgtttgaaggataagaagaaacaagagagggaaacatttcataggacgagtcaacattttattgaagactatggtgatagtgatgggtaccgagctcgaattcgtaatcatggtcatagctgtttcctgtgtgaaattgttatccgctcacaattccacacaacatacgagccggaagcataa

SEQ ID NO: 28983 - DNA, 525 bp, Glycine max
  Peptide Sequence Number=SeqID_145761
atggacagaggtgaagggtttgatgatggtgactttggtgatgaaggcagaggcatgggcacaaggttttcaaatattgtgggtgcggaagtaggagctggtggtggtgaaggaggttggatggttagaggcagcctctattgcataagtatattcatgttgaaaaggacagagtcattgaaggacttgagcaaagattctaagtttcttccagattggcctattaaaggtgcaacatttcttgaatcctctcttcagacacaccgttggagtaagggcggtcaaaagagttacctcacatgcagtattggaagtgataatcgttgcaagggcatcttcaacaataggttgggaagagacttcaacaagcgaaggttcaactgcatccacctagggtccaagatgagcgtcttttgcctcatcttgcatctccataagttggtagttaagcttgtcctatttttattggagttcaacaaccattccttgtcctggaacccaagggttcttatcaggagagaataa

SEQ ID NO: 28984 - DNA, 795 bp, Glycine max
  Peptide Sequence Number=SeqID_145762
atgactcttgaagagcttgttgggattcttaaagtccatgagcaaaagcttgatcaagatgaaggaacaaagaaagggaagtcgctaacccttacaactcaaagaccaaaatgcagctttgcgtccaaagagtcatcatccaaagcccttgttgttaacgatgattccaaagaagagtctgatgatgatgactatgatgaagaagatgatgagctaagtccgaaactagggcacttcaagttggaatgtcctgaccttgaaaagctaaaggataagaagaagaaattcttcaagcccaaaaagacgagcctcatgagcacttgggaggacctggacaattcctcatctgacgaggatggtgaagaagaagccaacctatgtctaatggccaatgcgttcaccagcaaggcagacccaacactggacgtaagtttagatgatgaggactctcagcctgatgacattgccaactctgatggtgaagaggaagtcaaggcactactggatgaaaaggtatctagtggatgcaaaagtcttcgtaaggattttcaagacttggaagagaaggtaaaatccttaaccacaactcttgaagattcagaagaatggcacaaggaaattcttaaacaaaaactcttacttcaaaaagaatgcacctttgctaatgatgaacttgataatctgaaaaagaaggactcagatctctggatggaatgtcagcatgacaaaaagatggcttttgatttgaactgtaagcttaagggacatgaggtcttgaaagaactacctccttag

SEQ ID NO: 28985 - DNA, 231 bp, Glycine max
  Peptide Sequence Number=SeqID_145763
atgcttaagctacaggttcatatacatctctatgagatacaagtagaaaaacatgaaccgaaaggctctagacgaaaaactaagtatctgtcgttggacgatactgcttcagcgtccaaccttgagaagacaagtgctttagcacttgactcacagtacaaaagcaatggagcagttactcgatcctcaagtactgaaaacattcacaagaaagtaacgtccataggctca

SEQ ID NO: 28986 - DNA, 369 bp, Glycine max
  Peptide Sequence Number=SeqID_145764
atgccaaatagaatagctttgaggttgcctccattagacctggataaaaagaaaggaaaggtgcctcctcataccaagccaatgcctcatcctggccccaaagacaatattgccttgtgtccaattccctatgattggagcaggtacttcactcgagatgcggctaaaaagactattactctgaagctagacgctgagtttgatcaaaatgatgccatgatcttttacttcaaagacatgtatgataccccacgtattgcatccacattagagtatgacaaggaagacacatccaatcatatatgcatggacaagcttaactaccaacttatggagatgcaagatgaggcaaaagctaagcaacaatag

SEQ ID NO: 28987 - DNA, 381 bp, Glycine max
  Peptide Sequence Number=SeqID_145765
atgtcggcaaccaacactcctgctccgtactcgtcctcaccggtattctctcagaaggtgtctccctcgggttggccctctggttctttgaaatcttcactcctgctccacatagatggaacaagtccagtagctgaagatattgggcgtcagccttatagaaagacaagcctgctattttgcatgactattcacgtagaagatgccggcccaaagcaatgtaatgtaatgctgatgattattgtggcagttaggaatagagaaaaaataaatcagttgagagagagagagactatgaatgagggagtctttcatgttgggtgcgtaccttactaccttacgcattgggaaaaatttgggaattcagttgggagaacctaa

SEQ ID NO: 28988 - DNA, 735 bp, Glycine max
  Peptide Sequence Number=SeqID_145766
atggaacaggttgaggggcaaatggaggaagtaatttttgaccatttacatgcaactgctttccagtacactccacttggtagaacaattcttggtcctgctcagaatattatgacaatcactaaagatcatctacaaaactacattcagacacactacacggctcctaggatggtggttgctgcatctggagctgtcaagcacgaagaaattgttgagcaagttagaattttggatgatgatattccccttgcacaatttgccgtagcttttgaaggtgctgcttggacagatcccgattccgttgctctgatggtcatgcaagctatgttgggttcttggaataaaaccgcaggaggtggaaaacacatgggttctgagttggcacaacgagttggcattaatgaagttgcagaaagcatgatggccttcaataccaattacaaggatacaggtctttttggtgtttatgctgttgctaacaaagattgtttggatgacttaagctatgcaataatgtacgagacaaccaagttggcttatcgggtttcagaagatgatgtcacacgtgcttgtaatcaggtcatgtgttacatccccattgctcaatccatcaaagttgtgggtgccagcagcctgtcaaggttggcaattccaccatatcatgatctgacaatcccaccagtttgcaatattctgtcagaaagggatacaaagccatcacgaaaagcatag

SEQ ID NO: 28989 - DNA, 492 bp, Glycine max
  Peptide Sequence Number=SeqID_145767
gtggcctcccatgttctcgatctcctcctcgagctccctgacggtgcgcttcgcggtgcccttgaagatcatgtgctcgaggaagtgcgcggtgccgttggtctcctccgtctcgaaccgcgacccggcgtcgatccagacgcccacagtcgcggtctgggaggcgagggaggactccgtggcgacgcggaggccgttggggagggtcgtcacgcgggtctcgggcgcgcccaggacccgcgtgtggtccgccagcgcgggcaccggggacccgtgtttcaggaagcgtgggtccgggttatcgagccggcggagtttggctttggtcgcctccgcgaggcggtcgtagagcatggcgtcgggaggggtaggggcaggaggggagggggacttggtggccgccggaaaggtggagaagaggcggagggagggtggttggaggccatggtgggtgggtccgatggaggtgtggacctaaccgggggagagtga

SEQ ID NO: 28990 - DNA, 254 bp, Glycine max
  Peptide Sequence Number=SeqID_145768
cccactgttgcccccagcagggtcatcaggccccctaccaatcgagttttcatctagaagtgctgcgtctccaggcaggggcagggcgaaacaccacagcagcctggggatggccggcagcgggcaacagacgcaccgccatcacctctagagttcacctcagctcatccacaaaaaggacgcacctagttgctcatgatcctggggatttaaataaaacaagcgcaagctcgaaaggtagaaagataccttag

SEQ ID NO: 28991 - DNA, 921 bp, Glycine max
  Peptide Sequence Number=SeqID_145769
atgcggtcatgggtaaggggtcagtggattcattttgatgcagacgccctcagccaattcttgggtgactcgcaagtgttagaggagggccaggaatgcgagtttagtcagagaaggaaccgggccgatggatttgacgaggaggccattgcccagctattatgcataacgggtcaggattttgctcgaaccactgctaggaggcgggtgcggatcatgctcaccaacatgaccaccttgacccagatgtggatgacgttgcttcacagcaatgtcctgcccagcgatcataactccgacctccctctgccaaagtgtcagctggtgtatgccatcctgacacggatgagcgttcatgtggctcggttgatcgctaacgccatttatttatttgcaggtatgccacctaccagcgttgatcacgggtctctgccagtcacacctagcaaggtgattcgaccgccgatcacccgggccttcattgagaagtattgcacgcctagacaggcgcagggtgatgatgcaccgcaggccgctgacgcaccgccaccacctcatcaggctgatccagctgggtcattcggcatggagcggtatttccagcacttggttcgccagcaggcggccaaccacagggggcaggtgcagatccatgagtgtctctaccagctcagcctcagtcagcagagccagggtttcgctccttttgcatgccctactccagatcagtttagggctgaggtcgcatggcccggagattggcccgaggaccagacagaggaggcacttgcaggagctcccgacggtgcagaggatgcccgcatggatgaggagatgactcgatttcttgggaggaagcggagccacgtgaccgaggtcaccgcattttttgacatatctgttttttttcgttttgtttag

SEQ ID NO: 28992 - DNA, 213 bp, Glycine max
  Peptide Sequence Number=SeqID_145770
atggcaagcggccaagaatacaaaggatggaaaatgagtgttaatgtcttgagagaggactattttagaggaggagtgatggctagatggaatgatcatgcaatagttgaagctctacaagctttagctcaggctatagggaatcagaataagggaaaagctgttggagctactgagtatcaaaggatggaccacttccaacaaaacaattga

SEQ ID NO: 28993 - DNA, 295 bp, Glycine max
  Peptide Sequence Number=SeqID_145771
atgtctcttgcaactctttttggaaagcttcaggaacacgaaatggaacttatgagactaaaccaacatgaagaacatgtcaagaaaaagaaaggaatttcacttaaagcctcatcttctattcaagaagaaattgacaaagaggacttgaatgaaatagaagaagatgatgatttcagcttcttcgtaaagagattcaagcagtttctaaggaacaaaagaaatcaaagaagaacaaacttcaattcaaagaaaagaggagaatattcatcttttgttccaaagtgctatgaat

SEQ ID NO: 28994 - DNA, 325 bp, Glycine max
  Peptide Sequence Number=SeqID_145772
atggaagaggcaaaggacagtagaaaagttgagcaacttggagaatggtgggagatgtttggtgatggaactccaaagttgaggagatttgctattcatgtattgagcttgacttgttgctcttctggctgtaagcgtaattggagctcatttgaaatgaatgatgaggatgagcaacctcgaggtgaaggtgatggtggcaatgttgaattagtaggagatgttggaagaagttcaaatgatctagttgtagacgtttttgatctagataatttaattttggtggaacctaatgatgatgcacaatctaaggaagaccttgatg

SEQ ID NO: 28995 - DNA, 417 bp, Glycine max
  Peptide Sequence Number=SeqID_145773
atgccttacgctgaccaccaaggagttaggggctttgacctgatttcctacttccagggtcagctaagatggggtcctattgtggtctttgttcgaccagagagggtggtacgacaattcaggtatattcaaacgatccctccaccgcctgttagtgcttcactgtcatatgaggagatagatgataggtggatgaatttctcggaccatgtagcacctgcgggtgagattcgtgttgtccttggacaggtatcagcagactacatggattggtttttccagatatctcatccattcgtcacaccaacccaggcaggtgatcagcccagacatccacctgccccacatgatgaggaatacgtcgagccacatatcccagaggttccagtggcatctaatctccctagagattcagtg

SEQ ID NO: 28996 - DNA, 216 bp, Glycine max
  Peptide Sequence Number=SeqID_145774
atgaaggagttggaggctgcaatgaaggcaacacgaagaggccaaattaaggtggccaagggtgataactgcccaagttttataaggattacattagtcatatctctagttgatgtaagactaaacacaacccctcacaccttgcacaatgaaggtgacagaggctatatgaaggcaacccaaagacaccgcacaattaagtggaaaagggggtga

SEQ ID NO: 28997 - DNA, 2007 bp, Glycine max
  Peptide Sequence Number=SeqID_145775
atggaagaagtttgtctgaatagtgagccactttttgatgaaagtgatgaggttgatgttgaggggaactcttctgtagcagaacatgatcttgaatctttaaactcacaaccgaataactctccacttccaactgtgggtctggagtttgattcttttgatgaagtttacaacttctacaatatctatgcaaaggaacaaggctttggtatcagagtgagcaattcatggtttagattgaagaaaaaagagcgctatagagcaaaacttagctgcagtagtgctggttttaagaaaaaaagtgaagccaataacccgagaccagaaacaagaactggttgtcctgcaatgatagtgattagaatggttgagtccaacagatggagaatagtggaggttgagcttcaacacaaccatcaagtgagtccacagagcaaacggttttacaagtcacacaagaaaatgatcgttgaagccagcaaatcacaaccaccgtcagagcctgtaacggaagtacacaccattaagttgtatcgaaccactgtcatggatgttgattacaatggttactcaaattttgaagaaagtcgtgacaccaattttgataaattgaaatatttggaacttagagaaggggatgccagtgctatatataattatttttgccgaatgaagttgaccgatccaaatttcttttacttgtttgatattgatgatgatgggcacctaaaaaatgttttctgggctgattccaggtcaagaattgcttataattactttaatgacatagttacaatagacacaacttgtttggcaaacaaatatgagatccctttgatatcatttgttggtgtaaatcatcatggacattctgttctattgggttgtggcttccttggacatgaatcagtggattattttgtatggatattcaaggcatggcttcagtgtatgcttggtcatcctccacatgttgttattactgaccagtgcaagccattgcaaattgcagttgctcaggttttccctcatgctcgtcattgttattctttgcagtatatcatgcaaagagttccagaaaagttgggagggttgcaaggatatgaagaaatcagaagacagctgtataatgctgtctatgagtcattaaagatagttgagtttgaatcttcttgggctgatatgattaaatgccatggactggtagataacaagtggcttcagacattgtacaaagatagacatctatgggttcctgtttacctaaaagatgctttttttataggactgatcccaactaaagaaaacgagggccttactgcgttttttgatggatatgtgcataaacacacatcctttaaggaatttgttgacaagtatgacttagttcttcacaggaagcacttgaaagaagccatggcggatttggagactagaaacgtaagctttgaattgaaaacgagatgcaattttgaggtccagcttgcaaaggtgtatacaaaagaaatctttcaaaagtttcaatctgaggttgagggcatgtactcttgcttcaacacaagacaggtaagtgtcaatggatctataatcacatacgttgtgaaagaaagagttgaagttgaggggaatgagaagggagttaaaagttttgaagtcttatacgagactacagaattggatattcgttgcatttgcagtttgttcaactacaaaggatatttgtgcaggcatgcattgaatgttctcaattacaacggcattgaggaaatcccatctcggtacatcctgcaccgctggaggagggatttcaagcaaatgtttaatcaattccatgtctatgataatgttgattcccacaaccctgtgcccttgtatactcgtctgtttaacagtgctcttccagtgttagaagtaggggcacagtcacaggagcattatatggttgctttaaaagaactggaggagttgttaggcaagtttgatatagaggacaataacataatgtaa

SEQ ID NO: 28998 - DNA, 1806 bp, Glycine max
  Peptide Sequence Number=SeqID_145776
atgaagctgctgcgtcttcgaatcctcctcattgctctgcttctcatgttgtgcgccccattttcatcttcttccaaacccaaagaccccttcctcggcgtcgcccccgaagatgacgactattacaagtcttccgatgtaataagttgtaaagatggatccggaaaattcaccaaggctcagttcaatgatgatttctgcgattgtgctgatggcaccgatgaacctggtacatcggcatgtcctggtggaaaattctattgtcggaatgcaggacattctcctgtttacttgttttcatctagagtgaacgacggaatttgtgattgctgtgatggaaccgatgaatacgatggtcaagtaaagtgtccaaatacctgctgggaggctggtaaagttgctagagacagactgaaaaaaaagattgccacttatcaagagggtgtcaaattgcgaaagcaagaaattgaacaagctaaagtagctatggagaaggatgaggccgaactttcaaaattaaaaaaggaagaaagtatacttaaagggatcgtgaaacagctaaaggatcataaagaacaaatagataaggcagaggaggaggagcgtttacagaaagaaaaagaagagaagcagaaaagggagtctgaggagaaggctaatgaagcaaaagataaagctgatgaagatacagagcatagaaatgaagctgaaaagcattcagatattgaagacaatactctagaaaataaccatgataaaatagaaaatctagagggttctcctgcggatcaggatgaagcaggggacaaattagcagatgtacttgatgatgatgatgatgatgatgatgatgaagccagtgatagtcatgggagtgaaggatctttgcataataaagtggaagagaatgcaaaagaagctgaggaagaacctattgttaaatctgaaactgatataaaggtcagaaacaaagagtcttctgatgaaatcatcaataagcaccaaggtttagggcatccattgttgcaagaccactcccaggcacaggtctcacatcacagcaacacaatggatagtggtcagtggtcacaggggaatgatgcatctgaaaatactgagggattatcaagggaagaattgggccggcttgttgcttcacgttggacaggagaaaatactgataagccaagtgctgtacctgatacaacattagacaatgaagatcgggaagatccaaaggggagaaataatgaggaatatgaaggctatgcttctgaaactgatgatgacaacaacaaatatgatgatgacagccacaaatacgacgatgaagatgaagttgatgatgaatatcgagaggatgagcatgatgacctttcttcctcctacaaatctgattctgataatgaaccagacttgtcagatgctgctcgtgtacgcaaggaatatgatgaatcaagtgccaagttgtcgaaaatacagtctagaatatcaagtctgaagcaaaagctaaaacatgattttggtccagcaaaggagttttattcattctatgatcattgctttgagggcaaggagaacaagtacacttacaaagtctgcccctataagcaggcttctcaggaggagggttattccaatacccgtttggggagctgggacaaatttgaggattcgtacagagtaatggtgttttctaatggtgataaatgctggaatggtccagataggagtttgaaggtcaagttaagatgcgggttgaaaaacgagattactgatgtagatgaaccaagccgttgcgagtag

SEQ ID NO: 28999 - DNA, 615 bp, Glycine max
  Peptide Sequence Number=SeqID_145777
atgtgtgcgtgtgtgtgtggaaatttggaaaatgatgcaaagattggatgcgcgttaattggatcgctgggagcatcgtacaatggcgtgtcgctcgtaaatctggcaatcgcgttgttcgctttggtcgcaattgagagtagcagtcagagccttggccgcacctacgcttttcttctcttttgtgccatcttgctcgacatttcttggttcattcttttcgccaacgaaatttggaacatttctaccaagtattacacaacatttttcacattttcagtgaaacttactctggctatgcaaattgttggttttacagtgaggctatcatcctcgttgttatggattcaaatttataggttgggtgcttcctatgtgaacgcagcttctcgagcagcagattctgacttgaggagtagttttttgagtcccatgacacctgcagtagctaggcaatgctctaattccaatgagatacttggaggctctatctatgatccatcatactactcatccctatttgaagatgctcaagaaaacaaatattcatctgaggtaggcttaactttgctcaaaaccatagccatgattactttttcagttggtatcaattag

SEQ ID NO: 29000 - DNA, 1662 bp, Glycine max
  Peptide Sequence Number=SeqID_145778
atggctacgacgaggattgaggcagagaagaagccgaagacgaagatcgtgtgcactctgggccccgcatcacggtcggtcccaatgatcgagaagcttctgcgagcaggcatgaacgtggcgcgcttcaacttctcccatgggtcccacgagtaccaccaggaaaccctcgacaacctccgcgccgccatggagaacaccgaatctaatcttgaatacaatgttggagaatcgagatcacctgatatgatacgtttgatttatgagggatcaaacttgggaccttttcctccttcctttcttcttaaccacccaaccaaccttatgtctcttgattttggtcacaatactatacccatcgtcatgcctagcattgaagagaaatgggggcctgagattcgaactggttttctcaaggacggtaagcctatccaactgatacaaggtaatgaaataaccatttccactgactatgacctaaagggagatgagaagacgatttgtatgagctacaaaaagctgcctgaggatgtgaagcccgggatggtcatactctgtgcggatggcaccatatcatttacagttttatcatgtgacaaacaagcaggcttggttcaatgccgatgtgagaactctgccactcttggcgagaggaagaatgttaatttgcctggagtgatagtggatctcccaactttgacagacaaggacaaggaagatatcttggcctggggaattccgaataaaattgacatgattgctctttcttttgttcgaaaaggttctgacctggtggaagtcaggaaagttctgggaaaacatgctaagaacattatgctcatgtctaaggttgaaaaccaagaaggggttgcaaattttgatgaaatccttgcaaattcagatgcatttatggtggcacgtggtgaccttggaatggaaattccaatagagaagatatttctcgcacagaaagtgatgatttacaagtgcaacatccaaggaaaaccagttgtcactgcaacccagatgttggagtcaatgatcaaatctcccaggccaaccagggccgaagctactgatgttgccaatgcagttctggatggcacagactgtgtgatgcttagtggtgaaaccgctgctggagcctatccagaccttgctgttcaaacaatggctaaaatatgcattgaagcagagagcacccttgactatggtgatgtgttcaaaaggattatggagcactcaccggtacccatgagcccattagagagtctagcttcttctgctgttagaacagccaactcggctagagcggctcttatcttggttttaactagaggagggagtactgcaaaattggtggcgaaatacaggccagggatgccaattctttccgtggttgttcccgagctcaagactgatagctttgattgggcatgcagtgatgaggcccctgcgagacatagccttatattccgcgggttggttcccgtgttgagtgcagcttctgctagagcttctcatgctgaaacaacagaagaagcaatagaattcgccatgcaacatgccaagtccaagggtctctgccacaacggggattcagtggtggcactgcatcgtgtgggcactgcatctatcatcaagatcttgactgtgaaatga

SEQ ID NO: 29001 - DNA, 342 bp, Glycine max
  Peptide Sequence Number=SeqID_145779
atgaagaacgcagtcagtctaatggagaaacttatgaagaacaatagcgaagcaaagaaggaagtgcagttgtgcactctcagagctccagcttttataatggaagaaccaaaattttcaagcaaaggcaacccgccagccatgctggcgatccgtgggcaaggcaaatcgccaatgactaacgctttccacaccagtttcaagaatcagctggcagtggtgctccttgttccaatcttcaagcttgggtgctacctatggatgatactcaagtgtaacattgatgctactttcagggatcacaagctcaaaataggttgggggatacgtatgtgtctgtga

SEQ ID NO: 29002 - DNA, 270 bp, Glycine max
  Peptide Sequence Number=SeqID_145780
atggttgtgacaacaaacatgagaagcagggttgatgctgtcagtggcaaaggttactatgctgctgctggtgatgataaattaggattagcagtagcagcaacagtgatagagatgagctatgttgcacagttcgagcagattgaatggcagaacgctgaagattctccgcaatcgacgccagcgattgcgagggttctccatctgaagaggacgacgaatctgtctctgccattattttccgatggttgcactgcactcggtggctag

SEQ ID NO: 29003 - DNA, 237 bp, Glycine max
  Peptide Sequence Number=SeqID_145781
atggctccaaaactcatctggctatgcatgattcttttgcagaattttttaccagaagcagtatcacagtatagaacatatgaagatgcttttgtcaataaagttaaaggttttggcaaaaatggactgatgattgcaaaggagaatccagctgtaagtgctggtgtagctatttctgctgcccttctggctatgcgagtttccattgtactaactagtcacatggaaagcatttga

SEQ ID NO: 29004 - DNA, 198 bp, Glycine max
  Peptide Sequence Number=SeqID_145782
atggcagagacagattcgtcgtcctcttcagatggagaaccctcgcaatcgctggcgtcgattgcggagaatcttcagcgttctgccattcaatctgctcgaactgtgcaacatagctcttcaactcatttccgtgcctttcagttggtgagaactgagaaggtgaatgcggacttggggatttccattcctctgtaa

SEQ ID NO: 29005 - DNA, 921 bp, Glycine max
  Peptide Sequence Number=SeqID_145783
atgcgtaattgtccagatacgcaggacgcttgggcctcaggtatgttctggtctctgttgctatcacaatgccagcttgctgagggaatgatgagggaaagtgatctttacattgtccttcatctttgtctagaatatgctgaacagaggaagttaagcattgcgtttgatcatgaaaagaaactgattaagcttgagggtggatctagtgttagtggatatattctactagcacggattttatcagctcaacaaaagtttgtagatgcagagcttgttatagatgctgctctagaccaaagtgggaaatgggatcaagatgaattgttgagaactaaagctaaactacggattgcacagggaaaattaaagaatgcagttgagacacatactcttgcagttcttcaggtccaaaataaaagtttaggcacagcaagtaatgttgtgaagaataagggaaaccgtgacagaagtctggaaatggatatatggcttgatttagccaatgtgtacccagccttatcgaagtggcaagatgctgaagtttgtcttgtaaaatctgaggctattaatccctattctgcttctagatggcacacaaaaggtttactttttgaagccagaggtcttcatcgagaagctttgaaatcatataggaaaggattggatattgagcccaaccatgtgccaagtttgatatccacagcctgtgtactcagacaacttggtgatcaatcatcttcaattgttagaagccttctcaccgatgcactacgccttgacagaacaaaccctcctgcttggtacaatcctggactgctctacaaagctaatttggggacatcagcaatggaaactgttgaatgctttgaagcagcagcttttcttgaagaatcttcttccattgaactctttagataa

SEQ ID NO: 29006 - DNA, 516 bp, Glycine max
  Peptide Sequence Number=SeqID_145784
atggagcaccagactgttctccaagcttccttcatccttctcaaaccattcggcaccacatgttgtaaaaggcatgattgggcttcccgtgctccaagaaggtttctgtttcgccatacattgggtcgattccaaagtgaggaggcgcgatatgctagaattgagaagaatgtaaaggacttgaacctttcagtggatttactgaagaaggagaatgcaaaattgcttcaaaggacaactcttgctgagaaggaaatgaaatatgggcatacggaactagtgagtgccggaacccaatttcaacagctggcaaaatcagcatacaaggttgaaacccgagctgctgatttgcttgacaagctgcggtatatacctagtcgtgaagctctggcacttcgagctgaggcaagccaactttgtcttattgttgcttccatggcttcaaatttgaagcgtcagagatcttcgctgaacaaacggataatgaagatcaacgagttaggggttcctgtgtga

SEQ ID NO: 29007 - DNA, 237 bp, Glycine max
  Peptide Sequence Number=SeqID_145785
atgcctaactgtactctatggagatggattatcacttatttgaataaagtaggtcaatgggcaaaggctagggttgagtctacattttataacagtaaagagagatcgtccagagatcacctgaaagacagagaagggtggaaccacagccacaaaggcatcaggacagaccacgatacaatgatagaacaaggtatgtccggcgcagagaaaacatgcagtgaaggaccaatttga

SEQ ID NO: 29008 - DNA, 243 bp, Glycine max
  Peptide Sequence Number=SeqID_145786
atgatgattgggaaacaacgtgcaaaattagtcatggctacaactaggtgggtactcaagcatcctgtttatggcattgtgatactaaggcttgggatttacacaagtagacccaatatttccaaattatgttctttcatcggttcaaggaatccatccattcttatctcggacgacgttcctaaaggaaaactctacaaggttccggaatttcaacacacattatcgacaataaggaagtaa

SEQ ID NO: 29009 - DNA, 381 bp, Glycine max
  Peptide Sequence Number=SeqID_145787
atgacactcaaagaacaaaccgagggtgcccaaaatgttagaccttctaaaaataccctatcccagcttattccacagacaaaaacggatgagatacatgatcctccccccagctactctcttccaataaatgtctatgatgatgatgttatggcacaatttcaatcatgttcatcaccaagcttgcgaatgcttccttatgatagtagtagcagctgtagtcaccaacaatttccaaggtaccttccgttccaagtgactgggttcggtccacaaggtatacctgcgatgatgcctcagtataataagggacatttatggcttcaccctccaactctcacagatttcccaaaattggtgcaagcttgggaggtaaactaa

SEQ ID NO: 29010 - DNA, 504 bp, Glycine max
  Peptide Sequence Number=SeqID_145788
atgaatcctgaaggtgcacaagctaatgcaaacaaccaaaacgaagtgatccttcatctatctcttgatcttgaatcattgagtctccttcctttatttcccgtagctgaaagtgtgcaaaggttcaatgaagggcttcttcctcagccacaaatgaatctacacaatggtcccaaaactgttgttcctcttcatgagttctctaatgtagcattgagatccaacatttctccttcaagttcccttgctaaaactcctcaaaagccttccaccaatcttgatttgtcactagcctcaggcttaggtatgaatcctaataacaatcttgcacaaggacatgcagtgcaagagcaaggcatgcgtagaggcactttaacaaacattgtgcacctacgaaccaagagacgcttcagtgactgtgtttttcaagaatttcaagtgggtgaaagttcaaagatgggtgaacaagctgcactggctaaacggcgtgctacccgattctaa

SEQ ID NO: 29011 - DNA, 930 bp, Glycine max
  Peptide Sequence Number=SeqID_145789
cgaagggtcccacgggttgttcaaaacaactacgactccctcgacgtccacgtcggacagtgctacactgtcctcgtgaccgccgaccaggagcccaaggactacttcatggtcgcctccacgcgcttcacgaagaaggttctcaccgccacgcgcgtgattcgttactcgaatggcgtggggcccgcatccggcgggcttccacccgcaccccaaggctgggcttggtctattaaccaattccgctccttccgttggaacctaaccgctagtgctgccaggcccaaccctcagggctcataccactacggtcaaattaacatcacccgcaccatcaagttggtcaacaccgttagcagggccaacggcaagctccgttatggactcaatggcgtctcccacgtcgacacccaaacacctctcaagcttgccgagtactatggcgtcgccgataaggtcttcaagtacaatctcatctccgactcccccgacaccgccttccctgacctcaccgtcgctcccaacgtcatcaacgccaccttccgtgacttcatcgaagtcatcttcgagaaccctggcaaggtcattcagtcctacaaccttgacggctattctttcttcgctctcgcggttgagccagggaagtggaccccagagaagaggaagaactacaaccttcttgatgctataagcaggcacaccattcaagtgttccctaactcttgggcagcaatcatgttaacctttgacaacgctggaatgtggaacttgaggtcggagatggcagagaatcgttacctgggacaacagttgtacgtgagtgtcttgtctccaaacaggtctctaagggatgagtacaacctcccagagacccagcttctatgcggaattgtcaaggatatgcctaagccaccaccttactccagttaa

SEQ ID NO: 29012 - DNA, 533 bp, Glycine max
  Peptide Sequence Number=SeqID_145790
atggcatttcttgacgtacggaaaaaaataatgggtagggtttggacttggacgatggcactgatgctttgcctgatggcagcatcggttaggagcgaggacccttatatttactacacatggaaagtgacatatggtaccattgcccctatgggtgttccccagcagggtatcctgatcaatggccagttccccggccctgaaatcaactccaccagcaacaacaatgttgtcatcaatgtcttcaacaacctcgacgagcccctcttgttcacatggcatggtgtccaacacaggaagaactcctggcaagatggtacattgggtgtccagtgccccattgccccaggaaccaattatacctatcactttcaggtggttaaggatcaaattggaacttatttctactacccgaccaccggcttgcaacgcgcaatcggtggattcgggggtttgaggatcttcagtcgtctgttgattccagtgccctatgccgatcccgccgatgagtattgggtgctcatcggcgactg

SEQ ID NO: 29013 - DNA, 237 bp, Glycine max
  Peptide Sequence Number=SeqID_145791
atggtggcagcgacacctaatgaggcagacgttgatgtgcatcatgttcgacatgcagtggatggttttgtagcaattagtgatgagttggagagactactgaacctgaggatcctgaccgaaggaacaaaagcctatactgttgttgaagaatgtgtgagcatcacaagaagctacataggccaaccaactgtaggtcacagatcgaggcgtaggcggcgtatggacgatcattga

SEQ ID NO: 29014 - DNA, 156 bp, Glycine max
  Peptide Sequence Number=SeqID_145792
atgtctctacgtcgcgtgaggtcccagggtcagagtctgctcttataccagagagagggcggtgacttgacgtttccaagcccggtaattagcacgagacaatttgaaagtgatggaagcattaaggaggagatgatttggaagaggtggggttag

SEQ ID NO: 29015 - DNA, 255 bp, Glycine max
  Peptide Sequence Number=SeqID_145793
atgttacttattctcaccactattcccgaattcactaacctagcttcctctcagtcgccttctctgctttcattcatcgttgtccaagttgtggattccctcaaagttgtgaccctcgaacccatccgccctttctcactcaagttttcactgggccctctctctcttgaagctctgcgaagcaacgttggagcagttcatctgtcaagtgtctccatcaaaggtgtctgtgtaggtctatcgcttctcaaatag

SEQ ID NO: 29016 - DNA, 648 bp, Glycine max
  Peptide Sequence Number=SeqID_145794
atgtgggccgaatggtcctacaacacctcaattcactatgcaactagtgtttctccattcgaaataacctttggctggaaaccacccagcatccctcaatacctcacaggatcggctcgggtaatagttatggatgagttactgactaacagagagacagtcttcactagtttgcggaagaagctttcgaaatcacaagcgcgcatgaagagtctagccaatacccacataagggaaatccacttcgaagttggacagtgggtcatgcttctagaaggttgtcgcatccatctagttttccattgctcaatacttaaaccattccaccaatccccctcagccaccgacataccaataacattaccttctcagaccagagaccagcaacctgtcatttcacctcttgcaattctgagtacttgccaggatgttatcggggatgaaactcatttaatggtcctcatccaatgggagtgtcttcatccaaatgaaacatcctggaaagactgggccaatttaaagaaagcttatcaccttgaggacaaggtgttgcctgatgggataggaaatgatgggcccaagttcaatgatcagatgagtacaaggcccaaaagagtaatcaccatcccaaggcacctaagagattag

SEQ ID NO: 29017 - DNA, 1185 bp, Glycine max
  Peptide Sequence Number=SeqID_145795
atggcattccgcactcatcacgggcattatgaatttcgcgtaatgccctttggattgtgcaatgctccgtcctccttccaaacaatgatgaatgaaacctttcgacctttccaccaaaaatttgtcattgtgttttttgatgacattcttatctacagcaaaaatttcgcagatcatcttcatcagttggagcatacatttcgtgctctagagaagggagtggaacccgtacccgacaaggtcagagcaatccaccaatggccaacacctcgaagctttagagctcttcgcgggttccttggtcttgttggattttatcaccgctttatcaaaggcattggaataggagcggtgctatcacagttgggtcaccctctcgcattttttagcaagcaattttgccccaagcttcgtctagcttcagcttatgttcgtgagtttgctgtcatcacgaccaccatcaagaaatggcaacagtatttgctgggacatacatacctcgctcgacttatggggtatgattatactatacactatcgaacaagcaagaccaatacagttgccgatgtgttatcacgaatcctagaggagggacacgcttccttattggtcctttcagtgccccacttcgcctttttggatcaactcaagcgcgaattaacattccatcctgagttcattgctctcaaacaggccttgcaagataatccgacaattaagcctgattatgttgtcgttcagaatttcattttgtacaagaatagtatctggcttccctctagactcgactttatccataccctgttattggaatttcacaccacacccacaggaggacacatgggtatcaaaaagatactagcacatttggtggagaattttactttgtcgagtatgcgtgacgatgttcgaaaaatcattgcatcgtgtcgtgactgtcaacataccaagtatgaagcacgaaagtcggcgagcctgctttgcccattgccaatgcccttacgaccatgggaagacctattattagacttcattgtgggccttccaccttatcgggggcacactaccattctcgtggtcgttgacagattttcaaagggggttcacctgggagctctttcgtctgagtggcacgtgactgcgcatgagttcgacttaccatccctaaacggatggccaaactga

SEQ ID NO: 29018 - DNA, 489 bp, Glycine max
  Peptide Sequence Number=SeqID_145796
atgagactcgacatgcaaagaatttggagaagaaatttagggagagatgatagatgtattgctgataatgggaaggaggctagatttccattcttggatgaggatgttataaggcttttgctcaatattccattgtgggaggtagccaacctcgatcaacctagtggcattggtgataaaaggattttaagagaggttgctgaattgcttggtttatatgaagcagcagttctgccaaaacgagcaatccagaatacagttgttccattcgttcaacagtttaagttttatactctgctggttcacctgtgtaccggaaccatattgccttttcctttcatgttagatgtcaatagagttttgttattgctgggatgcattgaagaactaaaattttggttcaagaattgcaagggaatcaaatcggaagaattttggaagcaatcgagcagcaaatcaggcatcggctggcagcgtaacgattcatag

SEQ ID NO: 29019 - DNA, 504 bp, Glycine max
  Peptide Sequence Number=SeqID_145797
atggctgattggttgttggtgactggaagggaggcaggaaaactaagtgatcggaggcttgggaataaatgtgttggtgtacctgtggaagaacctgttctagatatgtttactacaaaaacaaatacgggtgaattacacaggtggagacttgtggaaattgatgctgacttgtcagacttggtgttcgaaactagtcatgttatgtccctcataaatcctgccaacacctacatggacctgaatattggaattgctttatggcttgctgctggtggtgatggatgggtatctgatgcaaatacatatgataatgatggcaatcatgtacgaattaaatataagtcaaatgcgaagattctccttgttggttctggtgccgatgagcagtgtgctgggtatgggagacatagaacaagttatagacgtggaagggactactttgacaacgttttgcatgattgggggactaaattgatgaagctttacgaaggactaaattga

SEQ ID NO: 29020 - DNA, 255 bp, Glycine max
  Peptide Sequence Number=SeqID_145798
atggctgaacaagatactacaaatacaggcacgaatgagaggcccaagaaccaattctgttggagtggtggctggattagattgaagggatatgcttgtgatgtttgttattttcattcctgcacctctattacagcacctttgtatgctatctgtatatacttaatatgtactgaacagaagcaagcaagaaatacaatctcttttctcacctttgctattggggttcctagtcctccaattctaggaagctaa

SEQ ID NO: 29021 - DNA, 336 bp, Glycine max
  Peptide Sequence Number=SeqID_145799
atgtttgcacattcgattaaaggctgccgtcccttgggacggacgtgtggggtgctaataccttccccgtgcgtaaatacaactcccgaaccttttcacttaaaagtttgtagatcgcgtcttttccggtttttccgacgttttcctcaaataaacattggtggcgactctgcgcgtattcctttcgtggaacacgcatcccgcgagtcacgcgtcgccctcccgccgaaggggaattggaaaggaggattggtgccataccttgaagaatttgagtcaagaagcaaggggccaaccaccttaagagctattggactaagaagcactccaaattga

SEQ ID NO: 29022 - DNA, 405 bp, Glycine max
  Peptide Sequence Number=SeqID_145800
atggcgaccaataagaatttgacctgtcttggggcttttggttatggtcctagtatgtccatcccttacatggcaaaaggccaaggggagctctttgtgattgtcaggggatgtgcgtggaacatttgcaaattcttggcattgtctgcacctctttgtgatgtcgagggcagcggccttgagtgtcagccaatagtagccgacacgcaccactttggttgccagggagtgtcccccgatatggagtgtatcttagatgatggtcttgaggtgtctagtcctcttcatgctagccaacttggagagcaagtctgcccttatgttgctttcacttggtatgtgatacatcttgaaacaattgaaatcatcaacaagggtgttgactatgtaataatatttgagtag

SEQ ID NO: 29023 - DNA, 420 bp, Glycine max
  Peptide Sequence Number=SeqID_145801
atgaccacctttggtcaaggcaagctctcacgaaacttcactgtcagggaaacgttaaacgagcttggaaccatcctctctacaccacaccttaagatgaaattcccaacatttactggcaaaatcataactgtcaaggtaaaccaaaagcaaacccatcaatgctatgtcgaaagccttaaggtggctctttatcctcctattagagagtcggacaagcctcatcctacatctagtggtagcagtcaagtcatgaacatggacgaagaatctaaattaaggaccctggtcttctacgaaacaactaggatatatcaagatggtgtattcgatgtagatccgtgggatgacatttttcacaaaggtctgaaaccgatcgaagaacttgtcaagttagaacttggacataaacctagatag

SEQ ID NO: 29024 - DNA, 651 bp, Glycine max
  Peptide Sequence Number=SeqID_145802
atgggagaagagcaacaaaaggtggtcagaaaggaggttgacaagttactcaaggcccaatttatcagagagttgttaagtttcctagatgcctactcagggtataaccagatcaggatgcaccctcccgacgaggaaaaaattgccttcataattgaagacatcaatttctgctacatggttatgccctttggattgaagaaacacaggggccacgtaccaaaggctcatggaccggagattcgcaagtataacatgcgcctcaacactaaaaaatacacatttggggttgaaggcaaaaagtttctaagcttcatgattacctatcatggaattgaagctaacgctgacaagttcctcctgaggctcgcaaagaaagagaagccattgtacaagctactctggaaaactgagccattcctgtgggacaaaacttgcaagcaagccttcttagcttttaagaaaattattgagacaccaccgatcctaagtcgacaaaagccagaggtacccttgctactttacctagtggtagcggaaaaagccatcaatgatagagaaggtagtgttggcgatcataaccttagcccgacgtctcaggccatattttcagagtcagcaagtggtagtcgagataaaccaccctattag

SEQ ID NO: 29025 - DNA, 675 bp, Glycine max
  Peptide Sequence Number=SeqID_145803
atgacgacaatgcacaacactacagtgactattacgcatgacaattatgttaaggtgcatgagggtgcaaatacgatgacaatagagagaagaaaaggtgcggtggagagaagaagaagcgctcaagggtttgggactgaagaggaaattttggagtatcaagagttgaagaaatatttggagatgaagagcattttctacccatatttgattaaggtattctacaccactacacatgtagatggggaaaaaggtaatttgtgtgctaatgttaaggggaaatctattgagatgactcttgagttatggatggatattgttggcctctctagtgtgggcatgattgctaatgagaaaggcttggaagatgaagaagtgaccttcaacaaatttctggaccactttgaagtggatgtctcaaatgaaattgaagattttgtggacccaaattttgaagcgaagaccaaggtgttaaagcaaatggggtatgtagaagctaaagatgggaatggttggattgagaagcaaaaggactccacaactaacaatatagagaagcaaatgaaaccttttgcagagatgcttctggccaagatggatgagctaatgagagttcaaaaggaagactacaaagagtggaaaaaaaatgtttcgacaccatctctgaaagactag

SEQ ID NO: 29026 - DNA, 414 bp, Glycine max
  Peptide Sequence Number=SeqID_145804
atgccagctcatattttgctaaatgctttaaaggaatcagtcttacggcgcacttcaatcctaaggctacaagtctatgactgcacattggtttgtctggctgtgatatctggtattagacaagagaagttttttcctgtggcaattcttttctctggtggcctggactctatgatacttgcagcattattggataaatgcatggatcccagctatgaaattgatctacttaatgtaagttttgatgggcagttagctcctgatagaaaatctgccaaggcagggttgaacgaactaagaagagttgcaccttccagaaaggcgaaccctggtgcagcggtaaagttgtgccttggtgacttgttggtcatgggttcgaatccggaaacagcctctttgcatatgcaagggtaa

SEQ ID NO: 29027 - DNA, 231 bp, Glycine max
  Peptide Sequence Number=SeqID_145805
atgaaaacggagaagagcaaagtcgatacagtgatagcaatttctccaaacacatggcatgcatcaaagattattcatatttctccccaagatagtgaatatgtgatttatggagacaacaagcaaaggccacttgatcaacaagcccaacaagtggttgtcatcatcaaaaagggggagaatgtaaatcatgaagattttaatgatgtcaaaaagatcaagccttggtga

SEQ ID NO: 29028 - DNA, 198 bp, Glycine max
  Peptide Sequence Number=SeqID_145806
atgtggcaaagatgccttaagcaaggtggagctaaagattggcttgccgaggttgatccaaagatgcacagacaaggtaaagtggaagatgtcctaaccaaggatctcttgaaccacctcattaagtgggagaccttgtgcttaggccaaactagcacctttaggtctaatgatgagcttgtgactcattcattatga

SEQ ID NO: 29029 - DNA, 883 bp, Glycine max
  Peptide Sequence Number=SeqID_145807
atggccagcacgatcgccagcagcgacagccagaaatgggtcttctctgcggcagctggcggctttggtccacatgacgatgaaggtttgcagatagataatatcaaacagccaggcagcaaagaaaaagcccagcggcaacggctcaagcagggtaaacagcgtcacgccaacaaccgagcgtcccgagagtcatgcgcacagcccgcacaaaaagttaaccgtgccgacggaactggttcagttcctgcgcgtcgtggctgcagaacagttgcacctcttgcgcgtgctgcagtgacagttcacgcagccgctgctgattgctgtgccaggcggcgcggtcactgcacatcaggcgctgataggcgcgcaggcccggcgtacagtggcgctggctgtggcgtcgccgccatgcagcagccagccgccctggtgacgaatcgccacgcccgcatggcccagcgtatgtcccggcagcggcaccagcagaatctcatcgctgagatcgtcgaccgccttcaccgcatcaaagccataccagcgctcgccgccgctggcgtaaccgcgccagccatcgtgcgctgtccactgctgcgggcgaaaccgctgacgcgccagccagctgctgtcgcccgcctgggttacggtatccagttcacgctgcagcagatgaatgcgggcggccggaaaatcactgatgccgccggcgtggtcaaaatcgaggtgggtcagaataatgtggcgcacatcttccgggcgaaaacccagcagctgaatctgtgccagcgcgctgagctgctcgttatagcgaatattattcagcgcgcggaaaaagcccgacaggcggcggtcaggatggtgcatatcctgcgtgcccagaccg

SEQ ID NO: 29030 - DNA, 906 bp, Glycine max
  Peptide Sequence Number=SeqID_145808
atgagtgcgctgtggattgcggtactgctgagcgcctgcgacagcggatcggacctcgatccgcaacggcaaatcggccctgatccgcaactgccgcaggccaaaaacttctttatgccgccgatgcaggtgccggaaggcaccgcgtggaaagagggcgagacaccaaaagtggccgacggcctgaagatcgagaaaatcccggccagcctgatgcacccgcgtcagttgtatgtgctgccgaatggcgacgtgctggtggcagaagccaacggggtgaaaaacccggtcacggcaccgaaagaattgatcatgagcctggtgcagaaatcttccggcaaaggtggcccgggcggcaaccgcatcacgctgctgcgcaacgttaacggcaagtgggaacagcaccggttcatcgaaaacctcaatgcgccgtttggcatgcagctgattggcaatacgctgtatgtggctaacgccgacagcctggtgaaattcccttaccagaccggcgaaaccgaaatccgcacgccgccggaagaggtgacgtcactgccgggcggtgagctgaatggggcactggaccaaagcgctgctcgccagtccggacggcagcaaactgtacgttggtgtcggctccaacaccgcatctatgccagcggcatccgcaatcctaccggtctgcagtgggagccgcaaagcggcaagctgtgggccatcgccaacgagcgtgacgaaatcgggtcggatctggtgccggattacctgacctccgtgcaggacaaaggtttctacggctggccgtacagctactttgcggccggatctggtcgcgaaagccatcaagccggactatgcgctgagctcacacgtggcaccgctcggcctgctgttctatggcgcggataa

SEQ ID NO: 29031 - DNA, 495 bp, Glycine max
  Peptide Sequence Number=SeqID_145809
atgtcttttatctcagacttttgggtatgggtggaagcaattatgagggttgttggaatgggaagtcattccaatcggcgactcctcatcggaggagacaggttgttggacccgcgacatgtcgacgagggtagctctcaacctcatgagatagttttaccttatgttgctcctctaggagaggaacccatccctatcataacaatccttccctcttctccttcggcggctaaaagaaggggtgatagtggtgtggttagggtttcgccttgtaataggcatagccatagtgccaggatgtcctcacctccacccttcattgctggttatgagttggtgagggttgatgtcttgaagcatcgctcttcaataacatttgttatgagcatcgtgactctatggcgccaattggagctggccaaactagaagattcccgcaatatgattgttcaggcttgcggggaagatgagttttcgttcatgcgggcggcatag

SEQ ID NO: 29032 - DNA, 528 bp, Glycine max
  Peptide Sequence Number=SeqID_145810
atggctaatgaagaggaacagaaaaaccacctcttcggcatcaaagatctcggtcacaagactctccttcagagtgatgcactctatcagtatatacttgaaaccagtgtctatccaagagagcacgagtgcttgaaagagatacgcaagatgactgcaaaacacccactgaacatcatggcaacaccagcagacgaaggacaacttctgagcatgcttgttaagctcacgaattcaaagaacgccttggaaattggtgtattcactggttactctctgctctccactgccctggctcttccccctgatggaaagatcttggctttggatgtgaatcgcgaatactatgagttaggattgccaataattcaaaaagctggagtggctcacaagattgatttcagagaaggacctgctcttccgtttcttgacgagatgcttaaagatgtgggtgcacagtttctcaccatctcaagttttatccatgattttttgttaacattgggaaatatttttcgatttggttga

SEQ ID NO: 29033 - DNA, 1304 bp, Glycine max
  Peptide Sequence Number=SeqID_145811
aatcgctggtgtggcaaccactgaccgaagccgccatcaatcaggcgctggagcaggataagcgcgtctttgtcgatgtcaccgctgactggtgcatcacctgcaaagtgaataaatcacgggtgctgaatcagcctgacgtgcgtgccgccctcggcgcagaggatgtggtgctgctgcgcggtgactggactcaaccggatccggccatcggcgagttcctgcgccgccgcgatcgcgtagcaatcccctttaaccagatttacggcccggcactgccgcacggccagattttatcgccgttattaagtccacccgccctggccgccgcgccatttacccctgagcaggaggcgcgcattaaacagctgattcgcgaaaccctggtgcaaaatccggcgattctggcagaagccgccgacgcatttgataaagaagccgcgcgccagcagcaaaacgtggtcgcgcagatggtagagaaaaaccgcgcggcgctgtttgacgatgccggctcaccgcgcatcggtgccaaaaaaccggcactgacgctggtctatttcaccgactacaactgcgtcttttgcaaaaagtttgaggcggatatcgaaaaactgctgcacaactatccgcaggtggcggtggtgctgaagccgctgccgtaccgcgctgaaagctcgctcagttcggcgcgtctggcgctgacggtgtgggagcagcagccgaataactttcttaagctgcatgaacggctgatggcaaagaaaggcaaccatgatgaagccagcatcgccgccgcgctggacaaaagtggcatcagcctgtcagcgccgagcaccgccagcctcgacaccatcaacctcaacctgacgctggcgcagcagctgggtgtgcagggtacgcccgccacgctggtgcgctgcaggctcagccatgagccgggtaacgcgctggctgcgcgaaggcgtgctattgttgctgatggcagcggcgctgctgctggccatggactggctgcgtgcaccgcagctgcccgcggatgtggcccggcagccgctcagcgcgctgcagggcgaggtgaacctggcgacgctgagccagcagcggccggtgctggtttacgtctgggccagctggtgtggcgtgtgcaaactcaccacaccgacggtggccgcgctcagtcagcacggcacgcaggtgcgctggcaaatcagcgccacgccgacgttcatcgtgctgcatcagggcaaggtggtcagcaccagcagcggctggaccagcagctgggggctgaagctgcgcctgtg

SEQ ID NO: 29034 - DNA, 888 bp, Glycine max
  Peptide Sequence Number=SeqID_145812
atggattcgcagcaacgaacagcggcttctcctcggtcgccgccgcgacaaggccacgattccaccgccattctcttcaccctcctctcgttcttcgccattgtcgctctggttttgcttccttcagcatcaccattcttccaaaatagcttatccatcctgcaccaagtccctgaaggacatgttggggtatattggagaggaggtgcccttctgaaaacaattacagagccaggtttccatctaaagatgccttttctaactcagtatgaacctgttcaagttacacttcagacggatatggtgacagatataccctgtggtactaaaggtggtgttatgatcagttttgggaagattgaggttgtgaatcgactccgtaaggaatttgtctttgagacattgctcaactatggtgtacactatgataagacatggatttatgacaagattcatcatgagattaatcagttctgcagttctcattctctgcaacaagtctatattgatgtctttgatcagattgatgaaaagatgaaagatgctcttcaagttgactgcactcgctatgctccaggaattgagatcttaagtgtccgtgtcacaaagcctactattccagaaagcataagacgcaatttcgaacaaatggaagaggagcgtactaaggtcttaatagctattgagaaacagaaagtagccgagaaggaggcagagactatgaagaagatggccattagtgaggccgagaagaatgccaatgttagcaagatccttatggagcaaaaattattggaaaaggatagtgctagacgacaagaagaaatagagaatgcaatgtacctggcacgtgaaaagagcctggcagatgcagacttctaccggtga

SEQ ID NO: 29035 - DNA, 1659 bp, Glycine max
  Peptide Sequence Number=SeqID_145813
atgaaaaaatcaatattttcgcatcggcactcgacagagatctcactcaactcaatcgcctccactctctcccgcaaaccattcttcttctcttctctccctctgagcctttcatcgctcctcggaggcaagattgggtgttggaatgcttttgtcgacaaatgtgtggttactgaaggtgttggttttttagtaatggagggctatgagatggctgcgtccgaagaatcatcaaccactcagatgattggcaatgcttttgtgcagcagtattactccatattgcatcaagagccagaccaagtccacagattttaccaggagtctagcatcctaagtcgacctgaagaagatggtaccatgacaatggtgactactactctggaaattaataaaaagatactctctctggattacacaagctttagggtggaaattctgagtgctgatgcgcagccttcattcaaggatggagtaattgttgtcgtgactggctgcctaactggaagtgacaatctgaaaaggaagtttactcagtcctttttcctagctcctcaggacaaaggctactttgttttgaatgatgttttcagatatgttgatgagtataagtcagttgatattgaatctgtgccagcaaatgatgctgctaccgctgatgaaagtgctccaacagatgcttttgtcccagagcctgaggtcattcatgttgctgaagatgttcctcctagtcaaactgctgttgttgatgctgacattagtgtcagcaaagaagtgagtcaaccactggagaatggaaatgtatcagttactgaaaaggtggttcctgttaatcatgttaaagaatctagtcatcaggagcatagtcattatcatgctgagaaagctgcttctaataatgcactggaagatactccaaagaagtcttttgcatccattgtgaatgcactgaaagaaaatgctgctcccttccatgtgagggtttcccccgtgaaacttgttgaacaaccacgtgtttctagcatacctgcaccagaagcaccagctcctagcattgaaagtccaccagaaaagaataatgagaatggaggcaaggcttatgcaatatttgttgcaaatttgcccatgaatgcaacagtggaacagctggaacgtgctttcaagaaatttgggcccattaaacaggatggtattcaagttagaagtaataagtgcacttcaacaacttcaagtattgatacaatgttttgctcttatttccagcaacagcaatcttgttttggttttgtggaatttgaatcggctacttcaatgcaaagtgcacttgaggcctctcctcccgttaccttggatggccgtagactttcaattgaagaaaggcgagctaataatgatagggggaggtattcatcgggaaggggcggttacaggaatgatagaaatgataacttcaggggccgtggcaacttcagtggcggccgtggtggtggtggctatggaaacaggaatgatagttttgagaagcgaagtgagttctctggccggcctcgcggaggcaataataacggtgggggccgtagcaatggagaagctgtgccaaggagttatcagaatggaggaggagcaaaagtgactcgtcaatcagtgaaagttcagtaa

SEQ ID NO: 29036 - DNA, 954 bp, Glycine max
  Peptide Sequence Number=SeqID_145814
atggcgaagaacgagaggagggtgaagagaatggcggtggaatcgtggccttgtcgcggcggcgaccgaggagaagccgctgttcgttgctgcgaatccatggcgtctcaatcgggcgtaattggaaagagaaggtttatgaaggaggtagtctccaatccaagttctattatttctcttcctatcataagcaccaccccaacaacagcaccaccacaaccacacacaacaacaaaggctaacggcgatgctgaaggttacgcgttttgtccatgcaatggttgcaacaataggactcgaggtttcaatttgattttaatcatggagttgttggttgttgtggcaattgatgcaggtggcgaagggtggccctcttggctctctaaggttgctggtgaggctatatcaatgggggggtggaaccctgaaatgggaaactattgcagaaaattagttgaattttgcagtgggaaggctgtgagtgaattgtgccacaacatagaaggaaacatcaacgttggctcatttagcaggttgatatatgacatgatgcttgcgtgggagagacctagctactacgatgaagaagataccacggagaatgtagcaaaggagaaagaagaaaggaagataactttgaataccactcaggaacaggatgatatccctcttttttattcacatgtgaatgtgagtatgagtatggtgcgtgtgggctgtgaagccaacactggagatggaatagggatcatggtggctctatctcaccagttttacgaggagatttggaggatgtctatccaagatgggctgcaagctctcactacaccttggtaccaattccggagggacaacaacttgatggctcgagatgaagttgtcttttattatgggccaaaccaaggtgtgtgggagatcattctgaggaaggacatcggatgggatgaagactag

SEQ ID NO: 29037 - DNA, 2739 bp, Glycine max
  Peptide Sequence Number=SeqID_145815
atgggcagcagcggtaatctcaccaatctgctgttcgtcacgccggattactacgaagagcggcccaaaccctgtatgggcggctggggatcgatatttctcagcgtgacgccggaaggtacggcgttaccctgtcacagcgcgcgccagctgccggtgcagttcccttcagtgctggagcagagcctggaggatatctggtacaactcgtttggcttcaatcgctatcgcggcttcgactggatgccggaaccgtgccgctcatgcgatgagaaagagaaagatttcggcggttgccgctgccaggcatacatgctgaccggcgatgccgataacaccgacccggtgtgcagcaagtcgccgcatcatggaaaaattcttgaggcacgccgagaagccagctgcagcgatatcaaaatcgcccagctgcagttccgcaaccgcagcaactctgagctgattttcaaacagcggcccgacgcgcgggaaagcgcggcgctggtgcgcgtcggcgcaggcagcctgcacgaacccgatcgctggcccggcctggcgcatctgctggaacatctcctgttttgcggcagcgctggctttaccggtgacgagcgcctgatgccgtggctgcagcaacagggtggtcaggtgaatgccaccacgcaactcagccgcagtgcctggttcttccagttgccggcgcaggcgctggcggcgggcatggcaaggctggcagatatgctggctgcgccactgctgaccggtacggcgattacgcaggaagcggcggtcattgaggcagaatatcagctgctgcggcatcatgccgaaacgctgagtgaagcagcgctgctcgacgcggccggtggcgcactgcgccgctttcgcgtcgggagtgcagcgtgttttggtgacaacgtaacggaactgcagcaggcgctgaggctgtttcatcagcagcattttgtcgccgccaaccagcagctgtggctgagcggaccgcaatcgctggatgaattacagcagctggccgaggcgtttgctgttcgccagtcaggcggtgcggtgcactcctcattgccagccattcccgcgccggagcctgttgaaacgctcatccagcttcccgatgaagagtcattctggcttagcctgtttatcaccggcgaagagaacgctttgcgtgacaatgtcacattgctgggggctttctggcaggatgaagcccctggcagcctgatggcgcagctgcgcagcgagcaactgtgcgcttcgctgcagtgtgaatggctgtggcagagcgccgattatagctggctggcgttgcgcttcagtgcgccagcgctgtcagcgtcggcggcaagacgcattgaacagctcttctggcagcatctgcgtgcggtgcacgccgccacgccagcgcaacatcgtcactatttgcaactggcccagcaggatttcgctgcgctgtcgccgctgacgcagctgcgcggacgggcgctgggatcggcgccgtcagctgacgttcccgcagatttcaccggtttcatcaccgcgctgccacaggcctcgtgcccgcggctgctgacgcagcgacagctgtccgccgcgccttacaccacgcagggattctgcatgcagcgcgcgccatggccaccgactgcggctggcccggtcgcgccggttaactggtcattttatccgtgcgctgacgtcctgcatttgccggaactcccggtaaatggcccgccgttgctgcgcgtaagtccggtgcagccgcggggaacgctgctggtacgcccggcgttttattacaccctgagtgacgaggcggcgctaagctggcagcagcaactgcgcccacggctggccgcactgcgccatgccggtggcagcggacgctggcaacagcagcagggcgtctggcaactggtgattgatctgtctgacgatgcaatgcccgcgctgcaacagctgcctggcgtgctggcggcgctgaatgcgccggtgctgccgcaaccgcaccgtgctgcacaaagtattgtgattcgtcagttgctggaagcactaccgcagcagctgctggccccggcagtgcatcctgcgtggcaggccgcctggtgcggccgcagcgaaagcgtcagtcagcacgccgcgcactggctgagcgaggtggtccggactcagcctgcgccgacgcgctcggcggcgctacagcacggcgtcagcgcgctacgctgtgcggcgaacgatcaggccttattgctgtttattccgctgcccgctgccgatgatgccagcctcgcggcgctgcgtgcgctggcgctgatgttcgaaccacgcttctttcagcgcctgcgggttgagcaacagattggctatgtggtgtcagcgcgctaccagcgcgtggcggatgtggatggactgcagctggcgctgcaatcaccgtccattggctggcgtacactgctgcaacactgcaaagcgtttttgcgcgacatggtgagtgaactcgccgccatcaacgatgaaacgctgcggggctggcaggcaacgctgctggcgcagtgccagccacaccagaacgccgacgccgccagtgaggcactgcgaaaacagcagggactgccggtgcttacgccagaagcggtcgccgcgctcacgttaccccagctgcagcggctgcatcagcgcctgctgcgcgaacgccgccgctggcgtttactgattaatcacagctga

SEQ ID NO: 29038 - DNA, 902 bp, Glycine max
  Peptide Sequence Number=SeqID_145816
cagcagttgcaggtgatcgccctgcggcgcggcgcgcaggcgcacttcagcatggctattttgcgcgttgcgcagccagccggtatcggcggcttgcacgggtttacgcggtggatcgcgtggtgttattcccggaagacgcagagcgtgagatggcgccgtcgcagcggcacaaacagcggttcacgccgccagacgggtttatcactgctggcaccgtcatcaacggcggcgctgtgagcagtaatgctaatgacaggctgagtcgggagattgaagctgcgctggacgagacaaaatgccagcaccagacaaaccagtgccagaatccattttgcgcgttggggcgatatcgtcatgccacagcctcagagaaaagtgccgccagtttacgtgaggacatgttagcagtgatgcaaatcctggcggagattggaccaaaacccggtcgtccctatgttgataccttgaaggggtgtcagtttcctaatctaaaagaactgcgtgtgcagcatgcaggcatgcctgtcagagcctttttcgccttcgatccggtgcgccgtgcgattgtactttgcgcaggaaataaggctggctggataatggggacctacaagcaactactggcaaaacaatcacctgaaagtcagcagcgcatcgctgaaaaggtggaaaagctgcgtcaggaaatagccctgagccaattgcgtgaagagctaaacctttcgcaaactgaactggcgcgcaccatcggtgtatcacaaccaacgctggcaaagatggaaaatccggaaaacgatccgcgcctgtcaacgctaaaacgctacgtcgccgcgcttggtggggaacttcgtattgatgttaaactgccaaacggcaaacattttgcttttcagctgtga

SEQ ID NO: 29039 - DNA, 426 bp, Glycine max
  Peptide Sequence Number=SeqID_145817
atgaagttcgacaggttggaaaaaagcatgagaaaggagaaagttgcacaaggatcgactcgcacaagcggattctcttatagagggctatctagccagtcccggaactgtcatttctatgccatcagagatattgatgtcaattgtgtcaacatacaaccaccgagaagccttcctcccataacaatcaccgagagagatttcaaaggcatcaaccccataaacttgaacgaccctatggtcgtctccattgccattgccaactctatggtgtctaaagtccttatcgatcaagatacttcttatttaactttgattggtaggaaaacattaaataagcttggagctatagtagtctctacaccacaccttaaaatgaagttccctaccttaacaggagaaatcataactgtcaaggtagattag

SEQ ID NO: 29040 - DNA, 456 bp, Glycine max
  Peptide Sequence Number=SeqID_145818
atgcaaaagttacatgaaggaatcttcaaccttcatacaggggggcgctccctggcaaccaaggtagtacgtgctagctactattggctaacactcaagactaacaccctcaacttcatgaggagatgcagaagatgccaggaattcacaaatgttctgcgcacaccccccgtcaacctccacaacttgagctcttcttggcccgttgccatgtgggggatggacatactgaggccattgccaaaagccccaaggcaagtcaagttcttgttggtcgtcattgactattttaccaaatggatcgaggcaaggccactacgagagatttcagccagcgaggtagaaaagtttacctggaagcacctcctatgtagatacagtcttccttatgccattgtactgacaatgacaccgaactcaaggctgaagcctatgaagaattcctgtcaaggctag

SEQ ID NO: 29041 - DNA, 360 bp, Glycine max
  Peptide Sequence Number=SeqID_145819
atggtagacaaggctatactgaaacgattgctagccttgcttgacgcacgagccatcttgtccttgccatcaacaaatgaccctcttattgttttggatgtgaagcaggttggacctattgaaggtgatatgcctccccctccaactatcattcaggaaccctttataggggaaggagatcctactaaagctagggccaacctatcccgtgatgtcgacgctatcgaagatgatgttgtggagtttacgcttgtcgtgcctccttctgcggcgaccacggggaagctcaacgaagagtttggggggactggtcaatgcaagaagttgagggccccctttagtcttcgagctcttaagtag

SEQ ID NO: 29042 - DNA, 924 bp, Glycine max
  Peptide Sequence Number=SeqID_145820
atgaatgtttctgatcctccaacacctctatctccgcctatttatgccacctctataccttcttcctttgcaccagcctctcccactcctgcctctgccgcactcgctcccacttcttctactacaccgctgctacttagtgttggggtgacgacgacaggtgtcttgacaagcatgcctcctccttcttctactttgtcaccctcagctcctattatcctgcctcttgccatgccttcttcctcttcacgcccaagcatttctttggaccaggttaagaatttggctgacactacaaaggtctttctccagagaagcctagctatcttaaagaaaaatgtgaataggcataaggagactaggggcgggattacttccttggaggttgaggttgccaaatggagagccactacccggacagtgtggcgagtggagttccctaaggtggaaaatgctactgtcgcccttgctgaagtcgttaggtccaaccatcgattgttgtccaaggttaacaatatatttaccaagttagtaagcacaagactggaaggcgacaaggtgtccagacgttacaaagatttattaaaagaaaagaatgacttggagtgtgaggcttggctgagagattcagagctcattgtgtccaacttccagactaagctgaaggagtccaagctcaaagtggagaatgagaaagaggtgaataaggagctagaggatgagctcttaatgtttaaaaagaagtccatggagcaatacgagatgggatttttcaaggtcatcaggatgagccttaggggtagagaggctcaccaagggaaaaccttgggtttaatgagcctttggagatttaaccaaggacatgttcctcctaggctcggcgagactcaccaagggcagaccttgggtttgatgagcctttga

SEQ ID NO: 29043 - DNA, 612 bp, Glycine max
  Peptide Sequence Number=SeqID_145821
atggcccaatttatcatagaggtcagatacttgacctggctagccaacattgtcattgtaaagaaggccaatgggaaaaggtgcatgtgcactgactacacaaacctcaacaagggtacaaccaaattagaatacaccctccaaacaaagaaaaaatcgataactgaggacattaattcctattgtagggtcatgccttttggacacaagaatgcgaaagctacataccaaaggctcatggactgggaagtgttcggagagactagcaagtatgacatgcatctcaatcttgagaagtgcacctttgggatcagcgacaaaatttttttgggcttcatgatcacctactggggaatcgaagctaaccttgacaagtgtactgcaatactagaaatacatagccttactaacatcagagaagttcaaaagctaaatggtagactagcgtctttgtccaagttcctcccgaagctcgcaaaaaaggcaaagccattttacatgctacttaggaaaattgaaccattcctatgggacgatgcttacaagcaagctttcttagcctttaagaaaactattacgacacctctagttttaagccaaccaaagccatga

SEQ ID NO: 29044 - DNA, 139 bp, Glycine max
  Peptide Sequence Number=SeqID_145822
atggaatccaaacacattactaagggagtatacgctccattggcattgttgataccagttgtagatgttggacttattgcaaatgtgggtgttgtaccacctgttgatggtgttgtgcctggtggtgaaccagtagatg

SEQ ID NO: 29045 - DNA, 223 bp, Glycine max
  Peptide Sequence Number=SeqID_145823
gaggatccgggattcgagtttgctgcatggatcatggctcaagaatttctcagcctcttcttctgcttgctactcagccggggctgcacatgctgtctcatttgatggaagccctcctgatgaacagcttgcaaattcctctttttcgcctgacccatttttcaatttagtccttgccacattggactcaaacttgccacattgggttgcttacgtggactga

SEQ ID NO: 29046 - DNA, 285 bp, Glycine max
  Peptide Sequence Number=SeqID_145824
atgactgccctcagtagaggaaatccatggtcaagaaatttggaacaattgtgcagtgcgcagtgttgtcagtggagtcatggatcgttgttgaaaaatgttcttgatatatttgttgagattggtatgggcgaaatggatcaatatgaacaggattttgaggtacatatgcttgaggatactgtcgattactacaaaagtaaggctgcaaacttgattgagattgactcttcccagattatatgcttaaggcaagtctgtctatattgtgccttgagagtttga

SEQ ID NO: 29047 - DNA, 288 bp, Glycine max
  Peptide Sequence Number=SeqID_145825
atggggactacttgtcccaagaatcacctgaagatgtactgtcggaagatgagggtggacgcgaaagatgagaaactcttgattcatttttttcaggagagtttggccagggaagcaatcacttggcagtatcaatataactctgacatggctccagatagaaggcaattgcaaaacatgtgcaagaaggagcataagtctttcaaagaatatgcccagaggtggagggatttggaagctcaggatgataacaatgatagtaaacactttaccagtgttctactatga

SEQ ID NO: 29048 - DNA, 159 bp, Glycine max
  Peptide Sequence Number=SeqID_145826
atgtcattgcctagcgctgttcatgtggctccattatcaagggcgaagcttctgaagaaagaagaagaagtagaaatgagagtcgtcatcgcgaaaagggcaggacggacgaaatcagtgtcctatctttgctttcctcttatctccgatgagaggtaa

SEQ ID NO: 29049 - DNA, 585 bp, Glycine max
  Peptide Sequence Number=SeqID_145827
atggcatcaaggaaaaggaagagcactgcttctaggccacaagctcagaatgttaagatttatcatactgaattcgatgagtttaaggcaaagttggagaggcgtaacctacacaaacgcctcgccaaccttcaagagggaagcatagatgtggtggtggttaaagaattctatggcaacttatacaacccggaagaccacaaccctaagcaagtaaaggtaagaggaaatttaatcaggattgatgctgacagcctgaataccttcttagagatcccagtagttttggaggagggtgagacactgcctacctattccagatttacgaggatgaggattgatcctcaagagtttgctgcccgtctctgcatccctggtaggggttttgttctaaatgcagaaggccatcctcggaagcttctgaggaaagatctcaccactcttgcacagacatggagtgtcctctcctacagcaacctgactcccacttcccacacctctgatcttaatatggacagagccaggttggtttacggcttagtcataggcacaaacatgaatattggagccctaatctcaggttag

SEQ ID NO: 29050 - DNA, 672 bp, Glycine max
  Peptide Sequence Number=SeqID_145828
atggaggatttgagagagtcaacagtgggtacaatgatagatagtcggaagcacgatctttcgctgagtgcatctcagacgtccagtgcgacgcagttgcttagcgggcaacgcacacttagagctaggaagtttcaggagatgaacgcgctaagccgtcatgccgcacttagcgagttcatgagtcacatgcatatgattccttcctcttggcttcagagacaaattggattcgttacaaagataatgttcatcttcggaacattctaccggagaggaacggggttcttgcgcctggcatgtatgacggattttataatgagctctagaggtaccaacaaatttgatgctcagacgttgagtgatttcttagggacacgtgccatcgtcccaaagggagagcagctgaatgcacgtgccatcgcggccaacgtgctttcctactttaacctcgctcctacctcccacacctctgacctcaacatggattggacccgcctaatatacggactcgtgatgcagatggacatagacctaggcatcgattcagacactttgacctacgagtccttcaacccggtgcccagcgcgacgcagttgcttagcgggcaacacacgcttagcgctaggaagtatggagaagctaagatcgtgaaggggcacttagtgtga

SEQ ID NO: 29051 - DNA, 675 bp, Glycine max
  Peptide Sequence Number=SeqID_145829
atgggagacgacatggtgttgattttgggatgctctgaggattgggtgactgataacaccaaacaagagggctttttctattcaattcggaaatggaatcctagtgcggtgtactggagttccgttggatgcgtggggagaggaatgctttggagcgatcgccggaaattttggaaaattggtgaaaatggacgcgacgtttgccatgttggtaaatgtgagctatgccaaattactggtgttggtggcatcaccaatgcttattctgaaaatgagaatgtgagtctcaatggtttttctgatgaggttggtggagaggatggcgagggaaaaggaactagaagggagagccagcatagaggaagcggagaagagcatcggtccacgaagttggaattttcaaaattcaacaatgtggacattatccatgagacaaacactttgcctaatggattcaacatggaagacacaccgggtaaagatggcgaagaggtagcatgttcacctgttgaggatgacagtctcgtgactaggttgagcagggcagatgtcgacatgtcaaagaaggtcccacaaggagaacgtgacgcacataatgatattaactgtgttgccaagtgtattgatccaaccaatggttgggcgagtgttaaactctacagacaaagaacgtga

SEQ ID NO: 29052 - DNA, 735 bp, Glycine max
  Peptide Sequence Number=SeqID_145830
atgacgttgcctacgatgatggttaataaccgacaagttatcgttggcagcaatgagagggatcatgtcaccaagttattcgccatcttcatcaccggccaagacaaaggagcaggcatgacctgcacggggttgatgaagcaagaagaagaaaaattgagagaaaagaaaataggggttgatggaatgcataagtcagggaacctcatggctacaccattagatgaaggacaactttttagcatgcttcttaagctcatgaatgccaataacactatggaaattggtgtttacactggttactctcttcgctccactgccctggctcttccccctgatggaaagttgggattgcccataattcaaaaagctggagtgatccacaagattaactttagagaaggacctgctcttcctctacttattgagctgcttaaagatgaggacaacaagggagccttcaatttcattttcgtggacgccgataaggataattacttgaactatcacaagagggtgattgatcttgtgaagattagggggctgatcggatacgataaaaccttatggaatggatccgtggtagcatcagccgatgcgcctatgaaggattacatcaagaattatcgtggtcatgtgattgaactcaacaagtatcctgctcaagattctaggattgacatttgtcaacttccagtgggtgatgggattaccttgtgccgccgcattatataa

SEQ ID NO: 29053 - DNA, 273 bp, Glycine max
  Peptide Sequence Number=SeqID_145831
ccccgagtcgtccctcaggccccacaaacggatatccctcacgtgccggagccaggagcatcgtcgacatctgtggatgagcctagacatgcagtggaagtttgtgatgacattgttgagaggttggagcaccatctgagtttaggggtggtcacgccaggctcatcgacacataaggtgatcgaagaatgtctcaggatggccaggagtgggacacaggaccatctagtatatgttaggtctagacgcaggcggcgcacggatcaggcatag

SEQ ID NO: 29054 - DNA, 918 bp, Glycine max
  Peptide Sequence Number=SeqID_145832
atggccttttcacaacaagtgctgggtgcaccagcaaaactgctggtgcacctagcaatactcttgtatctaccacaagagtgcacagtgatctcgtggatcagtgttcgcaacaaaaggataaggtcccaagatattggagtatctataggtccaattagaaggccctcccttctcaaggagccatctaagtctgggaataagggtatagggaagatggtagatgctaaattgaagaggaaaatgctgagggcagtgtcattcaaaaacgaattgctagatgaatgtataagaaattataacaaattgttgtggataaaaaatgataatgttgaaccacacagaatttggaacatgggaaaggatatagtggtttcttatgaagcgaaggaaagtatggtaataaacagaatcaaagagattgtcatgaggggtgagatgggaaaaacagagaggaagcctaggtggaaaaaggaattcaggtggttattgtcaacgtatatgcaccctcaaatcggatcaggaggagaatcatgcgacttcaactgtgttcataaggcatcagaaagggtgggaatcaaaggacaagacacagggggtggggaaaaggaagagttcaatgtttgtattgagggtctggggctaattgatctacctatggtaggcaagagctatacttggtatagaccgaatggaagtgcaagaaacaagattgacaaggttttggtgtctatggaatggtttgcagtgtggcctagaagtactcaatttgtgcttgaaaggaatgtttctgatcattgccttatcgtcgtgaaaaccaaactgattgattggggtcctaggccttttaaggtccttgattgttggttcgaggataaaagttttgagaaaaccgttaaagagatttggcaagcttaa

SEQ ID NO: 29055 - DNA, 912 bp, Glycine max
  Peptide Sequence Number=SeqID_145833
atggaggtacaagaagaatggtggaaggtgaatagatgtaacgactcgcttatcagacaaaaggctagagttaggtggttatcggaagatgacaaaaaatccaaatacttccactcttgtctcaaatggtgtaggagaagtggctcgttgaagaaactctggattgatggcacaccaaaattggagggagtccgatttaatcagatatcagagttagaaaacagaggtttgattgcttcatttttggaatctgaggtcaatgaggctgtatgggaatgtagggaacataagttgtcgaatctggactggtacaatttccattttattaaaactttttggtctctgttgaagaatgatgtgatgaagttcattggagattttcatactgatgaagtgttccccaagggagcaaattcttcatttatttcactcattccaaaagttcatgacccacaaggattggaacaatataggcctatctcactgattggatgcatgtacaatatagtggcaaaggttttatccaaaagactgaaaaaagttcttgggttggtgatatatgagaggaaatatgcttttctgaaaagaaacaacttcttcagaaaatcgcatgattctgttgattggaactttcttcaatacatgatgtttagattaggcttttgtgaaacatggataaagtggattgatgggtgcctaattagtagcagagtttcggttctcatcaacagtagcccgacgaaagaattctcagtgtctaaaggcctacaccaaggagacccttttgctccattcctctttaatattgttgcaaagggactcactgggttaatgagggaaactctaaggaaaaatatgtttgctaaccttctggttggggagagagaagtatctgtcaatcttctcaagtaa

SEQ ID NO: 29056 - DNA, 177 bp, Glycine max
  Peptide Sequence Number=SeqID_145834
atgtcggcctttatccactcgttcacctcgtctacttcacccattactctagctctagcacgcattcggtgtcataccctaatttcatctggggaccattgtttcatggcatgtaacctttgtttgaccgcttcgaggtacttggcaccctttgttgcacaatacgtgaagttctga

SEQ ID NO: 29057 - DNA, 444 bp, Glycine max
  Peptide Sequence Number=SeqID_145835
atgcaatgcggtacgtaccgtattcaataccaaggaaatagccctaagcgtgtctacatgacacctcacttaggaaaccatgcagtatttgttgaggccacccagtcgtgcaccgtaactccccccctaggtgatcaacctggggccacaaggagttccctaccaggtgacacaccccctagtacaaagtacatactgccacaatttatactatttcccgtgtcatatgagtttcccacacaagggacgtccaacaaggtcaatgtacccccccatgaacatacactacatacgacgtatgaacgtggccaaaagcaagtgccaaagaccatggaccaattaaagcgcctaagcatcccctcggaaatgcttagattctttaaccacgcttgtcccccacaaatggaccattcgacaaggtcagtgcactctgcccctcactaa

SEQ ID NO: 29058 - DNA, 990 bp, Glycine max
  Peptide Sequence Number=SeqID_145836
atggtagaagaatttaaagagatcctaggatgtcctctagggggaaggagaccatacctcttctcagggttctatccctcattagctagaatttctaagatagtccaaatctcggcgcaggaattaggccacagaaagcaagtcaaaaatggggtggttggaataccgagaaaatatttggaggcaaaagcaagaatcttggcaggtaaaggcgaatgggccccgttcatagacattctcgcactgttgatcttcggaggagtcctctttccgaatgtggatgggttggtggacctagcagcgatcgacgcttttctcgcctatcatgaccacaaggaaagcttggttgtcgctatgctagccgacctatatgacaccttcgaccgaaggtgtgagaagagcagtacgaggattgtttgctatactccagctctttatgtatggttggttttgaacctttttcgccgagaggtgaggcatgcttgcccgttagaaagccactattcatacacagagaaaggaggggcaagttgggaccaactcttagcaaacaaagaagaagcgtctgttaactggttccctcgatggaaagaaggaagaaccggagttcttatttcatgtggaggatttccgagtgttcccttgatggggatgaggggttgcatcagttacaatcccgttcttgctataaggcaaattggctaccctataagaggggcgccactagaggaagagctcgcgcttgtcatttcacaaggtttcaataagatcaacatggagacacttcagaaggtctgcaaggcatgggaggtgttgcaaaagaaggacaaggaactcaggggcagtaacaatgggcccatcggtggctaccgtaagtggttgaaagcccacgtgcaaggtttggattggcttccgagtttgagaaccgctaaaagggaggaagttgaggcaccggaggaagacgaagaggtgcaggcccttaggacataa

SEQ ID NO: 29059 - DNA, 513 bp, Glycine max
  Peptide Sequence Number=SeqID_145837
atggcaagcagagaccaagtttggtcattctgcacacatgatacgcggagataccttacggttatccgcccccctttgccattcagacacagtcgtgttcgatggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgccccccctttgccattcagacacagtcgtgttcgatggcaagcagagaccaagtttggtcattctgcacccatgatacgcggagataccttatggttattcgcaccctttcttttgctatctgtaagacagaacgcttga

SEQ ID NO: 29060 - DNA, 207 bp, Glycine max
  Peptide Sequence Number=SeqID_145838
atgccgtcaccacctcacccgcgttctactgcgacgtcatcaccacctcaacccgcgctttgctgcaacgccatcgttgtttcgtcttctcaataccttgcaacaaagaaatttattggtgttttggttgtttgcatagttttggttttggttgttttcgatagtgtaggcctcattattatttgtttgcatgggtctggttcctag

SEQ ID NO: 29061 - DNA, 330 bp, Glycine max
  Peptide Sequence Number=SeqID_145839
atggatgagcatcaacagaactggaaggaaatagctaacacaatgatgaagattaacaaaaaagcagaggaaatgttcaatactgttcatgttatggatcaggatgaactagagcctatttggcatttgctacactctagtggcaacatgcactttgtcacaaataaccaagatctggtgagcctaactctacttgttggatggacagaacttagagagttctatgggctcactagaaatcatcaggtgaccttgacccattatggacagagtgttttcctcctcaccatcttcaaaagaatctctgaaccaaaagcttaccctaaatga

SEQ ID NO: 29062 - DNA, 729 bp, Glycine max
  Peptide Sequence Number=SeqID_145840
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatgatgatcgctcccgaaaaggaatctattgattctctcccaattggttggactgtaggtgcgatgatttacttcacgggcgaggtctctgctcagttggtagagctccgctcttgcaattgggtcgttgcgattacgggttggatgtctaattgtccaggcggtaatgatagtatcttacgggctgtcaagaacgtagaggagggtttcctcatttgggatcctggggaagaggatcaagctggccattgcgaacagcttgatgcactatctcccttcaaccctttgagcgaaatgtggcaaaaggaaaaagaatccatggaccgaccccatcgtctccaccccgtaggaactacgagatcaccccaaggacgcattcggcatccagg

SEQ ID NO: 29063 - DNA, 483 bp, Glycine max
  Peptide Sequence Number=SeqID_145841
atgaagctaccgcaagagcccttgaacgagaaaccaagaaggctcgcaaggaagagtatggccgagacaaattccgtggagctttatggagcagcaacagagttagctgcttgctcaaggtccaaaagaaacttgtctcatcgtttatgcgagacagagaccaacatgttagccatcgtcagcaggtaccaagaagaattaaatctagccgcggcccacaagcacaaagtggcagacgagtatgcccaagtgtacgcgaaaaaggaggctagaggaagggtgatcgacgcattacatcaagaggcaacaatatggatggaccgatttgctcataccttgaacgggagtcaagaacttccccgattgctagccaaggccaaagcaatggcggacacctactccacccccgaggagatccacggacttctcagctattgtcagcatatgatagatttaatggcccatataattagaaaccgctag

SEQ ID NO: 29064 - DNA, 513 bp, Glycine max
  Peptide Sequence Number=SeqID_145842
atgtcgatctccccggatcacacccacaagacacccagtggacccggagaagtccaacagggccctggggttttcagctctggttataggcctctgttagtcctaccagggatcgcgcccgcaagacacccagtggacccggaggaatccaacagggtcctggggtttccagctctgattacaagactttgtcagttctacggagtgcccgtcgcccccaagaagttcatcaggccccctattaaccgggttttcatcaagaagtactgcgccccccaggtaggcgtagggcgagacaccacaacagcctggggatggccggcagcgggcaatagacgcaccgctgccacctccagagccgctcagctcatctaccaaggctggagcattgcctatgacctgtggctgactagcaggcaaccaagtccaaagccaaaggtaagaaaaagtactaggtccgtgaccgacgagtcatcacgcgtccagctcaagacgttaaagaagcgctactag

SEQ ID NO: 29065 - DNA, 283 bp, Glycine max
  Peptide Sequence Number=SeqID_145843
atgtcacgaaaccttacagattacgcagccgtccccactttggcttctggaatgttacggaactttacagattgcgcattaacgcttcctttcgactcccgacatgttgcggaacttcacggattgcctaacgatgggtgtcaaaaaggtgttacttctggaataggtgttctagaaaccttttgccaaaaagcggttgtgatgtgggaagaagagaagaaggaatggaagggtccgtgggaggaagaagaggaagaaaaagaagaagatacaagggataggg

SEQ ID NO: 29066 - DNA, 264 bp, Glycine max
  Peptide Sequence Number=SeqID_145844
atgggagaaaaagaaggaatagcagcttctttggataaaatggccaactcttttaaccgaatggtagacaaaatggatggtaaagttgatgatgaagatattcaagaagtattacgtgaggcagctttgataccagatcttaatagacaacaatgggctaaagctattaaatggttcgctgatgatccaaagcagttagctattgtgaaagcccttccaattcaccaaaagacagattatgttttaacacatcttggagaatga

SEQ ID NO: 29067 - DNA, 326 bp, Glycine max
  Peptide Sequence Number=SeqID_145845
atgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagtcagtttgataaggatcgagtgacattgcttcttcggtcatttcgggacaagcggatcatttatgatgaagaggatgagcttcaagagaatgattccgagctcttgcagggtggaaccatgca

SEQ ID NO: 29068 - DNA, 237 bp, Glycine max
  Peptide Sequence Number=SeqID_145846
atgcttcaccaactggtgggtcaatcaaaactttcgtgtgcacttggtgcaacactcgtgctgagcgcgcatgtccagctggatcaagtggccacgcgctacgctgcaagatacgcgcttagcgcacttgctcatgatagttgtcttccaacgtgccttcttgcgctatgtagttttcttgggtggagtggttgtgactcactaagtgaggaggtcacgctaagcatgacactttag

SEQ ID NO: 29069 - DNA, 180 bp, Glycine max
  Peptide Sequence Number=SeqID_145847
atgggggtgcaaatagcaacaaggcccacttgggccttccagattcttcctccagaaggtggttgcttctggagaaagcaacctggcttgcctgggcgagctaggcgcttccgtaacgtttctgtgggtgatttcgtgaagattttctatcgttcttcgacgttcttcggtcttcaaccg

SEQ ID NO: 29070 - DNA, 249 bp, Glycine max
  Peptide Sequence Number=SeqID_145848
atgggtgccaagtccctcgaagtggtcaaacgtgggtcgcatcccaacaacggatggttcccggacgaaattagggatggtattatttcttctgaggtgcatggtatttctatgatcattgatcaatctttgttcttttctttgactaaattacccagtcaaggtgcaccttttgagggcaccattgttgatgactggaaattcgattattccagtcatgatgctcgcagtatggtttgccatgactag

SEQ ID NO: 29071 - DNA, 486 bp, Glycine max
  Peptide Sequence Number=SeqID_145849
atgtcccatactaatggattcgggtccacaacgatgggttcaaatgtaagatcggttcaggatcatgggatccttttctatcagataggaagggctgtttcacaaaatgtacttctaagtaattgctccatagatcctatatctatctatatgaagaagaaatcatgtgacgggggggattcttatttgtacaaatggtacttcgaacttggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagtcagtttgataaggatcgagtgacattgcttcttcggtccgaaccaaggaatcccttaatatga

SEQ ID NO: 29072 - DNA, 285 bp, Glycine max
  Peptide Sequence Number=SeqID_145850
atgatagatgaaatggataaaggtgatatcttggtccctcatcctctcacaaacgcatgtttgcttattcaactttcaccggaatgtgggtgcaagccattggtctgtttgctcaagcgacctgcgctcctgagtgttgacttccaagactgttcaatcagagattactcgtcttgcacgttggtgggggaatcctctacaacaagagacccacggtctcttaatcccttttcagaaataagaagaagagaagaagaggtctctcgtaaaagaggtagattgtaa

SEQ ID NO: 29073 - DNA, 435 bp, Glycine max
  Peptide Sequence Number=SeqID_145851
atggctccaaagaagcttatagctaagagggcaatgaaagatgttgctggagaaggatccagtgtggccccacaagtggatatggagtttgatggacatcgacgggtccagttgagggaaagagaatatgctgaattccaggaggaaattgccaggaggcagtggactcaacatgtgaggcccatggctaagaatgatccagaaatagtcatggagttctatgccaatgcatggcccacagaggaaggggtcagggacaagtgctcctgggtgcggggccaatggatcctctttgatgtagatgccattaatcagtttttggggcatccattggtcctggaagatgggcaacgctgtgagttcagtcagaggaggagccaggcctcgagatttgatgaggaggccataggccagttgctgtgcattccaggatag

SEQ ID NO: 29074 - DNA, 483 bp, Glycine max
  Peptide Sequence Number=SeqID_145852
atggagacttttcaagtctcacaagttatcaagaactacgtaggtcatgtgacatgcacccttgtatcatccagaggcggcgggcccgatgatacgcggagataccttacggttatctgcacccttttgtcatccagaggcggcgggcccgatgataagcagagaccaaagaccaagtttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatctagaggcggcgggcccgatgatacgcggagataccttacggttatccgcaccttttgtcatccagaggcggcgggcccgatgatacgcggaaatacccgagtggttatccgtataaacattcttttgctatctgtaagacagaacgcttga

SEQ ID NO: 29075 - DNA, 171 bp, Glycine max
  Peptide Sequence Number=SeqID_145853
ggccaaggtcttggtaaagctcttatagagaaactgattcgaactcttctacaaagggacattggcaacataactctatttgcatatagtcaaggtacaacagttttgacaacctttatgcatagtatcattgatgctaattacgagattacgcacaacatgtcaaatctg

SEQ ID NO: 29076 - DNA, 378 bp, Glycine max
  Peptide Sequence Number=SeqID_145854
atgtctccttatcggattgtctttggaaaggcatgtcatcttccagaggagattgagcaaaaagcatactgggcagtgaagacctgcaacttctctatggatcaagctgaagcgtatgagaatgccaagttctacaaagaaaagaccaagaagtttcatgatagcatgataattaagaaggacttcatggttgggcaaaaagtgttattgtataattctaagcttggactcatgagtgttgagatcaaaagtgactccacaaacaagagcttcaaggtcaacggacaccgacttaagccattcctcacaaacccctctttagtggacgtagtggtggaaaagagttccttactccaccctactcttcctccaccatga

SEQ ID NO: 29077 - DNA, 676 bp, Glycine max
  Peptide Sequence Number=SeqID_145855
atgcagcgggcgcttgtccggcgcctgcccggggcggtactcggtgtagttgccgctgccgatggtgcggcgccagcgcctgcagatcgaagcggtacatcgcccgccagccgtcgctggattcggatgacagcacgaagtcgccctcgtcaggcagacgctgcagcagatagcgctcatgcggcgtggcctgcggctgcgcatcgtgcagccgcagcggcacggtcggggtcaggctgccgaaaccggcatcaccagccagtcgtccccatccacatgcacgcgcagcagcagatgggtacgcgcggtcagttcgccgtcatgcgctgccagcagcacgcgcgcactcagcggctgcgcatcaaagcccagtgcctgcagcagggccagcaggccgccattgagttcgaagcagtacccaccgcggcggtcgtcaagcagcttgcgttgcacgctgtccaggtcgatcggcaccgcgtcgcgcagcaggcagctgaggggtcaggccggccagggtccgcggtggcggcgcatccagctgcaggcgttgcaggtcaagcgcggcgcccgtgtcatgcccccgtcgcttgcaccctgtacaaaggccgcgtccacccgcgacggggggacccggacgaagaaggcgctaaagttgccctgaatccggccgatacag

SEQ ID NO: 29078 - DNA, 642 bp, Glycine max
  Peptide Sequence Number=SeqID_145856
ccttaatgctttttgctggttggtttcattatcacaaagctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatg

SEQ ID NO: 29079 - DNA, 507 bp, Glycine max
  Peptide Sequence Number=SeqID_145857
agcttagatggtttggacaacatctactatgcagccctcattaataagctctcgtgggatcaaggagtctatcatgtgttcaaaagaatggacaaggattccaagcataccctaatagttaagggtttggtggttggtaaacaacaaaattttagcaagactaacctaaaggatatgaaggtggctctagaacgaagcctaaatgaggctttagaagtggacttggaagccatcaacaaaaggaaacaaaagacgttggccaagtccaatactgatgaagaactagaagaagaagagatgttggcagagcagcacaagaccaaaagaaggcatagggctggtgtgagtgacccacaaaagaggaaagttgttgatcctgatacacctcccaagaaagcaaagaaggctcaacaagttattgaacccagggcatccgtccttccttctgcccttctaggatgcatcaagacaagcatgactaaggctaacccaaattttggtgactaa

SEQ ID NO: 29080 - DNA, 234 bp, Glycine max
  Peptide Sequence Number=SeqID_145858
atggctgcagataaatgctatccaagtctaccagtatgggatgctgccaagaaaaaggggtttgagttgtactacaaggaacaaatgccttcactgtggatgaagttgatacgcactccagatgctcatgacgcaaggaccttctggagtcagatcatgttgatggactctcaaaaagcctctacttctagctatgatggaagtgataatgttgtgcactacaatgttgtttaa

SEQ ID NO: 29081 - DNA, 303 bp, Glycine max
  Peptide Sequence Number=SeqID_145859
atgtcagaagcccaaataatagcccatgcgactcaactccatgaggctcaacaaaagaagagagctgaagatgttgttgttgttgctattactgagaaagaacttgttgctattcttggaagagaagctatttccactatccaagtttgtgaaaagatgaagaataaaaaggttgttgtggctggtgtctcgctaagcgaggcttgtgcacttagcgagaattatccgctaagcgaggcactcagcccgcttagagagttgggaaaatctagaggagaatctgcccagcatttgcgtgcttag

SEQ ID NO: 29082 - DNA, 169 bp, Glycine max
  Peptide Sequence Number=SeqID_145860
ggaggtgggaaagaccatgcatatcaccacgtcatcgttggagtacaagttgacttgcatggaggagagttaagtgttactttcctaggtatgtatcttagcatgggtgggtggatggtggggatggagagcgaggtggagatggtggtggtgggagtaagggatgtgg

SEQ ID NO: 29083 - DNA, 228 bp, Glycine max
  Peptide Sequence Number=SeqID_145861
atggataaccatgagcatgcaaatcatcgtgatacggcacaagccaggataaagaataaaggtatcaggcaacacaaagttaatgatcaggctcagaatattgatttcaatattcgtgattcatcagaggatgagagttctgaatcaacacaagtttcttcacctgagaaccaaaattatatgtcctcagctaatgagcccgcaattaatagagaaggtaacgattaa

SEQ ID NO: 29084 - DNA, 621 bp, Glycine max
  Peptide Sequence Number=SeqID_145862
atgtcgattggctttcgctttatgccaggacaaggggaattcttaataaaagatctccgagctcctgataccttagtgggtttaagaaagttaaaagatagcctaggcttatcgttaacaaaaggtagtcttaacagcaatccattacttaagttaaagggtatttctgactctgtttctaatagtatggagtcgctggcatctcgtgtcttggttgaagtaattacatttaatgaggggtattatggtcgattcttaatcctggtccaaatgggtattggttgtactgtatggtatggcttcgtacctggcgatggtatcaatatgccaattgaaggattaaataccctatttagtcctattgagaattatgatactatctttactaatcctgatgctcatgttataccgggctttaataaaatgactttaattgagggcgtaaataatccagcagcatcgctgtcacaggcatttgctcaagataggcccttcatggatatggatattgaaataccggattctaataaatctattattatcggtgttagcttaggactagcagttgccatcttatttacatttgggattaacccatgctgcggagaagttatagtatga

SEQ ID NO: 29085 - DNA, 234 bp, Glycine max
  Peptide Sequence Number=SeqID_145863
atggatagatttcctgcttttctccagagtcttgaagatatgaataatgttgatatgatgtataaggttgatatgtccgcatcaacatcagtgattactaaagcactggttttaaaagccgttaagccttttgttggcgataatgattatgtatttagactactacctatctatacaaaggatggggataaagttttagtagggtctgatgatattcctcctcctcttggagag

SEQ ID NO: 29086 - DNA, 420 bp, Glycine max
  Peptide Sequence Number=SeqID_145864
atggaggaaacggatcaaatatgcagtttagtgttgagaaacttgtacgatcgaactacaaatattggcgactgtgcatggatttatgggatctcatggggtttgaaaaaggagtattatccatttatcatgtccattcaaagatggaccaatcaaccatcattggaggagttacaaaattttctcacaaatcaagaagcttttctacaacaatcttcatcatcacctgcacaagaggcaccggatacaccggacacgacggaggcccgacgaaaatggaaggtaaaatgtgggaagatgttggttgttctgagaatgacggtcaacaaggaattaattgatcacattagagatcttgacacaccaaaggatgtatgggagacactagaaaaactcttctccaagaaaaatgttgcttga

SEQ ID NO: 29087 - DNA, 276 bp, Glycine max
  Peptide Sequence Number=SeqID_145865
atgtcagtgaaaaacctcgtcgggcgcctaggagtacatgacaagacaaaccacacactaggagaccagtcagggtcacactattttgcgagaatgctccatccatatgggatcggcacaggcttaaaggagcactcaaaccgggtgtatttacccccaaggcctacactccgaagagtccgtcagggtctctccctcctgattcaggtccaactcggaaaacattttagcacacagactctatctatggactataaaaaatacacaactccttaa

SEQ ID NO: 29088 - DNA, 699 bp, Glycine max
  Peptide Sequence Number=SeqID_145866
atgctttcaaaaagacgacaatgtcttcatctacatttcagagggctacacgctctgtccttcagagcactacacgtcctcacctttagagggttgcacgccctaaccttcaggggactgcacgtcctcacctttagagggctacgcgccctcaccttcagaggactacacgtcctcaccatcagagaactacacgtcctcaccttcagagggcaacacgctcttaccatcagaggactacacgtcctcgccttaagagggttgcacgccctcaccttcagaggactgcacgtccactccttcagagggctacacgctcttaactttagaggactacacgtccttgccttcaacgggttgcacgccctcacctatagaggaatacacatcctcaccttcagagggctacacgctgtaaccatcagagaactacacgttcacgccttcagagggttgcacgccttcaccttcagaggactgcacgtccacaccttcagaggtctacacgccctcaccttcagagggctacaagctcttagcttaagaggactacaagtcctcgcctttagagggttacacaccctcaccttcagaggactgcagaggactacatgtcctcgccttcagagggttgcaacccctccccttaagaggattgcacgtcctcaccttcagggggctacgcgcactcacctttag

SEQ ID NO: 29089 - DNA, 414 bp, Glycine max
  Peptide Sequence Number=SeqID_145867
atgattactgcctcacattccaatgctatgctgggagatgtttatgcttatggcttaatctcaggtcgtggtagtgtgcgagacttcacaaagcctgctgtaggttgcttgaggggtagtgtgaatctaaggagactacaaccattgtatggtcctttgagttttgggtgttctacttttgatgctaataggaggatccgggattcgagtttgctgcatggatcatggctcaagaatttctcagcctcttcttctgcttgctactcagccggggctgcacatgctgtctcatttgatggaagccctcctgatgaacagcttgcaaattcctttttttcgcctgacccatttttcaatttagtccttgccacattggactcaaacttgccacattgggttgcttacgtggactga

SEQ ID NO: 29090 - DNA, 405 bp, Glycine max
  Peptide Sequence Number=SeqID_145868
atggccacgcaacgactgttttttgccctcgaattgcctgatgccctccagcaacagctggtgcaatggcgggccgattgcttcgccgcagatgcgggtaaaccggtggcggcggcgaatctgcacctgacgctggcgtttcttggtgaggtcagcacggaaacagcgggccagctgcagcagctggcggcacgcatccgccagccgggctttacgctggatctcgatgacgccggtcactggccgcgtcccggcgtggtgtggcttggctgccagcgcgcgccgcgcggccgcgcgccatggctgtgcgcagagtacgcagccgttccatccccacatcaccctgctgcgccacgcggcgcaggccgtggcgctgccgccgcgcggttttcactggcgcgttga

SEQ ID NO: 29091 - DNA, 336 bp, Glycine max
  Peptide Sequence Number=SeqID_145869
atggaaaaatccgacaagatgaatttcaaagagaagaaagaaaagaaaggatatatcacttgggaagataatgtcataaattattcaagtgattcagagaagaaaatcataagtctggatatcatgatgaaagactatgaaaatggagaagagcaaagtcgatacattgatagcaatttctccaaacacatggcatgcatccaacaaacgaagaccacatttctccccaagaaaagtgaatatgtgatatatggagacaacaaacaaaggccacttgatcaacaaccccaacaagtaatatcaaatgataccaatgggtcacttgtctttgattga

SEQ ID NO: 29092 - DNA, 165 bp, Glycine max
  Peptide Sequence Number=SeqID_145870
atgttggtggcgactccgcgcacctttcctcctttggaaagcgcacccgtgagccttgccttcgctcgcccgcaaaagggcacgctgcgacagttggcgactccactggggacctttttgagtggaggtgaatctatcatcatgctaggtctccgacttgcttga

SEQ ID NO: 29093 - DNA, 312 bp, Glycine max
  Peptide Sequence Number=SeqID_145871
atgtacgatggagacataccaagctcaattgaaggactactcttgctgccaggaataggtcctaagattgctcatctgggacaatgtccaagggatatgtgtagatactcatgtgcaccgcatttgcaattgtcttggatgggtttcatcgtggcatatatacttacgataggtaatacttcaggagcaatatgggaaaacgtaataaaagagaaggcagtagaaaaccttaaaatgcccatggctgagagcttgacatgtggcacttttgctgggtttttggtgattttacccctccagctttgggcttaa

SEQ ID NO: 29094 - DNA, 520 bp, Glycine max
  Peptide Sequence Number=SeqID_145872
acttaagttcacacctacttttgttttaattggagtctctgtttggttccactttgcatcattttttaaaaagaaaaattcaaacatatttttttacttagtaagggagaaattaccatttgtggagagagctaaggtaagtattttttattgtgaagaagaagactggagtctcttgttgaggatggaagaagaatacattgaggagctctgcatgcagatattgaagtttaaacctgatttggtgattacagagaaaggacttagtgaattcgcatggcattttctcagcaaccatggacttactgcaatcagaaggctgagaaaaactgataataatagaattgccaaagcatgtggtgctgttattgtgaacaaagcggatgaattacaggagtctgatgttggtactggtgctgggttatttgaagtgaagaagattggagatgagtattttgcatttattgacgggtgctaccaaggaccccaaggcttgcagtgtactattgaggggtgctag

SEQ ID NO: 29095 - DNA, 276 bp, Glycine max
  Peptide Sequence Number=SeqID_145873
cctgcttctgttggaataaagttgctggccctgaagttcttggaaacgtttgtattactcttttcatctgacatcggtgatactgagaaattagccacaaaaggaattaggcaagctgttaatgtcgaatggttggttggtggtcaccctcaccctgttcttgatccagtggtgctcatatcagatgcaaataggactattggcattctattaaatttattgctgttggttggcagtcttccaacttgcttgactattactgttgtaaattggtga

SEQ ID NO: 29096 - DNA, 237 bp, Glycine max
  Peptide Sequence Number=SeqID_145874
atgaggcaaataaagtgttttgttactaaaaatgttaaagaactagctccgaagctgggtgatcctgaccaacgctcaaattttgtgcctttgcaggctgtttgcaccgaagctggaatgtttgcattgagggagcggagggtacatgtgactcaggaggattttgagatggctgtggccaaggtgatgaaaaaagagactgaaaaaaacatgtcattgcggaagttatggaagtga

SEQ ID NO: 29097 - DNA, 798 bp, Glycine max
  Peptide Sequence Number=SeqID_145875
atggatatgaatttggggtaccttatctcccaccagatctctcttactgcacaacatgatacatctagacttggattccctgccttgatcacaactctatgcaaggccagaggagtccaattagattctagatccttggagaacttgagccctgccattaactcggcatatattaagaaaaattgttggaatctagatgatccaatagtgacatttagagggggaaggaaggccaagggtaagagattagaggtccccactacttcagcaccaccagagacaacaactccttcttcttccacagctccagtacctctcattcagactcgagctattcctcctacatctactcagataccacttcctgcttcatctcagataccacttccagcttttttatctgtaggaccttcaaatttttcatttactccacagatgctgcactccatgttccagagcttacacagggggcagtccattatcatgaagagccttcagggcttgggcttgccatccatcatgagcatggatgagtttgatgtatacacatggcttaggaggaggagacttccacagaccaaatcccaaagccatccccaatacccatactgtagaagcaagcttcatgatgaatcaagattgattcaaagatgttttgatgataacaaaggtgatgacaaaaagctcaaagaatcaagattcaaggttcaagcttccaagaatcaagatcaagattcaagaatcaagagaaggcttaatcaagataagtatgaaaaagtcttttcaaaaactgagtag

SEQ ID NO: 29098 - DNA, 360 bp, Glycine max
  Peptide Sequence Number=SeqID_145876
atgggttctccacctgcctccactcctcctcctcctcctcctcctcctcctcctcctcctcctcctcctcctgctccttctcctcctcctcctcctcctacttcagacacatcggcttcgacgtctaccgtgaagcggacactcaaagccttacgtctaagatcgttgtccactagaccacctggtgttgagagaccagtggtgaatgctgatcctactatagagaaggctgacggtccccacaaaaaaaaattaagaacatatttggggattgtggcacatgataaggtggacatcacctacgagaactggaaggaggtccctactactcagaaggacctgatttgggaggatatttag

SEQ ID NO: 29099 - DNA, 1023 bp, Glycine max
  Peptide Sequence Number=SeqID_145877
tggtcagcggcacgccggatttcagcaccatttcggcggcttcgggatcgacgaagatgttgaactccgcgaccggcgtggtattgccggcgttcatgccgccgcccataaatacgatgcgctcgatgcggcttttcagctcggcatgctgggccagcagcagggcgatgttggtcatcgggccggtcaccaccagggttatcggctgcgcgctggcgcgcagcaggtcggcgatcagttcgacggcgccgcggggatcgggtttgagggtcggcgtcggcaggtgggtgttgcccatgccggttttgccgtggacatagtcggcgatcaccagctcgcgcatcagcgggccgccggcgccggcggcgaccggtatgtcctcgcgccccatcagggtcaacaggcccagcgcgttatgcagggttttctccggcgtctggttgccggcggaggtggtgatggctttgacgtccagctccggcgaacgcagcgccatggccagcgcgatggcgtcgtcgaggccgggatcgcaatcgatgataatagggcggggcatgttctttctcctctgtttgttatccagcgagcatcggatcaaaaccggggagaaacaagcgcttttagtgccgggcgtttgcgcgacgggataaggcgttcagacaccgcagagttcatgagcgctgcgtttccattcttccacctcggttgggtgcaagaaggagtaatagacggtagtgccgtcgggcaagatattttgcagtgcttgcatgcagttggcctcgcaggggcgcagctcgatatacacgttggtgatcggcacctgctccttatcggcgtcaaagcgttcgatgcgtcttatcgccgcaaccagcgcggccatttcggcatgaagcttgacccaattatgggtgtagatatccggcggcatctccattttcatctggctattgccaaaggcatagcgagtgctgccgcgcagctggtattcgatggtggcgcaacaggactcaggcccgtaacccg

SEQ ID NO: 29100 - DNA, 543 bp, Glycine max
  Peptide Sequence Number=SeqID_145878
atgggatcaagtcaaaagccttcgcttaaaaagaggttttatcaagtcaaaatcaagagcttagaggtcaccagtttacgaaagttggggcaattaatgggtcaacttcaacggcaagccttccgcaaagcctatggaattagaccgccaaaggcaagtcgaaaatggggtggtcggaataccgagaaaatatttggagcgatcgacgtttttctcgcctatcataaccacaaggaaagtccggttgtcgctatgctagccgacctatatgacaccttcgaccgaagatgcgaagaaagcaatgcaaggattgtttgctgtactccaactctctatgtggggctggtttcacacctttttctccaagaaggtaggcccgtctatccgctacaaggttaccgctcgtgcgtcgaaaaaggaaaggcgaatagggaccaactcttggctagcatgggggggcgtctgttaattggttccctcgctagaaggaaggaagaatcaagattctatcttcatgcgaaggatgtccaaatgttcccttga

SEQ ID NO: 29101 - DNA, 179 bp, Glycine max
  Peptide Sequence Number=SeqID_145879
gcttcgcctacggcccggaagcggcggagaaagccgcccaggacagccgcatcgcggtcgcgcagaaaatcccggccggcgtcgccgtaccggccagcgcaccggcgcaggcacaggccgccccggccaccgtcagcggcggttttctcagcaacctgctgaagaaactgttccgctaa

SEQ ID NO: 29102 - DNA, 627 bp, Glycine max
  Peptide Sequence Number=SeqID_145880
atggatgatttttatgttcgaacaactgaatttttatgcccctatttgaagtgcagaataaaagcgacaccttgcagttacagaaccgagaatgttaatcaatcgtatttcaaatatactggcgagcacaagtcaggttgtggcatacatgatgcaaaaaatcgcaaccgaaacaactctaacgatgaaaaaacacataactctcctccagctccattcatttcaattcttcgtctggaaaatgacgaaaggattcacagagaaaaaaacgataataggaccagaaaagtaaacgatgaagaagatgttgtaagagaacatcctgtttcgtcttcaagtattaaaccaatagttgattactatctgtcgggagttaacaataacgagttcctttcaataccgccctatgaaaaaaggacttataatgagacatttcagaaattaaaatacaaacctgatgttaaatattttaagcccgcaatatattttggtgcactacaatctaatcttactttagatcctaacgcagatgagtatgaaattgtttttcttgctcgcaagaaaggaacaaaagaagcctttagacttaaagttgatgcatcaagctggaactcaagtcagaaagat

SEQ ID NO: 29103 - DNA, 180 bp, Glycine max
  Peptide Sequence Number=SeqID_145881
atgccgcaagtgagagagagagatgatgcacgagggagggcttcactaaggggaactaagcacttcaacagagggcttcacacgcgagggagctcttcactgagggaaggcaaacttgttgacagagggcgaccgcgaaagtttgagagatcgagctcaagagttcgagagatcgtggaa

SEQ ID NO: 29104 - DNA, 429 bp, Glycine max
  Peptide Sequence Number=SeqID_145882
atgaatgcggatcatgcacaccaacatgaccactcttacatggatatggatcgcgcccacaagacacccagtggacccggagaagtccaacagggccctggggtttccagctctggttacgggcctctatcagtcttacagggtgcccgttcccccagcgaggtcatgccatcgtacataggaatcgcgcctgcaagacacccaatggactcgaagaagtccaacagggtcttggagttgtcaagctctaattacgggtctctcaagggcatcaggccccctactaatcgagctttcatcaagaagtactgcgtctccaggcaggtgcagggcgaaacaccacagcagcctggggatggccaacagcgggcaacagacgcaccgccatcacctctagagttcacctcagctcatcaacaaaaaggttag

SEQ ID NO: 29105 - DNA, 201 bp, Glycine max
  Peptide Sequence Number=SeqID_145883
atggaagcttctcaaagaagcctcatgaggaagcttctcaaggaagcctcacgagaaagcttctcaaggaagttgtctgagctgtctcagaaaaagtgccctgttaaccgttggatattctcgaaatttggtctagaggttcataggatagatgtccacgatctgaccgtcgcgatctgcgatatgtatttggatgtgtga

SEQ ID NO: 29106 - DNA, 153 bp, Glycine max
  Peptide Sequence Number=SeqID_145884
atggtgtattctcttgaacgacaaggttccattcaggatgcaatggccacagtatacagacctgcaggtgttcctgttcgtgcaactaacagacctggttcacagttgcttggggctaatggtcgggataatggtccaattttggttccttaa

SEQ ID NO: 29107 - DNA, 549 bp, Glycine max
  Peptide Sequence Number=SeqID_145885
atgaacaagataatagctaacaaatacaactcagtagctgagatcaatgttgagaaagagagttggagaatcatggttagggttgttcatttgtggatggtatcagatgtttcaaataacaaacaaacatctagcagtaaaataccattatccatggagatggtgctggtggactcaaagggtgatagagtccatggttctgtgaagcagactttcatttataagtttgacaaagccttacaagaaggaaaatggtactctattcaattttttggtgtggctgagaatggaggtatatatagaaccacccaccacaagtacaaaattgtgtttcagtactccactaaggttgcattggtggacaatgcaagtattccaaactctatgtatgattttgtacctataagagacattgtttgtggtgggtatgacactgattatttagttgatgtcattggtattttgacgggtgttgggactgaaagagaaaatgaaagaaacgaaaggagaacaaagatgaatgtcatccaaatagagaatgatggataa

SEQ ID NO: 29108 - DNA, 1176 bp, Glycine max
  Peptide Sequence Number=SeqID_145886
atgggtcagctccagcgacaagcctttcgcaaagcttatggtaagatctgcgacctaaccatggccgagttaacacccacggtggaagagtttgaagagatcctgggatgccctttggaaggaaggaaaccatatctcttctcgagattctatccctccttagctagaatttctaaaatagtcaaaatctcggcacaggaattggaccgcaggaagcgagtcgaaaatggggtggttagggtaccaaggaaatgtttggaagcaaaggcgagagtcttggcaagtcaaggcgaatgggccccgttcattgacatcttggcacttttgatcttcggggtggtcccctttccaaatgtggatgggttggtggaccgggcagtgattgatgcttttctcgccttttacgaccgcaaggaaagcccggttgtcgctatcttagccgatctatatgacacattcgaccgaagatgtgagaagaacaatgcaaggatcgtttgctgtatgccggctctctacgtatggggttgcatcaattacaatcccgtcctcgctataagacaacttggttatcctatgagaggggcgccatcagaggaaggcctcataccttttattgtacgaggtttcaatagcaccaacacgggggtgcttcagagggtccacaaggcatgcaacgggcccatcggcggttacaataggtggttgaaagcctacgcacaagatctgaattggctcccgagtttgaggacccctaaggggatggagattgaaactccggaagaagacgaagagaccaagagggcccgtagggaagaacatggccggaacaaattccgaggggctctgtggggcagtaacagcgagcttaagctccgaagagaagaaagggaccaatcgcgagtagacagtttgatcttgaaggatgaattgaaggtttgcctaaggtccaagaggagcttgtctcagcggttaagcgagaccgaaaccaacatgttagccatcattagcaagtaccaagaagaattaaatctagccacggccaacgagcacaaagtagcagacgaatatgcccgagtgtacgcggaaaaggaggctagaagaagggtgatggactcgttacatcaagaagcaacgatgtggatggaccggtttgctcttactttgaacgggagttag

SEQ ID NO: 29109 - DNA, 225 bp, Glycine max
  Peptide Sequence Number=SeqID_145887
atgggaagtgaagagaagagagagaacaaagaaaatgcagagggcgatggagatagcagaagtgaaagaaactcagaaccagagagagtgatgaatgatttgattcagaggaagcagcactcactcactcgactctcaaaatcagagtctcggattttctctttcactcttcttcgcaaagagagacaggaaggaaggcacagatttgacatcttatatgtttaa

SEQ ID NO: 29110 - DNA, 189 bp, Glycine max
  Peptide Sequence Number=SeqID_145888
atgaggctaagtcatgaagtgctaaaagtgacagttgagcttagctcattacgcaaaggagaatctggcaaagcatcagcatcaaggacgtgccctaagcgcgagatcagtgtgcaaagtgcaacaattgtcttcagccaggctcaacgcataactggtgctaagttcaaatccacttactcgcactga

SEQ ID NO: 29111 - DNA, 234 bp, Glycine max
  Peptide Sequence Number=SeqID_145889
atggctatactcatggatgataaagacttccgctcgagggggagactaccatgtggaagagactcacacttgaaggggagatgtgttgggttacaagtgtctccttatgtggtggctcgtggtccacaggtgtacccctcgaatctccccaacaattggtatcagagccgatggttcaagttggtgaccggctcagacgagtatgcaagtaccgcaggtagccaaaatggctag

SEQ ID NO: 29112 - DNA, 567 bp, Glycine max
  Peptide Sequence Number=SeqID_145890
atggctgcgcagcagcgccaccagccggctgacctgctgttgattgaggaaggttggcgtgccgccgccccagtgcagctgcgtaacgcgacggccagcaaacagcggcgcgcgctgacgaatctcctgcgccagcacgtcaagatagcgatcggccttgtgcagctggcgcgtcacgattttattgcagccgcagaagtagcagagacgatggcagaacgggatgtgcacgtacagcgacagcgcgcgctcgggatagcgctcaaccgcgtgctggaaatcgctcgcaccaaagctttcgctaaactccagtgcggtgggataagagggcgggtcgcgtggcagaagaggagaagaagcgctgggcggaacgccgccgtaagcgcgatttcagccgcgacaggcggcgcgcatcatatcctcttctgcctgctcgtcttcggcgtcgtcgtccagcgcaatgcccagcgtttccatcagctcgtcaatgcgatccagcgtctcatccagccacgcctgatcttctgcgctcagggtttcgccgctctcaaggcgatcgagcagcgt

SEQ ID NO: 29113 - DNA, 1542 bp, Glycine max
  Peptide Sequence Number=SeqID_145891
atgactgagttatctttctcaaacacttccaacaagaagaatgagttatctagtaacctcttctctatcttcttccacttctgtttctccattttttctcaccctttatacttctcctacttcatcttcttctccccttacctccttaggatcctctctttcctctcccctttgttcatcaccacaacccttcttttagttgcccttctcactttcactcccaacaatcttgctcaggagaagtgtggttctgagccttctgagtccaagtggggcattgtgctttctgttatgaaatcttttctagcatggctgcattccaaagctgatgagatagatgaagaaatggggctcctaggtgaggttgaagcatatcttgtcatgttccaggcatcaatctttgaagtgtttgagcctaagtcagtggaagaatgttcagaaggatttgaagcagttgatgctgagtgctcagttgaaggaagagaagattcttgtgcagtggaagagccaaagcctagtgtcaacttggacaaaaaccttccctcacaacgtggtgaaccaacgttcgaatatccgtcaaaagtgtccacatttaatgcccaacagtgtctcgaacaagattgtctagaaaaaaggataattgtggacgaaagccttcactcacaaccaaagttcgaatccccgttagaagaggtgcctatatttagtgcccgacagagcttcgaaaaagattgcccccaaaggaagataccagtggagagccaaataaacatggatggaaacccagttgagaaggttgatgaagtggaagccactatgcctattgtagaagtcaagagcctagaaagtttgttccaagaaaatcaagagttggaagatttgtcttctcaaaaggaacacaaagaagtgaagccactgattgctgagttcaataaagttgaagaaagtaatgagaaatggcccttgagaagtggatccaaagtggtgatgggttatagagacaataaagtgagcactaacagtgatggggaatttgcttttgctgcatccgggagggtgaagtccttatcacaaagactagaagcaaatattgggagcccagaaagcaactgggtgtacagtggcaaaggcatggggaataataatcacgcacttggtagttttggttcaatgagagtggagaaagagtggaggaggaccttggcttgtaagctttttgaggagaggcacaatgcagatgggagtgaaggaatggacatgctttgggagacatatgagacagagtccaacaacaaggttctgaagaagagcaacaccaagaaagggaagaagaagggtgaggttgagaatagtgaggaggatgaggaagaggaagaagaggacatggaggctaagttgtgctgcttacaggccttgaaattctccacagggaagatgaatttaggaatggggaggcctaaccttctcaaattttccaaggccctcaaaggcattgggtggttgcaccatgttggcaagaatggcagaaagagtaaccactga

SEQ ID NO: 29114 - DNA, 273 bp, Glycine max
  Peptide Sequence Number=SeqID_145892
atgaaacaagcttttaaaagaactgaaactcagcttagcaagttgatatatgacatgactaaagttatggacagaagagaagaagagtatgcaaagattgaagaacatcaagaaagcattcttcaagttaccacaatccatcatcaattgatcaacaaagaagaaaagggtgaagatcagaaaatctcttttaacctctttgaagtcgtgaaacactcaaatatgggtgatgcctattttgaagaagaagaggtggagcaggaaatagcataa

SEQ ID NO: 29115 - DNA, 174 bp, Glycine max
  Peptide Sequence Number=SeqID_145893
atggagaatttgcgaacagcgctatgcaataacttcacggggctccagactcgaaggtggaggatgcatgaacattgctgggcaatgacattcatggggctccgaaaacagtggagaatggagaattggcgaacagcgctaggaaatgatattcgcggggctccagactcgaag

SEQ ID NO: 29116 - DNA, 438 bp, Glycine max
  Peptide Sequence Number=SeqID_145894
atgattagaagttgtccacatcatggcttctaccaacaaaggctagttcacatcttctatggtggagtgtcctaccacaacaagacaagtttagatgctgcttgtgggggtaacctcatgttaaaatcccatgttgatgccatcaagatcattggagatatatattctaacccctataacaactcaaaagataggaggattataaagagaggcattaaccaggtggagaaggatgattccgaaatggagttgggaaaacaggtgaaacctatggcactgaagattaagacacttctgagagctcaaactcaagtcctcatcactacaccttcactcccaacctgtgataaatgtgggattgtacatgggtcaagagaatgcattgtttatgataagctagttgcagccatggatgagatcaactttgttggggaatga

SEQ ID NO: 29117 - DNA, 303 bp, Glycine max
  Peptide Sequence Number=SeqID_145895
atggacacccgtctccgtgtgattggtgatcccatgaatggagttcaacggtacaccaaaatgaaagttgacggagctgttccgtttctcattcctatgacgatgtgtattataaattgtggcaatattaaggttgaggtatttatatatgtgtatttttggggtgagggtcacaactcactctttgaggattcacctagtgaatgtggtggtggggccgccactgtgagatatgggctaatctctaaaggacactcacgaaacaagatacaagtgcaaggccgtgtaacgcgctaccactga

SEQ ID NO: 29118 - DNA, 267 bp, Glycine max
  Peptide Sequence Number=SeqID_145896
atgactaatgcaaactgtctacaagaatcattgcattcagtctcaaacaggaatctaagattcttcctccagaaggaggttgcttctggaggaagcaacctggctcgcctgggcaagttgggtggcaagctcatcccctattttgctataaataaagggaggaatgaagagggaaggggttcagccttcttggcacttcgtattctcttaaaattgctgaggaaaattgtttccgtgaagaaaatccaagccgaggcgcttccgtaa

SEQ ID NO: 29119 - DNA, 207 bp, Glycine max
  Peptide Sequence Number=SeqID_145897
atggcggttaccttgggctgccattccctacttaagcatctcaaaactttattaattaaatcttcattaggaaaggtttttcctaaggacgaaaaaccgataggagagcaacatcaaaaacagaacctcaaagagagttatgcttcatcctcagaggggaacaacactagaaatttagccttccataagttcaacaaaagcagataa

SEQ ID NO: 29120 - DNA, 153 bp, Glycine max
  Peptide Sequence Number=SeqID_145898
atgactattctatgtgttattttgaagcttgaatgggcgatggctctgaagaagttttctattaaaagggctaggaagaccaccgcaggggaaggatccagtgcggtcccacaagcggaaattgagtttgatggacatcgtttccgaagctag

SEQ ID NO: 29121 - DNA, 222 bp, Glycine max
  Peptide Sequence Number=SeqID_145899
atgtgtatacacctgaagggtgaatgctgtgaaaattttcccggacgcccaaaatggactcgaatgaatgcacaaattgataaaagaacgtattttggaaacactgtgggacatccccttcatccccgaaccgctggccaaaccctgacatatatcatgaccagccgttctacaagccttgagctagaattccaacttaccataaaccttgacccagggtga

SEQ ID NO: 29122 - DNA, 354 bp, Glycine max
  Peptide Sequence Number=SeqID_145900
atgaggaactcagacctacgtagttcttgcaaaagcggttatagcgtgaacgatcggaaaaagggagaggaggttgccgcccagctcgcccaggcgaccttagctcgcccaggcgagctgggtggcaacctcctctccctttttcctataaataggctgaagggggctgttctaaggatccctcagccccctggctatgtatttcagctgttttgggtgaaaaaaaattgtttccgtgaagaaaatccaagccgaggtgcttccgtaacgcttccgagatgtttccgtaagcaaatccgtgaaggtttacgtccgttcttcatcgttcttcatccgttcttcgttcttcaacgg

SEQ ID NO: 29123 - DNA, 198 bp, Glycine max
  Peptide Sequence Number=SeqID_145901
atggcgtcatcaagtgcaaagaccatggacagattaaagctcctaaccatcccctttcggagatgtttagattctttaaccactctatttttccccacaaaggacatccgacaagatttatcgcatcccattcgtcaaaagcattgttttctaaagaaaaactcagcatgcaacatggacatgcatgtattcccttag

SEQ ID NO: 29124 - DNA, 270 bp, Glycine max
  Peptide Sequence Number=SeqID_145902
atggtggggtatgcaccttcaagctttacggatttggtcttcgtcggggaaaggatcgaagcaggtctaaaaagaggcaaatttaatcatcttgcttggacgaatgagaaaactggggcaaatgaagagggtgtgaatgaaggagaaacccatgctgtgattgtcgttcctacatggaaaattcctaccagcttaacaaacatcattactcagccaatatcagcccttcttattacccaccacccaattatccacaaaggtcatccctaa

SEQ ID NO: 29125 - DNA, 633 bp, Glycine max
  Peptide Sequence Number=SeqID_145903
atgcaaagaagatctaatgcaggtgatttgatctctatcgatttggagattaacgctacttgcaggaggcgcaacatagagagaattataaattttttgcaggacttagaagctgcagcaactccaaaagaagaacctcgatcttctgaggcatcttctagctttcctattccagtaaaatctcatacagatttaattgaagaagttatcatggctgaagagccaaggagagtgaccctagaagattactcaagttcaagtgtgccgcaatttttcaccagcattgcacaaccagaggttcaggcacaaacaatcacatatcctccttctttgatacagctggttcaaaataatctatttcatgatgcaattcgattgagcttgttttcattctcattgtctggagaagctaatagatggcttcactcgttcaaaggcaacagtcttaagacttgggatgaagtggttgtgaaatttctgaagaagtatttcccggagtctgagactgttgacggaaaaacaagcatctcttcttttcaccaatttccagatgaatccctgagtgaggcattagaaagattacgtggtctattaagaaagacacccactcatggattcttagaatcgatttag

SEQ ID NO: 29126 - DNA, 123 bp, Glycine max
  Peptide Sequence Number=SeqID_145904
atgtatatatgtgtggaaatggctccgaagaagctttccttgaagagatctaggaaggacgccgcggccgcagagactagtgccgctcccgagttcgatagccttgtgttgggggagcgataa

SEQ ID NO: 29127 - DNA, 1476 bp, Glycine max
  Peptide Sequence Number=SeqID_145905
atggatgccaaggtgaagcaaatgattaagcttattgaagaagatgcagattcctttgccaggagagtagaaatgtattataaaaaacgcccagagcttatgaaaatggttgaagagttttccagggcatatcgggcattggctgagagatatgatcatgcaactggagtgatctgccacgcccataagaccatggctgaagcatttcctaatcaaggtgcatttcttgatccagatgaaccacaaaaggatgcttctgctcatttccatgctatcaaaagaaatggtggttatattggtgaacccgattctccattgaacaaaaccggtttgaaacagctcaatgatctctacatccctggagaacaagaaaatcttccaaagtttgctagaagggggctcaatttttttgagatgcaggaggagagtaatcagcaaaaccgtggaagcaacaacactttgtctgagtctgaacgcgtgacaaaagatgagacagaaattttggccttgaagaaagccattgccaaattagaagatgaaaaggaagctggcttacttcagtatcaacagagtttggagaaaatttctaatctcgagttagaagtgtctactgcacaagagaattctcgaaaactcgatgagcgagcaagtaaagctgaagctgaagttcaagccttgaaggaagcccaaatcaaattacaagctgaaagtgaagctagtcttcttcagtaccatgaatgctgggagaaaatatctaatctggagaaaaatatttcttctttgcaaaaggaagcaggagaacttaatgaacgagctactaaagctgaaactaagtctgagtccctaaagcaggaacttgctagagtagaagctgaaaaggaagctacccttgttcaatataaccagtgcttggagacaatatcaaaactggaggagagaataaaagaagttgaggagaatgcaagaaggattaaggagcatgccaatatagcagaaaaagaaatcgaagctttggaattacaagttactaaacttaatgaagaaaaggaagatgctgctctccactatcagcaatgcatggagataatttccagtttggagtataagctctcttgtgctgaagaggacgtgcataggctaaattccaagatagttgatggggttgaaaaattacagagttcaaaacaaaaatgtcttctcttggagacatcaaatcacactctgcagtcagaattacaatctttggcacaaaaagtggggtctcaaagtgaagaacttaatgagaagcagcaggaattgggtagactttggggttgcatacaagaggagagactgcgattcattgaggctgaactgctttccaaactcttcagcagttgcattctcagtctcaggaatagcttagatctcttgcttttgaacttaacagtaaagtggaaatactggggaatgtggaatctcgtaagtaggctttag

SEQ ID NO: 29128 - DNA, 1077 bp, Glycine max
  Peptide Sequence Number=SeqID_145906
atggtggtgagagaactggaacgtaaaattgttcaacttgaacaacataataaggaattgggagatttacttaaagaactcagggaagctcagattaataatggtggagcaaattcggtgcataaacactgcgcctcaattgtcaagtctaaagaatctcaatggggtgatcaagtggcaaagatggaagcagatattgttacttataagtctacactgaccaacaaagaacaagaaataagggagcttcagatggaattggaaaattgttattatgccattgaagagaatcacttgggactcttgatctttaaatctgaacttgttgaggcttactccaaatcatgcaggggcagggcagaccttgataaagcatttgatatcaaagagaatgaagacatggttctaatttctgtagagcaattgagagtgaaagacaagtctgtaaaaactatggcacaagctgcacaacaacactatctgttggaggaagagcttaaacaacaaaagaaaaaactcgaggaatcatctgagggtcaactaatcttggaagagcaactgctgcagatggaatacaccgtacaatatgaaagaaatgcagcatttgaggctctagaaaagacttctggtgctgagggggagcgtttaaaagaagcagctaacatcaataaatcattatctaccttgggtcatgttattatgatactagtggatgtggcaaatgggaagcagaggcatatcccttacagagactctagactaacttttcttcttcaggctgtggtgaacgaagattctactggggatgtaattgctttacaacatcaaattcgacttttgaaggaagagctttctatcctcaaacgacgtcagaatgtctctaggtctttgtcattttctttgtcatcgatcagagatataaaacaatcactagaactcgaagactgttgcctagaaaatgcaactgacatggttgaccaacatgaagataacatgccgaattatgaatccaagggcatcagaatgtcccacaaacaggtatacatgggtaggcttggctatgttaatgaaggctag

SEQ ID NO: 29129 - DNA, 246 bp, Glycine max
  Peptide Sequence Number=SeqID_145907
atgtgggaaaaacttgcttcaccttccatggtagaggtcccggcctgtcatttggctaagcaagctttcgatgaggcaattgcagagttagacaccttgagtgaagagtcatacaaggacagcactttgatcatgcagctgctgagagacaatctcactctctggacctctgatttacctgaggatggaggtgacgaaattaaaacagaagaagccaaacctgctgaaacttctgagcactcatag

SEQ ID NO: 29130 - DNA, 1548 bp, Glycine max
  Peptide Sequence Number=SeqID_145908
atggtgttcgactgtctctctcaagggcaattctttcttaaggaatctaaatgtgtgtttgctcagcaacaactaaaattcttgggtcacattgtatccgcccgaggaatggccccagatccttcaaagcttgaagccatggtgacttggcccgtaccaacaactacccaatccttatgcggtttcctgggcttaattggcttttatcccaagttcatctgcgggtatgctgccctagtcgtgcccctgaccactttgtttcagaagaataacttccattggggagttgatgctcagaacgccttcgacaacctcaagcatgccatgacccaggccccagtattgtctttactagacttttctataccattcaccatcaaaacagatgcttacggcgtggtcaagggtgtcgttttgacgcaacgcgaccaccccctggctttcttcagtaaagccttctgcccacaactacaacatgcttccatttatgtccgtgagctacatgcggtcatgaacgcggtccacaaatggcgacaatacctattgggtcaccccttcaccatcctcacggatcacaagagtctgaaagacctcatgggtcaggttattcagacgctggagcaacaagtctatctatcgaacctgttaggatatgactacactatccaatacaaatccgaaaaatccaatattgttgttgatgcattatccagagttccccaacacaccagtggacaatacatgttgctatccatacctcacttcatcttcatcgacgccatgcacaaacactttatcaccagtgccccatttcaaaccaagctccaacaagttaactcagacctaggttcccaccccgactttgaattccgagatggcttgctattcttcaatgatagagtgtggctcgaacctgagaacccttttattgtgccgttgatagaagattttcatttaactcctattgaatggtgttacaacaccgttgtccactccgccaccgacatcacccccttcgaagctacatacggcaagcctcctcctttactcgcaacctacttgaaaggttcatctacggtcaaagtagttgacagcctcttgtcctcaaggcaggatctttggacttctttatcaacacgtctgcgcaaggtcacaactcctttgccactgcaagccgcagataaccatccactagttgaacctttgaatattgtggataccaagtgggatgacacgaccaccccgccatcactattggtgttagtgcagtggaatggactcgtattgatagaatgtagcacattcggcctaagagagagacccacaagccagtgttcctgcaagattacgtgcgaccataggccgttagcgtatttgtcaggatgtagtactaccttgatctcgagtccaagggacaatcactatgagatggcttccaacctatcttctacaaaagcttctggaatattcttgaagtggatgtttggagcatggtcagccaaccgttctgcacaggaacttttagggaagggcttgttgaaacactga

SEQ ID NO: 29131 - DNA, 153 bp, Glycine max
  Peptide Sequence Number=SeqID_145909
atgaagtgggatgcttggtttaataatactgcttatcctagtgagttttatgggtccactgggccacaagcttctcaagctcaagcatttacttttctagttagagaccagcatcttggggctaatgtaggatttgctcaaagatataattga

SEQ ID NO: 29132 - DNA, 507 bp, Glycine max
  Peptide Sequence Number=SeqID_145910
atggttgaatgcatgaagacaattgcaaaacttgatctagaactaactgttgaagagaggaacctgctctcagtgggatataagaatgtgattggtgcaagaagagcctcttggcgcattatgtcatcaattgaacaaaaggaagagtctaaaggaaatgaaagcaatgcaaaactgataaagaattatcgtcaaaaggttgaagaggaactctcaaagatttgcagtgacattctcagcattattgaccagcatcttgttccttcttccacctcaggagaagccaccgttttctactataagatgaaaggtgactattatcgatatttagccgagttcaagaccgatcaggatagaaaggaggctgctgagcaatcactaaagggatatgaggctgctttagctacagcaagcacagagcttccatcaacacatccaatccgtcttggacttgcgctcaacttctcagtcttctattatgagatactgaactctcctgaaaggtaa

SEQ ID NO: 29133 - DNA, 741 bp, Glycine max
  Peptide Sequence Number=SeqID_145911
atggcgacgatgatgtggtccttggagaggagtgattgggactcggtgaagaccagatctgatgatgttgaagttgagctcgctcttagagtcttggaagggtgttttttgcttcaccctcaaagtactgctctcgcccatcaacacaacgctattcaagttttaatgaatatattatccactcgtggagtgcttgagcaaggtgcatgcttagatgctctaatctcattgatggtggattcatcatccaatcaaatggatgtactgattgatgttcctcttgatgcttatgagatagtttgtctaagggttggggtcgctgttcacaaccttgggcagttttaccttggacaacggaagttggaagaagctccatatgttgcggtttccagaagtggtcaagaaaatctccttcaggctcccttattgtctagatcaaatagcatggaggcttccttggcaaaggatacttcctctaatgatgtgaaaaatggtcaagggttcaaaggccatagcatgcttgctcctttcacagctgggtggcagactactgatttgcatcctctggtcatagaaaggtcagagggtggtcatgatcttactgaaattggtgaaagaggggtaaacatcagcggtggccaaaagcagagagtatccatggttagagctgtctactccaattctcatgtgtacatctttgatgatcccctaagtgctctcgatgcgcatgtggctagacag

SEQ ID NO: 29134 - DNA, 1548 bp, Glycine max
  Peptide Sequence Number=SeqID_145912
atgagaagctcgtggttgaagaaacagtccttcgtcatcggccataagccgccactgaactggttgatcctgttcctgataagcctcctcgctctgattgcagttttgagttcttcttcttcgcctttgtcgtcgtcgaagaagaattcatcgcgtcgcaccaccgtggaatcgctaatctacacgagctacaggaggatagaggagcaggccgcggtggattacttggagctgagggctgtatcgagcgccggcggcgcgcggcagaaggaggtgggactctgccgcaaggagagggagaatttcgtgccgtgccacaacgtgtctgcgaatttggttgcggggtttaaagacggtgaggagtttgatcggcattgtgaggtgtataagggaacagagaagtgtttggttcggcctccgaaggaatacaaggctcccttacagtggccggctgggagagacgttatatggagtggaaacgtgaagatcaccaaagatcagtttctttcgtctggaagtatgaccaaaaggttgatgctactagaagagaatcagattgcctttcacgcggaggatggtacgatcttcaacagcgtgaaagattatactcgccaacttgcagagatgatagggttaggaagtgacactgagcttcctcaagctggtattcgaaatatactagatattaattgtggatttggtagctttggagctcatttattgtcgctgaaaataatggcggtttgtattgcggcatatgaagcaactggcagccaagttcaactatctctggagagaggtcttcctgctatgattggcaactttatctcaagacagcttccatatccatcattatcttatgacatggttcactgtgctcagtgcggcattatgtgggatgaaaaaaatggaatgttccttgtagaagttgatcgtgttcttaaacctggaggatattttgttttaacctcacctacaagcaggccacagggttcatcacgggagaaaaagagaatcatggcaaacccaatagaagggctgacccagcaactctgctggactcttctagctcagcaagatgaaactttcatctggcagaagactgctgatattgattgttatgcatctcgtaagctgcctactatacaagtatgtaaagcagatgatactcagtcatactatcggcctcttttgccatgtataagagttcagcctgaagaattttatgaagacttccaatattggagatcagctgttaacaattattggtcattacttacaccactaattttctctgaccatccaaagagacctggagatgaagatccattgcctccatataacatgatccggaatgttatggacatgagtgctaattttgggggtttgaatgctgcgctgctggaggagaaaaaaacagtgtgggtcatgaatgttgttcctgcaagggcttctaatgcacttcctcttatactagatagaggttttgctggtgtcacacatgactggtatgaaggtaatactgttgagcttgagggtgaaaactga

SEQ ID NO: 29135 - DNA, 288 bp, Glycine max
  Peptide Sequence Number=SeqID_145913
atgaagtttgaaactcccattcgtaaacccgacatgtccagcaagtatttaatggcaaaggttcctagttcgttggggagtttgatgagactaacggtgttggatttcaacaaccaaaacctctcaagtgagttgccccttaaggccttttacatcggttctaatgacctttctacatcgattacgacgcgtggtggtaacacagtgtcgttgaataccgacatcggttggaggaccgtctttgaagggcgacttttctacatcggttgtgtagctcaaccgatgtag

SEQ ID NO: 29136 - DNA, 261 bp, Glycine max
  Peptide Sequence Number=SeqID_145914
atggcgcagcaacaacaaaatcaccgagacgagttcgggaacgaccagagggcctatgatgtccgccaccgcgatctcgcggtggcggaaccagttcggaagccgaactgccatagaccccgtggcgaactacgcttacgggaacatagggagtggcgggtacggagcgccacccacaggagaaccgcgctccgactgaaggccatggaaccgctgatcgcggccgtggtgacggtgaaaggaacaagaatatggacatga

SEQ ID NO: 29137 - DNA, 578 bp, Glycine max
  Peptide Sequence Number=SeqID_145915
gtctcctgggctgggggcccgttgctgtgtattatcgaccagagagggtcgtgcggcaggttggatacacccagaccattcctgctccgcctgtcgattcatgggtgtcatatgatgatatacacgacaggtggattcactactcggatcatatggttccagctggtgaggtttgcactgtgtcaggtcagtgtgtcagtgactacatggactggttctttcgcatctcgcatcctttcatgacatcagaccaggcatcagatcctctgccagatggtcatgctccgcaaccccgagtcatccctcaggccccacagacagatatccctcacgtgccagagccaggagcaccgtcgacatctgcgaggcccgttgtggaggagcctaaacatgcagtggtaaaagtttgccatgggattgttgagaggttggagcgccatctgagcttaggggtggtcaagccaggctcatcgacacatgaggtgatcgaagaatgcctcaggatgaccaggagtgttacacaagaccatctagtatatattaggtctcgacgcaggcggcgcacggaccaagcgtag

SEQ ID NO: 29138 - DNA, 144 bp, Glycine max
  Peptide Sequence Number=SeqID_145916
atggcgtttagaggaggcactatgttgatattaacaatgatggcattacttgagattcagatatgctcatcggagataaaccgtggaaactttccaaatggcttcgtatttggcactgcctcttcagcttttcagaaaaaataa

SEQ ID NO: 29139 - DNA, 276 bp, Glycine max
  Peptide Sequence Number=SeqID_145917
atgggtcgatcccggagatgcggatgctcaaacttggaaagggccaagcatgggtcagattcggggtttgtgtgggatatgatgttgggtgattatacatcggcaaaaggagatgatggaagtgggggaggttggtggatgaaggtgttgtttgcggctgataggaggagaatagcggtgctcggtagtgatgggcggccgcaggccaatgcaggggtcattggaaacggtggagaggaagggagagtaaaatttggtggggaaggtgtacaatag

SEQ ID NO: 29140 - DNA, 411 bp, Glycine max
  Peptide Sequence Number=SeqID_145918
tggattgttagccagttgcttttctcccttgaccttgctactttcatagccatagcaggaagcctggcaactttctttcgagacatggttgaagaaaaggctaatgccctgactccaacggcgcctactccttcccctaaagcggggtacctccctgaatacaacaaaagaaaggctaagaaaagaagaaagaggagaatgcaaaagaaagtgggcactcgtttcgttggttcaactcctctctcaaagagaagcgtaggaatccgcttataccgaacagagcttagcagccacacctacaacttgagatgttcccctgtgagccttttatcttatagtactgcattgggcacagatgccaggctttcagcctttcataggtacggttaccccgcctacttgactacttga

SEQ ID NO: 29141 - DNA, 408 bp, Glycine max
  Peptide Sequence Number=SeqID_145919
atgatatggctatctgatgctaaccgggaaccgcccatgcctgccgtcaacttacgccatattgagattttccacgcggtgatgaccaccggcaacctaaccgaagcggcgcggatgctgcatacctcgcagccgacggtcagccgtgaactggcgcgttttgagaaagtgctgggcttaaagctgtttgagcgcgcccgcggccgtctgcagccgacggtgcaggggctgcgactgtttgaagaagtacagcgctcgtggtacgggttggatcgcatcgttagcgccgcggagagcctgcgcgaattccgccagggagaattgtcggtagcctccgttcctggcgcgctatccggacgtcagcctgcagatcgtgccgcaggagtcgccgctgctggaggagtggct

SEQ ID NO: 29142 - DNA, 180 bp, Glycine max
  Peptide Sequence Number=SeqID_145920
atgtcattggattactgttggaggtgtgaatctggtattctagataatggtcatatagaagttcgaatagctacacgtcttccatggtggcattggcgaatggttctaccagaaaatgcagaagaaccgccacttgcagacatagagaaatcaaagcccattaggaagaagatggagtaa

SEQ ID NO: 29143 - DNA, 255 bp, Glycine max
  Peptide Sequence Number=SeqID_145921
atgaggcgcttccgtaacgtttccgtgggtgatttcgcgaagattttcaaccgttcttcgacgttcttcgtcgttcttcagtcttcaatcgggcaaggattggcattctcaccctgggtcaaggtttatggtaagttgggattttggcttaaggcttgtagaatggctggacatgatatatgtcagggtttggccaacggtttggggataaaggggatgtcccacattatttccatgatacacatgcaacaatga

SEQ ID NO: 29144 - DNA, 358 bp, Glycine max
  Peptide Sequence Number=SeqID_145922
gaaagaacacgttttatggtgcccttaccaaacccgtgctagagctagagtaatgggtgaaatagaggaggtacaagagcagatgaaggccgacacagaggccttgaaagagcaaatggtaacaatgatgagcataaaggggataatagaggtcaatgcggctgcaatagtcactaccagcaccattgatgagaagggcaaagcaattggtgatatacccctgcaaaacactttggagggccttcagtatcacccacaaaccacacctcttgcatttcacagcggggttaaaaccttcatgctatgggcagaaatggggaaagttggatcatctagaggaaaggctcagggccattga

SEQ ID NO: 29145 - DNA, 288 bp, Glycine max
  Peptide Sequence Number=SeqID_145923
atgtgggatgctacggtgtttggggtgcataatgacaacttctccttgtacataaagcatgaagatttgtctgaaatagcacacgatggtcaatgtctcagcatctctgttatacaattgtggatttttgctttgaaaggacttgacgatactccacaaagtaaacccaaggttgctgctaggtggattgttgttaaatgtttcaatgatgctagaccattggaaccagagagattgaagacgcttcgcatccattgggcaaagtattatttgaaagttaaaaaatga

SEQ ID NO: 29146 - DNA, 480 bp, Glycine max
  Peptide Sequence Number=SeqID_145924
atggttgtgcaggcttttcagcagttcacgggtattaacacagtcatgtactacagcccgacaattgtccaaatggcagggttccatgctaatgaattggctcttcttctatcccttatagttgccggcatgaatgcagccggaacaattcttggcatttaccttatcgaccatgctggacgaaaaaaattagctctttctagtctgggaggagtaattgtatctttggtcatcttggcctttgcattttataagcaatcatccacgtcaaatgagttgtatggatggcttgcagttgtaggcttagccttgtatattggttttttctcgccaggaatggggcctgtgccatggactctgagttcagagatatatccggaagaatatcgagagaccaaaggattgacctttgatgaagtggaagtactatggagggagagagcttggggcaagaaccccaagaacacaaaaccttcttga

SEQ ID NO: 29147 - DNA, 102 bp, Glycine max
  Peptide Sequence Number=SeqID_145925
ccacgttgatgttactctaacatcaagtgttggacctgagtgtgtagagttgatctctatagtgtgtggagttgatctctattgttcagagagcaatctctg

SEQ ID NO: 29148 - DNA, 993 bp, Glycine max
  Peptide Sequence Number=SeqID_145926
atgcgtagtacggactccgcgctggtggcggaacatggcaccgaagccgataccctgacccgttatcgtcaggttctgcgtcagcgactgctgctgattggtgtgctggtgctggcgatcctcgcttcagttatcctcgatttcacccttggcccggccggcctgactctcgacacgctgtggcaaacgctgctccatcccgcagcggtggacgccggcacgcgcgtgatcgtctgggacatccgtctgccgtacgcgctaatggcggtggtggtcggcttctcactcggcctggccggtgctgaaatgcagaccatcctcaataacccgctggccagcccgtttacgctcggcgtctcgtcggcagcggcgtttggtgccgcgctggcgatcattctcggcatcggtattcccggtgtgccggatcagtggctgatctccgccaatgcctttgtcttcgctttgtttgccgcgctgatgctggatggcatcacgcgctggaccaaagtctcaacttccggcgtggtgctgtttggcatcgcgctggtgttcacctttaacgccctggtttcgatgatgcagttcatcgccagcgaagatacgctgcagggcctggtgttctggaccatgggcagtctggcgcgtgcttcatgggaaaaactgggcgtgctgagcgccgcctttgccatcctgctgccgttctcgatgctcagcagctggaaactcacggcgctgcgcctgggtgaagatcgcgcggtgagcttcggcattgatgtgcggcgtctgcggctggcgacgctgttgcgcatcagcattctctcggcgctggcggtggcattcgtcggcccgatcggctttatcggcctggtcgcgccgcacattgcgcgcatgatgtttggtgaagatcaccgctactatctgccggccagtgcgctgaccggcgcgctggtgctgtcgctggcgtcggtggcctcgaaaaacctcattcccggc

SEQ ID NO: 29149 - DNA, 249 bp, Glycine max
  Peptide Sequence Number=SeqID_145927
atgaccactcttacgcagatatggatgacgttgctacttagcaacattctgcccagcgaccacaatgccgatctccccttgcggaaggatcacgcccacaagacacacagtggacctggagaagcccaacagggccctggggtttccagctctagttatgagcctctatcagtcctaacgggtgcccgtcccccccagcaagggatcacgctcgtaagacacccagtggacccggagaagtccaacagg

SEQ ID NO: 29150 - DNA, 666 bp, Glycine max
  Peptide Sequence Number=SeqID_145928
atgtggagtcctatgaaggtaagggcgtgcagccctacgacggtgagggcgtccaaccctctgaaaacaaggacgtgtagtcctcagaaggcaagggcatgtagcactctgaaggtgaggaaatgtactcctctgaatgtgagggcatgtagccctctaaagaggaggacaagcagtccattgaaggcgagggcgtgtagccctttgaaggagaggatgggaagtcctatgaaggcgaggacgcgtagccctcaaaaggcgaagacgggtagtcctctgaaggcgagggcgtgcacccctcgaaaggcgaggacgtgtagtcctttgaaggtgagggcgtgcagccctctgatggcgaggacatgtagtcctctgaaggtgagggcatgtagccctctggaggtgagggcgtgtagccctctgattgcgaggacgtgtattcctctgaaggcgagggcgtgcaaccctctgaaggttaggacgtgtagtcctctgaaggttagggcgtgtagccctctgatggcgaggacatgtagtcctctgaaggcgagggcgtgcagccctctgaaggttaggacgtgtagtcctctgatggtgagggcgtgcatccctctgatggcgagggcatgtagctctctgaaggcgagaacatatagtcctctaaag

SEQ ID NO: 29151 - DNA, 316 bp, Glycine max
  Peptide Sequence Number=SeqID_145929
atgcggctgaacgtttaccggcatgcgtcatcacgctgtcttcacgcctggcaggcggaaggcaacgcgttcaataacgacaaggagcgatcacggcatcgccaaggttatggatccggcaggaactattgcttatatcgagagtgcacacttgccactgccgcaggtggcttacgtggttgcgctgattgtagagctcgggctgggcctggcgttactggtcgggttcaaggcgcaactggctgcggcgggaatctcgctgtttacctttgtgacggcattgatgtttcacagcaatatggcagatccagtgcag

SEQ ID NO: 29152 - DNA, 1386 bp, Glycine max
  Peptide Sequence Number=SeqID_145930
atgccacccaaggtaaaaactgacgccgaaaaacaagctgtgcgcaccgcgattatggacgcggccagggagctgtttatccatcagggcgtacaagcggtcaccatgcgtgccgtagcacaacggataggctattcggcaaccagcctttatctctacttcacagacaaggaacaactgctcagggcagtggtagatgctgacgtgatcaagttggcgcaggcgttaaagtcgaccctcagcattgctgacccattgcagcgttttttacagtttgggcagcactatgtgcaatttgcacttaccaaccccaaccattaccgcatgatgtttatgacccaacatccgccatgcgacccggcgctttccagcattgagcaaaacaatcctgagcaggacgcctactccatgttaatcggcgtcgtcaccagcgcctggcatgccggcgtgttcaaaccgtccctgactgacccggtcctcattgcccaaaccatctgggccgccatgcatggcttgtgtgcattacacatcaatctcgccgacgatgcctggatcaactggcgttccttggaatcccgcattcaggctatgatagaaatcttgtgcctggccgcaatcgtcagtgcctgccaccagccaccagaagaaaccgctgcaccacgcccggtatggatcatgtccgttggcagcacgacctcctccattgaggccagctatacaggggaagtgaagtcccgctacgaatccaacattggcttccgtatcgcagggaaaatcatttcacgcgcggtcaatgtcggcgacgcagtcaaaaaaggccagttaattgcccagttggaccccaatgactcgcgcctcaacgcgttggcggccggtgcggaagtgcaaaccgcccaagccaacctggcgctggcacaggcagaactggcgcgccgccagcagttatacagccagaaatttatctcaaaatccgctctggatagctatgaaacccaggtaaaaacaacgcaagcccgcctggaacaagccaaatcccaggctgcagtcagccagcatcagactggttatacccagctggtggcagaccgttcgggtgtgatcggcatgatccaggcggaacctggacaagtggtctccgccggccaaacggtcgcccagatttatgatttgcagaccctggaaatccagattgccgtcccggaatcaaccatttccaccttgcatgtgggcgatgccgcgcaggtggccctcaatgatttgtcacaaggctaccagggtcgcatacgtgaaatttccccggcggccaacagccagacccacgcttttgatttgcgcatccagctgcttgatgctgacccgcgcatcaagctcggcatgacggcgcaa

SEQ ID NO: 29153 - DNA, 216 bp, Glycine max
  Peptide Sequence Number=SeqID_145931
atgaccacatatcgacctccactccttatggctcatatatacccgggtataaggcctaatatctcaatgtgtgtgcaaaggtgtaggtgccattccccagtggagttgccatctgtcacaacctaccattcgacgggagggcgaggtgaaatgaaaaacacgttcgtctcctggggagaaaacgagtgggagtcgccaccaacgtttattcgatga

SEQ ID NO: 29154 - DNA, 195 bp, Glycine max
  Peptide Sequence Number=SeqID_145932
atgaggaaatttcctttcacaaagcgtaagcctcgcactaagcgcatctctgttcatgcgctaagccgcgaatctcatgcgcttagcgcccaacccttgcatctgaggctgattcattctgctaagctagccatggccaagctgagtctaatcgaattcgatctgaatttggctaagcttcagcctgatcgctaa

SEQ ID NO: 29155 - DNA, 159 bp, Glycine max
  Peptide Sequence Number=SeqID_145933
atgatgtatgctcaagtttgtttcaactgcatgactctagcctatgagactttcataaacactccagctggagatgttgtcgacaatctgattcaggagtgtggaactgttacacatcctctagcctatgagacttttaacgacatgactctagcctaa

SEQ ID NO: 29156 - DNA, 858 bp, Glycine max
  Peptide Sequence Number=SeqID_145934
ggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgacgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgctcgcgggag

SEQ ID NO: 29157 - DNA, 435 bp, Glycine max
  Peptide Sequence Number=SeqID_145935
atggaggccatgaaggaccaaatggccgccatgatggaggctatgttgagcatgaagaaaataatggaaagcaatgtggttgcagttgccactatgagtgctgccactgaggtagacccgagtcacccatcgagcctcaatcaaagcaagaattctttcccaccatacggcttgcctcccaactatgcaccacccaatgttgtaccggtgcctgacgagaatgccgacaactccacacctatacctattgagggccaacaaccccaatatgatcatgcacatgtccaccaacccatgggggagacacatgaagtaccccaccacaatctagccgacttcgagcctcgcctcggatatgccactaaggggcaagcagttggtggtatacccctgccaaacactatgaagggccttcaattttgcccacaaccataa

SEQ ID NO: 29158 - DNA, 438 bp, Glycine max
  Peptide Sequence Number=SeqID_145936
atgtttgtatcatacaaggattggcatgagatgctcccctttgcactgcatggttattggacttcgttgcgcacatctactggggcaaccccgttctctttggtgtacgggatggaagttgtgctcccatttgaggtggagattccttctttaagaattctagcagagtcgggattggaagaagtagagtgggcccagacacactttgaccaattaaatcttatcgagggtaagagattggctgccatgagccatgggcaactatatgagagtagagtgaaaaacgcttttgacaaaagagtgcacccgagtaaattcagcaagggggaccttgttctgaagaaggtatcgcaggctcaaaaagatcatcgaggtaaatgggctccaaactatgaaggaccgtatgtggtgaagaaggctttctcaggaggagtgtag

SEQ ID NO: 29159 - DNA, 183 bp, Glycine max
  Peptide Sequence Number=SeqID_145937
atggttatgaagcttcatcatagccttatcattgttgttgaaggcttccctgatgcagaatttgcattaatggagtgggatgagtcccattctagcgcttgttggtgtagtggggtgactttcccaggttgtgtcatggtgatcatagtcaattgctcattgataatcccgttaaagctttaa

SEQ ID NO: 29160 - DNA, 591 bp, Glycine max
  Peptide Sequence Number=SeqID_145938
atgaaaccacaacacaagcaacacttttcacttctcaatttgtttctccttttttctggtcaccatcatgggtcggaagaaggccgtgaggaacccgagccggaggtttggccatccgaattgggtgtcctaagtgtggtggaaaggttcagaagcaggcctgaattggatcagggtaggaagaaagtgaaccaagagagtttcgtttcccaaagtatagtgaagggtcaagacaagttgcagaaagttgtgaaggagaacaaggagattgaaatgtcctcgttcatgactcagtgtcttaatatagggaatgttcaaccttgtaagaacattaccacagctgatttgaatgttctttcatctatgattgaacaggatctgatggacgttgataaaagaatggaaatgcagaattgcaaccagctggaggcaccatctcaactccagatgcaaacaacaccaacatacaaacctgatatgcaaaccctagcaaaccaacctggtgatcagatgcaaaccctagaaaaccaacctgatatgcaaaccctaacaaaccaacttggtgatcagatgcaaaacctagcaaactaa

SEQ ID NO: 29161 - DNA, 201 bp, Glycine max
  Peptide Sequence Number=SeqID_145939
atggagccaattgaaagaaattatgaagtgtacatgcatgtcttcagatggagatgtatttgtagtgggaggaaattgatagcactggaagtactaggggcagatctagatctggacgaagaagtcgttaatgcagaaggagttaagcatggagcaacacgtgcggtaatagggggtgcatgtgtaggggaggactattag

SEQ ID NO: 29162 - DNA, 183 bp, Glycine max
  Peptide Sequence Number=SeqID_145940
atgggggataatggctatggatctatgtcctcatatgccaccaagctgtatggcgggcagttgagtgatttatatttggatgcctttatcttaaaacaactctcactttcaccaaaaccatggtttgagagtgagattccattgacatccccaactggacttttgcctaacatgttgaattga

SEQ ID NO: 29163 - DNA, 281 bp, Glycine max
  Peptide Sequence Number=SeqID_145941
ttgttggtgggttgtggtgttgggtcttgttgagccaacgtctatttcagaatcatcgtctgattctgaggccatttttgcacagtctgttttgctgttactggtttgggggattcctgagtggatgactcaggttgatgacccagtctgggtaggtgaaccagaggatgatgaggttgttttcttgattactgactctggtagagccaagagaacttcttttcctttactacttgttctacctcctctcccggaggagctggacaccttaggaggcatta

SEQ ID NO: 29164 - DNA, 251 bp, Glycine max
  Peptide Sequence Number=SeqID_145942
atgaacttggttttgagctcgtccggggtgacgatggcaacgcgagcaatgtctcaatcgacggcgagcgtgggaaggcgcgttacgcgcggttgagaccgaccggcatgataagcgaagataattttgaaaaacagtacatgtgcgtgccagatggtaaaaccatcacaaccccgtcgagtcgcgtcttcgggagagcgacgtgcgcaatcccgcataatccaggagtacatgtgttcgatatcgtaatg

SEQ ID NO: 29165 - DNA, 417 bp, Glycine max
  Peptide Sequence Number=SeqID_145943
atggcgcctcgcgttcttcgaaatctggacgaaatctacgcgggcgtgtgtgatggaatgacgtacgacgagattcgaacggcgtatccgcgcgagtacgaacttcgacgacagaacaaactgtcgtatcggtaccctcgcggtgagagctatttagacgtcatagctcgtctcgatccgctcattcaagagctcgagagctaccgcgaagacgtattaatcgtaggccaccagggtgtgctcagactcatctatgcttactttgcgggattaaatcgagacgaagccgccacgttgtccataccgctcaacacagtgatgaaattgacgccgaggacgcacgactgcatcgaggaacgatttttactgcacgatccgaacgaaaacaacgaaccgctggatccgccgagtaactga

SEQ ID NO: 29166 - DNA, 258 bp, Glycine max
  Peptide Sequence Number=SeqID_145944
atggggcaaaaggcaaccaaaaggaagaacaaggggaaaggagtaggaacatctactaatcttgtggacttgaccggtgtggaggaagcaatgaggaaaagaaatgttcttaacgctaaattagtagccttaagggagaaagaattggaaaaagaatattacgacattctaatgaataacatatttacaatgtctgaaactcaacttgaagaccatcaagccttttataaaataattaggcataaactaggaatctag

SEQ ID NO: 29167 - DNA, 260 bp, Glycine max
  Peptide Sequence Number=SeqID_145945
atgaaacataccccccctcacacttattctcaaaacaattccaaagggaacataggctcaaaagggctatcaaaggaattaattcaaggtaggcttatttggctagaggcttataagaacaaaatgcctaaatcatctcccaacatggatatgaagcaagaagtatcaacaagagtcaagccaaggctattgtgcaagcaatcaatggggcaaaacacaccgaataaaatagatgatgatggctcaaattctcaccaagg

SEQ ID NO: 29168 - DNA, 381 bp, Glycine max
  Peptide Sequence Number=SeqID_145946
gcattaggttatgtgcatggagctcaaattgtccacgcatctgaaccaatccatggtcgtttgagtgaagttgagcacaacggctgtcagctttttcatgatataccttctgattctgaatcacttcctgaagagctcattccaatagcatggacctcttccactagcacacttccatttattggatccaaagattttggcaagttcaatactcatgaagttcagccagatcaaagcattttcattgatccttttttagctaaagtaggaagtggaagttcaaaccagtttgattatggaaaaactagaagtgcaagagttcttatgggaatcaagcattctacaagaccacactatggtgtgcaggtgtcaagtgcataa

SEQ ID NO: 29169 - DNA, 1566 bp, Glycine max
  Peptide Sequence Number=SeqID_145947
atgaagcatttagaaatgttcaacatggtaaatactcctcatgcaaccactggttctaaatgtttgaagttgaaatggaggaaatttggtcacttggctggtcaagttggtggagcaaaaagtatattttgtgggttgtttgggcatgaagctgaaaacaccttttggttggatagttcctccacagagaagggaagagcacgcttttcatttatgggaggaaaaggcggatcactatggaagcacttaatgttcagattgtctcatcaaagtgatgggagttcaaaaggaggtggttatttgtcaactgaagattctcaaggttctgctgaaacaatatttttggaagaaggttttcttgattttttgaacaaggagcttcaatcatatcattatggtaaaaatgaatgtgaaggcttgccatttgactttcatggtggatatgtcggttacattgggtatgacctcaaagttgaatgtggtgtcaaatctaaccgtcacaaatctaaaactccagatgcatgttttttctttgctgataatcttgtagctattgaccacaaaaatgatgatgtttatatattggctatacatgaagaaagttcaagtattacacagtggttggatgacacagaggagaaacttctgagcttaaatggctctgtgagagtggctttggaaatacagaactctcatcctttaactttttactcatgtaaggctggtttggccgctgaaaaatctagagagcagtacattgaggatgttaagaagtgtctgaactacattaaagatggagaaagctatgagttatgcctcacaactcagataaggaaacctattgaggaattgaattctcttggactttatctgcatttgagagaaaggaatccggcaccttatgctgcttggcttaatttttcaaaggagaatctgagtatttgctgttcttctcctgagaggttcctgcagctggataggaagaatatactagaagataagcccatcaagggtacgatagctcgtggtgctaccaaagaggaaaatgagctactcaaattaaaattacagttcagcgaaaaggatcaggctgaaaacttgatgattgttgaccttctaaggaatgaccttggccgtgtctgtgatcctggatctgttcatgtgccacgtctcatggatgtggagtcatatgcaactgttcacacaatggtgagtacaattcgtgggaagaagcggtcagatgtcagtgctataaactgtgtcaaagctgcatttcctggtggttctatgacaggtgcacctaagttgagatcaatggaacttcttgattctattgaaagttgttctcgaggtatctactccggctgtattggttttttctcgtataatcaaagatttgatctaaatattgtcataagaacagtcattatacatgagggtgaagcttcaataggagctggaggggcaattgttgctctgtcaaaccccgaagatgagtacgaagagatggtcttgaagttttgcttagagctcatatgccaaagaaatagttttttcctttcatag

SEQ ID NO: 29170 - DNA, 213 bp, Glycine max
  Peptide Sequence Number=SeqID_145948
atgccagaggtagttaaatacatcaaggacaccataggagtatggcacaacgatattgtcaagatcgcatcagatctaataggcaataatgaattcttcatgcagcccgacgtgggaacgctcgaaagcagtggggcctctgggacagggaccagacctgagtcgctaacatttgggaataagagaagtagatatacccaattttttaactag

SEQ ID NO: 29171 - DNA, 567 bp, Glycine max
  Peptide Sequence Number=SeqID_145949
atgacaaacgccctcgccttcagagggctacacgccctctccttccgtggactacacgtcctcaccatcagacggctacacgccctagcctttagaggactacacgtcctcaccttcagagggctacacgtcctcaccttcagagggctacacgccctcacctatagaggactgcacgtcttcaccttcggagggctacacgccctcgcctttagaggactacacttcctccccctgcatgccctcgccttcagaggactacacatcctcacctacagagggctacatgccctcgccttcagaggactacatgtcctcgccttcagagggctacacgccctcgccttcagaggaatacacttccttgtcttaagagggctgcgcgcccttgcctttagaggactacacgtcctcgccgtcagagggttgcacgccctctccttcaaagggcgacacgtcctcaacttcagagggctgcactccctcacctttagagggatacacgtcctcactttcagtgggctccacatccgcaccttaagagaatttaaggtcctctgcccttaa

SEQ ID NO: 29172 - DNA, 912 bp, Glycine max
  Peptide Sequence Number=SeqID_145950
atggccccgggaaagctgaaactcacattcataggcaacgattttaaaagaaaaaacgtatgcaagaaacggaagcagtcactgctgaagaagacagaggaactcagcatgctttgtggcgttgaagcatgtgctatagtgtatggccccaatgatcctcggccagtgatttggccatccgaattgggtgtcgaaaatgtgctgcgaaagttcatgagcatgccacaattggagcaaagcaaaaagatggtgaaccaagagagtttcattgcacaaagaatcatgaagagtaaagaaaagttgcagaaaattgtgaaggaaaacaaggagattgaaatgtccttgttcatggctcattgctttaagacaggaatgtttcagcctgatatcaatatgaccacagctgatatgaatgttctttcatcgataattgaacagaacctgaaagacattgataaaaggatggaaatgctgaaagccaaccaggtgataccaaaccagcccgatgttgaaacatcaacattgcaaccccagataatgcatacactgacataccaacctcctatgcaaacatttgcattccaaccgcagattcaaatatcagaattccaaacccagatccaaacaccagaattcccaacacaaacataccaatccaagatgcaaacacaaacatttcaaccccagatgcagtcaccagcattattccaaccccggatgcaatcacctgcatttttccaaccccagataatgcaaacaccatcataccaaccccacacacaaacaccagcacttgaagatatgacactgcttaattatggcaatgggttgggtatgcaaatgcagcagttcaatggtaatgggtatgagacaacaatgcctgcatttggtggtgctaacttccctctctaa

SEQ ID NO: 29173 - DNA, 240 bp, Glycine max
  Peptide Sequence Number=SeqID_145951
atgaaaaaaggtctcaacattgtttcaattggagtgatcatggaggtcgatgaggctatctttcttggttattcattgcatagtaaggcatatagggtgtcgcaacctacccttcggcaggagggcaacgcgaggctcacgggtgcgtcttccaagggaggaaggtgcacagagtctccaccaacgtttattcgagtaaaacgtcagaaaaaccggaaaggcgtggtctacgaactttaa

SEQ ID NO: 29174 - DNA, 420 bp, Glycine max
  Peptide Sequence Number=SeqID_145952
atgacagagataccatcaatagggcatacatatgaagtgggaacatcaggaaaacctttgattcatcatcctagcatgaggactatcacccaaatctgggccaatttcttgttggctaatgttatcctcaagacccatgagtcagatatcaacatggataaggcccatttgatttggtgtataattcagggtctccaggtggacgttgttgccattatatcatataagatgcagaggatcatcacccatcatcagcaactggtagcgcctctagacctttgggatatttggcactcatcactagactgtgcaaatttcatggggaaggaagctgctggtgttgatgatgctgacgaaggagaagacaaagaagaagaggaagaggtttttgataatgtgtttcatcaaggagataactga

SEQ ID NO: 29175 - DNA, 246 bp, Glycine max
  Peptide Sequence Number=SeqID_145953
atgtcattcaagggagttgggcataaaagtcttgacactttgatggaaattcctaaagaagaggaaactctggaagaattgagggaaggtagcaaggtggaggaacccaagcttttatcaaagatgttatatcaacatttgaaatatgtgtttcttgaagaaaatggtgacaagccaatcatcataagcagcttcttaaccattttcaaagagaagaaattggttgaagtgctgagagctaactag

SEQ ID NO: 29176 - DNA, 951 bp, Glycine max
  Peptide Sequence Number=SeqID_145954
atgggacaccgttgctgcagcaaacagaagatcaaaagagggttatggtctcctgaagaagatgagaaacttctcagatatatcaacacacatgggcagaaaagcttgcaaagatgtgggaagagttgcaggttgagatggattaattatctgaggccagatctgaagaggggttccttcactgctgaagaagagcagatcattattgacattcatagaattcttggaaacagatgggcacaaatagccaagcacctaccaggaagaacagacaatgaggtcaagaatttctggaactcctgcataaaaaagaagctcatttcacaagggttagatccacaaacccacactctcctttcttctcataggagaagctcagtatgtaccatctccaacatccatcaaaattccaattccattttcattatgagttcgcacataccaaatgcacccttggaaaatactagtaaaaccttttctactttacctaaacctccagcaaacattgttcaaatcccctctgtcgatgtttcctcagaatttcaaacaacaacttcaaataatggagaaccccgccaacatttgacttatgaactattaatggagaacgccatcaccaacatttgttcacctacatacatgaacccctcggcagttgaattgtttaacaatgacaacaatgtgaattgggtttctacagttaatgttgaagacttcagtgctcaaacattggaagagggaacgcaagtgcaagtgcaggtgcagcatgagaaggacaagacttgtgaggatatgggaattgatgtgagagaagctaacaatggcaatattgaaactagtgcttcttttgagagttctaactttgattttgggttgttggagagtgtacttacctctgaattcatctcttatgatttcaattgtatggatgaacttgcatggaacttttag

SEQ ID NO: 29177 - DNA, 126 bp, Glycine max
  Peptide Sequence Number=SeqID_145955
atgagtattcgccttgccttctctacaattaaacatttctcttctgccgctaaagagatgactgttaaggagactctcaactccgcactcgatgatgaaatgttagttgatcctaagttcgagtga

SEQ ID NO: 29178 - DNA, 186 bp, Glycine max
  Peptide Sequence Number=SeqID_145956
atgtctgcttacagtcctttcgctaagcacgagccttgcgctaaactcatctttggtcatgcgctaagtcgcgagtctcaagcgcttagcgcccaacccttgcatctgaggctgattcattcagctaagctagccaaggccaagctgagcctaatcgaattcgatctgaatttggctaagcaatag

SEQ ID NO: 29179 - DNA, 507 bp, Glycine max
  Peptide Sequence Number=SeqID_145957
atggaaagaataaatatcgttattgatgatgacaatgcttatttcgtggcgggattacgtttcagcattacggaatatgcggaaaaaaatcataagacggctgatatggtgatagcagcatcgatgtggcgcgcacaacgatggcgtaaaatgaatccttgcgaagctgtatcggctatcatgaccattaaagaaaaaagagtagggcgcgttaatgagagtgagagtgtcctttatcgaaccgataaccggagcagactatttgagttgttggcgaaaagcttggttaaaaactctgctgaaaaacagcttctcggttatgttctgacgagtagggaaaaacaggtgatcggttttctaaaaagaggttttgatcaatcacaaacagccaaactcctagggataaacgtaaaaacggtacatagccataaacggtcggtgatgaaaaaactgatgctgaatcgccaacgagaatttatgtattggttaatatcgcaagatgactaa

SEQ ID NO: 29180 - DNA, 683 bp, Glycine max
  Peptide Sequence Number=SeqID_145958
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggttgcgcaactgttgggaagggcgatcggtgcgggcctcttcgttattacgccagctggcgaaagggggatgtgctgcaaggcgattaagttgggtaacgccagggttttcccagtcacgacgttgaattcgatctgcaaggattgtcatcgtgtaaagatcagttatactaaaactgtctctagggtgttcgccagtacgtctagtcccctgccgatacttaaatttatggatgtgtcctatcaagcttatctataccgtccacctctagggggggcccggaaacctgtcgtgccaactgctttaatgaatcggccaacgcgcggggagaggcggtttgcgtattgggcgctaacggagtgtatactgacttactatgttggctctgatgagggtgtcactgaaatgcttcatgtggcaggagaaaaaaggctgcaccg

SEQ ID NO: 29181 - DNA, 132 bp, Glycine max
  Peptide Sequence Number=SeqID_145959
atgcggaaattgattaaggaaaggatggaaaataaggtggttaatttcgtgggtcttaataaggttaagtggtggctggacagaaatatagaaatggcaataacggaagctacagggctccaaatgaggtga

SEQ ID NO: 29182 - DNA, 507 bp, Glycine max
  Peptide Sequence Number=SeqID_145960
atgtctctgtttgcacccctgttgttgaaccagagcgaccccttcgaccatttccgagccttactcggtggaaattcagaatcattggatctcggagcatacacccaaatggattggaaggaaacccttgacgcccatgtgttcgaaatcgatcttcccgggttcgccaaagaggatgtgaagcttggagtgaaagaaaacagagtgctctgcatcaaagcagagaaaaaagcagaacaagaagaacaagaagagaagacaaagctgaaatggcattgcagggagagaaggagcagtggcgtggtctctagggagtttaggttgcctgagaattccaaggttgatggtgtcagagcttcaatgtgtgatggggtgttgacagtaacagtgcctaaggatgagagtgagaccctgaagaagcacaagaaggaggtgcagatttttgaagaggatggtgaaggggttgctccaaaaggaattggtcgttttgtttgctgcaaatcttag

SEQ ID NO: 29183 - DNA, 635 bp, Glycine max
  Peptide Sequence Number=SeqID_145961
atggctgggaattcttttcctggaggtcgcaatagttcagttgtcaataatgaaatattgcaacagccatttgcttgctttcctccaatggcaggttgcaactctcaggaaccttgtggttttaaccctctaaggcagttggaatatgggcaaaatgatatgtatctaagttctcgaggccctcaacctaatctgcaacttcagccggctaactcaccatttgctccaagacacatgcatcctgcccagcctctaaatccatccaatcaatattcatatccaaatcctacaattcagcaacatcttccacattctttgcatcctttcttctcattgccatcacttccagatggccagaggcaatttgttgccaacgagcaatggaggatgtcatcaagtgagggtctatggataggtcgaaatccttcatgccctactcctgcctttgggcaggaaggaaacaccattaatggggagaagaaacttacctcgacggtggagcaacaccttcaatggaggtcctcaatgccacccaaaggaggagaagaagaagaagaatgcaacgacgtggaggagacggtggcgcgacgaacaaaacgagcaacgaagaagaagaagaagaagcgtaacaatgg

SEQ ID NO: 29184 - DNA, 762 bp, Glycine max
  Peptide Sequence Number=SeqID_145962
atggcgatgactgatgcaatgattgaggtggcactaatatctgggagaaaagtggaggctgagaaggttcagatgattgaggaatcaatgaaggtggaaggcctgggggttgcaacactgagggtggtgggggaggtgataaaggataatgaaagaggtggtggaggtggaggcaaagatggcagaggcgggggagaagggggtgaatcaagtggcaatggaggagaaccctcaagaatatcagtaaaacaaaccccagagaacctaaagtctgtagtgtgtgattctcatccagttcctaaaagcccagacagaaacattccatatcaatatattctggaacatggtgatttctacaattcacttgtgatttctttgataaggattaaaaagttggaggaagcagagaagctcttcaaggaaatgcttgctggtgatgtaagactggatactttggcatctagcctcttgctaaaggagctttgtatgaaggaccaaatattggatggattctacttgcttgaagcaattgagaataagggattcttgtcttccattgactctgatatttattctattcttttaattgggctttgtcaaagaagccacctcaaggaggccacaaagctggccaagataatgcttaagaaatcagttctgctacgacctccacacaaagatgctgcaattgatatcttaataaagtttggagaaaaagatcttgtgaaccagttgaccggcatacataagaaggagctttga

SEQ ID NO: 29185 - DNA, 300 bp, Glycine max
  Peptide Sequence Number=SeqID_145963
atggagtttgcatcacttgaaggcacaacgaatcactacacaagtacttggttagaagcaattttaggggcgtatcctaaaactgttatcacagaccaagatactgctttcactaatacatgtgctaaatgtattcctaaagaaaaaggtttttctctccctgcacaatatattctaagtcgatggaccattaatgctaagaaggaaaaggctaaaggattggcaagtgaagatttccatgaagacaacaatgaagcttctggtatacaagagctaatgagaaggcttgatctattgtaa

SEQ ID NO: 29186 - DNA, 1275 bp, Glycine max
  Peptide Sequence Number=SeqID_145964
atggttaagcctaagctcgactctcaatctatcatccaagtcctcaacacctgcccacctcaattgggtgtcaggtttttcgtctgggcaggatttcagtctggctacaggcacagttcttacatgtacaccaaagcttcgaacttgcttcggattcatcacaatccccagattattcgtgacgttatcgagtcttatgaggctgaagggtctttagtcactgtcaacatgtttagggaggtgctcaagctctgtaaagaagctcggcttgctgatatggctctgtgggtgttgaggaagatggaggacactttcaacctccacgctgacactgtcatgtataatctggttatcaggttgtgttgcaagaagggtgacattgaaacggctctgaagttgaccagtgagatgagttccaatgacctttgtcctgatcttattacgtatatggcaatagttgagggattctctaacgctggtcgatctgaggaggcctactctgtgcttaaggttatgagactacatggatgttcccccaatttagtgattttatcggccattttagatggcttctgtaggtctgggtctatggaaagagcattggaattgttggatgaaatggagaaaggtggagtttgtactccaaatgttgttacttatacatctgtcattcaaagtttctgtaagagaggccagtggaaggaagcattggatattttggataggatgaaagcttttgggtgccacgcaaatcatgttactgtttttactttggttgaaagcctttgtgctggcggtcatgtggaacaagcttatggattatttgataaatttgtggtggaacatggtgtttcctatggtgatttctacagttcacttgtgatttctttgatgaggattaaaaagctggaggaagcagtgaagctcttcaaggaaatgcttgctggtgatgcaagactggatactttggcatctagcctcttgctaaaggagctttgtatgaaggaccggatattggatggattctacttgcttgaagcaattgagaataagggatgcttgtcttccattgactctgatatttattctattcttttaattgggctttgtcaaagaagccacctcaaggaggccacaaagctggccaagataatgcttaagaaatcagttctgctacgacctccacacaaatatgctgcaattgatatcttaataaagtctggggaaaaagatcttgtgaaccagttgactggcatacataagaaggagctttga

SEQ ID NO: 29187 - DNA, 540 bp, Glycine max
  Peptide Sequence Number=SeqID_145965
atggatttgcctgtatctctgtctgcctcttcctcttctctgttatctgcccaaattttcaagtctcagatacacttttcaggcattacgggagcctcatacatccctatagctcaaggagggttgtcacatcttcttggtgctgctgctccccctagggatagtgctcgtgaaaattgttgccaatgtctcaaggttttaaggttatgggttgagaggaaaatttttcctgaatcagttcttcgtcgttacatggatgatattgaagtttcaaatgatgatatgacagttagtttttctctcaagcatccttcccgagcagaagggtctttggatgacccaataagagaaatggagggcatgcttgttgatttgtatggaagctgcctagctttttatcttctcatctgtttgaagaagatgaagacaatgattttccgagtaactcatctccagctgatgtcagtcgcactgttgtggattcagaaacttctacagttaccccgagtgacaagcgccattgtatcttggaggatgtga

SEQ ID NO: 29188 - DNA, 615 bp, Glycine max
  Peptide Sequence Number=SeqID_145966
atggagtcctccctacagggcaaccaaatagttcaaatggctaggaattcttttcctggaggtcacaatagttcagttgtcaagaatgaaatattgcaacagccatctgcttgctttcctccaatgacaggttgcaactctcaagaaccttgtggttttaaccctccaaggcagttggaatatgggcaaaatgatatgtatctaaattctcgaggcccccaacctaatctgcaacttcagtcggctaacccaccattttctccaagacacatgcatcctaccctgcctcaaaatccatccaatcaatattcatatccaaatcctacaattcagcagcatcttccacattctttgcatcctttcttctcattgccatcacttccagatggccagaggcaatttgttgccaacgagcaatggaggatgtcatcaagtgagggtctatggataggtcgaaatccttcatgccccactcctccctttgggcaggaaggttttcagcatgcaaaccctagcaacatgcctgctcatcctatgtcaggatatggtgttcctcagatgtcatgtagaccaaatattcctgcacttaattgttggagacctacgcgatgctga

SEQ ID NO: 29189 - DNA, 1203 bp, Glycine max
  Peptide Sequence Number=SeqID_145967
atgtgcggctctaagaccaaagtgacgattggcttagaagtcatcgctgctgctgctactacaacaactgctaagccttcagtggctagaatcaatggaaggccagtcctccaaccaacttgtaaccgtgttccaaaccttgagaggaggaattcaatcaagaaagtggcaccagcaaagtcactttctccaccatcaccaccacttcctagcaagacctcattgacacccccagtttctccaaagtcaaagtcccctaggcttcctgccacaaagagaggcaatgacaacaatggacttaactcaagttatgaaaagattgtgatccccagaagctccataaaaactccaactttggagagaaagaagtccaagagcttcaaggaaggttcctgtgtgtctgcttctattgaggcttcattgagttactcatcttctttgatcactgactccccagggagcatagctgctgtgaggagggagcagatggcactgcaacaagcacaaaggaaaatgaagattgcccattatggacgatcaaaatctgcaaagtttgaaagagttgttcctcttgatccttcaaataccagtcttgcatcaaagccaactgaagaggagaagagatgcagctttatcacagccaattcagatcccatctatattgcttatcatgatgaggaatggggagttccagttcatgatgacaagatgctgtttgaacttttagttttgagcggtgctcaagttggatctgattggacctcaaccttgaagaaacgcctagatttcagggctgcattttcagaatttgatgcagaaaccgtggccaacttgactgataagcaaatgatgtctattagttctgaatatggcattgacataagcagagtccgaggagttgttgataatgctaaccaaattttagagattaagaaagactttggctcatttgacaagtacatttgggggtttgtgaatcataaaccactctccactcaatacaagtttggccacaagattccagtgaagacatcaaaatcagagagcataagcaaagacatggtgaggaggggctttaggtacgttggtccaacagtggttcattcattcatgcaagcatctggcctcaccaatgaccacttaatcacatgccacaggcacttgcagtgcaccctattggcagctcgatcctttgtaccatag

SEQ ID NO: 29190 - DNA, 567 bp, Glycine max
  Peptide Sequence Number=SeqID_145968
atgaatgcttcagcattatgttctctgatgctcaccctttgcttgatcctaatttcttattctcttttgctagcaaatgctaaagccaatggtgatcattgcctacttggaaatagtcagcagatgattgaccaaatttgcaaccaaacctcacagaatgaaaacgagtgccttaagattttaaaagcagatcctaaaatcgtgcaagcaaaagactattttgaaatttcaaaggcgatcctaaagttggccacgaagaaggcaaaagaaggacagcacttcctcaaagggttggcacataaaaccggttctgcagccattgctttgtgtgcaaaccaatggtatccttacacggttggatcgttcgggagtgccctaggtgagttgaaagaaagtcctgatactgctaattatgatgcaaaagttgctggtgatggacctgtatactgtgatgaagccattgccaaagcacatattgttaaccctgccatttctgctcttaaccacaaaacttcgttgcttagctttattgcattcctagccacaaattgtctttcagaagagtaa

SEQ ID NO: 29191 - DNA, 873 bp, Glycine max
  Peptide Sequence Number=SeqID_145969
atggctgcttcaagggatcagtcatttaaattcatatgtggagggaggttggtattcgggcccgatgctaggtccctgtttgtcaccttgttgctgattattgttccagttataatcttttgcatatgtgtagcaaggcatcttcggcatgaactttcttcatataattctggatatgctattttagctgtggctattctctttactgttcatgtcctggtggttctctttcttacttcatcaggtgatccgggcattgttccaaggaatccacatcccccagaagaagagtttcgttatgattcttcagtttctgttgatgctgggggagctggacgacaaacgccaagtcttcagttccctcgaacaaaagaagttgtagtcaatggcattgctgtaaaggtgaaatattgtgagacttgtatgttgtatcgtcctcctcgttgctcgcattgctccatttgcaacaactgtgttgagcgttttgatcaccattgcccttgggtgggccaatgcattggtctgaggaactaccgttacttctttatgtttatttcttcagcaactattctgtgcatctatgtgttttccctctcagctttttacatcaaggttctgatggataattatgatggcacagtttggaaggcaatgaaagaatcccctgcatctgtgatactaatggcttattgtttcatctctttgtggtttgttggtggactgactggttttcatttataccttataggcttaaatcagtgtacctttagactgtcaataaaaaaagttaaatgggatgatcttcgtggtattaattccacgctgctttatctaaaactacaagtgaatgagctaaaaagtaatataagataa

SEQ ID NO: 29192 - DNA, 228 bp, Glycine max
  Peptide Sequence Number=SeqID_145970
atgtaccggattaaaagccaaaaagatgcgaaagatagaaaaaatatgaaaaaggaagattttggcattaggtttaacgagaactatccgcttatcgcacagtctgctcatcgagaagcacaggctaagtgtgtcagcccaagacgcgctcaatgcgtaacacgaaaacacgcattggtgctaagcgagaagagtcgcgctaagcacaaatacagacatccgtactaa

SEQ ID NO: 29193 - DNA, 102 bp, Glycine max
  Peptide Sequence Number=SeqID_145971
atggcgttgcagcacctgcacaggcagaaaggtggacactttagcatgctcttcagtggacatcagatcttggttgccaaaatggatggatctagaaattga

SEQ ID NO: 29194 - DNA, 1248 bp, Glycine max
  Peptide Sequence Number=SeqID_145972
atggtgagattgtggaacaagcttaagagactgcagcacgatatgagaaggtttaacaaacccctgagtaatctaaagcagaatctgatcaaagccagagaagatcttcaatttgctcaggaaaaccttagaaacaataacatgaatggagatagtattgatagagtgaggcagctgacagaagaggttattaatcttaatgaattggaggaaaagatgcttatgcagagagcaaaagtggattggataaggaaaggtgatgggaataactcctttttccatgctattataaaaagcagaaataatagaagaaatatatacatgctgcagaaaactgatggaaccttgcttgaaaaccagtctgagatagaggatgagatcatggatttctacaagaaactcatggggactgaggatagccagctgcaccatattgacatagatgctatgagaaatggcaaacaagttaatatggagcaaagaagatatcttgtgagcaatatcactgagcaggatattgagagagcccttaaagggataggtgatgataaaagcccagggattgatggttttggggctaagtttttaaaggccagctggtgcatagtaaaagaggatgttatagcagctattttggaatttttcaacacaggaagattgtatagaggctttaataatacagtggtaactttaatccctaaaggtgataatgctaggtatgtgaaagattatcgtcccatagctggctgcacaacggtgtataaaatcattgccaaaatcataactgagagattagggaaaattctgcctagcatcattagtcatagccaggctgcctttgtgcctgggcagaatattcacaaccatatccttttagcttatgagctcctcaatgggtatggcaggaaaggtggaacccctcgtgtgatgatgcagttagatttacataaggcatatgacatggttaattggagggccatggaatgtattcttaaggaaataggtttacctatgcagtttgtgagttggatcatgactagtgtctccacagtctcctataggtttaatgttaatggaatctattctgacattatgcaagccaagagagggattagacaaggggaccccatgtcccctatgctttttgtgataatcatggaatatatgcatagaactttggggaagatgcagcaaaatcctgacttcaatcatcactcgaaatgggggatagtaaatttgtatctatga

SEQ ID NO: 29195 - DNA, 522 bp, Glycine max
  Peptide Sequence Number=SeqID_145973
atgcatgaagaagctcaaaggcttgctgttttaaacaaaaagctgaaaagcaaactaaaattgcatatcactaaattggcttcaacacaaggtgaggtgaataaattgaaacaagaaaatgaaaaagttgtttcaagttgtaaagccactggttgtgattatacctctacttctttttacatggatgatcacaagtctttgcaaaccaagtttgaaaatttcaaaatggatcactatgctaaacgtatgaagttgcaaactgagctttcttatcataaagatatgtttgaaaaattaaacaaaggaaagagtaatcttaatcacatgctcactgtgcaaaaacatactacagataagaccagcttggcatataacatgcaaaccaccttttcaaagaaaactaagtttgtatcctcaaaaggggtgtgtctaaaagctaaggactcactatggtacttggatagtggttattctaggcacatggcgagtgataagtccaaactctcagactttgtgtcgtaa

SEQ ID NO: 29196 - DNA, 171 bp, Glycine max
  Peptide Sequence Number=SeqID_145974
atggagagagaaaaaagaatcgcacgaagacagtacatatggagtcttcaatgtcttctccgtctctctaacgtttgggaactctatcggagcagtcggaggaaaaactggaggaatctcaggaaaccgctagagatgtcgctatcgctgtcagaagacacggatccttag

SEQ ID NO: 29197 - DNA, 192 bp, Glycine max
  Peptide Sequence Number=SeqID_145975
atgttcggtcgctataaccttgatattgcgactgaaatctattcggttgctgtcttcaactacatatcggtcgctacttcgatggctaaagtacttttgtttttttacatgtacagcaatcgaaatagccaccgaagccttcagcgaccttcaaattcggtcgctaattcagtcgctgacacacggaaatag

SEQ ID NO: 29198 - DNA, 348 bp, Glycine max
  Peptide Sequence Number=SeqID_145976
atgtggtcgcgcatgacccgcaacggcgcgctggccggcatgctggtcggcgcggtgacggttatcgtctggaaacagtacgaatggctgggtctgtatgaaatcatcccgggctttattctgggctgcctcgctatcgtggtagtgagcctgatgggccgccggccatccgccaccatgaccgagcgtttcgatcaggcggaagccgaggctggaggccgcgctgatcgtcagcctgatcgccagctacctgaaacgcacgcagcgcagccaatggctgggcgcggtgtgggtcggcgtgattgtcgccgcggcgctgtgtctggcgctcggcatcttcatcaatga

SEQ ID NO: 29199 - DNA, 897 bp, Glycine max
  Peptide Sequence Number=SeqID_145977
atggcaggttcaatttctttgttggagttctctttggtcatttttatccaaatcatgacacactgccatagcagcatcaccacatgcttgcctgagaaacatgctgcactattcatattaggagattcgctatttgataacggaaacaacaattacatcaacaccaccacctcttaccaggcaaactatcctccctatggagaaactttcttcaaatacccttctggcaggttttctgatggacgcatgataccagatgccgttgctgagcttgctaagttgcctatacttccaccgtatctgcatccgggtcacgttgaatatgtctatggtgtcaattttgcttcaggaggggccggtgctctgcgcgaaacatcccagggaatggtgatagacctcaaaactcaggaaatttataatattggtggaaagaaatttggatttcttaatgtgcctccgataggttgttcccctgccataagaattttggtcaataatggaagcacatgctttgaagaattttcagccatagcaagattacacaacaatgcactctcaaaaaggcttcacgagctagagaaacagctcaagggattcaaatattcagtcatggatttttatagtgcattttctcaagtgttcaacaatcctacaaaatatggcttcaaagtagcgagcgttggatgttgtggaagtggaccatatagaggagtggatagttgtggagggaacaaagggataaaagaatatgaattatgtgacaatgtcaatgaacatttgttcttcgactctcatcatcttactgatagagctagtgaatatttcgccgagttgatatggaatgcaaatcgcactgtcacaagtccttacaatctgaagcaactatttgaactttga

SEQ ID NO: 29200 - DNA, 696 bp, Glycine max
  Peptide Sequence Number=SeqID_145978
atggtgaatgaggccaaattgtttatatcctcttattttgatatgaaagatataggaaaagctgatgttattcttggtgttaaaataagaaaagattataatggtttctccttatgtcagacacattatatagaaaagatactgaaaaaatttaattgctatgctgaatttcctgtgaaaactccctatgatcctagcatacatcttaagaaaaacaaaggctctagtgtttcacaagctgaatatgctaaaatcataggtagtgtaatgttcctcatgaattgtactagacctgacatagcatatgttgtgagtaggctaagtagatatgctcgcaaccttggtagtaaacgttggattgcacttcgtcgtttacttaagtaccttaagggtactatggattggtgtttacatttttgtaaatttcctgttgtgttagaaggattttatgatgcaaactgggttacggataatgatgaggcaactattggaattgccatgaacaatgtgtataatggaaagagaagacatatacgcattagacatggtttaatcagagaattgttgaaaaatggtgtgatctctttagagtttgtaagatctgagaggaacttgtcggatcctcttactaaaggtctaacaagaaaattagtccttgaattgttaaggaagatggggcttaagcctttgtgttaa

SEQ ID NO: 29201 - DNA, 483 bp, Glycine max
  Peptide Sequence Number=SeqID_145979
atggcaccaatgagtctcccacctgggtttaggtttcaccccactgatgaagagcttgttgcttactacctggagaggaaaataacaggtcgctcaatagagctagacatcatcgctgaagttgatttatacaagtgtgaaccatgggatttgccagataaatcattcctcccaagcaaggacatggagtggtacttttacagtcctagggacaggaagtacccaaatgggtcaagaactaaccgtgcaacacaagctggatactggaaagctacagggaaagataggccagtgcactctcaaaagaaacaagttggcatgaagaagacattggtgtactacagaggtagagcaccacatgggattagaaccaactgggttatgcatgaataccgtttaattgaatcagttcctggtgctactctctcatctttgaagggtatatatatgaggtacaaaaacttgtacaagagtcctatttga

SEQ ID NO: 29202 - DNA, 1326 bp, Glycine max
  Peptide Sequence Number=SeqID_145980
atgttgatgaatgttctaagaatgatttcggatatgttgaaattggaacctctagatgtcacaaattataggaggtggtcacaaaaattgttgattttgtttgaagccttagaggttgattatgtgttatctgaagatcctctggctgaccctgtttctcttgctaacccttctcctgctactcctgttgtcacaccgctctttgaaggaaccaagaaacttgatgaagaggctaagaagaaatatgaaaaggacaataaaactattagggtgatgatgatgctggaaaaagaaaatatgtggttcaaagggaaaggaaaagagaaaaaatttcaaaaaaatggacaacagaaaaatcatattggtatcaatagaggtgataacaagattcagaaaaagaaacttatctgctatgtttacagcaaaacatgtcacaaagcatatccgtgctacatgagacagggacaacaaaatcagaaccagaagcctgctgcaccgtttgcacctcaagcacatctaacaggaaatgaagaagtgatagttgttgtggtagtggaggcaaacttagtggataacaaggtggactggattttggataccggtgcttctaaacacctatgttccaacaaagagctttttcaccactttgaggatgttgttgatggagagtgtgtcttcatgggaaattctgctacaaccagagtacttggtaaaggaaaaattcttctcaaacatacttttggaaaaactttatccttgagtgatgttttatatgttccttccctatgtaggaacctaatttttggtagtttacttaatagagctggcttgaaattagtttttgaagttgataaggtagttataactaagtatgggaactttgtggagaaaggatatttggttgatggattgtttgtattgaacagcatttatgttgcttctaatgctaattcttcgactggttgtgcttatattattgaatctgttgatttgtggcataattggctaaggcatgtgaatgtggcttctattaagaaacttaaaaatatgaatttgattaatgtaccatatgtaaataaactttctaagtgtcctatatgtgtggaagcaaaatatgcaaagaagccttttaaacctatcacaaatagaactactgaactacttggattaattcacaccaatttggcagattttaaaaacactgttagtagaggaggtaaaggggattatgtgacatttatagatgatttttctagatatgccaaagtttaccttctaaggtcaaaaaacgaggtcgaagaaatgtttttaaaatataaggcataa

SEQ ID NO: 29203 - DNA, 1038 bp, Glycine max
  Peptide Sequence Number=SeqID_145981
atgttttgtattgtcgcagcaagtttccaaccagtagagggcggcgtgtggacttcacaagccaagcagagggttttggacaagcggcacgtggaggtgcttttggatgtgcgatttgcaggatattttgctggtggccgtggtgtatggcggccggagagggaatgggctgaggccaagcaagagttaaatgaagagcgggaaaatgtgcggagattcacatcagatcgggaccaaacactaaaaaattctttgagacaggttgaggatatgagcaaagagttagctaatgcattgcgtgcagttgcatctgctgaatcaagggctgctgttgctgagtcttcacaaatggtaaagattaacttcaagctctatacacaggcaaaactctctggtcttcaaagaaagatgggttccacagatgacaagcttggcaagctacacattgcagtaaaaagggcaaccttgtggacgagactctcccctgagcttgttgaaataggtggagtgagtggatcttccactttgtcaagtgatgaggttgttgctgaattgcaaaaggcaaaagacgagattgaaaagtggaaagaggaagcgcatgccaacaaagctcacatgctgcagtataagagcattgctgaggtgaatgaagatgcattgaaagagatagaaaaggcgcatgagaagtttaaaacagaggctgacaatggaaagaaagttttggaatctgaacttaactcacttagagagaagatgttagagattgaaaatgaatcttctttgaaatatgaagaagttgcttctgaaactgttggaaaggaagaggctcttacatctgctatggctgaaatcacaaatcttaaagaagaaattttaaccaaatcttctcaaatttcagcaatggaaattcagatctcaggtttaaaagaaaacctggacagggagcatcagaaatggcgggcaactcaaaccaattatgaaagacagttaataatggccgcattggcggtggggcggtgcaatgaaggtggtacataa

SEQ ID NO: 29204 - DNA, 219 bp, Glycine max
  Peptide Sequence Number=SeqID_145982
atggttagcaataaaagagtcctcatactattgaagaatttttatgcttcaagagttcatcaacaggatgaagaaactcatgacactcatgttgttagctctaatgctaaaagtgtcaacaaggacaagaatgctttagattcaaaacttcccatcttgacaccagaagcaagagaagcaactgaaaagaatgatgcaaagaacaaggacaaagtttaa

SEQ ID NO: 29205 - DNA, 843 bp, Glycine max
  Peptide Sequence Number=SeqID_145983
atgatcaaaactattcacaaacttcacaattccccttctcattctcaatctcagagacatccttctacctatgcttatggaggctttctccgtacagtcaccattccctccaatttgtcacgtagagaagccactgagaaaccttctgtctcacatgttaacctttcccatttcaccaggtaccccggcacctcaagagccacaaagcacaaaatcccagccacaatgaatgctgcgtgttcagcaaaaactatcacggctactgctgaggggatttctgagaaaacagattccaaggatgacaacttagtatttgttgcctgtgctaccggtagagttggttcacggtcagtgagggagcttataaagcttggatttagagtcagagctggagtgcaaaatgctcagagggctggtgcattagttcagagtgttgaacaattgaagcttgatggtgcaagtggaggaggggcaagcccagctgtagagaagcttgaaattctgaaatgtgatttggagaaaccagatacaattggatatgcatcaaaagtgatatgtagcattgttgccagtgagaaggggggttttcacatcactgcaccctttcaatttccaaaagattatcaggtcaccaaaaatctaattgaggctgtcattaatttacattgtcctaatgttgaaaacacaaaaatacaaaatgtctgttctttctaccttgcagcaactgttgccaaatttgttttggggattcctgatttggaaaaggaaggaagaagaagcattgctggccagtggacttccatacgcaatagtgagaactggatgtatggagcagcctactga

SEQ ID NO: 29206 - DNA, 339 bp, Glycine max
  Peptide Sequence Number=SeqID_145984
atgtctagtcctgcaaatttcacgcttgaaatgtctagtacaagacatgacaggtgtgtgatgcagatcccacatctaggagtaaaaaatgaactaaagactaagtgggaagatgagaaggcacaactagaaaagtctaggaatgatgctgagaagaaatacaatgaaatcaatgaacagaataaaatactacatagccaacttgaggcttttcatattcaatgggccgagaaggagcgtaatgctgctggtatttcatctggaagtagtagtgcagatgcctttggtgatgctggtcttcaaaacgtgattaattatctcagacgttccaaagaaatt

SEQ ID NO: 29207 - DNA, 444 bp, Glycine max
  Peptide Sequence Number=SeqID_145985
atgcttgagactgctttgaaggcagcagagtctgcacatgcatcactagaaactgagcgtgcaaaatcaagatcatttttgtttaccgaagaagagttcaaagcattgcagcttcaggtcagagaaatgaacttacttcgtgagagtaacatgcagctcagggaagaaaataaacacaattttgaggaatgtcagaaattgcgtgaactggcacaaaaggttagagctgagacagagaacctagagaatctcctgaaggaaagagaaattaagcttgatggccatacgaaagaaattgaaaccctaaaaatggaaaaagatcatctcaataagaaggttactgagctgcttgaaaggagtaaaaatgttgatgttgaggattatgatcgagtgaagaaacttgctaaagagatccaggcttctgtcaaccttgaagttgtctag

SEQ ID NO: 29208 - DNA, 672 bp, Glycine max
  Peptide Sequence Number=SeqID_145986
atggacgagctgagacgccgggcaattgggtttatccaaatgaaagaattgtttgagtatcgcaacaaggacaagatagaagagttagttcaaaagggttgtttaaatgacttcatccgagggaacaattttaatcatggcgaatatcatggaggcagaggtggttgcttaggtggttacaggggtggctacatcaaaggacatggcaattacaaccaacaacaggttgaggagagtgagcaacaacaacaagaaacctttatggggcagttcgaggagtcatcaacaccatcaatcaactcaatgcaaattaagaagacatcaccccgatcactaccagccatcatgttcactaatgtcgacttcgtcagaaatgatcctacacaggatgaccttatggtggttagatgtccttcacaatcttattcaacctcactagaaaccgatgataggttttgtaggagaacatgtgcacacgggaagctctcccaatcattggtggtcccatacgtgttggttgacatggacacctcctacaaccttatgcttgggaaacccatgttgaatagcattggagccattgtgtcaacaccgcaccttaccaagaaattctcgtcgacatcaagagatattgtcatgattaaagccgatcattgggatgcacgagaatga

SEQ ID NO: 29209 - DNA, 1983 bp, Glycine max
  Peptide Sequence Number=SeqID_145987
gctaacctaaaacttgattcagagaagcataggaaactgctggctcagtttaagaagaggattgatgttttgtcaagggaaaaagaagacctaggaaaagagaaccagcaactttctaggcaattagatgaaattaaacaagggaaaaggtcaacaagtgatacaactggtgaacaagcgatgaaggaggaaaaggacacaagaatacagattctggagaaacatctggagagactgagagatgaattaaagaaggagaaggaagagagtcgtttagagaaaagtagacgactgaagactgaaaaggccataaaggactcttacaacaatgttgaacaggagaaaataaaatcgattaatgaaattgagaggtacaaggagtctctgaaaaggttatctgatgaagttgaaaagcttaagattgttattggaaatcttcctgagggttcaaatgtggttcaacttctttctggatccaatgttgatgactttgctgctccttacatatctgctgtggaaagttttgaaaaggaagctcagtcagtatttcgtgagcttggaggtcgcggtaatcttggagatgcagcaacagttacggatggttcagcagctgctacaggttctcttgtccatcctcaaccccaaggcattacattttcagcggcccctggagctagtggtttaccacctaaagccagtggagaaagtgagaaaagacttgcattacccaaagctagtgttgaaactcgtcgagcaggtaggagattggtcaggcctaaactactaagacctgaggagctacaaggtggtgacacggaaatgtctgatgccgaaggaccagggggcaagcctgggccatctagtgacactgaaactagtagtgttgttcaatcatctcaacaattggctcgtaagcgtgttgctcctacctccacttctgaattacgtgaagaatcagttgcacctggtgagaagagctccgatgtcttgaagaagtctaaaggatctgagtccccagaagagaatacagaagaacaacctgctgcgactctggaatttactggcagtcaccctgtcactgaagaattattggatagtagtgacatgccccaaggccaaaatgaggaggttggtgacgctcaaaatgaagatggtgaaattgctgttgggaatgatgaggaatccaaagatccacagaacttggatgttactggtcaagaggaattacaaggtgacaaaactggaactttagaagagaatccggatcaacctgttgatgcaaaaatgctgtctgatgagatgcagagggatcagacagacccagacaaccagcagtcaacattggcgcccagtggtgagagagaagagggagaattgttgccagatatcggtgatctagagggtgctagtgatttgtctaacattgccgaaaaccaagaatctcgggaaggtctatctgagtctgctgcaacccctgaacgttctccggctacggttgatgatgatgctctagaggccggtgagattaattctcctgagctttcaagtgatgataagaatgatgagggtgactcggtagaggatgctgctgatgcttccgacaagttgatggacgtcaatgaacaaatatcagccgagagcgatcaggtggccgagcctacacctgtggcaagtgagggtgctactttgacaagcagtgttgtagagagtagctcctctaaagtgaacttacctgttccaaggcaagggacccccaatgcccctgctgaaacagaagagacaaagcaggcatcacctattggtagtacttcaacgactataattttatcagagcgagcacgggaaagggcccaaatgagacaggctgggttggtttcttctacccttagaggtcgtggaagaggcggtgctccccgtggtcgagttggtcgaggtaggggagtagtacgccgaccacctccaccacctggcagtgatcaatga

SEQ ID NO: 29210 - DNA, 378 bp, Glycine max
  Peptide Sequence Number=SeqID_145988
atgacgaaaaatataaacttgatccaaagtaaaaaagtgtgttttcgtaggttattccaaaggcgtgaaggggttcaagttttgggatccaacttcgtgataagcagggatacaatgtttgatgagcagtccatgatgccacaaacaattgagacatatgtacctgtgccagatgaagctttccctagctctgtggatgttcatccacacaatccaagacttgaggccacacctgtagctaaacctagaagactagcgacttcagatggaccacaagagtacaatcttgtcaaagatagagaaccttgctctattaaacttgttgtcagagatgggtttgaagactcgtctacctttcaagaggctactaacaattag

SEQ ID NO: 29211 - DNA, 219 bp, Glycine max
  Peptide Sequence Number=SeqID_145989
atgggtatatggaggctggctcacgaaaaattaactataaataagaaaggtcaccatccatcctatgtgtggcgtagcatctatgcttgtcaaatattgttaaagggagggctgagatggtcgataggttctggtgctaacataaatgtgtggggagaaccttggttgaggaataacggtagactctatgcgattaaccaacttcctggggaaatttaa

SEQ ID NO: 29212 - DNA, 438 bp, Glycine max
  Peptide Sequence Number=SeqID_145990
atgtctgccctgaattccactcatttcacttcattgagggaccaagtgctgaatgtattcaaggaattgcaggagatcctcattaaattcttaacactgtccattgctttgatttcactaacaaacactgagtcagggaagcttttgtttacagaacagcacaagctaatgatgtttctgattttaaccattgtcttatacttcttatttgcttccactgggacaatacttcagatatataagggaaacctccttccacttgtaatttgggtcatgcttattgtgggaggtattgtttcagttctggctttgagcttcatttcagccaccgtagcttggatcactttggccatgtgggttggaatattcgcagtggttgcctacgactatagtgttcctcaaaggatcatgaattgggttaagggtccatcaagctga

SEQ ID NO: 29213 - DNA, 339 bp, Glycine max
  Peptide Sequence Number=SeqID_145991
atggctccaaagaagcttctctctaagagggcaaggaaggaggccgctggagaaggatccagtgtggccccacgtgtggatatagaatttgacggataccgttctacaccaatgcatggcccacagaggaaggagtcagggataagtgctcctgggtttggggccaatggatcccctttgttgaggatgccattaatcaattcttggtgcatccgttggtcctggaagaggggcaacgctatgagttcagcgagaggaggagctaggcttcagggtttgaagaggaggccatcggccaactactgtgtgttccagggcaagacttcacccgaagtgtga

SEQ ID NO: 29214 - DNA, 1534 bp, Glycine max
  Peptide Sequence Number=SeqID_145992
atggggaggaggatgatgcaatggaacaccatcaccaaagcttcaattctcgtcaccatcaccctcctcttgattctccccgtggccgttaacagcatgaggctcgaattggtgcacaggcaccacgagcgctttgccggcggcggcggcgacgtggatcgggtggaggcggtgaaggggttcgtaaaaagggacaagctgcggcggcagaggatgaaccagaggtggggtgtagtaagtaattacgacagcagaagaaaaggcttcgagatgacgacaacgccggcggaggtggaaatgcccatgcactcggggcgggacgatgccctcggcgaatacttcgccgaggtcaaggtcggaagccccgggcagcggttctggctcgtggtggacaccggcagcgagttcacgtggctcaactgcgtaatgcagaatgccacaacaacaacaacaacgcggaagaacaaaaccaaaaagaaacaacaacaacaccaccaccatgtgcacaagcatcacagcaagaggaacaaccgaacgaggacgaggagaacgaggaagaagaaggttaagagtagtaaaagtaacaagagtgatccttgcaaaggggtcttctgtccccataagtctaagtcctttgaagctgtgacgtgtgcgtccaggaagtgcaaggttgaccttagtgaacttttctcgctgagtgtttgccccaagccttctgatccttgcttgtatgatatcagacacaagcacaaaaagtggcatgctcctgctggtgaaccagcagccattctttccagcatccaaccatgctatgctgatggatcatctgcaaagggattctttggcactgacactatcacagtagacctcaaaaatggaaaggaaggaaaattgaataatctcacaattgggtgcacaaaatccatggaaaatggggtaaacttcaatgaagacactggaggtatattggggctaggctttgccaaggactcattcattgataaagcagcttatgaatatggtgccaagttctcctattgtttagttgaccatttaagccacagaaacgtttcaagttatctaaccattggtggccaccacaatgccaaattgttgggtgaaatcaaaagaacagaactcattttgttccctccattctatggtgtgaatgtggtaggcatctcaattgggggccaaatgctgaaaatcccacctcaggtttgggatttcaattctcaaggaggcaccttaattgactcaggcacaaccttgactgcactacttgttccagcctatgagcctgtttttgaggccttgatcaagtctttaacaaaagtcaagagggtcactggtgaagactttggagcattggatttttgctttgatgctgaggggtttgatgatagtgtagtgccaagattagtgttccattttgcagggggagcaaggtttgagccaccagtgaagagctacatcattgatgtggcacccctagtgaagtgcattggaattgttccaatagatgggattggtg

SEQ ID NO: 29215 - DNA, 366 bp, Glycine max
  Peptide Sequence Number=SeqID_145993
atggtgaatgaattaattcgtgacaataatgatgatggtggtaatggtgacaccggtagtgatgaagatgacatttgtggtggtagtagcattggcaatggtgatggtgattatgacaccggtgaccacaacaatggtggcggtgatggtagtagtgtcaatggtgagaaacatgtaaagtgcgatgtctctaccaagtttgctactcgtgctttaagtgctgtcataccacattcttgtgaagccacctttggcactttgaggggttgttctcagacaaaggccagtactaacagcagtggtgtacaatgcagtcttctaagctgtaaaatgggctatcttgtattttcgaaattaaaattatga

SEQ ID NO: 29216 - DNA, 186 bp, Glycine max
  Peptide Sequence Number=SeqID_145994
atggccaatggacaaggatgttatgttgtgtgtggtcaagtactatacttaaagggtacaaagaagccatggaagtttctaagcctaagttacttagaatgctacaaggatgccttgaatagactgagcataatcccaaagggtacacaacacttggaagtcgtgagagccccttattggatttga

SEQ ID NO: 29217 - DNA, 540 bp, Glycine max
  Peptide Sequence Number=SeqID_145995
atggcacatctttcttttgcctatcaattgtcatacgtgcctattcctagttattttcagggaggtcttaaggatcctaaatggaaattcgcaatggtagatgaaatgaaggctctccaaaagaatttcacttgggagatagtcgagcttcccaacgataagaagatggtgggatgtaagtgtgttttctcaataaagtataagttagatggatcaatagacatgtataagtttgatatgagaaatgcctttctacacggtgatatattagaatgggtgtatatggatcttgctccaagttttacaccaaaaggaggcaaggtatgcaagctaaataaggtattgtatgggctaaagcaatcacccagagcatggtttgggagatttagccattctatgaagaagtatggtttcaagaaagccatggaagatcacacactattttatcagaaagttggtgttgttattacccttcttattttttatgttgatgacatgattgttataggtagtaacctttgtgagatagaggagctttga

SEQ ID NO: 29218 - DNA, 991 bp, Glycine max
  Peptide Sequence Number=SeqID_145996
atggcaggttcaatttctttgttggggttcgctttggtcatttttatccaaatcatgacacagtgccatagcagcatcactacatgcttgcccgagaaacatgctgcactattcatattaggagattcgctatttgataacggaaacaacaattacatcaacaccaccacctcttaccaggcaaactatcctccctatggagaaactttcttcaaatacccttctggcaggttttctgatggacgcatgataccagatgccgttgctgagcttgctaagttgcctatacttccaccgtatctgcatccgggtaacgttgaatatgtctatggtgtcaattttgcttcaggaggggccggtgctctgcgcgaaacatcccagggaatggaaatactgtccaaatctgtctacttgtttaacattggagccaatgactatggttctctactggatccaaactcaaccagtgtacttcttccggttgatcatcaaggatttgtagacattgtaattggaaacctcacagacgcgatcaaagaaatttataatgttggtggaaagaaatttggatttcttaatgtgcctccgataggttgttcccctgccgtaagaattttggtcaataatggaagcacatgctttgaagaattttcagccatcgcaagattacacaacaatgcactctcaaaaaggcttcacgagctagagaaacagctcaagggattcaaatattcagtcatggatttttacagtgcattttctcaagtgttcaacaatcctacaaaatatggcttcaaagtagcgagcgtggcatgttgtggaagtggaccatttagaggagtggatagttgtggagggaacaaagggataaaagaatatgaattatgtgacaatgtcaatgaacatttgttcttcgactctcatcatcttactgatagagctagtgaatatttcgccgaattgatatggaatgcaaatcgcactgtcacaa

SEQ ID NO: 29219 - DNA, 191 bp, Glycine max
  Peptide Sequence Number=SeqID_145997
atgaagggaagaatgcataaatatgggtttaacaacaataaacgtaagaagccagagaaggtaagggtggtggatgatgaaactggcgacaaacatcagctggatgaagtcctaaggatgccatctacatgtgtatttctgaagatacagtatttatattccatcacgcatccattggctactgattacat

SEQ ID NO: 29220 - DNA, 246 bp, Glycine max
  Peptide Sequence Number=SeqID_145998
atgttggatcaatttcatccatgcattcatgattccattgaaaacattgttgatgtcaaagctgatggtaactgtggatatcgtgtaatttttgccttatcagataaatttaaggaattaaagctgtccctacttgttgatggattatccatggttgccattgataagtggatgaatataatcgacatgggatatgtgattgcatcaaggtatttttcagagactgttgtcccttaccgtcaataa

SEQ ID NO: 29221 - DNA, 216 bp, Glycine max
  Peptide Sequence Number=SeqID_145999
atggcaatcaattcatggggctccagactcaatggtggaggatgcatgaatgataagcatttcatgtggctccggataagatttgagggtggcggaggatgcatgaatgacaagcaattcatggggctccggataaaatttgagggtgcaggatatacaacagcgctaggcaatcaattctccggggcaacagactcgatggtggaggatgcatga

SEQ ID NO: 29222 - DNA, 182 bp, Glycine max
  Peptide Sequence Number=SeqID_146000
atggagccactaaaagatgttgggcttaacaatgggtccatattgggttttaacaaatccccattttcgaatggacttgggttggaattactccttaataatcatgaggagagcataggcaaaggattggtaggccgtgaccattcctttaacgtgtgggaagttgctaccaatcatacgag

SEQ ID NO: 29223 - DNA, 384 bp, Glycine max
  Peptide Sequence Number=SeqID_146001
atggaaactgaaccacatcctccacaacaaagcccaccagtcattgccagcatgcatgatgaaagactacaaccacatcctcaatcatttgaattcacgaaacaacctcatcaccatcaagaagattataggtacaatccacatgtattaagtgctagtggagaagaatttatgagcaaccttattggtaaagatcttcgaacactggagtctgctaatacgtacatgcaaagtatgcttataccttcatccactaatcacttcatcaaggaagagcaacctgttgtttctgatgaacaacttcaaccacaagagcatggacgagtacatcgacagccgacaagaaataggaaatctctcagatgtggaactggtggacattaa

SEQ ID NO: 29224 - DNA, 555 bp, Glycine max
  Peptide Sequence Number=SeqID_146002
atggatgaggtgaaaggggaaatcttctttatgaaggctaaaggcactcctagctcggatgggtttggaggctctttttatcattatttttgggatctagtccaacaagatggcttcaacttggtcaactatttctttctcggggagtccgctaaggtgatccactctcgtcgcttctcgcttgtttggcgaaagaagccctcaacaaaagcatcaccagtttcatatcttcagatgacatacattccctccctagatcacatgaagttggttacagtttattgggagaaggtttgtcatcatgccaaagaggaggggaatgaaaagaaccaactactacttggcacccaccgtgctaatcgaccacaaactgtaatgccttcttcggtgttgtcaaatgatattcgctgggatgaatccactgttggagaaaggcaacctagagtgtctctatgggaaattgagccattaactacatctcctatgtatctatctccattcccccttaggcttaaacggccatggcctccaggacttccttcattccatgaataa

SEQ ID NO: 29225 - DNA, 360 bp, Glycine max
  Peptide Sequence Number=SeqID_146003
atggtggttctgataatcatagaggcaagaaaggaagagggagattccagaacacgagaggtaaaggaggttactccaaagataaaggcaaacctcaacctgatcaaagaagtggagatagctgcagcaaaagaagtggtggttctggtactcgtggaagagaaggcaaaaagaagtgggataaaagaaatgttgaatgcttcaattatggaaaaaagaggtcattatgcagaagaatgctggtataaggagaaaaatgctaatgatgaagcacaatttgccacaggagttgtttctaacactgaaccagtgttgttgatggtcactacaaagactggagctgatgcagaagatcaatga

SEQ ID NO: 29226 - DNA, 315 bp, Glycine max
  Peptide Sequence Number=SeqID_146004
atggagcccacgttcaattattactacaacatgctgatggaggaagtagatgttgaccgagtaattaattggctcagtgaaattccacgagaaaaatggactcttgcatcagatggtggtcgacgatgggggcagatgaccaccaatcttgttgggtcaattaatttcaagaaatcaataaatttgccaataggtgcgctagtaaaatacacagatgtaagaggattgtttggaaaattgcaaaacgaagcctattggccatcatgtcatgagtcaatgatctccccccgacccagattagaaaagaagtactaa

SEQ ID NO: 29227 - DNA, 1278 bp, Glycine max
  Peptide Sequence Number=SeqID_146005
atggtgagaagcatgttgaagactaagaagctacctcacttcctatggagtaaagcagctgcaacaacagtctatatactcaacaaatgccctaccaagagactgaaaggagtgacacatgaagaagcctggactggtactaaaccaaaagtgaatcaactcagactttttggttcactttgttataagcatgtccctgagcaactgaggcagaaactagatgacaaaggtgaacaaatgatccttataggctatcatgcaactagaggttacaagctacttaatccaaggtcaaagcaggtctctgtgagtagagatgtgatatttgatgaactaaaggaatatgagtggaaggaggaccctataaacaatacaaccaaggttatggtagattcaatcattctagaagaattgagtgacactactgatgaactgcctacaaggaacactgaaggaggaaccaggaggtctcaaagggttttgcaaccctcacaaatgttgaaagattatgaagtcatgaaagatagccaaatcacagatgaaggtgatattgtacacttttccctatatgcagatgttgaacctagaaatcctgctggtgaagtagttaaacacaaagccagattggtggcaaaaggattcctacagaaagaaggtgtagactatggtgagatctttgcccctgtggcaaggattgaaacagtgagacttgtagttgcaatagcaagcatgaaaggttggtcaatgtatcagcttgatgtaaaatccgcatttctgaatggttctcttgaagaagaagtgtttgtcaagcaaccacctggatttgaagttgttggacatgaaggaaaggtatacaaactgaagaaagcattatacggcctaaagcaagctccaagagcttggaacaagaagattgacagtgtcctaattcagattggctttagcaagtgcatatctgaacatggagtatatgtttatgcaagctccaaaaactcctcacatgatgcaacaaagagaattctaaggtatattagaggcacaattaactatggtattctactgccaaataccatcacgagttcaaacatggaactggttggctatactgactcagactggaaaagagataatgatgatagaaagagcactgttggatatattttcctacttggagatgcactggtgtcatggagttcaaagaagcaagatccggttgccatatcaacttgtgaagctaaatacatagcaacatcaatgtgctcgtgtcaaggcttatga

SEQ ID NO: 29228 - DNA, 232 bp, Glycine max
  Peptide Sequence Number=SeqID_146006
ggaggcggcgagttcggggaagttaaggatggcggatgagccttttatcgtcagcgccgccacgtcgtgggcacgcgccgccatctcggcggtggcgaagcttgatgatgacggtgatggcgacggagataacgacgatgaggaagagggtgaaggggtgttggtgttggtgtttcgtgttgagtctgataattctgagcttgctgctactgcaggctcgaccatggtttaa

SEQ ID NO: 29229 - DNA, 420 bp, Glycine max
  Peptide Sequence Number=SeqID_146007
atgagtgtagagcagttcattgagaaggtggcctggcctgtagcccgaccttcttttgtgggagataatgaaagttttacagtccagacacctcaacagcatgagccagaaccacaaaacgatcactcatctaaagccaccatccctggagttattgatttttcaaaaagaagattagagacgagatccaatgaggctggtcatcctggaccagtgtcggcatcagctgatgcatcatttccaggagtggatccatctctacctcagcacacaacaaactctttcactcctgtcatagagatacatgagggccagaccatgccagtcctgcctttggacacttctcttccagctactccaatacgacatctaacagatgagaaggatggtcagacacaggaccagtcacaggaattttga

SEQ ID NO: 29230 - DNA, 180 bp, Glycine max
  Peptide Sequence Number=SeqID_146008
atggagtttgaatctgctctcagtacattggaggatgctgttaatgatgctcccagagcagcagtttcttggctgaatttttgcgaaagccataacagagagtgtagtcacttgacacatgttttccaagaaataaggttgaagcagagaatcactcccgaaagcaagaaaaagggttaa

SEQ ID NO: 29231 - DNA, 144 bp, Glycine max
  Peptide Sequence Number=SeqID_146009
atggcgccaaaaacttgtttgactattcacaagtgtaccaatgtcgtcgcagcaaatgagccaagaggtgccagaccaactcgcctagacaaggtgtactcacccaagcgagttggttggctaaggctgaagaaattccactag

SEQ ID NO: 29232 - DNA, 357 bp, Glycine max
  Peptide Sequence Number=SeqID_146010
atgtcgcgaaactttacgggttacgcggcgatgtgtgttaagcgtctcaaagtgatcaaccaaggtcttcatgccgacaacaattgtccccagacgaaattaggtgatgtaagctccattggagcttgtaggcctaggatcttcttcatcaatggattcctttgcttcttggaagtagaatggagaaggaagagagaaaggagacaccacttcaaggagaatatgtgtctagaagaagttcaccaccataggaggccatggataagagcttggaggaagaaggagatgaatgaagggagaggaagaaaagagcacggaattttgtgctctaaaagagctccgaaatctgaagtttaa

SEQ ID NO: 29233 - DNA, 1383 bp, Glycine max
  Peptide Sequence Number=SeqID_146011
atggtgtattcgaaggcacccacagcgtactactcgaccctgcacgactcaatatcttctctgtgcaagaccattttacccttcggcctcaagaaacatcggtgtctcgtttccgcagagcagaagctgtggcagcttcaatccgacaacctcaaatggcagcgagattctctctatcagatgctgaatttggtggctcttcacagagatgacattctttctgaagctgaggtttcggctttcaggacccatttgctcgaaacccttcttgcttctccccctccgcaccaggatcatgccctcatcatcaaagataagcttatgtttctgcaggaacttcttaatgcaaagtgcatttcggaaggggagtaccactcttcaagaaggcctttgcttgtgagacttgcagttcaaggaggtgagattgaaggcagggatgtgatcattgcagggtcaaaagacaccaagcaagattcggaggaagaatggtcagagatagacttgaaggatgagcagtgcttggtgaacaaagagaactcaaattccaagaagacatcaaaacaggcaaggaagcaggttgttaaaggagcaacctcggttttcggctttggctcttcttacaagcctagcaaaaactcgacggagaggagcatattcaattcaccctctttacacaagcactcagcacaatcaaaaatgtcttctccatctatctatgcacaaagtgaattgaggcattctaaggaaaacaaccccttctgggatgggccggagaagatgaagaggaaaccatttagagctctatttcatagggataagaataagaaagaggggaatggtggtggagacggtcttgaagcagcagagaaatcagctaataaacaatgggggtttgatgggttgaggaaatggaagaaaagtgacacagatgatgacacagttcctttgtctctaaatgagaggtctgatagtgtggcatacttgccttcctatcagctttcttcaacaattccatatggtgagctttcaatgaagaacaagttgcactctggtctatcaccatctgatttttccatggatgataagaaggagctgtctagaacccctacagaaatgaggagcacaaacacaaatctcaacttctcgagggatcagaagcaagcaaattctaccaaacttccagattactacaaggccgagttagaaagtgactttcccaagccattggatgtggtgaagaaacaatttaaagacagtgttggagaatttgaaaatatgcacaatgatgcagaaaactcaatggggtggacaacatttgaagacgaggaaaaccttcacccaaatctttttgttcatcaagaaaaatcattgcgcaagcagtaa

SEQ ID NO: 29234 - DNA, 2455 bp, Glycine max
  Peptide Sequence Number=SeqID_146012
taacaccgttgaggtttccaactcttcctgtagatcatccctggtgtatgcaattacaactagggaaaagacaacggaacaaccttctaagaaatcctcaagccatcacgcctctactacaacaagcgttacacaagcattagttgatcctactttttctaacactaatacctttgtcgtgtttgcggcggtcactactggtcatctaggtttcatcctggaaggctatgtagatagtttgggagaagctccaagcacgatggcacctgtcttggaaatggtgttgcctattccttctgaggaatgttgccatggccaattagaggtgacaactaattatgtacccaaaattcagctttatcagcctttgactatgaggctcgtggcatccattgatgcatttagacctcctccaatgcaatttgccttcctaggcattcaggatgccttagacgattggcagacaacaatccaccatgttgacaaagttgctctttttccgagaggttacaaaatcctaggtttcgcaaccttttcaggtgaagacgagaagttcaccatggaacattttatgaatgagaaagatcacaagaagtcacacaggggaggtaggaatcctcatactatctctatgatttttgaagaagaggaggaggatttggatgatgattttcttgtcaatcagatggtggttgagttggtcaaagggaaactatactcttgcccgaccttgcaacattttaaagggcagaaggttgaaggaaaagagtcaaacttgtttgatatctttagcgtcgaacaagggaatgaaatgcaagtagataaaaacccctttccattggctaacattgatatagtgcctgcctctaggttggcaaataggctaaggtgtaatgttgggggcaacatcaccaacaatggaaacctaagttggacttgggagtcctccttagtagttggaagatttgagctggatggcttgttgtcagatgatactcttgctcctacagtagctgttggcattctacctatggaattttctagtcagggtcagttaacaagtttggaaaccaatttgtcgagcctttatggacaatggagctttcttgaatgtgatgtcattcttcattgtcaaaaagttggggaagcccaagcaaggtttaatcaaaacttgttttctgaattatggcatgaattgtctcgtggcgaaggcctagcgctcgatccaataattggtatcatcgccaaggtcacaagtttgattcctaggtgggcaattgctaatggggagattctttattgggttgtggcatcaattgtcttgtggcataggcccaggtgggtcaagtcacagtcaacttgtggtgcttgggctgttacgtttgtaagtagaaagagttatgtcttgattgttagttatagcttttggcctagtggtaagcgctcgatgcaacaaaaccaacatgcgagtgcctacatcataggaaatcctacgatgattatgggagatttaatagccgaaatcatagttggacccacaactagtacggctgcatttattgtggtgaatgctaagttgtcttattttgtacttctaaggagagattggctgcattcaaatttttgtgtgccatctaccttccatcaagttctgattttcttggttggtgataaagtggaggattatcctaaaatgttgaggttgtctagagaattggttgagcatcaactatctttcaaagaaggattcaagccatacaaacaatcaattaggcattttaatccggaggtcctaccaatggtgaagaaagaggttgaatgcttgctatcttcagggttcattaggacggttaagtatgttgattggttgtctaatatagttcctgtcatcaagaagaatggcaaggtagtaatgccttatggacttaagaatgttggggccacttaccaaagggctatgaatcaaatatttaatgattttattggtaggaccatggaggtatacatagatgacatagttgtcaagttgattgcatttgatcaacacttgttggacttggaacaagcgttgaagaggatgaggttacatggcttgaagatgaatcctgaaaagtgtgcttttgggatagcggcaggccatttccttggtttccttgtacatagcaagggaataaaagtcaacaagaataaagctaaggcgattgtagaagcaactcctcccagaaataaattagagttgcaaagtttggtagggaagatcaacttcctcaagaaattcattactaattcgacaagcaagcaattcatggatgcagaagttgtatatgtaccactagaagagaatcaagaagctaatgagctagcccaacatgcctccaagtacaaagagctacaagtagaagagcttgagtatgaatggcctgatatagatgttcaagatcttgaccatgactga

SEQ ID NO: 29235 - DNA, 345 bp, Glycine max
  Peptide Sequence Number=SeqID_146013
atgtcgctgcatgttctctatctttatgcgttttctagatttccccccagggatttccggtccgttgtatctcttgttacgatctttcaaagaaatgaacatggatttgaggcttttagtcctcacgggcaggatcaccttgggctaccttctggagtgaagacaaaacatgaacggcagaaaccaatcaaggtagggtacttaaggatgaacgcaagcggggatgggatcacgaccgaccgatcgttgcccttgctctatgcgaaacaagcagggaatgtcgctgccaggcagccccgtatcctttgtattttgcagctttcttttactatttgcttgttttaa

SEQ ID NO: 29236 - DNA, 453 bp, Glycine max
  Peptide Sequence Number=SeqID_146014
atgtctggcaacattggcaaacctggcaccacatgtccaccgtttgagtgcatatgcatctcagagactagtcagcctctttggcatgctatcacggaagtatgttgccagtctatctgggctttcataataaactgtattcattattcaccaaaaaatttcatgtataacaaattagcagatctcagagatggtaagctcaataatgcaggaagcaactcaattgaaagaagtagccttgtagaagatatgtcagcagagttgcagatatatactgacttcttgcggcttgtactagaaattataaatgcgattctgacttatgcactgccacgaaatcctgaggtggtgtatgaaataatgcacaagcaggaagtctttcagcctttcaagaatcacccctgtttcaatgagcttgttgaaaacatctacactgtatgtttcatgtgttag

SEQ ID NO: 29237 - DNA, 798 bp, Glycine max
  Peptide Sequence Number=SeqID_146015
atgctttattctaatgcagatcagaccattgaaaatcttgttatgcggaatgtgctcaactttattgcatctatagatgtgagccccaacacatatttcctacatctggagctgcttaattttatgattattgcaatgtcaactcagcttcttcgtgggccatctcctggaccgaatgatgtgaatccatttcttgatgcggcgatggctcaggatagccatctggttacttcagttgtgtgcaaactgcttctaaattacattacccgtcctcgtgttccatttagtagagcatcttattccatcttttatgatgggagtcagaatagtgtgctaaagaaagttggttcagaagctgtggatcgtgtagataaagagggtaatgcacacagtgaccaagaccaacatgtaaagttgccttttgcaccgttgtttgatacccttggcatgtgcttagctgatgagacagctgtcctacttctttactcattgttgcaagggaattccacctttctggagtatgtcttggtccggactgatttggatacattgttaatgccaattctagaagcattatatgatgctcgaaggaggacagctaatcaaatttacattttgttaattatacttctcatacttagtcaagattcttctttcaatgcaggaattcataagctgatattgccaactgttccatggtacaaagaacgtctcctccttcagtcttctcttggttccctcatggtcatcattcttatcagaactatacagtataatttgtctaaacttcgggtatga

SEQ ID NO: 29238 - DNA, 273 bp, Glycine max
  Peptide Sequence Number=SeqID_146016
atgccactagtccttggaaacattggttctggaagcacaagtcaggtcaggaaatggaacatgaatagcacaaggtgggaagatacgaaaaaaaagggtacattaagcaaaagtggcaacagaaaggaagaaaaaaaaggaattctgaagcaggcccagcccaacagtggcgctaagcgcgcacaggcgctaagcgagcaactagctgcaggcgctaagcgtggcgttaagcacgaaggagtagaaaccgttacgcgcgctaagcccagctag

SEQ ID NO: 29239 - DNA, 405 bp, Glycine max
  Peptide Sequence Number=SeqID_146017
aactttgctttcgttgactctggccttttcgccactgatgacaggttcaacggatcaagacgcaaagcaaatgacaatgaggttatcggatgtggtgctagattgtgtgatgttatacatatacgactccaaggaccgcaacaccgtgttgtagggaaagccataggcgatgatgttcaacctgatatcggaggattggcgagacacatacttcaagcactcaagttggatacatgctctggattctccacccatggcctctactatatcgatcgtaattgtaggcccagcccaacagtggcgctaagcgcgcatcaggcgctaagcgagcaactaactgcaagcgctaagcgtgacgttaagcacgaaggagcagaaaccgttacgcgcgctaagcccagctag

SEQ ID NO: 29240 - DNA, 132 bp, Glycine max
  Peptide Sequence Number=SeqID_146018
atggatagtggatactacgatgtggcaaatacacctgatgaattgcccgagaggcttattggagctgttcgtatttctcatttagagctcaaatctgccatcgtcccaaaactggaaccagatccatcatga

SEQ ID NO: 29241 - DNA, 972 bp, Glycine max
  Peptide Sequence Number=SeqID_146019
atgtcgtcgaaggtggtgtacgaagggtggatggtgcggtacggccggcgcaagatcgggcgatcgtttatccacatgaggtacttcgtgttggagtcgcggctgctcgcgtattacaagaggaaaccgcaggataatcaggtaccaattaaaacactgctaattgatggcaactgtagagtggatgatagaggcttgaagactcatcatggacatgtgggttctgcaattaaatacgcacgtgtgaacacatacacgcacatatttgttttgtcggtagctatgcttgttgtttttaatccgattaggaaattggatgtgtggaatggagggagtaccctcatccagattaaaatcaaaccttacaagctcactagaatgagaggtatgcatgctcacctggtgcagggtcgtccaatggtttatgttttgtctgtttacaacaagaaagaaaagaaccatcgaattatgatggcagcatttaacatccaagaagccctaatttggaaggaaaaaattgagtatgtcattgatcagcatcagggagcacaaccatcaaatggcaacaaatatatttcttttgagtacaaatctgggatggacaatgggaagacagcttcttcctcagaccgagaaagccagttcagtgctcaggaggatgaagatgaacctcatccaaatttgttaaggaggaccacaattggaaatggtcctccggaatcagtttttgactggacacgggaaatagactcagatttgtcaaatcagaatatcaataatcaagcattctcaagaaagcattggcgtcttttacaatgtcaagatggacttcgtacttttgaagaacttggtgaagttgattaccttccaagaagctgtagtaaagctatgaaggcagtcggtgtcgtggaggcaacttgtgaagaaatttttaaacttgtgatgagcatggatgggacacggtttgagtag

SEQ ID NO: 29242 - DNA, 2025 bp, Glycine max
  Peptide Sequence Number=SeqID_146020
atgaattcgtggagaaagaagggatctcggtggatggggactggcaagtcgaagtgcttttggggagagacacgagaccgagtggagatgctttgcctcaagcagctaaacagccatgagcaaggttttaaatttcagtcaatcttcccgcggattttgaagtcttcatttcacaatgtttatcgcgtcaaccattcccgaccccgaaaaccaccatttccgtttccgaaaagaaccgaatgcgacgagtctctgcttctacattacctatccaatgggtggcacgacgacgcgcgaaacctcctccaaaattcctctggaggtgacctccactcgcgcgttgttcgctggacctcgctactctccaacttctcccgccacggtttcgtgaccgaagctcgcacactcttcgacataatgccccacagaaacctcgtctcttacaacgccatgttgtccgcgtacctccgctccggcatgcttgacgaggcttcccgcttcttcgacaccatgccggagaggaacgtcgtgtcttggactgcactgctcggtgggttctccgatgccgggaggatcgaagatgcgaaaaaggtgtttgatgaaatgcctcagagaaatgttgtttcgtggaatgcgatggtggtggcgttggttaggaatggggatttagaggaagcgaggattgtttttgaggagactccttataagaatgtggtttcatggaatgctatgatcgcggggtatgttgagagagggagaatggatgaggcaagagaattgtttgagaagatggagtttaggaatgtggttacttggactagcatgatatctggttattgccgtgagggaaatttggagggggcttattgtttgttccgggctatgccggagaaaaatgttgtttcttggactgctatgattggtggctttgcttggaatggcttttatgaagaggcattgttgctttttcttgagatgttgagagtttctgatgcaaagcccaatggtgagacctttgtttctcttgtttatgcttgtggtggtttgggtttttcttgcattggcaagcagttacatgctcagttgattgttaacagctgggggattgatgattatgatggtaggttgcgaagaggtcttgttaggatgtactctgggtttggtcttatggactctgcacacaatgtgtttgaaggtaatttgaaagattgtgatgatcagtgttttaattccatgataaatggttatgttcaggctggtcagctggaaagcgctcaagagttgtttgatatggtacctgttcggaacaaggttgcatccacctgcatgattgctggctatcttagtgccggccaagtactaaaggcttggaatttgtttaatgacatgcctgatagggattccattgcgtggactgagatgatttatgggtatgtgcagaatgagctcattgctgaagccttctgcttgtttgttgagatgatggctcatggtgtttctcctatgagttctacatatgctgttctatttggagccatgggttcagttgcttatcttgatcaggggcggcaattacatggtatgcagttgaagacagtgtatgtatatgatttgattcttgagaactctctaattgcaatgtatgcaaaatgcggggagatagatgatgcatataggatattctctaacatgacttaccgggacaaaatttcttggaacaccatgatcatgggcctttcagatcatgggatggccaacaaagctttaaaagtgtatgaaactatgcttgaatttggaatttacccagatggccttacattccttggtgtcctgacagcatgtgctcatgtgggtcttgttgataaagggtgggagttatttcttgccatggttaatgcttatgctattcaacctggtttggagcattatgttagtattatcaatcttctgggccgagcaggaaaggtgaaggaagcagaggagtttgtcttgaggctaccagttgaaccaaatcatgccatttag

SEQ ID NO: 29243 - DNA, 732 bp, Glycine max
  Peptide Sequence Number=SeqID_146021
atggcgctttatcttttctgtcttcttcttgctatcaccttgattttcatgcaaactctggcagatacttcatgcactgattgttcattcattcttgggcagcatattatccaaattctaaagaacgcggaacagatggcaataattggtgcatgtgggtttggttcctttggtgctacagtcaatggtggagatgtatcagctgcatcttctctttatcgaaatggtgttggttgtggtgcctgttaccaggtgaggtgtaccaacagtgtatattgctcagaaactggtgtgactgcagttataaccgaccaagcttcaagtgataacactgatttcattcttggcaaacatgcctttagccgaatggctcaaaccactgatgcagctgcttctctattagcccttggcgtggcttttatctttctatctgtctccagtgttgcatgcagctacccagataaaaacataacaatcaagatagatgagagcagcaacaacccatattacttggcttttgtcatttggtatcaacaaggaaggagagacataactgctgtgcagctctgtgagatagaagccatggggcagtgtggactactacctctccaccgagtggaccctttgtctttaaggatgttgtttagtgatgaagaagagggagaagaaacatgggttgttcctgttaataacatacccggagactggaaggctggtgaaacatacgattag

SEQ ID NO: 29244 - DNA, 1512 bp, Glycine max
  Peptide Sequence Number=SeqID_146022
atgctggtctttcaagcaaagtgcattaaacacatggaagcttttactcaaaggtttatatctagatggtccgttacactttacgctcgttactctgatactcctcagaagaagtctaagcttgctcctttgcaggagagaagaatgatggaccagtgtaagatatttgcaaaagcaggtgatggaggtaatggttgttctagcttgcgcaagggaagacctgatggtggcaatggggggagaggtggtgatgtgattctggaatgctctcacagagtttgggacttcagtggtttgcagcgtcacctgatagctgagaaaggaggacctggatcatcaaaaaagttgataggtagcaggggtgctgataaggttgcccgtgtaccgattggctctgtagtacatctcgttaatggtgatattccttctgttgtcaaaactcaatccgcaacagatgtagacccttgggatattcccggagcacttgttgatgattttcctaaccctggcaatggttctacctccagtgttactagtggggaagtcaaagcaatgcattctactagctgctcctcatcacaagatgaagaaacagatgttaagaaatctgaaaaatcaagacaagttgcattaacagatgtattttctcaactctccacttctaatggagctcctgaatttggaacagaggatataggagagaaacaagagatactatacaatgttgctgagttaacagaagaaggtcaacaaattgtcattgctcgtggaggagagggtggtctgggcaacgtgtcttgtgtcaaagattcaaggaagcctgtgactatggcattttcatgccaacacatggacaatgttcaggaccctgacagtgttctctcctctcagcaagcaggttcacctggttctgagactgttcttatattagaactcaagagtattgctgatgtgagctttgtgggaatgcctaatgctggtaaaagcactttacttggggctatatcaagggctaagcctgctgttggtgactatgccttcactactcttaggccaaatttggggaatctaaactatgatgatctctcaataactgtggctgatattcctggacttataaaaggcgcacaccaaaatcgtggactcggacatgcgtttctgcgccacatagaacgcacaaaggttcttgcttatgtggtagacttggctgctgctttaaatggaagaaagggaattccaccatgggaacagctgagagacttaattctagagctagagtaccatcaagatggtttatccaaacgaccatccttgatagttgcaaataagactgatgaggaaggtgcagaagaagtgtataaagagttaaagagaagggtccagggtgttcccatctttcctgtgtgtgctgttttgggggaagggatagcagatcttaaagctggacttaaaatgcttgtcagttctgaaatgtcatctgaactttgcctggatcaaattttgcttgcttag

SEQ ID NO: 29245 - DNA, 387 bp, Glycine max
  Peptide Sequence Number=SeqID_146023
atggactcaaactttcttgcacccaccttttttgcatcaactcctcaacttgtctttgaatttctttggtctcttgaggattactcctatatgatggcctatttggcaaggaagctcttgaaaagagatcaatttaatgttctattcctctttgaggtggtaaaccgtgaggcacctctttgggaaagacatcctcaaattcttgcaacaaagaaaaaatctcatttggaggtggttaggacgcagtttgacctcaaatgcgagaccccttttgaaagctcaaatcctcctccaacaaccatgctagatactgatactctccagcaactccaaaattgcattggggagatggagcgatgcaatgaggaggagctcagaaagctatag

SEQ ID NO: 29246 - DNA, 333 bp, Glycine max
  Peptide Sequence Number=SeqID_146024
atggcgcattttataccttgcaagaaagttgatgcttgccatgttgctgacttgtatttcacggaagtggtgtgtctccatggactaccaagaagtgatgaggatttcaatttgaggtggaattcactcaaagaaagaggggatgatgagaatcaaacaaggaacaatgatattgaagaaatacaaggacttggtggacctatgacaagggcacgtgctaagaaaacaaaggaagccttgaaccaaatggtgacaaccttcattgaaccaaattcacgactggaaagaataaagcccaagtcggtcaactacataaagcaacttaaggaatga

SEQ ID NO: 29247 - DNA, 183 bp, Glycine max
  Peptide Sequence Number=SeqID_146025
gtcttgggtggtggggatgacatcatattctggtcgcgtgaaaaatctccacgttctcgcaagtggccacatgaggaagcacaacaagtgcacgagaatggtgtgtgtcgctgcaacaaggagaaaggaatggaatatagcccactgggtggggttggctttcaaaaaaggaaacattcatga

SEQ ID NO: 29248 - DNA, 621 bp, Glycine max
  Peptide Sequence Number=SeqID_146026
atggacaagctcctcaaagtcaacttcatcaaaaaagtcaggtattccactaggctcgccaatgtcattgtggatgcataccctccacctaacatcgacaagctagttgatggagcatccgggttccaagtactaagcttcttggacgcttacttcggattcaaccaaattcaaatgcacgttccagacaagaagaaaatgacattcatcactcaagatgccaacttttgctatagggaagtccagaagctgaatggtagacttgcatcctcgtccaagttcctccctaagcttgccaaaaaggcaaagctgccaagagtacccctacttctctttgtagttatcgaagccgttagctcaacccttgtacaagaggaagggaagcatcagcttcccatttacttgactagctgcatactccatgacatcgagaagcacaaccaaatgatagaaaaaggtggtgctagcacttattacctcggcctgacgtctcaagccatactttcagagtcatcaagtgagtttgatctccaatacaaaccctgcgtcttcataaagacacagttcatggcatactttctggaagaatttgctggaaatgaccaaaccaccctagactag

SEQ ID NO: 29249 - DNA, 234 bp, Glycine max
  Peptide Sequence Number=SeqID_146027
atggctggggaggtccctactgagctacgtgcactgcctgagtttggggccaggttgcaaattaacgagttcttcaataggctttgggcctctatcagaagtatcgtcatgcagatctacattgaatacattgtccaagcttgcttggtggggaacttcatcttcaaatgcagcatggagacgatggctccgagatcattgagcgttttcctggcaatcaatgcaaagcaatag

SEQ ID NO: 29250 - DNA, 612 bp, Glycine max
  Peptide Sequence Number=SeqID_146028
atgccgaacgaagaacaccgaacgaagaacaatgtagaactcgattacggcacatttcgatatggcctcagcctcgtttttctcttctttctgcttcttctctctgatttctctccaatttcttttaacactgaaggtccaaacccttcctcagcctccctcacgcctatttataggaaattagggcacttggtggtcttacagctcgcccaggtgagttgtttcttcaccttgaacccttccccttgggtatcttctgcatccttgaccaaaacatctaatgatttttcatcttgcgcacgacgcatccgtcctgaattttggcaagactcaccaagggaggaccttgggtttgacgagcctgtgagactcaccaaggaaggaccttgggttttgcgagcctttagagaaaagagactaaccaagggaggaccttggcctttggagaaaagagactcaccaagggaggaccttgggtttgacgagcctttggagaaacaagacttaccaatgggagaccttgggtttgataagcctttagagaaacaaccagggatgcacccatccaggattatggtgagactcaccaagagtagagcttgggttttgtga

SEQ ID NO: 29251 - DNA, 1212 bp, Glycine max
  Peptide Sequence Number=SeqID_146029
atggatgaaagggtcgcaagcaagaccgagttcacagaatgctggcgcagaacaactgaatcaccttacatcatgcgccttgctttatctgctggcatagggggtctcctctttggttatgatacaggggtgatttctggggccttgttatacatccgtgatgattttgaccaagttgacaagaaaacatggcttcaagaaaccattgtgagtatggctgttgctggagccataattggtgctgcattgggagggtggataaatgacaagctagggagaaagagaactattttggtggctgatgttgtattctttattggtgctttggttatgtcccttgctccttctccatgggtcatcattgttggtagagtgtttgttggtttgggagttggaatggcatctatgacagcccctctatacatctctgaagcttccccagctaagatcagaggtgctctagtcagtatcaatgcttttctcatcactggtggccaatttctgtcttacctcgtcaatttggcattcaccaaggcgcctggaacctggcgttggatgcttggggtggcaggagttcccgctgtgatacagttcgtgttaatgttgtccctccctgagtcacctagatggctctatagacagaacaaggaagaggaggcaaagcatattctgtcaaaaatctaccgtcccagtgaagttgaagaggaaatgagagccatgcaagaatcagttgaagcggagagggcagaggaaggtttgattgggcatagtctagcacagaaactgaagaatgttttggctaatgatgtagttcgaagagcactctatgcgggcatcactgtccaagtggctcagcagcttgttggcatcaatactgtaatgtattacagcccaaccatagttcagtttgctggaattgcttccaactccacagctcttgccctttctctggttacttctggtttgaatgctgttggatctatcttgagcatgctttttattgatagatatggaaggagaaagttgatgctcatatccatgattggcataatcgtttgcctcataatgttaagtgttacatttaaccaagcagctcatcatgctcctgccatcagtaaccaggatacccttagctttggtgctaactctacatgccaggcttacacaaaggccccaaatttctcctcatggaactgcatgcattgtttgcaa

SEQ ID NO: 29252 - DNA, 129 bp, Glycine max
  Peptide Sequence Number=SeqID_146030
atggcttggtctagcttggtgacctttgtaagtgaaaatccgctaagcgagcttggacacactatgcacgggaagagacaacgtcctcgctgggcaagctcactgcgcgctaagcgtgctgatctctga

SEQ ID NO: 29253 - DNA, 902 bp, Glycine max
  Peptide Sequence Number=SeqID_146031
tgatcctaaccttcatattttgggggtcccacaagcagcaacttgttgctagatcccatacggaggcagaatatcgtagcttagctcagattgctgcagaaatcttgtggatgcagacattgttgactgaactcaaagttcccttcagcactcctattgtcttctgtgataatcaaagtgcagttgccattgcccacaatccagtccttcatgcaagaacaaaacatatggaacttgatgttttctttgttctattttacctgatattattctgcaacagaaaccagagaacattccgcccgaaaaaaagtactccttctggaagtaagggagctcaacttcgaaaacatattgatgccacgttaggtagtggaaatctgagggaagcagtaaagctacctcctggggaggatttaaatgagtggctagctgtcaacactgttgatttcttcaatcaggtgaatctgctttatggtacccttacagagttctgtactcctgagaattgtcggacaatgtctgcaggacccaagtatgaatatagatgggcagatggtgtacaaattaagaaacctattgaggtttctgctccaaaatatgtagaatatctaatggactggattgaagcacagcttgatgatgaatccatattcccacagaagcttggttcaccatttcctcccaactttaaggaagttgtgaagacaatattcaagcggttgttccgtgtatatgctcacatataccattctcactttcagaaaattgtgagcctcaaagaagaggcccacttaaacacttgcttcaagcattttatactcttcacctgtgagttcgggctgattgacaaaaaggagctggcaccccttcaagagcttatagaaaccattatcccatattaa

SEQ ID NO: 29254 - DNA, 681 bp, Glycine max
  Peptide Sequence Number=SeqID_146032
atgaagtcccttctcaacccaaagttctcagctttatctcccaaagcttctccttttgctctgttctcacttccttcttctcgattctccttccgcagcaacccgcgtcgaatccccaatcgtcttcttcgcctcaacccatcaccctgttcgtccaataatttctgttgcaccattcaaaatcgaagtttgcaaacggagccctcgccgcctccctccggcgagattcacgtcattgtggggcccatgttcgccggaaaaaccacatcgctccttcgtcggattcagtcggaaaccaccaacggcagtttgtcatggttagatgcatttacagttatagtggcatcttgcttgcaactattgattcccaaagtcattattgtcttgtactttgacttggaaagactttttttgtgcaatgccatattcactggtctgatatggtcaactttgaggtcaagccttgcagaagaccccaaccgagtaaggtcttggaagttgtgtaaaggtggcggcttaagtgttttaagtcaactaaaagtaatttttgaatcctgggttggtgaaggtaattgggctcttgtgccaaacgggattggcgatgcatcaaagagcttattctctgatgctgcaggaattcatattctggaaatctataaacctcaccaacaagctgattag

SEQ ID NO: 29255 - DNA, 1725 bp, Glycine max
  Peptide Sequence Number=SeqID_146033
atggcagaaactgtagtgtccttggctggtcagcacgtgcttccaagatttctggaagtggtcaatatgctgagaggtctaaagaaagaagttgaagacattaaaaaagaactggagagctttcaacatttcatcaatgatgcggataaagtggctgaagctgaacaagatgatggaaagcacattacaaataaaaaaaaaagggtgaagcggctgagagaagctgctttttccatggaaaatatcattgatttatatgatatctatgaggacaagcaacctggtgatcctggatgtgcagctttaccctgtgaggctgttgactacatcaaaactctgatcttttggctccaaatagaactgaaggaaaactacggtctccaaagcaaacttcctttagaacaaagaccaatcagttctacaggaaatcaaaatgtcacaaggcacaaccttcgaatggctcctctgtatgctgaggaagctgaggaatgggagaactgggaaaaacaactcttgccaagctggtttatgacaacatggaggtttatgcatgcttcgattgtcgagcatggatcagtgtctaaatcctacactgcagaaggattgttgagggagatgttggacatgctttgcaatgaaaaagtggaggatcctgctccgaattttgagaccttgacaagaaaactcagaaatggcctgtgcaataaggggtatgttgtcgtgtttgatgatgtatggaataaaagattttggaatgacattcaatttgctctgatcgataataagaatggaagtaggatattaatcacaacacaggacacacaggttgcacagttttgtatgaaagattctttaattcagcttaagctagaacctttaagtgaagaaaagtctttggaattgttctgtaagaaggcatttgggtatggttttgatggacgttatccaaaagaatataaagatctgggtcttgaaatcattggaaagggtcaatgtttacctctagcaattgttgccattggtggtcttttatatagcaaatgtaaaagtgcagctgagtggaaacggtttagtcaaaatctaagtttggagttggagaggaattctgagttaagtagtatttcacaaattttatgtttaagttatgatgatttgccatacaatctcagatcttgtttattgtattttggaatgtatcctgaagactatgacggatttgtcaaacatgtaacgggggaaactttggaagaagttgctcaacaatatttagcagagttaatcaatagaagtttggtgcaagtatcttcatttaccataaatggcaaggttagaggatgttgcgttcatgactcaatacatgaaatgatccttaggaaaatcaaggatacagtattttgtcattgtattcatgagcataatcaattagtgtcaagtgggatccttagacacttaacaatagcaactggttccactgatttaattggaagtattgaaagatcacacgtacgaaaatttgggcaatttaatccacttgaagtatttaagcttgaggtatacacagggaagcacaggctggtggatcttgtagtgaggaacaattcatttgagaagactgttgttgttgctctttctggtggtgggattgttattctagatgaggtgtttgagatactgccactgattcagctggaaccgagtgcatcaaagcttcagtttcccatctga

SEQ ID NO: 29256 - DNA, 699 bp, Glycine max
  Peptide Sequence Number=SeqID_146034
atgcaggagtttccagagagaggagagttaaagagaatgcagagggagcaagagagggagaggaggcgcatccgagacaggcagaggagacaatcaatgactcaagaacaaagggaaagacatcttgcaaggcgccgcagaaattaccagcttcgaagacaaagagctgcaaatgctcaagttccatattctccttttcctcaacttcaaactctagaatcaagtgcaggtgaagctagtaccagtgatgagcttcaaggtctcacttcttctacctttctagactatggagtcctttctcaaggcctcaaccaagtacaagaaacattcaattttggatccaaagttcttgaaggatcatcaattccgttggaaactctagtttataaaccagccaattcaccaaggaggatgcgcctgaatcatattaaaggtcttgcgcgaaacctgacacattcaatggatgatgatcctgctgttactcaccagttggtagcagagttgatagctaaggaagatcaagatgtatccgccggtaattttggtagcacaccaaaatccttgcgtttgaactgtgtgaagcgtcttgcccgatcaaaaaattctccacccatagagactgcagatcaaaaggaccttaaattgccatcagaagggattcaattacttggtaacgagagcttcataggctctacctga

SEQ ID NO: 29257 - DNA, 252 bp, Glycine max
  Peptide Sequence Number=SeqID_146035
atggagagcaagtttgaatctctgcctatcgcacaggttgaagcacttctccttgctcatgaatctcgtttgaataagagcctgaaagtttttctaatttccgtggcagatctagccgcaacagtagttttggtggcggtttcaaccatagtagtggccagcacggtggcggctaaggccatggtagtggttgcttcgcaaaatttcagtgtcaggttaccaatgaagtcttactccaagcttgtgcagtag

SEQ ID NO: 29258 - DNA, 426 bp, Glycine max
  Peptide Sequence Number=SeqID_146036
ctggatgtgattggtattgatgaagctcaattctttgatgacctttatgaattctgtcttcaagctgctgatcatgatggaaaaacagtaatagttgctggactagatggttatggttggattttacattatcgcgtccacgctgaaggtgtttctacatttactggcaggaggagctttggttccgtccttgatataattccccttgctgattcagtaaccaagttaactgccagatgtgaaatctgtgggaagcgtgcttgctttaccctgaggaagacacaggataagcagattgagctgattggtggtgttgatgtctacatgcctgtgtgtcgccagcactatgtcagtggacaggtagccatggaagccacaaggcatgtccttgaatctcacaaggttgaatgtgcctcccatacataa

SEQ ID NO: 29259 - DNA, 1068 bp, Glycine max
  Peptide Sequence Number=SeqID_146037
atgagcgttcctccgccgtatgcggcggcgatgtggacgccgttcacggcggcacagtggcacgagctggagcaccaggccctcatcttcaagtacctcaaggcgggtctctcggttccccctgacctccttctccccattcgcaagagcctccagttgatgtctcatccatctctggggttttatgggaagaagatagaccctgaaccgggtcggtgcaggagaaccgatgggaaaaagtggaggtgttcgagggatgcgcaccctgactccaagtactgcgaccgccatatgatacggcggcgttaccgttcaagaaagcctgtggaatcatctcaaactcactcttcttcttcttcttcttcttcttcttctgctactgctgcttcttcaaattcaaatcctgttgctggtggtggtggtggttctgttgctaatgtttctggaactgcaactgctgcaaaaacccttcacacccttcccttgcacaccaatggtgcaagggaaggtttcactttcacccttgggaacaacaccaacaccaccctcccacaccttcacatgaaccccctcactctttcagctgacaataccaagaaaacttacagcaaacatggtagctgtgatgttaagttacctaacatgtggatcattatgagggtgagattctgggagtttggactgaactcagaagcagatgagcacaacgtcttacagaaagatctgggaagtgtgaggtatcaaggttatgactttacctcagatgccatgtggtctcaaatgtctcacattccatcaaatactgtttcggaatcaagaagtggttctactatgctgggcaactgcttccaacatcaaacaatgcgagatgctgagctgttgaacctggaaacggcaaggaccaaagatcttgtctttagtggccagttaagttcagctgggggtttgaaacaggaatatcagtctccccagtctctcttcagtgactgggactggaagaaggatttaagttcctctgcccttgagtataagcctaacaaggattttaactgcaacccagatgccaat

SEQ ID NO: 29260 - DNA, 864 bp, Glycine max
  Peptide Sequence Number=SeqID_146038
atgattcaacctttcttctctggcgttaacaagttgagccagttattaaatcccatctctttcattgatttgtcatcaatccacaaattccgttacaatttctctctaaagaagatcgtgaaacaggaattgaaaatcccgagtatgaaacttgggagcaacaagatcaagttctccttacatggctgcaatcgacgctttctacgtcaattctttctcaagttctcggatcatctcatttgtccgaagtctaggagtggattcacgattatttccataagcaaacgcgaaccactgtgcgttagcttcgaactcagctccgaacgcttggaggcaagtcaatgcatgagtatttgtcgcagatcaaagcaattttcagttctcttgctttggtcagaagcccgatcatgctttaggagcatatcgattccatccttcaaggtctctcatcggattcactcaatcatcactattatggagagcaagtttgaatctctgcctatcgcacaggttgaagcacttctccttgctcatgaatctcgtttgaataagagcctgaaagtttttctaatttccgtggcagatctagccgcaacagtagttttggtggcggtttcaaccacagtagtggtcggcacggtggcggctaaggccatggtagtggtcgcttcgcaaaatttcagtgtcaggagcatatcgattccatccttcaaggtctctcatcggattcactcaatcatcactattatggagagcaagtttgaatctctgcctatcgcacaggttgaagcacttctccttgctcatgaatctcgtttgaataagttcaagcaatctctctctgaatctccctccataaactaa

SEQ ID NO: 29261 - DNA, 939 bp, Glycine max
  Peptide Sequence Number=SeqID_146039
atgttaaaggatatggcactgaagttttcaggtgcctacaagcagtgcaaaccttgcacagggtctagtacctacaagaaaggacagaggccatatcctgactttgacaccatttcagaaggggttccatacccttatattggaggtgcaagctcaacttcaacccctgcttgggacttcacaagctccaatttccttggtgctagatcagaccaaagatttatggggggattcagtggtgataggacccctagagggcctcaatcagcaccagcctgtgatgtagttgttgaggatgaggatgaaaccaaggagtggatggcacaggtggaaccaggggttcacattacctttgtgtctcttcctaatggaggaaatgatctcaaaagaattcgctttagccgagagatttttgacaagtggcaagctcaaaaatggtggggtgagaattatgacagaatcatggaactttacaacgtgcagagattcaatcgacaagctcttaatactccttcaagatctgaggatgagcaaagagattcttcttactcaagaatgacatctggacatgatagccccatgcactcaatgtctttaaaggactggacacccaggaatcactataaaccctcagggaataacccttctgaagctatggatcaaggtggtggtggccaaaatttccatgcagcttcatccgtggaagcatcaaggacaaccacctcttctagagacgagcgttcaatgagcaatgccagtgatttggagacagaatggatagagcaagatgaacctggagtctacattacaatcaggcaattagctgacggaacaaaggagcttcgccgtgtcagattcagccgggagagatttggggagggacatgcaaagaaatggtgggaagacaacagagaaagaatacaagctcaatatctttga

SEQ ID NO: 29262 - DNA, 759 bp, Glycine max
  Peptide Sequence Number=SeqID_146040
atgggaaccaaaggagctaccattttggtcactactcgacttgagcaagttgcgtccatcatggaaacccaccctgcttatcgcttgataaaattgtctcaagattacagttggtcattgttcaaacatcatgcatttggaccaaatagagaagagagggaagagattgtagcaatcggcaaagagatagtgagaaaatgcgttggttcgccacttgcaatcaaaacactaggaagccttttgtgtgatgaaattgaggtaacacaatggcagaatataaagggaagaaatttagaggtggaggatgttggaaataaagtgcggagaaaattatacaatagatcattttttcaagaagcaaagttagatgggttaggtatcattacaagtttcaagatgcatgatctatttcatgatctggcccggtctataatgggtgaagaatgtgtgaaattgcaaatattgaaactggaatattttgggtcgcataatttgttgcctaaagacttgacaccattacaggatctaagacatcttgtgatttatagatgtccttcaatagcagatatgcctctcaatattggcatgctgagccatctaagaacattgagcactttcatcgtagattcaaagtcaggctatgggttggatgctaaacaatcaaattttattaaaggtactaatgttaacgctgagctagtactggaaacccttgaacctccctcaactctcaagagttttgggatgagaggatactaa

SEQ ID NO: 29263 - DNA, 480 bp, Glycine max
  Peptide Sequence Number=SeqID_146041
atgggctcaaaaatctaccctaaggttcatgagaaccctagggccttctttagtagctctagcccaagcctcttggagtcttgtatccaatacccttgggggtggcgtcttcaattatctttcttccttctccattgtgctgccattgatcttcaagaagcaaatgacttcattgatgaagaagatccaaggcctataagctccacatggagctacatcactactgaactaaatgttcatgagattaagcactatcttgacggtaggcttaactgggttcctccaagtattggagaattatattaccttaggatgatgttggctgtggttaaaggactgaccacttatgaacaaatttgcacagttaatggtcaactctattcttcatttagagaagcttgctttgctatgagcttcttgcttaacgataaggaatatattaaggctttaagagaagcataccattggggttatggctaa

SEQ ID NO: 29264 - DNA, 147 bp, Glycine max
  Peptide Sequence Number=SeqID_146042
atggaaagtgattcgaagaagtctttgtatccgaggtacaaaaggtcattgacactgttgtcaggggtgttaagtctagttaatgtgaaggtagtgcaaggtttgagttatcacttacaaggattactcttactcattgaaggctag

SEQ ID NO: 29265 - DNA, 147 bp, Glycine max
  Peptide Sequence Number=SeqID_146043
atggagttccacaaaaaaacatttgaaggacaactcagagatgttgacgaagtcttcgaatattgcttgaaaaagagagagctggaaaacacttcagcctcagaagctcagatggcgccaaagaaaggtgggcttgaccggcgatga

SEQ ID NO: 29266 - DNA, 216 bp, Glycine max
  Peptide Sequence Number=SeqID_146044
atggcgagtttgttgtgccgtgaaggaatcgccactgggaatggtgatttggccatgcatggggaaccgccagtcaaactggcgagttccaacaggctttgcaggcgaggtgcagcttttgcaggcaaagttcctacatatgtgtgccctgtgcagaatttttattttacaacatttttgagttatgaattagtgaataacccgccatgcatatag

SEQ ID NO: 29267 - DNA, 246 bp, Glycine max
  Peptide Sequence Number=SeqID_146045
atgatagtgtctgcgatctcctcgacgcatgaggtgtcgacgtggatgaggcgggggtcgaggtcagctgcgagggggtgggtaaacagacctaggtccatagactggctcgcggggcccgcggcccgcatgggttacgaaccaatttttttgaacggtccatggttatgtcatattttcgggcccgccccgcttaacccgcggactatgcgggtttggcccgtggggtccgcgggttgcccgtag

SEQ ID NO: 29268 - DNA, 384 bp, Glycine max
  Peptide Sequence Number=SeqID_146046
atgcttggaagtgcgcttagcacgcttgttgcgctaagcctgaactactctctctttttcatgtgcttgtgcccttgtgcttttgtgctttcttctgcctacacttcaagtcatccttgcatcattcttgctttcatctcacatccttcacttccatccaagttgagttgtaagcccattaggggcaatgctgctaaaagggatgaggacccctgtgtttctgttggaaattgcgatgaacgcactaagcgcgcctgttgtgctaagcccttgttatgtttcatggaggttgagctaagtgtgccctgttgcgccaagctcaactctcttattgtctttaagctttggctaagcgcgtgcctgtcgtgcttagcccatgagtaa

SEQ ID NO: 29269 - DNA, 294 bp, Glycine max
  Peptide Sequence Number=SeqID_146047
atgtttgaaaaatcccttggaggtgcatattattttatctctttcattgatgagcactcaagaagagtatggatatacttattaaatacaaaagatcaagtaattcaagcattcaaggagtaccatgtcatggtggagcgtgaaaccgggaaaaaattgaaatgtgcacaagctaataatggtggagagtatcatgacccttttgaagcatattgcaagacatatggaattgaacttgagaatatgccgccaaagacaccacaactaaatggtgtggtcaaaagaatgaactaa

SEQ ID NO: 29270 - DNA, 771 bp, Glycine max
  Peptide Sequence Number=SeqID_146048
atggatactatcactgatagcttgttgaatgaaaaagctaggaggaaggaacaaggtatggttgtccaatctgaagctatcattgtagaaaactgcaaaagaagtgagaatcgcagaagaagtgcaagtcacaagaaatctaaatgtcgatatctcaagcgagataaaaaaatcgacattgttaagccagaccaaattcatccaaagaaaaatgaggataaaagcactacgaccgtggcagcagatcaagatgacgatgtattcctcattggagaagacaactatcttaatgttgcttgtgatgattgttcatggattgttgactcgggtgcatctttccatgttagcccacatggaggatttttctcaacctaccaaagtggtgactttggtacgataaaaatgggaaattatgtcacaagaaaaatcgtaggcattggtgacatcacttttatgatcgacacaaggcataagctcatgttcaaggagatgagacacgtaccagacatgcgtctcaaccttatctcagtcgggaagcttaatgatgttggtctgatcaatcactttggtgcttgcaaatggaaactcacaaaacacagtatgattgttggtcgaggaaagaaagaaggctccttatatgtcatgcatggaagaatatgcaaaggagaggccaacattgcctatggtgactcaagcatcgagttgtggcatagacaacttggccatatgagtgagaagagattgctaggaaaaaccatgtttctgatgtaa

SEQ ID NO: 29271 - DNA, 237 bp, Glycine max
  Peptide Sequence Number=SeqID_146049
atgagttcaactatcaattatgggatcctatgtgatacaatcctacccccaagggaattggatagaagactccaagaagattggaccagagatgcaagagaaggctcaaggattctcatgagccttaggggaaaactgccaggaaaccacattacaaacgaaacctcaaagaaagttgggcttcgtcctcaaaaggaaacaacaccagaaaaactagccttccatagattcaaatag

SEQ ID NO: 29272 - DNA, 308 bp, Glycine max
  Peptide Sequence Number=SeqID_146050
gctcatacttagcccatgggctcgaaatctaccctaaggctcatgagaaccctagggccttcccttggatctctagcccaatctacttggattcttctagccaatgcccttgcgggataggattgcatcaaaactctctcactttatcactcttgaaggatctcacttgcttgtttgccacaacccggatttccaacaatgaaggaggagtaggagaggagggaggcagtgctagggacactgttggcggtgatggttgtgatgatcgcgatggagagtggaggcacctgaagaagaattttgtctga

SEQ ID NO: 29273 - DNA, 816 bp, Glycine max
  Peptide Sequence Number=SeqID_146051
atgtatggaggacttggggagcaccacacgatgttctacttcttctttgaatctcaaagcagtaagaatgattgtgttgtcatatcgctgactagaggaccaagatgcagcaatgaactaggtttgttttgttcaaatggtccttttcagcttaccaagaacttgtctcttgagtggaatgactatggctgggacaagaccaacccactgggacgggttaagtaccatctctgcctgtgctatctatgcttcctgatcgctagactcattcttcctagttcggcttgttgggccacctcacttaaccaaacatctccgagaagaagttccaccaaatctacaacacttgttgcttcatgctcggttgcatgttactttgttggttcaccttcgaaacagcgagctggagctcctactattcccacgccagcttccactctagctcccttctacctcgaagatcatcagacccagaacccctacataccttttttctaccaaaaggcctgcttggcttcttatttaggttctatcttctgtagattcagcctaggatcaagacttatgttcttggttttggtcaaagagggctttcaacctagaattcctaggcaaagcagtttctttttcaaagagtttcaaaccatgcagataaagcatctgattcagcacccgatgaagcagacactagagcagctactagagaatccacggacgctgaagtctcagttgaacaaaggcagtcgataccataggagaatcaaccaaatccatatcataggaaagcaaaaaaagaaaagctctatcctccgttga

SEQ ID NO: 29274 - DNA, 1563 bp, Glycine max
  Peptide Sequence Number=SeqID_146052
ggtggtggtaacgataatgatgatgatgatgatgtcaacaacaatgacaacgatagagataccaatggtggtcgtggtgacggaggtggcattggtggtggtggcgatgccgatggtggtggcagtgacaacatggtggtggtaacaatgttggtggtgatactggtagcaatgtcgatggttggtgataacggtggtggttgtggtgataatgacagaggtgatattcttattagtgatggtggtagcaatgccagtggtaatggtgatgctggtggcagtgatgatggtagtggtgttggtggtggcaccaagtgtggtggttgtgacgatattggtggtggtgatgacaaatatggtggtgctgatagcaatgctggtggtgatggtgatgtggtggtagcaattgatgatggtggtggtggtaatagtgttggtggttacggtggtggtcacaacgatggtggcggtggcagtggtggcagtaaaaattggactaaacacgcatccaccgctaagcgcagcttcagcatgcttagcgcaatagaagaatctggcagggaatcaatatcaaggtcgtgcactaagcgtgagatcagtgtgctaagcgcaacagcttttacacagcttttacacactttagagaagacccagggcatagaattccacagcagccacaatgcctatttcgggaaaagagatctggaggcagcaagaggagcaacttttgttgagatacctagggtgccgccagtggcactagcgatactggctgacgtggagggagtcgctttctccattggcgagacaaccacacatagggtctcgcctctcccattggcgagacaccttcacggagttgttgaagtggttacgaaatttctgcgagcgtgttcggcggcgacggcggagaggtgtttgagaatgctggtggtgttggccacgtgcgtggagggtcgggcggcgatgacggaggagccgtggtgtgttgcggcggtggtggagaggattacgaaggcgtcaaaggctgcggcggcggacgcggtggcggtgctgtggagcttgtgctgtttatgcaagaacgtgaaggtgaaagatgacgtggcaaagcgaaatggcgtcgtggtggttttgttggttatgcagagggggtgggaggagcacgtgagaagcatgtgcgtggatttgattaaggttttgaagggtgcgcgtaagaacggtggccctctgaaacaatgcattgtgcacaattatccttgtattttctcatatatgaaattggagacccgtgaaggtgtctcgccaatgggagaggcaagaccctatgtgtggctgtctcgccaatggagaaagcggctccctccacgtatcgctagtgccactggcggcaccctccagccagtgcactgtatcgctgttggcaatggcggcttatgctttcttgccattacctttggcgggttccatgcaaaaacgtccgtggattctctagtagctgctctagtgtctgcttcatcgggtgctgaatcagatgctttatctgcatggtttgaaactctttga

SEQ ID NO: 29275 - DNA, 1558 bp, Glycine max
  Peptide Sequence Number=SeqID_146053
atgccatcatgtcgcccgaatttattccccatcttcatcgctgaggacgccgccatgcccggtacaatgcacgtctgcacttgtcgccgtgcgcttcatgacaagcgcgcctctgtcatctgttgttcgcatttcccgctcaccatgcgcgtagcggtagcgccaagcctgagtctcaacaccgcgcgcgacgtggtgacgctggataataccgatttcaccgacgtagccgcggtagtggtctcgctggccgatacacgcagcggcgtgctgacgctgctgcgccagactggcttcaatctgccggtgttcgtcgcgaacgcctttgatgacgcggtgctgacgctgccgggcgtgaccggagagatcaacggcgcagcggaagagtggcaggcgctggagcaggcagcgcaggcgtacgaggcggaactgctgccgccgtttttcgacaccctgacgcgctatgtcgatatgcagaacagcacttttgcctgtccgggccatcagggcggggcgtttttccgccgccatccggccggacgccagttttatgagttctacggcgagaacgtctttcgctccgatatgtgtaacgcggacgtcaagctgggcgatttactgatccacgaaggctcggccaaggatgcgcagaaatatgccgcgcgtgtgttcaacgccgataaaacctacttcgtgctgaacggcacctccagcgccaacaaagtggtgaccaatgcgctgctgacgcgcggcgatctggtgctgtttgaccgcaataaccataaatctaaccaccacggtgcgctgatccaggcaggcgccacgccggtttatctggaagcggcgcgtaatccgtttggttttattggcggcatcgatgcgcactgtttcgacgagacgtatctgcgcgagcaggtgcgccaggtcgcgccacagcgcgcggatcagccgcgtccgttccggctggcgatcatccagcttggtacctacgatggcacggtatacaacgcgcgccaggtggtggatcgcatcgggcatctgtgtgactacatcctgtttgattcggcatggctgggttatgagcagtttattccgctgatggccggttgctcgccgctgacgctggagctcaacgagaacgacccggggatctttgtcacccagtcggtgcataagcagctggcgggcttctcgcagacttcgcagattcacaagaaagataaccatattcgcggccagaaacgcttctgcccacacaagcggctgaacaacgcgtttatgctgcacgcctcaaccagcccgttctatccgctgttcgctgcgctggatatcaacgccagaatgcatcagggcgaagccgggcgcagcatgtggcacgactgcgtcacgctgggcattgaggcacgcaaagcaatcctcgagcgctgcagcctgattcagcccttcctgccggagcaggtgcacggcaagccatggcaggcggcagaaactgccaccatcgccgccgatccggcgtatttcagcttcgaaccgggcgcgaagtggcacggttttgccg

SEQ ID NO: 29276 - DNA, 390 bp, Glycine max
  Peptide Sequence Number=SeqID_146054
atggcaccaaatgcgggggcgcaacgcgggacccgatggtgcgtcttccaaggaagaaaaacatgtggagtcgtcaccaacgtttattcgaggaaaacgtcggaaaaaccaaaatggaaaaggtcaaaggaagcggatgaccataatttgtctccgcgtgccatcggacttgattgtctttggatagtgaaggaagcggatgagcataatttgtctccgcgtgccattggacttgattgtctctggatggcaaaggaagcagatgaccataatttgtctctacgtgccatcggacttgattgtctctggatggagaaggaagcggatgaccataatttttctccgcatgccatcagacttgattgtctctggatggcgaagggagactaa

SEQ ID NO: 29277 - DNA, 1560 bp, Glycine max
  Peptide Sequence Number=SeqID_146055
ccaaacgatcagcacaagctgagcgccaccttcgactactaccacaaaaccaatcacacccactacgatacctgggacagcagcagcggcaacactatctggggcactgcgcaacagcagagcgattcgcgccgctggggcattaatcttgctgatgagtggacgccgtacaacgagatgatcgatacgctgaccacgcgggtttactggcagcaaaccgaggcgcacgacaccacctggttaccgaccagcgccagtcagtacggtttcgtctactctgactacaacgtcgatactttagggtttgacacgcgcgccagcaaaaccctcggccgccacgaactgagcggcggcgtcaacgcgcgcgtggagaacagcgagcgtccgttccgccaggagccgaacccgggcaccttcggcaccatcacccagccgcagtcagacagccgttcctggaccgtggccggttatctgcaggataaaattaatttcgatctcgatagccacaatttcgcggtgattcccggcgtgcgcgttattcatcaaagcaccaaaccgaagaacctcggcgatctgaccaacggcagcacggtgctgaccgcagagcaggtggaaaaactgtacggcaagaccaattcagacaccgaagtgctgccgtcactgaccttccagtacgatatcaatccggcgctcaccacctggctgcaatataagcgcggcgtggagttcccgaccaccagccagctttacggctcgtggaaccttggttcaagctacgccggcagcgcgcagtatgcgctgattggtaatgccgatctgaaaaccgagaccagcaacaattttgagtggggtctgaaaggacagccgaccgacggcatcaccctcaatacctcggtgttctacaacacctacaaaaactttattgcctacacccgctatcgccgcgccaccaacccggcgatgttcgtcaatgttccggccaacatctacaccagctatcaggctgagaaccgcgacaaagcctacatttatggggcggagatcagcacccgcgtcaactacggcagctggttcccgaccgtggatggcctgagcagcacgttcgcgctcggctacagcgagggtaaagcgaaatcccgctatctgggcgacaaatacatcgatctcgacagcgtcgcgccgctgaaagcgattgtcggcgtcgcgtgggacgacaaagcgcgcggttacggcgctgcgctcaccgccaccttcgtcaaaggcaaacaggccagcgccaccaaccgtgagagctacagcaacagcggggcggccatcagcgacgccagcagcgaatacatgcgcgtgccgggctacggcctgatcgatgccaccgcgtactggcagctaacgaaaaacgtcaggctgagcagcggtgtctacaacattaccgatcgtaaatactgggattacctcagcagccgcacgctgaccagcgccagcgcgcaggagcgcaacgacatcaatctggccgtgatgccgggacgcacctggcaactgggcgtgaacgtcgacttctaa

SEQ ID NO: 29278 - DNA, 315 bp, Glycine max
  Peptide Sequence Number=SeqID_146056
atggatgtcttaacattctctaaggctatatttcatggaaatggtcttgttgctattttgtttgggctgtttggaaatgtacttgttgatacattggctcttggacctgtggccccctttgatgttgctttatgttttcttgctattggtatggccatcatactatcttcatggacagagaattttggggatccttcagagaacaaggacttgcttacccaatttaggggagctactatggccattgcttctgtttctatggctctgcattgcagtaagaaaccaggatcagagaagggaacgatagtgctttag

SEQ ID NO: 29279 - DNA, 1052 bp, Glycine max
  Peptide Sequence Number=SeqID_146057
ggtcgcgtgaagctgaaagtgccggcagaaacccagaccggcaagctgttccgcatgcgcggcaaaggcgtgaagtcggtgcgcggcggtgcggtcggcgatctgctgtgtcgcgtggtggtggaaacaccggtcagcctcaacgacaagcaaaaagcgctgctgcgcgagctggaagagagcttcggcggacccaccggcgagaaaaacagcccgcgttcgaaaagcttcttcgacggcgtaaagaacgcgggaccgtcgctgcagggagagaaacgttgccaaacccgactcaccaccgcgctccacaacgcgtgcgcaatgaattacgcttccgtcacatcaccgtcgccagcaaaacgcgggtggccgatgccttctggcgcatcgtctttagcggcagcgatctggcgggtttccactcgccctcttttgacgaccacatcaaagtgtttttcccggatacgccgggcggtgcgctggcgctgccacacatgaccgacgaaggcatcgtctggcctgacggcgtgcgtccggcggcgcgcgactatacgccgctggcctttaacggcagcgattcgctgacgctggatttttacatccacgacggcggcgtcgccagcagctgggcgagtgccgctcagccgggcgatcgcattgcgatgggcggcccgcgcggctcatgcgtcgtgccggtggattatgcctgtcagatttatgtctgtgatgagaccggtctgccggcgtttaagcgccgctatcaggaaatgcaggcacagcagattcatctgctggcctgtgttgatgagccagtcggccgcgcgtatcttggcgacctgccggacgtcacggtgagctggctcggcagcggcaagatgcagactgaggcgctgacgccgctgctggacccgattatgctgcctgctgatgactacttcatctggctgaccggcgaaggcgcggcggtgaaacagctgagcgattattttactcagcaacgtgcggcgcacagcgacctggtgcgcgccgtcgcttactggcatcagaaataa

SEQ ID NO: 29280 - DNA, 1023 bp, Glycine max
  Peptide Sequence Number=SeqID_146058
atggctaagagtgatttttacgagatcttaggcgtctcaaaatccgccgatgagcgcgaaatcaaaaaggcctataagcgcctggcgatgaagtatcacccggaccgtaatccgggcgataaagaggccgagacgaaattcaaagaggtcaaggaagcctacgagatcctcaccgatgcgcagaagcgtgcagcttacgatcagtacggtcatgcggcgtttgagcagggcggtggtggcggcttcggcggcggctttggtggcggcggtgccgacttcagcgatatctttggcgacgtgttcggcgatatctttggtggtggtcgccgtcagcgcgcctcacgcggcgccgatttacgctacaacatggaactgacgctggaagaagcgagtgtgatgtctgccacggcagcggcgccaaagcgggcacccagccgcagacctgcccgacctgtcacggtgcgggccagatccgtgcaacgccctgtcacggccacggccgcgtttgagcgccagaaaacgctgtcggtgaaaatcccgggcgggccgtcgataccgggcgaccgtatccgccttagcggagaaggtgaagcgggcgaacatggcgcaccggctggcgatctgtacgtgcaggtttcggtgaagaaacacccgatcttcgagcgtgaagataacaacctgtactgcgaagtgccgatcaactttgccatggcagcgctgggcggcgagattgaagtgccgacgctcgacggtcgcgtgaagctgaaagtgccggcagaaacccagaccggcaaactgttccgcatgcgcggcaaaggcgtgaagtcggtgcgcggcggtgcggtcggcgatctgctgtgtcgcgtggtggtggaaaccccggtcagcctcaacgacaagcaaaaagcgctgctgcgcgagctggaagagagcttcggcggacccaccggcgagaaaaacagcccgcgttcgaaaagcttcttcgacggcgtaaagaagttctttgacgatctgacccgctaa

SEQ ID NO: 29281 - DNA, 393 bp, Glycine max
  Peptide Sequence Number=SeqID_146059
atgccagcttcccccgcttcctcccccgcccccctgactcccgccgcgcgccgctacgcgatgctggccgtgtccctgtcgatctcgatggcgacgctcgatacctccatgaccaacacggcgttgccgtcgatggcgtcgcagttgggcgtcggcgcggccgacgtgatcggcgtggtcaccgtctatcagctggtcatggtggcgacgatgctgccgcttgccgcgctggcgggcaagatcgggcaccggcgggtgttcctgccggcgctgtggctgttcctggccgcctcggtctggtgcggcgcggcgcagtcgctgtggtcgctggaagcggcgcgggcggcgcagggcctggccgccgcggcgctgatgggttgcaacatggcgctg

SEQ ID NO: 29282 - DNA, 564 bp, Glycine max
  Peptide Sequence Number=SeqID_146060
atggcaatcttagggttattggtggcagtccatgttggtggttctttaaggaatgaggagtttgcatggaatcagccatcccttgatacaacatggtcaatgacttggccaaccaacatcttggtattttctggtttgcggctttgtatggaagggtgtggtgttgtcttaactaagttcagaggctatagtggaagggtcattgaggtcatgaagaagccagcttctgggaagagaaagtgggggtggcaaaactcaggtctgataagcgcaggcttgattgaggtgggcggttggcattgtcacagccccagtttatttaataataccatccatcttgctcttcctttccagtttcatggattgaagttgaagtcgcattcttctatgaggtgctcgagagttgtttatataacattttgcataggtctttttatcattagtgctcggggaggccgtaaagctggctacactcgtgggtctttttatggggtccccgggagttgttatataaattttatatgggtatttcatcattggtgcctagggaggccgtactactga

SEQ ID NO: 29283 - DNA, 209 bp, Glycine max
  Peptide Sequence Number=SeqID_146061
ctcagcctcagtcagcagagccagggtttcgctccttttgcgtgcctactctagatcagtttagggctgagctcgcatggcccggagattggcctgaggaccagacagaggaggcacctgcaggagctcccgacggtgcagaggacacccgcatggatgaggagatgacagatttactcggcttcatgagaggaagcggagccacgtga

SEQ ID NO: 29284 - DNA, 207 bp, Glycine max
  Peptide Sequence Number=SeqID_146062
atgacggagattgcagaggtatatccagaaaccaccataaggaatgtggttgtccctgtgcctgtttacctcaatgacccacaacgtcaaaccaccaaggatgttagtgtcatttctgggctcaacatgatgcaaactatccacgtgtctaccacggctaccattttttatgggctcggcaagaaggccattagattcatgggttga

SEQ ID NO: 29285 - DNA, 435 bp, Glycine max
  Peptide Sequence Number=SeqID_146063
atggttgcctcccatggctgcctctacctctactccggccatgccataccataccacccgctagaccacttcttttggttgcaacctcttcacacagccatccatccacaaccacccttgcaggagccatcccttctatctcagcacccacattctctttatgtacatccaactcaatcctttgggattgattttgagagtacccggatccgcttgctagccttgtgcggtaccacgactctgcaaactgtgcggaccatgccgacttcgccttccatggattttacagtgacgctggaacaccaaaacacaggcacttcctccattgtccacctactcgccaacagcaagccccacacgccaatgcccagtaaagaagatgatcctcctagtagtgtcattgtgcaaacgacgtaccctagcgtcgacatctag

SEQ ID NO: 29286 - DNA, 228 bp, Glycine max
  Peptide Sequence Number=SeqID_146064
atgtcaggacatcgtgtccgacatcgtggatcctgcagcttcacttctgcacttgacttttatcttgcattgtacagcaactccagtattctcgggcaggatcaacttcagtattctcgggcaggatgtcaggacattgtatccgacatcgtggatcctgcaacttcaattcttcatttgacattttatcttgccttgtgcattgtgcagcccgatcttattccttga

SEQ ID NO: 29287 - DNA, 576 bp, Glycine max
  Peptide Sequence Number=SeqID_146065
atgaagcgaaaagctagtgagattgataaaagcaagattgaaaagagcagaggtgataaaggaggatttggtccattacagttaatgggctctggaagaattgaaaatagctttagtgatttgagcatatctagcagcggaactggttttgaaagtggctctggttttggattgacttctgatgtcgattcctttgcaaccaagcctaaaggtcatccaacttcatcagccactgctccacctaaaggtcttggaatgaagctaggtgaggtcattcttgaagatgttcagccaaaacactctgagtcttgggttgtcgccccacaacttactgatcctatcacattgactgttgaggagaaactaaatataatagcaaggcaaagctggtctgattctgttactgatatcaggcgtaatcttgaagataagtgggtggcttctgcacttttctgggcctatggttgctatctgcacccctttgtgtggtattgctatcattacccaccgctggaaaaccaaccttatcctcaaggttgggcaataaaaacaagcagatacagggggtgggtgtag

SEQ ID NO: 29288 - DNA, 210 bp, Glycine max
  Peptide Sequence Number=SeqID_146066
atggagaatatttttggtttcaagtctgcttatatattaaagcaagacagtttgccaacttcatataaatcctttctcaataaacatggtggaaaggatccagttatcttacaaggtgtaaaagatatagccagtggcaagcctttcactaatttgggtgcaattgagaaatactacaagaccatgggtatcgatgtgaaattaaactga

SEQ ID NO: 29289 - DNA, 348 bp, Glycine max
  Peptide Sequence Number=SeqID_146067
atggccaaaatacagggcccaaaagaagaaaaaacatattctaatatttacaaagaagagtggacccaaccttggtccatgggctcagaaatctatcttgaggttcatgagaaccccagggccttctttagcagctctagcccaatcctcttggagtcttctatccaatacccttggggacttttttcagatccactccatggcctcccatctccagccaagcacttcttctctgatgattgcaactccaaggataaccactttatctttgtggaagcaaagcttcatgatgaatcaaaaatgattcaaaggtgttttgatgataacaatgatgacaacaaaagatga

SEQ ID NO: 29290 - DNA, 345 bp, Glycine max
  Peptide Sequence Number=SeqID_146068
atggaaccagaattggccatgatactttacacttatagaacagtctttgatttgccatcaggattaccccctagcagaactcacaatcattcaatcccattggttgaaggtgctggaccagaagggattattgcccctagcagaagccctttttcacctccaatcattcttgtcaagaagaaggatggcacttggatattttgcacagattacagggccttgaatgccatcacaatcaaagatagctttcctattcccactgtagaaaataaaaaagaagttcaatccatatgcattgaagtaattgaactatgtatggttcataaaagaaataagcaatcttaa

SEQ ID NO: 29291 - DNA, 379 bp, Glycine max
  Peptide Sequence Number=SeqID_146069
atgggatcaagtcaaaagccttcgcttaaaaagaggttttatcaagtcaaaatcaagagcttagaggtcaccagtttacgaaagttcgggcaattaatgggtcaacttcaacggcaagccttccgcaaagcctatgccgttgaggtgcttcatctttggggacttccagctatcaccaatggaattagaccgccaaaggcaagtcgaaaatggggtggtcggaataccgagaaaatatttggagggagtcctctttccaaatgtggatgggttggtggacctggcagcgatcgacgtttttctcggcctatcataaccacaagggaaagtccggttgtcgctatgctagccgacctatatgacaccttcgaccgaagat

SEQ ID NO: 29292 - DNA, 219 bp, Glycine max
  Peptide Sequence Number=SeqID_146070
atgtataaatgtgtggtaactagaatgtgttggatgtccttgtatgttgatgaaatggctccgaggaagctttcctcgaagagatctaggaaggacgctgcggccgcagggactagtgctgctcccgagttcgatagccatcgtttcaggagcactgagcaccagcagcgtttcgaagccatcaagggatggtccttccatcgagagagacgcgtctag

SEQ ID NO: 29293 - DNA, 867 bp, Glycine max
  Peptide Sequence Number=SeqID_146071
atggcatctggattgtcatccgagaacatgttaaccacaaagctgttccagccgtgggcccgcgccgtctcttcgatagagagcgttatctctactgagaatggagtggtcaccgtatccagtgccagcacgccgatggtgctcggtgttgcccgggcgccgcgaattttcttcgccgacagcgcgcgggataccgtcatcagtgagacgttggctagcttcgctacatctttcagggatgccatggtgattactccggaagtagggctgaaagccggggataccggcattatctacgcggtgctgtcggtctcggcgctattcgcccagatttgctacggctttatccaggataaactggggctgcgcaaaaatttactctggtatatcaccgtcttactgatcctttccggcccggcctatctgctgtttggctatctgctgaaaatcaacgtgctgctcggcagtatttttggcggcatctatatcggcctgacctttaacggcggcattggcgtgctggagtcctataccgagcgcgtggcgcggcaaagccagtttgaattcggcaaagcgcggatgtggggatcgctgggctgggcggtggcgacctttttcgccgggctgctgttcaacattaacccacaactgaacttcgccgtcgccagctgttctggtctggttttcttcatgctgctggcgcggcttaaggtctcttcagcgccgcacgccatgcaggaggcggtcagtggcggtaaagtcacgctggaagacgcgctgcgcctgctgacgctgccgcgcttttgggcgctggtgtttttcgtcgttggcacctgtatttacggcgtttacgaccagcagttcccg

SEQ ID NO: 29294 - DNA, 444 bp, Glycine max
  Peptide Sequence Number=SeqID_146072
atgatcaacaagccaccctcggtggaggaaatcactattccttccgttacagaactcttgaatgctggggttcgtttcttacccactattggaagcatatcaaacattagttttaatgcgaaaacatgcacgttttaccttcccgcaataggtttggatgttaatactaaagttttcttgaaaaatttggttgcatatgaagcatcagttgcattagggcccttggttataacccgttacactgagttgatgaacgggattatagactcagaggaggatgcaaaggctctgagagaaaaagggatcattctgaaccacttgaagagtgataaagaagtggctaatctgtggaatgggatgagcaagtcgttgagattgtcaagggaaccattgttggataaagtcattgaagatgttaacaaatattataacggtagaatgaag

SEQ ID NO: 29295 - DNA, 255 bp, Glycine max
  Peptide Sequence Number=SeqID_146073
atgttgattgatgttggaaatgcattggcatgtgcatgttgtgtatgttcgtggggggcactgtgcactgaccttccagggtctttggcactagcttttggccacgaacatacgttgtatggagtgtatgtcatgggggggggcttgtcacctggtagggaacacctttgggctcccaggctgatcacctatgggagggggctgttacgtgcacaccgggtggtctcgacaaactcagcacagttccctaagtga

SEQ ID NO: 29296 - DNA, 147 bp, Glycine max
  misc_feature (132)..(132): n is a, c, g, or t
  Peptide Sequence Number=SeqID_146074
atggtgttgattacacctctgatgtgctggcggattcctattctgtcttctcttgtctacttcttggttcttgtgttgctcctcttgatgtcctttaggccttactccttcctggtagtggtctggtctctnaacaaactgggctaa

SEQ ID NO: 29297 - DNA, 639 bp, Glycine max
  Peptide Sequence Number=SeqID_146075
atgaaggacagtccaaccagtcctgaaagcagcacctacacactatctgggacatcaacattaattttgtcgacacctcctatagcgaagtgtccctcctatcacctttacggcacaaggacttcaggggcatcaatctcgtcaaccaagacaatcacggtggttgtctccatcatcatagtgaatttcatgagactcgaggtttcacccgacattgtccacccttacgcaagtccactcctcggctttataggcgagagagtcgaaacccgaggctatgtggacttaatgaccaccttcggtcagggcaagctctctaggagcttcaccatcagatatctactggttgacgcgaccacatcatactttgccttaataggaagaaagacactcaaggaattgggagccatatcctccatgccccatttgacaacgaaattccctacactgacatgggagattgtaatagttaaggctgaccaaaaagacctctccgctcatgaatacatgtgccttgctgacatgctacgcaaaaacattgatctctttgcctcgcaaccatctgaaatgtcgagaatccaccttgacataatcttccaccaacttgctatctggccccaggccaaacaagtatcatag

SEQ ID NO: 29298 - DNA, 210 bp, Glycine max
  Peptide Sequence Number=SeqID_146076
atggcaaaggatctttctgctttgcacaagaaaggtacttgggatattgtccctcttcctccaagaaaaagagatacacaactcgcttggttgccaagggagtttctcaacagcatgatccagaaacaaagccaaaaggaagggcaaaatggtcttttcataaagatttatgaccccaaatttgcccagactagcaaccagctcgcctag

SEQ ID NO: 29299 - DNA, 312 bp, Glycine max
  Peptide Sequence Number=SeqID_146077
atgaagcttcattctctagctagttaccttagccaggagatactggcagagcaagaagttgatagagtgcatggattacctgcgcagcatccggtgaagttcaacaatatggtggttatatcactgtcaatgaaactcaaggaagagcactgttctattggtttttcgaggccactcacaaaccagaacaaaaacgcgttctcttatggctcaatggagaatcacaaaccagaaggtcaggaagtgagtgcagcaggagtaaacattgataatcacatgaatgaaggcagtggctggattaactcagcataa

SEQ ID NO: 29300 - DNA, 486 bp, Glycine max
  Peptide Sequence Number=SeqID_146078
atggcgagatacatttcattaggaagggcacacaacctccacgaaagcgtgattctacgtttggtcgccggtgacaaaaacaccactttcaccgttcatattgacggacttgcacaccaccactctaacctaaaacccatcatttatagaaggagatacatctttactgttgatatcacagatgatatgctacaacagaacctacctttaacacttcctgcagcggcttccaaatttgtgtatggctccaaaaaaagtattaccatccaccacagactttcaaaatccaccaaatggccactcaccatccaccatgacgtccctgccattacacaaccatggttcaacctaattcatgaaaaaaatttaaaagccggagatgaggtagtcttttactaccgttttcatgaccatgcatgggagctgctgataaggaaagccatcgaatggaacaacagcaacaccgaccccgactctgatgattaa

SEQ ID NO: 29301 - DNA, 345 bp, Glycine max
  Peptide Sequence Number=SeqID_146079
atggaaccagaattggccatgatactttacacttatagaacagtctttgatgtgccatcaggattaccccctagcagaactcacaatcattcaatcccattggttgaaggtgctggaccagaagggattattgcccctagcagaagccctttttcacctccaatcattcttgtcaagaagaaggatggcacttggatattttgcacagattacagggccttgaatgccatcacaatcaaagatagctttcctattcccactgtagaaaataaaaaagaagttcaatccatatgcattgaagtaattgagctatgtatggttcataaaagagataagcaatcttaa

SEQ ID NO: 29302 - DNA, 236 bp, Glycine max
  Peptide Sequence Number=SeqID_146080
agcccttcaagaaaaggtcgacgacaatcccggagaagccgttggggatgatggcgtttacggcatcgccgatgtaggcaatcctggtccctctcaaggtggagaggttgaagtactctcgggcgaccttgatgatagtagggtcgagctcctaacagtggaggaggacagatgggtggtggtggaggaggaggcgggcagcgatgctggcatcgaagccgaggagggcgagggag

SEQ ID NO: 29303 - DNA, 354 bp, Glycine max
  Peptide Sequence Number=SeqID_146081
atgtcattgcctagagctgttcatgtgtcctccaccttcgagtctggagccccgcgaatatcatttcctagcgctgttcgccaattctccattctccactgttttcggagccccatgaatgtcattgcccagcaatgttcatgcatcctccaccttcgagtctggagccccgtgaagttattgcatagcgctgttcgcaaattctccattctccactttttttcggagccccatgaatgtcattgcctagcgctgttcatgtgtcctccaccttcgagtctggagccccgcgaatgtcattgcctagcgttgtttgccaactctccattctccacttttttcggagccccatga

SEQ ID NO: 29304 - DNA, 809 bp, Glycine max
  Peptide Sequence Number=SeqID_146082
cagctttttccggtgctgggtgcccaaggcacctcggcattgcgcgtgggctttgccgcgctgatcctggtggccatctggcggccctggcgctggacgctggcgcggcctcaggcctgggcgcttctgcgtttcggcgtggcgctgggcgccatgaacctgctgttctacatggcgctgcgcaccattcccttcggcctggccgtggccatcgagttctcggggccgctggccgtggccatctaccactcgcgccggcccgtggattttgtctggcttgcgctggcggtggcggggctggccctgatcctgcccataggcggtgccagcgccggcgccctggtactggagcccgtgggcattgcctgcgccgtgggcgccgccatctgctgggcgctgtacatcctgctgggccagcggctgggcagcattcccagcggccaggccgtgtcgctgggcctggtgttcgccgccatggtggtggtgcccttcggcgtggccgaggcgggggccaagctgctgcagccatccatacttcttttcgggttgatggttgcggccatctccagcgccttgccctacacgctggagatgatggcgctgcgccgcctgccgcccgcaccttcggcatcgcgctggcaacggagcccgcgatagccgccctcatgggcatgctgctgctgcatgagcaactggtgggaacgcagtggctggccattgcctgcatcatgggcgcggccatgggcagcgccatcacgcggccggctgctgcggccaaggcgccggcggaggtggcctccgcaggctga

SEQ ID NO: 29305 - DNA, 900 bp, Glycine max
  Peptide Sequence Number=SeqID_146083
atgagcagaaaattcgattatctcggcgatgttgaggtcttcattactgttgttgaacatggctcctttaccgctgcagcggtcgccctttcaaccacgccctcagtgttgagtcgtgcggtctcccgtcttgaaatgcgtcttggacgacagctattgcaacgcaccacacgtcgtgtggggctaacggaagccggacggatttatcttgagcaggcgcgttctgctttttccctgcttgatgacgccgaacgcgatggccgggggcaggagggggatctgactggccgggtacggatcagcgtcccgaccacctatgggcattattgtctgccgcccttgctggcccgcttttcccaacagtttccgcgcgttcaggtggagctgaacattaccaatcgcaatgtcgacctgatcgctgagggattcgacctggctattcgcctgggtcaaatgcctgacagtggattcgtcgcgcgtaaattgcaggatgcggcactgctgttggttgcttcacccgcttaccttcatcgcatgggaatgccgcagacgctcgatgaactgcggcagcatatgtgcctgccttttattatgccgtgtaccggccgtattgcgccctgggtatttcgcgtggatgagcgggatgttgactggcagccagattcaaccatcgagatttcagatgatgtccttggcgtggtttcgctggctgaacatggaataggggtctgtcagagctacgaattcattgtccgcgagaagatacagcgcggccagttagttgagatacttccgcaacttcgtggacgatcgcgacctttctcgctcatctacgcgccccatcgacgccagtcagcagccacacgggccatgattgatcttctggcgtcagaacaatga

SEQ ID NO: 29306 - DNA, 261 bp, Glycine max
  Peptide Sequence Number=SeqID_146084
atgtatgatacattgcaaactgattcgaagaagcctttgtatccgacatgcaagaattccctgacattgttgtcagtagtgtttgggttgtttaatgacaacttccccttgtacataaagcatgaagatctgttcgaaatagcacacggtggtcaatgtcttagcatctctgttatacaattgtggatttttgctttgaaaggacttgacgatactccacaaagtaaatccaaggttgttgctaagtggattgttgttaaa

SEQ ID NO: 29307 - DNA, 198 bp, Glycine max
  Peptide Sequence Number=SeqID_146085
atgctacaatgcgaagggcttttctctaagctcagatatgattttgaaattcccaacggtgagactgtttggaattgggttacgaacatgatattcaaatttcacgacgatccaacggtttggtgggctgcgggaagaagaaagggttttgagaggagaagaggaaaaacgaaaatgaggccaaaaggaggcagctga

SEQ ID NO: 29308 - DNA, 151 bp, Glycine max
  Peptide Sequence Number=SeqID_146086
atggtggtgctggggcatgcgcagacgccgctggagaaagccctgggcttcctcgccgtggtgctcggtgccggcaacgccgccggtggctacgtggtcaccgcgcgcatgctggaaatgttcaagccgagcgcgcccatagggtggccat

SEQ ID NO: 29309 - DNA, 564 bp, Glycine max
  Peptide Sequence Number=SeqID_146087
atgccgtggatgaagttggagcccgacatcagcggggtatgcaggatcaccggcacccgagaaatgatcacgtggccggtgatgtccgccagcatgaagatgtacagcgccacgaacccgtcactcactggcaacgctcctgctctgtcttcgtcgtcccatcataaccatgggctgaaccccgcgtgcacccggcgtcaaccgaagcggcgctcacgcgttgtcgatggtgaccccgagcgaggaaccgtaccctgtgctggtgagcagccccgtccccccgagcgccgagaccgatgccccgccggcatcgctggaggcgttcctggccagcgtcggcccgcgagcgttccgcttcgccgaggccggcctgcgccagcgcgaagacgccatggacgcagtgcaggacgcactgctgcgcatgctggactacgccgacaagccggcggccgaatgggcgccgctgttctggagcatcctgcgccggcgcgtgatcgacacacagcgccggcgccgcttccgcctgccgttctggcgcgacaaccaggacgcggaaggcggtga

SEQ ID NO: 29310 - DNA, 246 bp, Glycine max
  Peptide Sequence Number=SeqID_146088
atgacgacgttagcctctgcatgctaccagactttgagtctgacgaatagcgaaatagtatgtgcgggttaccgtatagggcatcttcgtgtgccaacggattcacaggtcacgatagcaaaaggtggggtggtcgacaaaagcagggctttcgctcctacgtatcctcaatttgtgatgaggaactcagacctacgtagttcttgcttttgtgtgactaaaatattctcggtgttccttcactaa

SEQ ID NO: 29311 - DNA, 771 bp, Glycine max
  Peptide Sequence Number=SeqID_146089
atgatgctggcgacgcgaattttgcaacagggcgaggcgggccgcccgtggctggtgtggctgcatggcctgcttggcaacaacaatgaatggcgggtgatcgccgcgcgcagcccggaatggccgtcgctggccatcgatctgcccggccacggcgattccgtggcggtgagctgccgcggcttcgacgacatcagcgcgcagatcgccgccgcgctgcagctgcgcaatatcgaacgctattggctggtgggctactcgctcggcgggcgcatcgccatgtatcacgcctgccacggccaccatgccggcctgcagggggtgatcgtcgagggcggtaatccggggctggaggacgaagaacagcgccgccggcgctgcgaacaggatgcgctgtgggcggcgcgttttcgcagtgagccgatcgccgaggtcctggcggactggtatcagcagccggtgttcaaagagctcagccacgtgcaccgccaggcgctgatcgccgcgcgctcggtcaacagcggcccggcgatcgccgacatgctcgaagccacgtcgctcgggcggcagccctatctggcgccgcagctacgtcaactgaccgtgtcgctgcgggtgctgtgcggtgagaacgaccccaaatttcaacggctggcgcgcgacgccgggttgccgttgcgcatcgtgccgcaggccggccacaacgcgcacctggccaatccgcaggatttcgtcgccgagctgcagacctttctcgttaaccctggttaa

SEQ ID NO: 29312 - DNA, 168 bp, Glycine max
  Peptide Sequence Number=SeqID_146090
atgggtgaccaagaggagtttggggcagaggtcgcatggcctggagactggcttgatgcccaggcaggagaggagcctgtaggatcgcctggtgaggcagaggagtcccgtatagatgaggatatgactgatctgctcggtttcttgggagggagcggagccacgtga

SEQ ID NO: 29313 - DNA, 690 bp, Glycine max
  Peptide Sequence Number=SeqID_146091
atgacgctgccgctggagcaaggcctggcgctgtcggctattccggtgatcttcacctctttcggcttccacggcagcgtgccgagcatcgtcaactatatgggcggcaacattcgcaaactgcgctgggtgtttatcatcggcagcgctatcccgctgatggcctacatcttctggcagctggcaacgctgggcagcatcagctccgacaccttcgtcggcattctggcgcagcaggccgggctgaacggtctgttgcaggcggtgcgcgacgcggtggcttcgccgcacgttgaactggcggtgcacctgttcgccgatctggcactggcgacctcgttcctcggcgtcgcgctcgggctgttcgatttcctggccgatctgttcaagcggcaagacaacgtgcgtggccgcctgcaaaccggtgccatcaccttcctgccgccgctggcctttgcactgttttatccgcgcggcttcgtgctggcgttgggattcgccgccatcgctctgtcggtgctggccctgctgttgccttcactgctggtatggaaaacgcgccaaaaacatcaggcacagtatcgcgtctggggcggtacgccggcgctggcgttggtgtttgtctgcggggtgacggtgatcgccattcaactgggcatcgccagcggcatgctgccggcggtggggtaa

SEQ ID NO: 29314 - DNA, 258 bp, Glycine max
  Peptide Sequence Number=SeqID_146092
atggcttctatggatacctctgctaaggtcaactctaagatctttccatgcaatataggaatgcgggggtccggggaattcatccccttcttagacacaacgtctaggggtagcaaagtgccccaacgtacgtttttaagaaggcgacacggaccctccgtgggtttgtttacacaagggatcaagacagaacccatatgcgatgcctatgcaaaagacacaatgcgggaatgtacacagtatgacgatatttactga

SEQ ID NO: 29315 - DNA, 189 bp, Glycine max
  Peptide Sequence Number=SeqID_146093
atggagaggtgtaatctccataaacgcctcaccaatttggttgatgggagcatagatttggctttggtgctgcccacagactacagagagattgaggctgccttatgcataccagggcgagggttcatcttgaacactgagggccatcctaggaggattctcgggaaagatttgactactttagcctag

SEQ ID NO: 29316 - DNA, 609 bp, Glycine max
  Peptide Sequence Number=SeqID_146094
atgccaatctccccctgcagatgtatcgttgatctgtgccgtcatgacataggtaaggttgcgcccacaagacgcccagtggacccgaagaagtccaacagggccctggggtttccagctctggttacgggcctctgtcagtcctacagggtgcccgtccccccagcgaggtcatgccatcgtgacataggtaaggatcgcgcccacaagacacccagtggacccaaagaagtccaacagggccctggggtttccaactctgattacgggcctttgtcagtcctacagggcgcccgtcccccagcaagttcatgccatcgtgacataggtaagggtcacgcccgcaagacacttagtggactcgaagaagtccgacaggtcttggagttgccagctctgattacgggcctttgtcagttctacggagtgcctgtcatccccagcaaggtcatcagcccccctactaatcgagctttcatcaagaagtactgcgtccccaagcaggcgcagggcgaaacaccacagcagcctggggatggccggcagcgagcaacagacgcatcgccatcacctctagagttcacctcagctcatccacaaaaaggttag

SEQ ID NO: 29317 - DNA, 360 bp, Glycine max
  Peptide Sequence Number=SeqID_146095
atgcatagccacaaggaggaggagtcgaatgaaagaaagagaaagctgcaggagcctgtgcttgtgcctgtgcagaaggcagattttgtgaggacattgttgattgacaactatgacagttacacatacaatgtataccaggaactctctattattaatggtgtccctcctgtggtgatccaaaatgatgattggacatgggaagaactttgccattacttatacgaagaaaatgcttttgataacattgtaatatcacctggacccggctctccagcatgcccggaagatataggtgaggatctcagaatgcccttgtggattgataatttcactacatttgcttcatgcttcaaatga

SEQ ID NO: 29318 - DNA, 573 bp, Glycine max
  Peptide Sequence Number=SeqID_146096
atgctgcagctctcgtcaaacgcgcacggcgatgtgttctccgccgcgcgagggccgttgttcgccgcgagactggcgctcgccgagcgcgtgttgcgctccttcgtgacgcacgcgtctttgattcgaaagatggacaccggagccaaaatgcgtctcgttaaggaatgcgacgaaatttcacacgcggtggcgacgcatttgcgcgtctccggaagcgaggccgactcgtcggcgttcaaatccatcaaagcgttcaagtcgttggtgcttcttccgacggaaaacattgaggcgtcgccgctggtgagggacgtcgatccgcgctcgctcttgcaccatctgtattcccgtgcgcccgccgacgcgctgtcgacgcccgccgagcgcgcatccttgaatgcagcccaatacgcgtcgcggcttttgaacaagatgaacgacgccgaagtgtggcgaggagtcaaggcgacgctcgacgtctacgacgaaaccgcgaaaacgggtcgagacggcgccgacgccgtggtgacgctcatgcgcgccgtcggcgaacggttggcgaaaaagtaa

SEQ ID NO: 29319 - DNA, 486 bp, Glycine max
  Peptide Sequence Number=SeqID_146097
atgcggacggtacgagtcgttggcagcgacaaccgcaaggtgataggtctgcgatatcccgcttctctgttgccttacgtcaaagaaacagtcgaaatgcaatgggcggaaaaatttaccgatccttcgtcgttggcgctgctcgacggcgacggcgacgaaaacttgaatgccatactgggcgtcaccgtcgaagctccgacggcgatagatccggtttcgtttgcaaaatgttttagaaaaacgcaaaccatcatggactttttcggcggcgcaacaaagacgaagcacgcacccgtggatttgacggcgacggacgatggcgggcgctcaaagaaaaagaagaaatcgacgaaccctttcaccgtcgccgccagcgcggcgaaaacgtgttgcgtgtgcggcaagaaatttccagcgacgatgctcaacgccgaaatgaacgcgcacctagacaaatgcctcgccgacggcgaaccgctatga

SEQ ID NO: 29320 - DNA, 423 bp, Glycine max
  Peptide Sequence Number=SeqID_146098
atgaaggttgaacaactctttgcttgccatcatattagcgaagaaagaaaagttccattggctacccttagctttcgaaggtatgtcctatattggtggacttcccttgttagggaacgaaggattcatggggatcctctagtaaagtattggaatgatcttaagagtgcccttaggaagagacactttccctcctactatgaaagggagcttatggacaagctccaaatgcttagacaagggagtatgaatattggagaatatagagaacaaatggaactactccttttaagagctggacttagggaggaggaaagaacaagcatagctaggttccttagttggcttaatatggaagtgagggacaaggttgaactccttccatatagggacctagatgagctagtccaactttgtatatga

SEQ ID NO: 29321 - DNA, 426 bp, Glycine max
  Peptide Sequence Number=SeqID_146099
atggatatgaatatggggtacctcatctcccaccagatctctcttactgcacaacatgattcatccagacttggattccctgccttgatcacagctctatgcaaggccagaggagtccaattagattctagatccctggagagcctgagccctaccattaacttggcatatattaagaagaaccgttggaatctagatgatccaatagtgacatttagagggccaaggaaggccaggggtaagagatcagaggtccccactacttcagcaccaccagagacagcagctccttcttcttccacagctctagtacctcccattcagactctagctattcctcaagcatctactcagataccacctccagctcctttatcttcagggccttcatatttttcatttacaccacagattgttagtgcttag

SEQ ID NO: 29322 - DNA, 231 bp, Glycine max
  Peptide Sequence Number=SeqID_146100
atgggggagacacatgaagcaccccgagaccacaatctagctgacttcgaaccttacctcggatatgccactgagggggaagtagttggtggtgtacccctgccaggcactttagggggccctcaatttcgcccacaaccacaacccttgcattttacgatgggagaagtccctcctgcatggggtatttctcttgttcctacgtattcctcaattgcgatgaggaaataa

SEQ ID NO: 29323 - DNA, 341 bp, Glycine max
  Peptide Sequence Number=SeqID_146101
atggaacctaccgcagggaagcccggttctctccggaaccttctgatacggtttctcctcttcggcgttttggtcatcggcgttcgtttcgcttacctcatcgccgtcgccggcgagtcctgcaccatagacgacttctgtttcttctctctgccggacactctcagcctcgtcattgccggcactggacctctcgccgtcgagtctgcctccgccgccggcggtttggtgcagccggagctttacaccagcaaggactggatcaacggcgttcggttctactcgtcagcgttccaggacctcatcgccggcggctacctctcgccggagtcgaagactct

SEQ ID NO: 29324 - DNA, 387 bp, Glycine max
  Peptide Sequence Number=SeqID_146102
atgcttcagagcattcatcagggacaaatcattttacttcagagtttacaggtggtggcgcctccaggatccattccttccattgagcagttcctggagagggttagaccagagactgccaccactcttgagaggtctcttgagggcacttcagagccccttgctctagtggtagacctctcctcaccacaacctgcaactgacccctttactcctgtagttgataagctagaggaccagatgattggaaggcaaaggagaagaggagaggggagacaccatccactagggaataagccatggaagaaggagcttcaccaccaagaatgtgccttggatgagaagcttgaagaggatgctttaatggaggaaaagaaagagagatga

SEQ ID NO: 29325 - DNA, 234 bp, Glycine max
  Peptide Sequence Number=SeqID_146103
atggacgacatcaacgttgcaaccctaacaaattattgtgcacacacatgctatttacgacacaatgaaaggaaagtggtgttatcttgcactgaacaaccatgcaactacgattattccaggttcattgttccattggcttttgacgtagccacacatagttcttacttcttgcaaaggctcttggtagttgaagagagactaaatgcacgagaaaaaaagatcgctatgtga

SEQ ID NO: 29326 - DNA, 192 bp, Glycine max
  Peptide Sequence Number=SeqID_146104
atgacagtgaatgtgttggtcgagaacgacgacccacaacccaaccccatttgggaactcactgttgatgggcccttgtcaccatcatccccacctatcgttgttggttatgagtggatgagggacgatgttctaaagtgtctgtttgaggtcttgggtctcattcttcccttaaccacttttcactgttga

SEQ ID NO: 29327 - DNA, 1068 bp, Glycine max
  Peptide Sequence Number=SeqID_146105
atggctgggctatatcagtctgacattgagcatcaaggtgacttgttgttcgagttcagttttttggaaatgtgggtagcgatttttggaaattgggtgatgatggaagttatctggggaggtgtaggtgtctcgtggaagtgtaacggggaggatgaagtactggggcaagtgaaggaattgagcaacgtggaactggataaaattatgagtactgcccttgtcgaccaagataacaaggcaatgctgggtcgaggtggtccgagtgtaaggaaagggtgtcagaacttgatgcaaagggttcgatgtcctcatcggcaattaaaatatgcaatcgaggtttacaatgatggccaggaatccatttgtcatcccaatgataacaaagtccctggtcacgccagagagccatttcctcggaaggggaaattgggtttggggatgcttggtaacaaggcggtggtgggggataagagctgcaatggtggccaagaagttttgtttcctggagcttggccagggacgcggcttgtgtcaatgatgaaggttggagggcctgcacctcccgacgccagtgccgaaaggatcctcgtaatatgctgggcaaaacgtgactcaagggcttcgagcatccctgtccaggatgtgaggaaaccgttcctcaacatccattggtaccagcacaacatcggatcgcgtccatcaaaatgtgggacgtccaatttcatatggggccaagaaggggatggtgaagttagtatcggaaaggaagaaggaaagagaggactggccctggttcaagcgagtgaccgcctcatccaagcggtcaatggtggcctgcctggtattatgctctggcggcagcataagggaaggtcggaccagttgttacgatcctatactatgagaagtaagactacaaagatgggagggatagtggaaataagtagtgggcataacataatagattttagtgcttgcttaacagcttcagacaaaatcattgaagtgtgtgggttttctggtattccttctgggcctactgtggtccaattccttgttgctctg

SEQ ID NO: 29328 - DNA, 564 bp, Glycine max
  Peptide Sequence Number=SeqID_146106
atggcggattctgatatccataagacaaccttcagaacccaccatgaccactatgaattcaaggtcatgccatttggctatgctcacctggccagcctgtctactccttctgccctacgtggattcttgggattaacaggcttctaccgacattttatcaagagctatgccgcgcttattgctccacttacttcgctgcttcgaaaggacaacttccaatggtccgacgaggcccaaacaaccttcgaacagttgaaacgaaagatgacagaggctcttgttttggtttcacctgatttttctgccccttttactatagagacagatgcctcatcacgagctatgggcacggtacttcaacataattgtcacccaattgcatattatagcaaaacattgtgtccgcatttgcaacttgcctcgacctatgtcagagaacctcatgcgattactgtcgcagttcgaaaatggcggcactacctgttgggccacccattcaccatcttgacggaccaccagagcctcaaagagcttatgtcccaaggaattcaaatttatgagtag

SEQ ID NO: 29329 - DNA, 576 bp, Glycine max
  Peptide Sequence Number=SeqID_146107
atgagcaccacctatcattcacaggtggacgaccaaacagaggtcatgaatcgcattttggaacaatatcttcgcgcctttgttcatgataggccatctcaatggtatcacttcctattgctggcagaatggtcgtataatacatccacacactcaggcacgtgcatatctccttttgaggcaatatacagaaaaccgctactgtcaattccacattatatactgggtgacatgacagtcgaagctgtcgactccttgctggccacacgcactgtcatcctcgccggtctccgccgtcgtctgatcaaagcccaaaccaacatgaaaactgtggcaaacactcattgtcgtagtcttgaattcacagtaggcaactgggtgtatggggtgatgatagcaattcagacacacaagaataggaagaacaccagagtagcaaggaattggaccacaacatgtctagaaggaataccagaaaacccacacgcttcaatgacttcgtttgaagctattaaacaagcactaaaatctattctattatgcccactacttatttctactatccctcccatctag

SEQ ID NO: 29330 - DNA, 2421 bp, Glycine max
  Peptide Sequence Number=SeqID_146108
atgaataaaagatctaacttgtcttcgtgcttgtgcacattttcaaggggcacaaaggtcccaaccaaaaaaaatttatgtgttttggatgatgttggcttcttaatcattgtgtattcgttgtttttgaataacaaaacggggtttttgttcatgaaagaattgaatatgccgggaattgttacaaacggggttcaagatgaaggggggagtaatgagatgaatggggaccaggattcaccttttaaggaacccttgaatctggttaagtccccgaggggtggttctgtgagtcccggaagaggccagggtgatgatggtgctaattttgggggtgatggggtggttgagccctccattgaacagctttatgagaatgtgtgtgatatgcagagttctgatcagtcgccgtcgaggcaaagttttggatctgatggggatgagtctagaattgattcggagttgaggcatctagttggaggacggatgagggaggtggagataatggaggaggaagtgggggaggggaaagagccagaaggaagttcaagtagtgaaatatcttctgcattgggtggcttgtcccatgataagaagttggatcaggtggatgagattcaggaggttcagcctgcagctactagttctggttccacagaaaaatctgtcaaggcattgaattcacaggtggaatctgataatactttgcccaaattgacatccaagggaagaagtcctctttcaaaggctcccattccgagaaagaatggcaagcctttgaggaaaccgattggtggggttactggtgtgaagaatacgaagaattctcctataggtaagtcagtgtcacaaaaccgagttgagagtatggctgagtcagcattagaaaaacctgagcgggcacctgtattgctaaagcaggcaagagatctgatttcatcaggggataatccgcagaaggctcttgacttagctcttcaagcaatggaactgtttgagaagtttggtaatgggaaaccaagtttggagctggttatgtgtttacatgttacagcagcaatatattgcagcttgggtcaatatgctgaggcaattccgattcttgagcgctcaattgagattcctgttattggggaaagccaacaacatgcccttgctaaatttgctggtcacatgcaactgggagacacctatgctatgctgggccaacttgagaattcaataatgtgctacaccactgggttagaagtccagaagcagattttgggagagacagacccaagggttggtgaaacttgtcggtacgtggctgaagctaatgttcaagctttgcaatttgatgaagcagagaggctatgccaaatggctcttgacattcataaagcaaataattcagctccatctgttgaagaggcagctgacaggaggctcatgggccttatatgtgagacaaagggaaatcatgaaacagctcttgagcatcttgttttagccagcatggcaatggtaaataatggccaggaagcagaagtggcatctgttgactgcagcattggagacacatacttgtctttgtctcgatatgatgaggctgcctttgcatatcagaaagcgctaacagttttcaagaccagcaaaggagagaatcatccagcggtgggattagtctttgtacgtttggccgacttgtataacaggactgggaagataagggaatcaaaatcatattgcgagaatgcacttaaaatatatgagaatccaatgcctggagttcctctggaggagattgctagtggtcttacaaatatctcaactatctatgagtcaatgaatgagcttgaacaggcactcaagttactgcagaaagcactggagatatatagtgatacccctggtcagcaaagcacaatagctggaattgaagctcagatgggtgtcatgtactacatgttggggaactattctgaatcttacaacactttgaaggatgctatttcaaagcttcgtgctattggagaaaagaaatcatccttctttggtattgctcttaatcaaatgggacttgcctgtgtgcagcgttatgccttaagcgaggctacagaattatttgaagaagcaaagagtattttggaacaagaatatggaccgtatcacccagaaacacttggggtatatagtaatcttgctggcacatatgacgcaattggcaggctggatgatgcaattcaaattctggagtacgttgttaacacgagggaggaaaaactcgggaccgcaaatcctgaggtggatgatgagaagaggaggttgggtgagttgttgaaggaagcaggtagagttcggagcagaaaagccaggtcactggagaaccttcttgatggcaatgctcacgctgcaaacaatgttgtcatcagggcatga

SEQ ID NO: 29331 - DNA, 252 bp, Glycine max
  Peptide Sequence Number=SeqID_146109
atggctatcactgagagtggaccaatattcttaaaggcggtaaattactctggtgatataaaggacaaggatttcattgctctacacatcagagatgcaattacggagctgtatgtaagacatcagagatttagaagtttgaaagaaggactccaaaaaatgtttattactcttgaatggtctacttacaaggatcatgatgttggaatggcaaaaaaagtgaaagaaactttgttggatgatatttggtga

SEQ ID NO: 29332 - DNA, 255 bp, Glycine max
  Peptide Sequence Number=SeqID_146110
atgaatgattacgtgaagattgatcaagagttcccccacatcaagatgtggaacttactgatgaaaggaagaaatgctttagaagatactttgatgatgtggattgaaagagaagactttcatgatgttgactctttaagggataaaggtgaattggatgcaaaatcttggtggcccttaagttacttgggcaaccatacttatcttcttgttgtgaaaggaattggagcacctacaatttcatacatagtttga

SEQ ID NO: 29333 - DNA, 237 bp, Glycine max
  Peptide Sequence Number=SeqID_146111
atgttgacggccatgaccgtgacggccataacacttgtgtcgatgaagctcagcctatgctggccatggtggtggtggagggggtggcttcggtggtggtgcaagaggttgaaggtcgatgacgcaaaccacagcgagaacggcaggtgcaagaaggagcctaacaaggatagagcgagagaccgtgactgtgaacgttcttctagccgtcataggagcgagagggagagagactaa

SEQ ID NO: 29334 - DNA, 258 bp, Glycine max
  Peptide Sequence Number=SeqID_146112
atgaatagaaatagaaaatccaaattctccagttcaggcatacaactcaacagtaccaagagtgagcctaccagggagatgatcgtggctgtcccaacacaagctttgttaggacggctaattatgcaattcacttttaaatcaagaagtagctctgcagatttctgggactgttatacatgcaaaagtacttgtatgaccatcaagcatgttcaatggttgatcaccaccaaaaggaaaaacatcctgttaacataa

SEQ ID NO: 29335 - DNA, 399 bp, Glycine max
  Peptide Sequence Number=SeqID_146113
atgaagaagaagcaggaagaagaagagttgatccgaaagaagaagaagcagaaacggaaacgcggggagagagagagtccagtgagtcgtttagacccttcttacacggagacattaaagttcttgcagaaattaaaagcatgccatgcctgtttcagcggaagatatggaaatacctctagaagggtgttccgattggcagttatatgtcacaggcatgggaagtccatagatcttcggaatggagaaaggaagagagagaggagacgccacttcaaggagaagatgagtctagaagaagctcaccaccataggaggccatggataagaacttggaggaagaaggagatgaatgaagggagagggagagaagagcacgaaattttgtgctctaaatga

SEQ ID NO: 29336 - DNA, 210 bp, Glycine max
  Peptide Sequence Number=SeqID_146114
atgagatgctacaaaagatggatgatggataaccctgaccagcccttcaactactacatgctccaccaattgaaggttgtcttggttgtagatgatgttcacaagttgaagcaattacaggaacctgttggaagacctgattggtttggtcctggtagcataatcatcatcaccactagggacggacaattaattggtaccatctcataa

SEQ ID NO: 29337 - DNA, 1032 bp, Glycine max
  Peptide Sequence Number=SeqID_146115
atggaatttgatttcatcatagagtatagagagggtcaagaaaatgttgcagcagatgctttatctagacttgattcccatgagatcatggcattacaggttcatcagcctgattctagcatgctatctaggatccaacagtcctggcagacagatcctagcttacaacaacttgttagtgacttacaaagcaatccttcttctcacaaaaattatacttgggtacaaaatgagctaaggaggaagggcaaattagtagttggtttagacccccaattgagacaggatattctctcttggattcatgcttcagcttgtggtggccattcgggtagagatgctaccttgcaaaagatgaaaaatgtggtttattggagaggcatgtccaaggctgtcaagcttagtaaggcagctcatttcatggccttatcacatccttatactgctgctgatgtggcccaatgcttccttgatcatgtctttaaattgcatggttttcctgatagcattaccagcgatagggatcctatttttgttagccacttttggaaggaatttatgtccttgcaagggattcaatggttcaagtggttgcctcttgctgaatggtggtacaattccacttaccacaatactattaaagcaagtccatatgagattgtgtatggccaagctcctcttgtccatttaccttatctcctgggtgaatctaagattgctttggttgataggagtttgcagaaacatgaggaaatgttaaagttactcaaattccacatgaagagggcccaagacaaaatgaaccaacttacagataagggcatatctgataggagttttcatattgtggaagacaagcttaaattgcctcctggatctatggttcataatgtcttccatgtttctcagttgaagaagtttactggtactgccacttctgggaactttagtccctcacctttattggatacctctcaaaaggaacctgaagctatcattgacagaatgacagttaagaggggaaatcatgct

SEQ ID NO: 29338 - DNA, 1717 bp, Glycine max
  Peptide Sequence Number=SeqID_146116
ttctactatatcaattggtatcatcgagcctgttctttccttggtgatcaagcaatggcagagaacacgcgcaatcaagcttcccttcgtgaaatggaagaacgtcttagcagcaaaatggaatcgagatttgtcgagctcattgcttccatgcaacaaacaatacacgaaatatttcaatagaggcaacaagattctccaacagcaagcaatccatctaggggtgagagatctagcccctattcttgtagcactcgattggctagggaaagcacttcagtggcatagtgcttacataaaatctgtaggattagagaatttaccttcttggaatgaatatcagatcttgttacatgatcgttttggagatgtttgtgaagatcctatggtggatttcatgaaacttaggcagacaggatccatcatagagtatcatgaggagtttgactcaattgtatcaagagtagatctttttgatgagcatcaacttagctgctttttaggaggattaaaacaagagatccatgtgttagaagttgaagatgaagaagaggactctagacctcaagaaattgatgctaatatggttagtgaacatgatttagaacctttaatttctatgaatgcattaactggagtagctaattttcgaactatgagagtcactggttattgtgggaagaaacctctccaaattttaattgacaatggaagcactcataactttttggacttacacatagctcaaaagatgggctatcagaaagaagctatggacatagtatctgtcactataatagatggaaataaagtccagatttcttccaagccatctagtcttcttccttgccgaattggccatgatcacaagattcctttaacgcaaggagctaaccctatcaacaagaggccctacagtccagtagtgttggtgggaaagaaagatggggcctggagactttgtgttgattatagggatcttaacaaggcaactattaagaaaaagttccctataccattagtagaagaccttctagatgagttgtatggatcaaccattttttccaaaattgacttaagtgctggttacaatcaagttcgagtggatgcaactaatgttcacaaaactaccttcagaactcatgggggccactttgaatacttggtgatgccctttgggcttaccaatgctcctgccacatttcagggactgatgaattcagtttttcagcattacttgagaaggttcttacttgttttctttgatgatatactcatctacagcagaagtatggaggagcacctttctcatcttcatcaagttcttcttattatgagaactcatagtttgtatgctaagaaatccaaatgctactttggtgttgacaaggtggaatatttgggccattttataactaaagaaggagtttccacttatccttctaaaattgtagcagtccaagattggcccctaccacaaaacttaaagcaattgaggagtttcttgggtcttgtaggttattgcagaaggtttgtaagtcgatatggtgcaattgaaaaacccttgactgatatgttgaaaaaggacaattttagttggtcttctacaacaaaagaaacatttcaggaattgaagcaaagtggaggtggatgcttctggcctgggcttaagtgctatgttaatgcagaatcaccgcctaattgccttcatcagtag

SEQ ID NO: 29339 - DNA, 519 bp, Glycine max
  Peptide Sequence Number=SeqID_146117
atgggtatggctgcagaggctcagtttcatgttctggctgttgatgacagccttattgacagaatgttgattgagaggctcctcaaaacctcttcctttcatgttactgctttggactctggtagtaaggctttgaagtttcttggtttggttgaagatgagcagagaaataaagagcctccctctattgctctagaatcccatcaggatgtagaagtaaacctgatcataactgattactgtatgccagaaatgacaggctatgatctgctgaaaaagatcaaggaatctaaatctcttaaagacataccagtggtgattatgtcctcagagaatgtcccagcaaggatcaacagatgcctagaagatggagctgatgaattctttttgaaaccagttcaacagtcagatgtaaacaagctgaggccacatttgttgaaatcaaaagttaaggatgaagaagtccaacaaatcaacaaaaaaaaggaaggaaacagaagaaagccattcaccagataa

SEQ ID NO: 29340 - DNA, 921 bp, Glycine max
  Peptide Sequence Number=SeqID_146118
atgtatgctgacggggcttgcaaaggcaaccccggtgtgggtggctggggggtctggctcaaagccgggccacatgaaaagtcactatatggcggtgaagcattaaccacaaataatcggatggagctcacagcggtgattcaaggcctgcaagcgcttaagaaaccctcccatatcaaaatctatacagattccagctatgtacaaaaaggcatgacggaatggttgccgggatggaagcaaaagcaatggcgcactgcagacaaaaaaccggtcaaaaatgctgacttatggcagacactcgaagcattggcccagccacaccagattgagtggatatgggtccgcgggcatgctggcaatgagggcaatgaacgcgcagatgccctggcaaatcaaggcttatatccagaccagggacaccgcattattgaaattgcggccgtggaaatttttaatcgtcgtcctacccagcgtcatttccatatttatatcaatcctgagcgggagatcgatcccggtgcgcaagaggtacacggcatttcgctggagttcctgcaggataaacctttgtttgccaacatcgctgaagagtttattgagttcattcgcggtgcagagctgattatccataatgcgccatttgacgtcggctttctcaacatggagttggccaggttaaacctggataagctggaatcctatatcagcggcatcattgatacgctgaaaatggccaaggaaatgcgtccgggccaacgtaacaacctggatgccttgtgccgtcactatggcatagacaattcacagcgtaccttgcatggcgccttgcttgatgcggagttgctggcagaagtgtataaagcgatgacgcgaggccaggaaagtttgctgatggaactctccagccctgtagagcag

SEQ ID NO: 29341 - DNA, 435 bp, Glycine max
  Peptide Sequence Number=SeqID_146119
atgtattgttatgaggaagatctaccttcatttctcttcctagctgacttcatggttttggatctcaccagagctgacaacctctggcattgctatgggaggaggttgaggaggaacccacgctcattggactggctgctgactggatgcagcaggtgctccattatactcaattccattatcgatctctttgattctgacattctttgtttgccaccagggtactgggttgtcaccattatcttggaccttgccatttacttgatatggaaggacttggttctcgaccatgcgagctctgctacattcattggaagttcacttgtaggcatagggatcaagcttaaggaagtgagagatctagttgcagtccttagggaagtttgtgggagaaagattacatacctcaccttaagcccatcgccttatccataa

SEQ ID NO: 29342 - DNA, 683 bp, Glycine max
  Peptide Sequence Number=SeqID_146120
gagcaaaagcctcgcttttgtcgactgcaccgctttctgttaccatgacccaagagctggtagcccgcggagacaccttacggttatccgcacctcgagtgtgattgataagcagaggccaatatggtcatctgcgccctttccggagatgagcaagagccttgcttttgtcggccgccccataatctgtcatactgaccctgaggcggcgggcccgatgacaagcagagaccaagtttggtcattctgcacccttgtatcatccagaggcggtgggcccgatgatacgcggagataccttacggttatccgcacccttttatcatccagaggcggcgggcccgatgatacacggagataccttacggttatccgcacccttttgtcatccagaggcggcgggcccgatgacaagcagagaccaaagaccaagtttggtcattctgcacccttgtatcatgcagaggcggcgggcccgatgatacgcggagataccttacggttatccgcacccttttgtcatccagaggcggcgggcccgatgacaagaagagaccaagtttggtcattctgcacccttgtatcatccagaggcggcgggcccgatgatacgcggagataccttatggttatccgcacccttttgtcatccagaggcgggcccgatgacaagcagagaccaa

SEQ ID NO: 29343 - DNA, 411 bp, Glycine max
  Peptide Sequence Number=SeqID_146121
atggctccaaggaagcttgcctcaaagagatctaggaaggacgccgcggccgcagggactagtgccgctcccgagttcgatagccatcgtttcaggagcgctgagcaccagcagcgtttcgaagccatcaagggatggtccttccaccgagagagacgcgtccagctcagggacgacgagtacacggatttccaggaggagatagctcgtcggtgttggacgtcgctggtcactcccatggccaagttcgatccagatacaatcctcgagttttacgccaatgcttggcctacagaggagggcgtacgggacctccgacgccctcagttagttcctgggatatccgctagtattggaggagggccaggagtgcgaatacggtcagaggaggaaccgggccgatggatttga

SEQ ID NO: 29344 - DNA, 333 bp, Glycine max
  Peptide Sequence Number=SeqID_146122
atgacccttacttatgatgccctcctatattacaacgggaggtggaacatgccacgccaacacgactttgtcggttatgcgttcacaggaaaaaatccaaaaagatttgacattccttcgggatgtaccatcaatgtactgaaggatttgatcaagcaagttgcacctcaagatattcccccttatgatattcatgaatcacaaacggtcaggagattgttttgtttacaaccaggtcattataagtattcagacaaagttatcaaatttgaaattattgagctgaaaactgatgatgacgtgctaaaggtcttagtacagtctgactactag

SEQ ID NO: 29345 - DNA, 702 bp, Glycine max
  Peptide Sequence Number=SeqID_146123
atgacactgtcgagatgttggtggaattactcgaggtcagcgctgttgagacgagagttgagacgattcagtgtcatggctcttatgctcgacgtgtatcagacgaagatcggggcatgtcactggattgtagcagcacatctcagatggggccccttgacggccattcaccgatcggagagggttgtacgacagtttggctacatccagactattctatcacatcctgctgcatcttcactctctgttgaagaaattgatgatcgatggatgcagttcagtgaatacattgcacatgtagggaaaatgtgtgcagtgcctggccagtgttcgccagattacatggattggttctacatgatttcacacccattcatgagtctggcacagccaagggatcctcctagagttctgccaattcagcaatatgacacatttgttgaactagatttgtatcagcaaccgatggtagcagcggcacctgatgaggttgacgttgatgtgtatcatcttcgacatgcagtggatggttatgtagctattgctgataagttggagaggctactaaacctgagtatcctgaccgaaggaacaaaagcctatactgttgatgaagaatgtctaggcatcgcaagaagctacattagccaaccaactataggtcacagatcgaggtgtaggcggcgtatggacggtcattga

SEQ ID NO: 29346 - DNA, 1413 bp, Glycine max
  Peptide Sequence Number=SeqID_146124
atgaagacaatagcatccaaggtttggggagttaaagttgtacagtccggtgacactacagtcaaggcaacacggggtgtctatgtgaaggcaatacctatcaggaaggatgggagaagaactatgattcccatgttacaagggcactttgctaggaaaatggtgtatcatgtcttcaacaagatggacgaagactctaagcataccctaattgccaaagccaaagccattgctgatgaagaccaaggtctaaaaaactttggtatctccaaaaagatacaaaagattatgactaagcaacaaaagagaaagaagacaagaaagcaatcccaaaaggaagaagaggaggaagagttgcttgccaaggagcataggacgaagaaaagacatgagactactgtatccacccttgtgcatccaccggctgccacctcaatccctcgaaggttgaaagacctaagtgagactaatgaagaagatgaaggccttgtacaagtatcacttcaaaagaggaaagaagctgctttggttgctcccgccccaaaaagggctaagaaattccaattagtctctcaaccacgagtatttgtcatctcctttgctattccaagacgtatcaagacaagggtgaccaaagccaaccctaagattgatgggaaggaatgggcaatttccttcaatgggaacaatcaagattcagccttatcatcatcatcatcatcatcattatcatatagtgaatctataaacaacacttctatctctcccttccgtaaccatgattactctacacaatcgcatatacctccatcacctattcatctagacaaattcaaaaggtctactccaagggaaccattaagatatgctcaaatatttcctcttgcattctttaatagtaatcctatatctgaaaccccatactttgagtttctatactttaaacttgttgaaagggaaacaattcatgtccaagaacctacatggacaaagcatgaatgtgagcatacttcatctgaggcctttaaagctctaccaacatatgacatagttcatcttccgctaacacaatggacttatccagctaaagaagaagaaatttttgttgctgctatgaaacaagatattgccttagtccaagctaaagcatctactaaagctatggatgacaccattgtatgtggggtcatcattgatctcaccaacattggtgtcatgggcaaaacttctgaggcatctaatgtagccatagctgctgaagttgaacacaacattttagaacctatatccaagcagtcaacaaattcaaatgaggctacttctagagacaagggtgaacccgatgttgtctcgtctactccaccaattcatccctactcctttaaactatgcacaacctgtcattgttactag

SEQ ID NO: 29347 - DNA, 225 bp, Glycine max
  Peptide Sequence Number=SeqID_146125
atgaacatcatagttagtcttgagcaggtgatggtcgtggaggttgagagggtggtggtgaagatagaggaggtgatggtgttagggctaaggtttatggtggcgggtcaagagacacatgtgcagatggtggttgaggtgcaacaacaactccaagcattcacatctgagcccgttgaatgttttggaggagaacggcaccaagattggagaactgagtggtga

SEQ ID NO: 29348 - DNA, 189 bp, Glycine max
  Peptide Sequence Number=SeqID_146126
atgggggattgggggaattttctccaccgaatccttgaggaggattctgaggattccgctccgattaaaatgttcctcttggttgggggttcgacagcaagcaatgacggctcgtggcggccaccggtggtcgtgggtggtggagaaggaggtgttagggtttgggtggcgtttggagaggaggagaga

SEQ ID NO: 29349 - DNA, 387 bp, Glycine max
  Peptide Sequence Number=SeqID_146127
atgcaaagaagatctaatgcaggtgatttgatctctatcgatttggagattaacgctacttgcaggaggcgcaacatagagagaattataaattttttgcaggacttagaagctgcagcaactccaaaagaagaacctcgatcttctgaggcatcttctagctttcctattccagtaaaatctcatacagatttaattgaagaagttatcatggctgaagagccaaggagagtgaccctagaagattactcaagttcaagtgtgccgcaatttttcaccagcattgcacaaccagaggttcaggcacaaacaatcacatatcctccttctttgatacagctggttcaaaataatctatttcatggtctaccaaatgaagacccataa

SEQ ID NO: 29350 - DNA, 242 bp, Glycine max
  Peptide Sequence Number=SeqID_146128
ggagagcatgcgtaaccaatctcgcaggaagcactggcgagactgcctacgtggagcatctcgctgttagcactggcgagattgccctagtggtgtatgtcgttgttattgctggcaacatcaatgcctactcagcaagtatcgccaagaagaatggcggcatcagtgcctacgtggagcatctcacctgtgctgctggcgggattgctttctcacttctcctactggcggcttcaccttag

SEQ ID NO: 29351 - DNA, 405 bp, Glycine max
  Peptide Sequence Number=SeqID_146129
atgtggaatatctttggtcccgaaaaggatgtgatggcctggagtgccatgattactgcttttgctatgcatggactctcagaggaatgccttgaactgtttgcgaggatggtaaatgatggggtgagaccaaatgctgtgacgttcgtgggtgttctttgtgcttgtgtgcatggagggttggttagtgaagggaatgaatatttcaagaagaggatgaaagagtatggtgttagtcctaccattcaacattatggttgcatagtggacttatacagcagagcaggtcgtattgaggatgcttggagtgtggtgaaatcaatgcctgtggaacctgatgtgatgatatggggagctctgcttagtgggctaggatgcatggggacgttgaaacttgtgaggtag

SEQ ID NO: 29352 - DNA, 423 bp, Glycine max
  Peptide Sequence Number=SeqID_146130
atgaatcatgcagctccacgatatgacgttcctatgaggcatttgatcgaacagtttccgcgcaatgtgaatcatgcccgctttggcatttgcgtggatgatggcgttccaagaggaggtttgaacaaaagggtcgttggcaagaccaaggaggaagatttgagcgtgaagctggcgacctggatgaggggtgttgatggattgaagaaggaatgggaaggtatgaagatcgggaagcacggcatggtggcgcatgcgaaggtagagagacagtgctggcggaaacgatttcgactctgtttctggaaagataaagacttgggtgcgtgtacgatatcaccttcgcggaagcacgcattggtggtgactgctaaagccaatcatgaaactcccgatgttcaaggtcgcaggactatgaagtga

SEQ ID NO: 29353 - DNA, 318 bp, Glycine max
  Peptide Sequence Number=SeqID_146131
atgcttgatgagattgtgaagaggttggaaaagcatggttatgaacgtaacactggggaggtattacttgatttggatgaggaaggaaaggagtttgcattgtcccttcatagtgaaaaactggcaattgcatattgcttcctcaggacaagcccgggtaccacaattcggattgtgaagaacttgaggatatgtagcgattgtcatgttgcaatcaagatgatatctagggaatttaattgggagattattgttagagattgcaaccggtttcaccattttaagaatgggctttgctcctacaaagactactggtaa

SEQ ID NO: 29354 - DNA, 192 bp, Glycine max
  Peptide Sequence Number=SeqID_146132
atgttagatgcggttcttagtgtaagagatgagaggccagaggattgggtaccggaagagactccttattttcaacatgaagcccatgagaaggtggatttctctgatataaagcatgttaatgaagaaaatagggacactgttgatattttttacattcattcagaaaaccccacagggattaaaaattaa

SEQ ID NO: 29355 - DNA, 786 bp, Glycine max
  Peptide Sequence Number=SeqID_146133
atggactacagtggcaaggaaaatgaatctactgttacagaaaatcctgaccatgctttaggaaagcagcctcaggaatctaaacttgagccacgtgttgcaaaatttatatctcttgtttgcaatggctatgaagttctcaaaagattggctaatgtgattgataaaggtgataggaaagttctgaaacaattaagtggagaattctacactgtaattcctcatgattttggattcaaaaaagtgcgtgagtttgtgatcgatacccctcagaagttaaaacgaaagttagaaatggttgaggctcttgctgaaattgaggttgccacaaagctcttgaaagatgacgcagaaatgcagggagatcctctgtatactcattatcaacgccttcattgtgaactggcaccagttgaatttggttgtgtggaattttctatgattgaagagtatacgaagaacactcatgcagaaacacattcaaactatactgtggatattgttcaaatattcaggacatcaagagaaggcgaggcagaacggttcagaaagtttatatgcttcgcaatctcatactgcagcacaaaaggattaggaggtactgctcttgatccttcaaaagctcaggaacttgaggatgggctcgtagttcccctaggaaagcccaaaacagaatcaggcaaaaagggcgatctattgtacaatgaatacattgtttataatgtggagcagattaggatgcgctatattgttcacttaaatttcaattttaagactacaagttag

SEQ ID NO: 29356 - DNA, 102 bp, Glycine max
  Peptide Sequence Number=SeqID_146134
atggctcaacaaggggaccttggagccaattatataggatatagccatagtgaaagtagagcacacggctcttgtctttccccaaagggaacattttattaa

SEQ ID NO: 29357 - DNA, 591 bp, Glycine max
  Peptide Sequence Number=SeqID_146135
atggttaagattaaaaggttaattgaggagtataatttgggatgtggaaatccaacacaagcttcacctttcttggttgcagttgagaaatataaccatacaggagggttttccgtttctcaatttgagtttcctaattcgaaaaccatcgcaatccaagccgctaccgcactgcggggagacgaagaagttatcgaggggaaaggaagcggaggcgacgccgacggagaaatcgagatcatcgccgaaacgaacgacgtcgagaatgctgagccagaagaagaggatcttcacgctaatcccccggagttcggtgagcctgccgtcggatacgtagacggtgatgattttctggtaactcagctggtacgaaccttcgagggagaaactgcacgaaccgttcagatcggcgtggaattttccgctggacgggtccagctcgtagccggtcactcttttcgggagaatgcctgccggaaagtgaaagctctccagcatctcgtacgccgtcggggcgccggtggcggtgaccgccggaggaggaggaaggcggtgtcggacgtagtccctctattattggaattgaattga

SEQ ID NO: 29358 - DNA, 238 bp, Glycine max
  Peptide Sequence Number=SeqID_146136
atggatttgggcaagacaataatagagtattgccagatacaacgttttgcaatcgaagccacaaccacattgggggctctcgaggaagttctcgacgccgaaatcagcggaagcgatgccgacagagaagtaaatatcgttgccctgacgagagacctcgacgatgttgagccacaggagcaagattttgacggtgacacctttgagattgtagagcctgcccttggagatcacaccc

SEQ ID NO: 29359 - DNA, 210 bp, Glycine max
  Peptide Sequence Number=SeqID_146137
atggagcttcttcagatctaccaacgtaaatctgaaatcatcgattcgcacactaatattgttatcaacccacttacacttgaaaacacagacaatgaattttacataattaagctcccaaatttcttcaatgactccaaagtaaggcatggaagctacatggggattgtcatcatgtacagtagcaaagtgttgagattcaacccttag

SEQ ID NO: 29360 - DNA, 1438 bp, Glycine max
  Peptide Sequence Number=SeqID_146138
ctgccgattggtgaccgccgccgctccggcttcctgatccccaacgcgaaatacggcagcaacaacggcttcgaattcatgctgccgtactactggaatatcgcgcctcaggtcgatgccaccattacgccgcactacatgagcaagcgcggtctgcagttgcagaacgagttccgctacctgacgcagtttgttgccggcctgttagagctggactatctgccgtctgacaatcagtacaacaaagacaaagccgcgcgaccgtcggtgcagaacgacagcaacgacgaccgctggctgttctactggcgtcactccggcgtctacgatcagcactggcgcttcaacgccgactacaccaaagtcagcgatccttattacttcaacgatcttgattcgaagtattacagctcgactgacggctacgccacgcagaaattcagcgtaggctacgctgacaccaactgggatgcgacgctgtccagcaaagacttccagaacgatatcgggccgtttgacggtcgcatctatgcgcaggcggtgaagttcactaacgtcagtaaccgaatgccggaagcgacacgtttgcacatcgagccaacgctcaacctgccgctgtccaacggctgggccagcctggataccgaggcaaagctgctggcgacgcattaccagcaggataacgttaactactacaacgaaaatatcgataccacccgcaccaatcagctgaaagagtcggtcaaccgcaccctgccgcagttcaaggtagatggtcgcctggtatttgaccgcaatatggactgggccgaaggctacacccagacgctggaaccgcgcgtgcagtacctgtatatcccgtaccgcaaccagagcaacatctatccgtacgactccacgctgctgcagaccgattacaccggcctgttccgcgatcgcacctacagcggcctcgatcgtatcgcctcgtctaacgaagtggcgaccggcgtgaccacgcgtatttatgataacgatctggttgaacgttttaacgtttccgtgggtcaaatctactcgtttaccccgtctcgtaccggcgtaaaccagacgaataaagaagatgataccggtagcctggtgtgggcgggtgatacttactggaaagtcagcgatcgctggggcgtgcgcggtggcttgcaatacgatacgcggctggacaacgtttcccagggcaatgccattgtggaataccgtcgtgatgccgaccgtatggtgcagctgagctaccgctacagcagcccggagtatgtggcgcaggctttaagtggttcaggtttgattgacaaccctagctaccagaagatctacaaaaacggtatctcgcaggtgggcgccacggccagctggccgattgccgatgcctggtcgctggtggggggttactactatgacaccc

SEQ ID NO: 29361 - DNA, 219 bp, Glycine max
  Peptide Sequence Number=SeqID_146139
atgggtgcaagggataaatcaatcatgcacaagagattcatgcaaaaaccattacttaacgttagtcattctctcacaattaaagatcacactctcaccgggttgcggctaatgcgttccttcacagtcaacttgacaaaccaactaacatttccagtcatgatcctaattccatgttctttctcttctaatgactacatgctcactcaaggcatataa

SEQ ID NO: 29362 - DNA, 585 bp, Glycine max
  Peptide Sequence Number=SeqID_146140
atggaacttatttatcgcatggttttttcttggatgacacaaatctttgaggtacactggcaatcctctctttcctttaataggcttgatattgttattcctggaactgaaattccaaggtggttcagtaaacaaaatgagggtgattcaataagcatggacccgtctcctcttatggaagacccaaattggataggtgttgcctgttgtgcattattagtggcacatcatgatccgtctaatattggtaatagatcgacacatcttgatcattatccaagtattggatacagttttcaaaataaacagaatgatctggtcacaggtgaattagatcacttgctgattttgtttgcctctcgggaagaattccttctttttcctagacacgaaactgatatgcatggtcttgatacaaggggattcacaacttggatacgtgaccaccctaaaggtttgcggttgcaggtgaaaagttgtgggtatcgttgggtatttaaggaagatcttcaacaattaaacccaaacatgatgttcagaggaaattcttcatctaggaagtgcaagcttttatcaagtgattaa

SEQ ID NO: 29363 - DNA, 416 bp, Glycine max
  Peptide Sequence Number=SeqID_146141
atggtgaaatcatcagcaactatatcggtaatatcattggttgattttcttttggaacaagcaaggcatgagttcttagttctaactgtgacacaggataggcagaaagcaagcacaagcaatcagccccttcaggaagaggatttctgtggggaaaaagaaattctagctaacaacgcagaactaaaaaagactagaattaatgtctaccgtactcaccgccttacccctcattcttggacattctctatcaaatcatcccacggagaagcttcaacagactgcaatctaataggtggactaagttctatcaaaaatggaaatgctgttagctcaagagtcaagaccaaccctggaaattggtggagcgattggtggctctggtactacactcctggaaatagaaagggttccat

SEQ ID NO: 29364 - DNA, 180 bp, Glycine max
  misc_feature (117)..(117): n is a, c, g, or t
  Peptide Sequence Number=SeqID_146142
atgaatcacaaaggaatcccctcctttgtgttcagtgattacatccaagaagttatgcccacttcttgcaatgaacccaaaagcgtgatcaaccaagaagcaaatcctgcttcttgntatgaacccaaggaacgttggtcccttgtgttcagtgttcaaccaaggaagaccttctcttga

SEQ ID NO: 29365 - DNA, 1596 bp, Glycine max
  Peptide Sequence Number=SeqID_146143
atggcttgctcttcatcacacgcgaagaattttgatgtgtttgtgagctttagaggtctggatactcgtaatagtttcactgatcatctttttgctgctcttcaaaggaaaggcattgttgctttcagggataaccaaaatatcaacaaaggggaactcttggagcctgagctcttgcaggcaatcgaaggatcacatgttttcattgttgtcttctcaaaagactatgcatcatccacatggtgcttgaaagagctgagaaagatttttgatagggttgaagaaacagggcgaagtgtactccctattttctatgatgtcactccttctgaggtccggaaacagagtggaaagtttggaaaagcttttgctgaatacgaagaaaggttcaaagatgatttggaaatggtaaataaatggaggaaagctctcaaagcaattggcaatcgtagtggttgggatgtacaaaataagccagaacatgaagaaattgaaaaaattgttgaagaagtaatgaacctactgggtcataatcaaatttggagtttcagtggtgatttagttgatatggactctcgtgtgaaacaattggaagagcttctagatttgagcgcaaatgatgttgttcgcgttgtgggaatttgggggatgagtggagtaggaaagacaacacttgttactgctttgttcggtaaaatctctcctcaatatgatgctcgttgttttattgatgatttaaacaaatattgtggggattttggtgcaacaagtgcacaaaaacaacttctttgtcaagctctaaatcaaggaaatatggagatacacaatctttcccatggaaccatgttggtaagaactaggctacgtcgcttaaagacacttattgttcttgataatgttgatcaggttgaacaattagagaatttggctttgcatcctgaatatctaggtgaagggagtagaatcatcataatctctaaaaatatgcatatcttaaaaaattatggagtatataaagtttacaatgttcaactccttaagaaggataaggctcttcaattactttgcaaaaaagctttcaaatccgatgatattgagaaagggtatgaagaggtaacatatgatgtactgaagtatgtcaatggccttccactagcaatcaaagtattgggctcatttttgtttgaccgagatgtttttgagtggagaagtgcattaactagaatgaaagaaaatccaagtaaagatatcatggatgtgttgcgaataagttttgatggattggagacaatggaaaaagaaatatttctagatattgtttgtttcttttcaagtgatcaattccaggattatgaccggcggtctatacctcctgagaaaattctaggctatcggggattttatcccaaaattggtatgaaagttctagttgaaaaatcactcataagttttgatcgttatagtaatattcaaatgcatgacttgttgaaagagttgggcaagattattatccgagaaaaggcacccaagcaacctagaaagtggagcaggttatgggactacaaggatctccaaaaagttatgatagaaaataag

SEQ ID NO: 29366 - DNA, 231 bp, Glycine max
  Peptide Sequence Number=SeqID_146144
atggctggagcttctcgttacgagaagaatttgcacttatatctggcgcgagttgctgcagcaaagagaagatctaatcatttgtatcagctactgtacaaattttctcctcagtttgagtccaaagaccagctgcttgcaagaaaagctttgccgtgggaaaatcaaaaaatagaagccaataattttctggatttgaggagcaaaaaacgcattcacgtgaacaattaa

SEQ ID NO: 29367 - DNA, 195 bp, Glycine max
  Peptide Sequence Number=SeqID_146145
atgtgtggtattactgtagaagtcgtggaggaaggatttcaaaaccgtgagaaatgccaaaatgaggaaacacaaaagggaagtggttttattattgtagaagttgtggaggcgacgctgtttagaagacaagagatggggccggcaaggagggaggatgtgaggaaggagaaggtgaagatctctgatccctga

SEQ ID NO: 29368 - DNA, 450 bp, Glycine max
  Peptide Sequence Number=SeqID_146146
atgacagatcttgtgagcgcggaagatgacgtaaatctccgcgtgtcaacgggcttgtcggccgcgattgacgaagggcgcagaagacgatgtcagtcttcgcgtgctatcaggcttttcgtcttacagacagcaaaaaagaatgtttatacggataaccactcgggtatctccgcccgtcagcgtgactcaaatgtcagtatgacagatcttgtgagcgcggaagatgacgtaaatctccgcgtgtcaatgggcttgtcggccgcgattgacgaagggcgcagaagacgatgcttttcgtcttacagacagcaaaaagaatgttatacggataaccactcgggtatctccgcccgtcagcgtgactcaaatgtcagtatgacagatcttgtgagtgcggaagatgacgttaaatctccgcgtgtcaacgggcttgtcggccgctattga

SEQ ID NO: 29369 - DNA, 287 bp, Glycine max
  Peptide Sequence Number=SeqID_146147
taacttcctttgggtaccgtaaagatcggaatgatcaatggctgaagaaggatgcgctccttcctcaagatgaacgtactccttcacctcctcctcagcgcgatgtttcagcactcatgaatgaagtcctctccgaattacggggtcttcgttcttatgttggtgaccgtttcgactcattagatacacgctttgccagcatggacattcgcctcacacagcttgaagaggatgtaggttacattcgtcagagtttcgatcttccaccaccacctccaccttcttag

SEQ ID NO: 29370 - DNA, 273 bp, Glycine max
  Peptide Sequence Number=SeqID_146148
atgttctggctgaaatttaaggaagaactttcggatgtttggaagttaattgacaactatagaaacgttcaagaggttaatgtagtgaagactaagatagagaccctgatcttgcaaaatggatggggtcaggttacagtcaacaatgaagtgaatgaggataaagaggtgtattttagatatctagaacctccagaaagattttgctgcatttattcgtcagaagaagatcaccgaactacacctgacaaatggttatggaatggtgcataa

SEQ ID NO: 29371 - DNA, 349 bp, Glycine max
  Peptide Sequence Number=SeqID_146149
aaagacatgcaacttctctattgatcaggctggagaggaaaggaagttgcaactaagtgagctagatgagatctgtttagaagcctatgagaattccaaattatacaaggagaagaccaagaagttccatgatagtttgatagctaagaaggacttcgtggttggacagaaagttttattgtataactctaggcttagactcatgagtgttgagatcaaaagtgagtccacaaataagagcttcaaggtcaacgaacaccggctgaaaccattcctcataaatccttccttggtggatgtagtggtggaggagacctccttacttcaccctacttctcttccgccatga

SEQ ID NO: 29372 - DNA, 291 bp, Glycine max
  Peptide Sequence Number=SeqID_146150
tttagttttgctgagtttgatcgggagaagctaagggtttgcgattataaagttatggcacgtgttgctgataaaataaaattgatagatggatcaagggaagctcttaagctttctgtaaggatcactgatctttggttcattgggattcccggaaagactaaacaagccaaaatggtggttgttgattctgatggagatgaaatccatgttgtttgcaagcaggatcaactgaagtctcgcaaggctgatttgaaagaaaatttgacttatgtgatgcataattttaaa

SEQ ID NO: 29373 - DNA, 435 bp, Glycine max
  Peptide Sequence Number=SeqID_146151
atgggtgaaagacccactagcagctttggagccaatacagagaagaacccaaaggaggaatgcaaagcagtgttgacaagaagccaaagaagagcacaaggagaacaaagagatgaaagagaccagtttgaggaaggaaggataaacaaagaaggagagaaagaagaagagaagaaggaagaagagaaagaagtgccctcaaagaagaataaggagcgctacttcaagcgtttcttggagatattcaaggggctggaaataaccattccatttggagaagccttacagcagatgccactctacaccaaattcatgaaagacatccttaccaagaagggaaagtacattgataatgagagcattgtggtaggaggcaactgtagtgcggtgatacagaggaagttgtcaaagaaattcaagatcccgagagcgtaa

SEQ ID NO: 29374 - DNA, 321 bp, Glycine max
  Peptide Sequence Number=SeqID_146152
atgttggctaatagtttaaaatgggttatggatgatgttatttccacaacccaatcaacttttatatcagggaggaaaatgttggatggggtactcattgctattgaattggttcatgaagctaatgggaagaagaataagttgttgtgttttaaactggactttgaaaaagcatatgactcagtgagctgggagtttctagactttatgatacaaggtatcggatttagtgcttttggaggagcagaagggctaagcatgatgtttattgaggtagtaaggaagaggttatttgggggttttgagttggaaggattgtag

SEQ ID NO: 29375 - DNA, 222 bp, Glycine max
  Peptide Sequence Number=SeqID_146153
atggctctactagggaagtggtggtggaaattgagagtggactcaaaatctttgtggagtagtgtcttgaaggtaaagtacaagggagttggttgtgtgaaagtgaggaggataggtggaatgggattggttttaagcgggaggctggttctaacctttcatcatacatgtgttatgcattgggttaatggctctatgtttataaggttggtttacgcttaa

SEQ ID NO: 29376 - DNA, 982 bp, Glycine max
  Peptide Sequence Number=SeqID_146154
ggctcgcgacgctgtgtatcggcggcggtcagggcgttgcgctggcggtggagcgcgcataatacgatctcgcgccgtcttcggcgcgatgtccaacttcctcgccgatcttcttttcttcgtttttctctccgattttctctcttcgcgcggtctactatgtgaccatcagcaaaacggaactctgttttatttttatgatggggatgccccaggagttcttcttagcctcagaaccttgcctgtggggaaagtcgcggtagtgaccggctgcgacaccggtttaggccagggcatggcggttgggctggcggaagcgggctgcgatatcgtcggtattaatatcgttgagccgacggaaaccatcgagcgcgttaccgcgctggggcgtcgttttttgagcctcaccgctgacctgcggcagatagatggtattccgcagttgcttgagcgcgcggtggcggaatttggccacatcgatattctggtcaataacgcggggctaatccgccgtcaggatgctatcgaattcagcgagaaggactgggatgacgtgatgaacctgaacatcaaaagcgtctttttcatgtctcaggccgcggcgaagcacttcatcgctcagggtaacggcggcaagatcatcaatattgcctccatgctgtcgttccagggcgggatccgcgtgccgtcctacaccgcctcgaaaagtggcgtcatgggcgtaactcgcctgctggccaatgaatgggcaaagcataatatcaatgttaacgccattgcccccggctacatggcaaccaacaatacccagcagttacgcgccgatgaacagcgcagcgcggaaattctcgaccgtattccggccggccgctggggcctgccgagcgatttaatggggccggtggtgtttctcgcctccagcgcatccgattacatcaacggctacaccgtggcggtagatggcggttggctggcgcgctaa

SEQ ID NO: 29377 - DNA, 540 bp, Glycine max
  Peptide Sequence Number=SeqID_146155
atgaaggaacctatttatgtacattgcgctgtcaccagcgccaacgcatctcctccgccgtcaatgtcattggcaaaggaacctcacaaatacttcgaccacgtcatcatcaccgttcgcactggtgatggcggccacggcgcggttctgaatcagcagcagcaacaggagcaaggaaaaatgaagttgaagaaagggaaaggctccttgaagagggacttcgacggatccctcattctccccataggtggccacggaggtgacgtcgtgctctatgccgacgagtccaaagacacgctgctggagtttcacaacacaggccgctaccacaccaaacgcagtggcaacgttgatgccatgggcattttaactttgatgcttcgcgatggacttactgcaccaacgctatgtattgttgttcccgtaggtacagttgtgaaaagcaaacgagggaagatgttggctgatctagcgcaaccttgggatgaagttcttgttgcaaggggaggacaagaagaggtactatacatacatcactaa

SEQ ID NO: 29378 - DNA, 183 bp, Glycine max
  Peptide Sequence Number=SeqID_146156
atggggtcgtttttgaacacccaaaccgccagtaccactggcgagtttggtctccgtgaaggaatcgctccttgcaatggcgatatgcacctgcaagctgaacaaatcgccagtgtgactggtgatatacgtgccagtgggaatcgccagtcaaacgggcgagttccaggtgctgtttcgtag

SEQ ID NO: 29379 - DNA, 111 bp, Glycine max
  Peptide Sequence Number=SeqID_146157
atggcagtttcagcaatcagcactatgaagagaagtccgaatccgaaaggagaagaggtaaatgtggctgtggaggctgagatatatcctacaggaacgacggtgagataa

SEQ ID NO: 29380 - DNA, 210 bp, Glycine max
  Peptide Sequence Number=SeqID_146158
atgtgctcaaaagaaacacagagggtgacaacagaactcacggtgactcatgacagcgataacgtgacgatggcgaacaccaacaacaagcacacacgaattgatgaagatgaaccaccgattaatgaagatcaaacacagattgaagagaagaagatgagaggagaaatacaaagaaatggtgttggatgctggaagaaaatcccttag

SEQ ID NO: 29381 - DNA, 1404 bp, Glycine max
  Peptide Sequence Number=SeqID_146159
atgccggggttaacgtgcaacgcttgcaacaccgaattcaaagatgacacagagcaaaagctccattacaaatccgagtggcatcgatacaatctcaagcgcaagaatagaaacaactgcaaatcaattgtgttaagaacatttcatagagtaattgttgaagtgtcttataatattaggacatgggaggaagatgttgttaccaaagaggcatatcaagtggctggggttcctggggtgaccgaagcgctatttctggctagacaatctgtgcttgctcaagagaaaaataaactgggtgaaacccccatgctctacacctgtggtctttgtggaaaggattataaaagttctaaggctcatgctgagcaccttaaatcacgtggtcatatgatgcgggcctctgaaggaactagtcacgcagatgagaaggcaatagttaagcctcttccacaacgtgttgtgaataggcctcctcctaggagagaggtagataactctgaaaatgaggaaagtgaagatgaatgggaggaggttgatcctgaagaggatttggttgacggtgctgcaaagtccttgactgatttgaatgtgaatgagcatggtgaaaatgttgatatggaggtagatgatgattttgaggagttagacccctcttgttgctttatgtgtgatcaagagcacaaaacaatagaaaactgcatggttcacatgcacaagcatcatgggttcttcattccagatgttgagtatttgaaggatccaaaaggcctcctcacctatcttggccttaaggtcaaaagggactacatgtgtctgtactgcaatgatcgatgttatccattcagcagcttggaagcagtcaggaaacatatggaggcaaaaagtcactgtaaagtgcattatggtgatggtgttgatgacgaggaggtagaattagaagaattctatgattatagcagcagctatgtggatgatcaaggcaagcagcttgttgcatcttgtgatgcatctaacaatgtagaacttgttggtgggtccgagctcataatcagcaggaaatctggtgatagatcatcaaccaaaacacttggttcccgtgaatttttgcgttattatcgtcagaaacctcggccatcactagcaaatatggctatcactgctgcgttggcttcaaggtacaggagcatgggcttgaccactatccaatcaagggagaagattgtgaggatgaaagtgctgaaggaaatgaataggtcaggtgtggacaatatgcgtaccaagatggcgatgaagagtaatgtcatcaggaacctgccaaagaatgggtatcatcaacatctggatgataaggacacctttctgattggtgctttttttggggggagtgcggcatggagttga

SEQ ID NO: 29382 - DNA, 168 bp, Glycine max
  Peptide Sequence Number=SeqID_146160
atgggaagaagcatgttgcacgtccacaccgacatgaccggagaagcatggacggcaagacacgtgggagaggcaacaagggaattaagtgaaattagatggggagttagaaatcccccaatcagggagtcacatgtgactggggcaatagggaaaaaaagtatttaa

SEQ ID NO: 29383 - DNA, 507 bp, Glycine max
  Peptide Sequence Number=SeqID_146161
atgcataaggcattgcgatcaaatgctccacttccatatcctcatttgatcaccttgttcttacaacattttaatgtccctcttaactctgaaccttttgttaaagtcaagagatctttctctatcggtgtgaatgtggtctcttcctttggataccgcaaaaagagagatggttcttgggtgaagaaagatgctccagtacaggccgctgaagaccgttctccatcaccacctcttcagagagatgattcttcatctcttatgcacaacattcttgacaggttggatggactccacaccttcgtcagtgaacgctttgactcattggacaaccgtattgatgccatggatgcacggtttgcaagaatggatacacgcatcaccaagcttgaggaggatattgtcatcatcaaaaagggggagattgtggaagcaatgtcttccaagattattttgataatgccaaagaatcaagagtcgagcaagttccatagaatcaagatttag

SEQ ID NO: 29384 - DNA, 213 bp, Glycine max
  Peptide Sequence Number=SeqID_146162
atgattgatcctccatctcccatcagacgacacatgaaatggaagatgacccgcaccaagaaaactgggcaaatgatgtctcagacagcaaaggaaattgctaacaagattgaccagacctcacagggttcctttgtcacccatggacgtcaagatgtactaactgctgtcattgggcaaccagaacaccctggtcatgtgcgtgctgctaga

SEQ ID NO: 29385 - DNA, 312 bp, Glycine max
  Peptide Sequence Number=SeqID_146163
atgtataaatgctatgttagaagatttgatgttcctagagggaaatgtggttggattcccaaagatttaattgtagaaattaaccctattggacctaacctcaattgggtgtgtctaaaagaaaaagattcactatggtacatggatagtggctactctaggcacatgacaggtgacaagtctagacttactgactttgtgttaaaggaaggaggatacgccacttttggagacaacaataagaaaagaattatgggagaaggaaacattggaaatcagcacaagactcataaaaaatgttttgtatgttga
